United States Patent 9,487,797 (GENOMIC PLANT SEQUENCES AND USES THEREOF) - sequence listing, part 39

SEQ ID NO: 62713 - DNA, 21252 bp, Oryza sativa
taaaacaaattgacacgataaatcaatatatgttataccatttcataaatatataaattaaaatttggcatctataagttgagagagggggttgtcttaaaaaacgaagagagtggactatggcatcgatgatgtctggcgatgcgtgatggcaatgaacagcggcgcgagctcctttgacgtaaagtccgagggacgtgggtccctgatgataggcgaggcccactttcataggcccacacgtcaatagccatgtccctctgactttacgtgaagcctcgtccgtgaacagcgggatggacggagtggcatataatggaagaactcgcattctcgatgataaattccccaaggcatataaattaggagaaaacagacgatatgccactctctaagatgggttcggataaaatgccactcaatataatgcaccagataaaatgccactcaatacattgtttaccggatgaaatgccactttggagacttttatgcccaaaatgtccgtgtagcacaggatgactcgccaggcggcggtggcggtggcggcgacggaccgcggggacgacagggggaggaggacagggtggcgaggacgacagggcggaggaagaggccacgctgatggagccttagacggacctgtcgacggctgtcgtccccgtcgccgcccgaccactgttgcttgcgacgccgtcctcctcccgcataaactttttctcctcctcccccacgtcgcctcctcgtcctcccccggtggcgagtgcgcgtgggtgccactgccgccgccgtcctccttccccacatcagcgccctcgccctatggagccggcgctgtcctcccctcgatggcccctccccgatggagccggcgctgtccttcccccttcagcggggccctcctcctccccttcttgctgcccacccccgcgcgctcgctgcccaccggcgacgagcacggccgccgtcgtttctctctccctttctctctctccacggtgagggcattttggtctcaaaactgctcaaagtggtaaagtatactgagtggcattttatcctttgcaatctaatgggtgacattttttcctttgcaatattgtggagtgacattttatattaggcagtaaatttcgaaaggattgtaaatttggatggtacataattaattttttcgttttgatggcaaaatcaatagaatgaaatttacgcatgtatcaattcgcggcaggcagtcataattggagggagaaattaactgggaagaatatatcaataattgattctacatatccacataatcactaattaactgggaatttaaagccatgcaaaatttgtgcatatataactcacccgcaagggagttcagaaaaccatccaattcaacaaatcatcttacataggttgatcgaagatcaaatccaccagtatacgtaggaaactgaaaatgtcctccattaatggcgtcagtatcctcttcctcctcgccgtcctccttccggcgtctcagctcgccgccggcatcgactcggccctgtacggtgcatgcaagaccgtcgccggcaacagcggggtggtcagcgtcacgttctgcatctacgcactcagctccgacaaccggagccacgacgccgccggcttcaaggactacgccgtcgtcaccgtcgacctcatcacggccaacgcgacgagcaccaagtccaagatagacggcatcctccagaacggcggcggcggcggcgccggcgacgccaagaggcggtgcctccagtcgtgccaggcggcgtacgccggcgtgctgcgagctcagcctggcatcgtcgccgacgtgcagggcggccggttgccggaggcgatttcagcgctggagaagtcggccagcggtgcaggaatgcgagaatggtttcggcaagagcaacgtgacgtcaccggtcaccgcggatgacgacgactccttcggccttgccaagcctgccgctgagtttcttcgttgggaattgaaatcctgaaagagagatcgattatctaatctgttttttctcaacataattagctatttatttccctctatggccatatctccttctcaaataaacaaagataaagggaggttgaaatggatttgcaatttagagaaaattagcatgcacgcaagtggagtatcttaaacatgttttttttattttacatgctgctaatggtatttatgtattccctaatttatcttctctaatgtttccacaattagaagacatatggatcctacaggcctactcctagtatgcctagaataggagacatagtaggcctatgcctagaataggagacatagtaatttacttttgactactgtctcggttccttttcgcgctcgatttttcagcatatccggatctatcgtgcttgacactgtatttctgattttttttaccgtgattgattagtaagtttaattaaactttttaacagaaggtttaattttaaattgaaaattttgagtaaattttaattcaaatttaaaaacttttaactcatgaaaactgtaaagtcaaattttaagaaacttcacgaattttgaaaactttcaagtcaaatattgaaagctattaactcgaatttttaaaaaattttaactcaaatttgaaaaattttaactcgagtttgaaaactttcaactcgaatattaaaaactttcaactcaaattttgaaaactttcaactcaaattttgaaaactttcaaaccaaatttaaaactttcaattaaaaattttcaactcaaattttaaaaactttcagctacaaatttaaaattttaactaaattatttatgtatttctttaacataatggtataagcactgtcatcagagatgagcactacagtgagaaagtttattaacgaataggagcaaactcaaggtcattgatatgctttagaagagagtcgaggtgctccaaagtgaaacaacagcaagattatatagtccaaaatgaagacattggtttaagggtggtccaaagcgaaacatcctaataaaaggtggtctaaagtgaaattactcaacaacaaattaaactctaaatagtttacgtatattcatagttaaatttgtttgtttttgttacaacttatggaagccaaattataacttgtagtttgtggagtgatatattacatgttaaaccatattgtcaaattttttttgaaacatttttataaccatttagttgacatgcaataaacgagtggatgtctacacgggtgattacaatccctctctgttctgccaggcttgctgattctgtcagcaaaattaaaaaagaggtggttcatactaaaatcaaatttgttgtacatactaaagttcaaataaagccctcactataaaaaaaaaagaagttgcataaatattaagacattacatcattcccagtcccaatataccaccctgcaacttgtgttctaaaacatagccagatcaaatgaggtcaatgagaatggaaggagtaagaactgcatctcttgcccagcattgggtaactcccttgtaactggcacaacctgcaacaatctagtatgttagacaaactcgcgatgcctgataatttcttgtgttccactgaaattaattcactgcatacaactcctttagaaagatgatgaaataattccagacacgaccaaataaacaggttccgtaaaagcttacgaagaaaactaaaaggaagaacagagaagatagatctacaaagggtatatgcttatgtaccacacaccactactttgagtactacaaataggagacatacagctcccacagttttacttcaaaaataagggcatatgtcctaacagactataatgttgtaatggaaaagctgtcctctgctaaatttcagtgcataattatgaaacaaatagtgatcaaataacgactatcttaccttgtttggttcactaaatgaattctcatccagtaagttgctggatgtgagaacagtcacagttgattttgccgcatttacaccagcttgaagtccacttgaagatattgtaaggttcacagcacttggcccaaagtttactatctgcagatagaatcagtatgttctaatatatatgagcatattactccagcagtagaacaaataagacagatgttacgcaagtaaccggtgcttcaatcaattttatattgttgaaactacattattctaaacactaaggcgcttgtcgatcaatgatttcaagcaatggtatacaagtttggagaaactggaatggttggtttacctttaccctcagaaagatatcctcattgtcctgccaggtgattgcagatgctgccagtaaatcaaagtagctggagctgatagtgactggatgaatcacagaaccacttgattcacggaaatatgtttgcatccaataactaggagttccatactgttgccaggagttgaagacaattgcatctgggttccagctggtttttagatttacacattaattgtcaaagagagaacagatgctagaatcctaaacaaagtaaagtactaaaccatgaatactaacgtgcgatcattttcattcacgaagagtggtgcatagcttgccatctgaatgacatcgctgcaaagaagcaagcaaagtccaattcagtgtaaatatttgtttttttaataaagcttcctcttccccgcaaaaagaaatatttacaaattagaaatttatacatactagttttcctataatttctgaaatagttattttccttctgtggtgaagtagaagaatgagataataattgtagagacaaattaaccatttgtctaggaatcccttcaaagatcttttatgttcatgcataatctggagacaacattatatgcatgattttatatttcctctgtgtaaacgagagggattggcgaaataagatgaataattattgtattaagcttcaagggctgtttatatagcatgcatggcttggaggttaagaaactatcttcgagataagaaaagcctcttagggataagtcagtatcgggatgacaaatactaaacttccaaatacagagatatgccaaattgccaatatactctaatgctctaaacccaagataaaggagagagtatcctgagaggaactaaagggatcacctgtttttctctaaaccagtgaggaaagcagcttctgccaacgatgcaaggaggcttccattgccagcatcaccccctttgtcattattaacagcatactcgcttacaaatacctggagtgaaacaatagcataatcaatggttattttgactgtctgagaaaacagtaagacataattttaaaacagggagaatgatacaaccaaattagcttcggttagtattttacatggaagtcatacagatcagcaggatgatcaagtggcctagacgagccatcacagttcgaaattatttgaatgtcaggataagcctctcgtatagcattgtagaacttggggtaattttctgttcagcataattatatggttatatgatatcacaggaaaattaggatattggtgatagcagtagagcattgaagtgtactgaaacaacattaattataattgatagtcaatttagctttgttcacatgcaactagtaaagtgtgtctgtttcaaaacataacaacaggctagacaattaacctattttcatttgtttttcctagaatacttccattatagtactcagagtcaaaagagttgcaggtaaatgaaatagcgcttttgttgcagatcaatagagaacagaataatgaattttggtaattatcacagcattgacatgaaggaccataaacatactattttgttttagtcaaaatttaccttggtatgtcggcttgaatatttcacaatcttcattcccgagtgcaacatacttcagtgggaatggttcagggtgtcccatcgcggctctaacagagccccatgttgattctttactccctcttgcaaactcaagactgtctattgcatcctgtagcaagaaaatcaaagtatttcgaaataataaacatgggatgacaataaatgcaatgccttatgtaatattcacaagttataactgttttctgttacatcatgagaagccaatcttcatctcaaccatacttcaaaaaattgtagggtatcgaaaacatacctttacaaaaggtgtaagcatagttccattaactacatcactgtgactcatccctaaatcacaagataaaaactccgagcagttcattggtatgcgaggagaaaagattaaaaaaaaagtaaaacaagacaaagtagatgcagaatatttaccaatgttgagcacccgactggagcagcacccaagtcttcagcaagatttatgaagacatgaacagttcgaagtaaacaaatgatcagatatgatgagaccaagagagaactcatttgacattaatcaatccatacctggagaaagtcataatacccaaggccatcatcggtccagtagtgccaaacatctccatagtgcccaggtctctcttcccatggaccaatagtttccttccacctgaacgcattttttaaccaattgccttcaacaaagcaaccccctgccaaatgtaatgccagcgattaaattacagggcaaccaaaattgattaccagttggaaaacaatcataataccaggaaaccgtagaaaccgtggttttaagtccaaaagcatgtacatgagttcctggcgaaaaccatggccctgcatacatggaagaaaaatgcctatcaacaactcctgtgaactaatagtaagcatggctagattaaggaacaataagttgatctcacatctctacaggactaccgattacagataagttaattttttttttttgtcagatagaaatgagaacaactgaccatttttatgatgacttttttcgaatattcttgaaaaatgtcaaatagcatacatgatttgaagagggtgcccattgaacctggcatgcttatactagtgactaaatctttggggtcagtacatgaatattattctccattcttcataagatgatagcagattccggatcaagctatgatgacaatagcaataagaagataaaaggcaatgcaccttgtatgtttctgaaggcatgagtgacacctgatcaagccatatcactccccttctcctagttgtcagttcaagtcttgaagttctgcatgtcccatgagctagtaactgcagctctatctttgtccaatttaacaaatcagtttctctgaaaaatttgatgtacaatcctatgagttagctagcgaacaagagagagagagagagagagagagagagagcgagaaattgagaaagctttttcttaatctcagtgctaaggaaaaaaaatatataccgaacaaaatttgatgccagattttgcgatccatttgagcatgtgagtgaagccgtcaactccaccgattctaatgatctgatatgcatgactagattatatgtcttcctttcttctacattctgaaaattgaaatgatcataatcacattaaaatatcagaaggtaaaagtgaaaatggtttgacgaaaagctataacactgattacactttccaagcaagtgatgcacggcaataagatagaaaaccagcattatgcgatcaatgcaaattgaaagcaaacaaaaaataggttagcttagttatctgttagcttcagtattttgataagaataataactttgctataattaccttcggtggcagcaccgtatactttaaactatcatcagaaaaaagattctttcgattacaagatctattttgcatattcatatgggaatgagctgctatatgctgagagagaacttataccatgccccagaatcctggattgtatattccaacaccaccagctggacaatcgtcacagacaacctctatccttacagcaaccggattttgactgaaacaggatgagcgatcagttgtgacgtgcacagaggattcatctccaatgatggaccatgggtcaatgtttgatgtgttggctccagcttcaaaacctaaagcaagaaattagacaaaagttcagttaaagttaaacttcaaatattattatttatttatttatttattgagggggaaaatgttttcttattcaacattgctatacatgaggtgattgatttctccccaaatattcttggcagtaagatcacaattcacaaatccaaccatccatgttgcttcttcaacctccagccttctcgcacacagacacacaccacccccaaccaaaacgaggtcgccggtgaatctcgagcatccctgcgccgatgagcctcctcctcctcctcctccttttggctttcctccccggcgcgacagagggcgaatggattagggtattgtgttggggtggggccgtggagtggatctggcggggtagggggtttgtggagggaggagcagttcatcggggctgcgtattcagggaggggaggccttgggcggtagggcgaggcggtggggtggcgccgccggtgcggtgggtgaggaggcggcggatccggccgcgagagacgccggagatggtgcaggtgcaggtgcaggtgcggggagggaggaggcaggagggaatcgttcacaagagatgaaaagaaagaagagaggagagagagagagagagagagagagagagcgtagccatgagctggaggttgaagacgatctatcaaccgttggatgggcatccaacggctgacagcactccactgctatctcctcctctaatttaagactgaattgtactttgtgcgtaaacgtttcactttgcatcaccctatacacaattttttttactttggactagataattttatctttattacataatggacaccctaactctctttgttagccatgtctatcatttccttcggcaaagatatagcatgcatataagtatgaaagttcatcagcatgtcgttaacgatttgctcaaaatcattgaagtgctgaagatgtggttttgagtaatccattatacaacaaagataaagttatttaaaatgaaaaaattgaacataggatgatccaaaaaccaaaatgaaattttaaaaataaaacatgatccaaataaaattaactctttaatttaatgctcaacttcacaagagaagagctctagaaaaacaaaaaggagaagagagacaaatcgtgtctatgagctggaggttgaagacgatcaatcagcctggatgggcatccaacggctgataccactccactgctcttctttataatttaatggtcaacttcagctcggaagccaaataaaataggagtagtataatgtggtgtacgtgtacctctgttactgacgagttcagcccaaaggccaccacttccagcgtggttaatctcctgcacaaataataataatacagatttcgataaggaaaaaagcaaagcatccgcaggagaataaatggaaaaagaagaaagaaatgaaaagaaacgagacgtagctagctagctagtcacctcgaagaacagaccgaacagagtgtccggcattcttcgagcgacagagtaatcgacatggagagacgccgtctccaacgtctcggcttcgcatctgctgccgccgccgacgaagaaaagaacgaggaagacgacgacgacgacaatggcttgccgggacagcatgctcctcgtcgccggcggccacactctcatcattctctctgcgaccacaatgatcaatggattgggtacgttgttacttgcgagagggaggcttgattattcgaggttgctccatatctactgctggaaattgctctagttagatagagtaagtcacttgctaaaattgccaacaagttagttcattcacatatatgggttccagtaaaaatgtacagccagagcccatattttcttcatttttcctcttctttatctgctcatcttgattcattccacagaaattcctctgccaagggaggcttgagttagtgtgacatgaactacactacttgagttacacgaaacgatccaaaatgattatttgaggttgcacgatctactgctggtaaatgctttagttagagagagtcagtcacttgctaaaattgccaacaagttactagttcacttcacaagttcacatgggttccagccaaaatgtacagccagcccatgcatattttcttcctttttcctcttctttatcttctcatcttgattcattcgacagaaacatatcgaggaagacgaatgagcacaagcatttctattgctaaccccgtgcacgttgcagctgcacatctctgccaccagcaccactttgtttggaccggcccagatcaagaacgaatgaggagcaagtgcatatgctcctgcatcgaagctgtggcttgagatggccaaaaccaccaattataccacacattgacttgtgcattacatccagagataaaagtagaaaacagttgcttaccttatccggggttactgaaacagttctcatcaatgcaaaagacacaaagtttccctctccaatcttttctcccatcatgattttatcaaccaccagttgaatttgttctctactcagcttcccacaatgtaaatgactagtcagtatacctatatggggaacatgccatatttacagtgaaacataaccacaaagaatcaacagccatcctaatatggattggactccatttggatctgctcaatcctaaattcaaattctcagtccataatctgagccttaattttctcaagtttaaatgccaacttcagttcaagttcaaatccttaatcaaattctgatattctctacaaatctgttatccttggaccaaattattttctctttcccaggccaaagagctcatatttgttatccttggaacaaagcaacacggtggcaatgcgccatctagtctcatccgatataaatatggagaaagcaaaaaaaaaagaaaagaaaagaaaagaaacgaaaagaaggaagtaagccaggagtgaattttattcatcattccctgtgtattacactatacagtagtgcttcaagatacatgcacatatatggacagcattctggtattcgcatatcacatctcgtgtatttcttgtgtttctgtcgctaaccttgtgttgctgcttcacatctctgccacgagtttggactgggcaagcgcaagatcgaatgaggagaaagagtgaggagcaagcgtgacttgcatctgctctgctgcattggaaagctggcttttgacaggaacaacctgcattggttgtcatgagcaaagctttggcttcagatgaccaaaaccacaaactctactagacattgatatgtgcattacatccagtaagaagtcagaaatgtttgcttaccttattcgggttactaaaagagttctcatccatcacattactggatgtgagaacagtggcagttgatcccagtgcattaacacgggcctgaagcccagttgcagagatcgtgaggctcactggatcagacccaaagtttataatctgcacaggagatttcaagatcaattcatgaggtacgcaatctcctacagatgtagagtaggtttagaacaaaatttcttacctttactcttaagaagctattttcagaatcctgccaagtaattgcagatgctgccagagaaccagagtagctggaagtgattgtaactggatgaaacatagcaccgctagattcaccgaaaagagtctgcatccagtaactaggagttccatattgttgccaggagttaaatacaatggcgtctgggttccacctgattgtttgattgaagcattattacagtacttgttaaataaacaaaaacacaaataaagaaaccatggagtcatcaaaactaacgtttgatcattgttgttcacgaagagtggtgcataacttgccatctgaacaacatcactgcaaagaaccaacaagaagttacaatgaatatcttgttgcatttgttagtagatcttaataaagccctacccagaggaaagctcaaatgtgatctgtcacaagacccagaaagaaaagattgtttcaaggaaagatcacctattcttctccagtccagtaaggaaagctgcctctgccaatgaagcaagtagacttcctctacctgcatcacttctccaaacagcatattcactgacaaaagcctgcaaccaaaacatatatgaagaaagatagaagtgaataagcaagagatgcaatgaggttccaagattatccaaaacatgtaaacatcatcacacatgacatagatgaactgtggacattactgaattattgttgagaaatagatgaccaaggtcatcctacaaatatacgagagatgtcatgaaatcctggattattaatgtaaaatattagatgaagatgggagatttcacagtgctattctacaagcatatccacaaatgaaaaaaggtccacgacaatggaagtccgggcatacaacgtaccttgggcccattacgagatgatctatcaaatgtattcttcattgaaaacaaagtcttagaatcagtatagacctagaaaaaaggaattgtttcaatttaataaatgggaaaagccttgacatttgtgacaaagaatgagaagtgctggagaacacaactcaagaggatgagtagtttacatggaaatcatataaatcagcaggatggtcaagtggacttgatgaagcatcacaatttgaaatcatttgaatgtctggataggcctcccttatagcattataaaacttgaggtaattacctgtataatggataagagaatatcatgcatgtacctaaaatgagaattcaacagttgttctccacacaattcaagtcaaacatgtgccttatcattggagattatgatcaaatataaatgatttacatcccaaattttctaaaaatgaaaataatcacattttagtatgtttgctaccaggaattgtttttatgtgttactaatcctagtttatttgcaacaacaaaaaaatagaacatatattactacaagtaccattggcttggcgaagtacagcagaggaaaaggagaacatagggcataaaaaaagtaatattatatgcagattaaaatagtgaaaacaaatgtctccctgtaaggttttgctatggagatttatgtgactaaattaatgaaccacttctaaggaaacaggtacaactgcataaagaagttgcggcctttatttacagagtgagttgagtgactaccttcataaaaaaaattacaggattagcatggtccatgtacatatcttttattcgatcatacaccttaatttattccagacaaggctcttcaatttatgcagttatatggtgaagtgataaaataagaaagtaattgaggaatgcaccgcggtaaaattttttcccacaatcttcatttccaattgcgacgtatttgacagggaatggttcggggtgccccattgcagctctaacagaaccccatgttgaatctgcattcccccttgcaaattctagactgtccaatacgtcctgtagagagacaacaagagatgttcccaaacaaaaaactggtgttacgacaagtaacatagcttcaattcaagaaaagatatttagtattttcttggtaggtacattgttatctgtaagtataccagaatgcaaattcaggttaaacatcatcactccttgtgaacattgtgaattaatttttttgaaaagaactttgagaactaatagagtaaaagaacaagcccaaaaccatctccttttttacacaaataatcagctctatttcaatagtgagaaaataaggcaagagttttagcatcattcaatgagacacatcatatgcagttacattcttaggatctttaatatttagatatgcaaagataaaagatggaacactactatgatggcagtaaagatagtatcagttttctcacatgccatatccatggaagtgcagccatagctaggacgttacaggtgaattctaaagtggaaactatttaacaaatcaaggtgcatctgacctgacagaaaataaaatagagagttcagaacatacttttacaaaaggagcaatcgcagcagtatcaacttcatcattatggctgattcctgatatttaaagagtttagtgtcgattcaggaggtcagctgtggtgatcaagatataaaaaatatggcaattattaccattgttgaacacccagattggggcagcacccagatcctcagaaagctttgatgtggagttcaaagttttcattagaaaaatatagaactcaaaggcaatatatgattaggacgtgataagaaaatgaaaggcaggaataatgtcaagtaaactagtacctggagaaattcataatatccaaggccatcatcagtccagtaatgccaaacatccccaaagtgtccaggcctctcttcccatggaccaatagattccctccacctgaatgcgttccttaaccattccccctccacaaagcaacctcctacaattgtttgaatgtaaatcaagtcaattatcccagacatgtctggcatatatgtacatatcaagaacttgattttcaatgggaaaatatagctcataccagggaatctcaagaatcgtggttttaagtccaacatcatagatataagttctgtgcgaaaaccatgtccctgtatgtgtaaaagaaatgttggaagcacttgaaaaagcccatgaagacttaaagtgttatcatacactatacatagatagcataaaaagcccatggcatcgttttccttttccagtaatgaagtttgacaacaaaatataatgtaccttgtaagtgtctgcaggcatgagcgatacttgatcaaaccatacaactcccttcttgttagttgttatttgaagccttgaggttctatttgttccttgagcaaccaacttctgctccagttttgtccaattcgatgcaccagaaaccctgcaacaatataatcctttcaaaactaatgggaatgggcaaacatccttgttctcctgtcccagtattgagagaaaaggcactaacggtatggtagttgaagccaaattttgcgacccatcagaacttgttaaggaaactgtcaactccacagtttctggtgatttaacatacatcactaaattgtagatctttccatcttctatgttctgcgggttgatatgacaattacgggtgatcagagtattggaaaagaagcattgcaaaagttaggaaagcaaatgtttactaacacaagtgcacaaaagagctatcactacatgaaaaatcgaaacagaacatgtggaggtccatgatttacttgttaattttatgagaaaaggaaagaaaatggcagcaatactgtgaggaaaacaaactaaagaacaacgatatataagcccataccatgccccagaaccctgggttataaatgccaacaccaccagctgggcaattatcacagagaacctccatccttagagcaacagtattccgactaaaacatgacgttcgatcagtcgccacaaatatggaagagtcatcaccaattatggaccatggatcaatgtttgatggggtatgagggcctccagcttcaaaacctgtgcataaaactcataagttggttatactaaaccctaaatgtcaatataacttcaaaaaaagggcatattattttccatcgagtttatgctcttaatcaaagttttgtgtgtcaagtttacagtactaaaaagataactatgtttaaagtttatggggaaaacataatttagttaatcagatagtatggagaattttcgattaaagacaaaataacaaaaggatttttttttcgtaagccatgtttgtgttccagcagactgcagaagaatttattcatgtccattcagaagcaaattatgttttatctggaagatcgatcaaaataagtgcatatattacaacaaaaataactgaagtacctctgttactaacaagttcagcccatattccaccagcccctgcatggttgatttcctacaatattagccaagatcattatcatcaggacatggtggaacatgtataatctacctggattattctgggcatgctaatgcacttgagcatcctaacaaaaaagtgccagaggaaaggatatagtgatacagtgcaattgtgaaaaacagaattactgtatatgtctcacggcttacctcaaaaaatattccaaatagtgtgtcagggatctgtcgagcaagttgcggtgaggcatcaaccttgaggaccgcagtctgggtcgcatgtaagtgtaactctgaagctatacacttgcagccgagggagaacagaagcaagaagaagaaaatggtactcatgaaggattctctggaagccatacttggagctgtaaacactagtgcaggccgtgtgtctgttgaacaaataaagccagaagatgatacagtatgagaagtcaactaaggaagataggcatcggacaagtagatgctattactagatggcatgaaaacagcgataccattagaagaaacgaaaggcaaacatagacaagacagtgatatgtccaaaaccatgcttacaagataaccaaatcatttgctttgtttagaaaatcacaaaagcgttgacgccagacaatttggcaaggattaggaaagctgaggtttcaaatgatctcatcatcagggtaaacaaacacaaaaaccaatcaattgccttctactcggtcatttcatcgaactggtcgtttgcataaccaaagaaacaaaattggaaacaaaagaagtcaagcaggggggagcagtaaacgatttcaccaaaatcgctcaccataaggccaccatccaagacctcagacctcaacaaggaaggaaggaagagaagctgggcgccggcgaggcgttggggggcggacagacacagaccgaggctttggtgttaagtagaggagaggaggagagagagacagtggctttgaagggaagtgtacctcgacctcgtggggaggcacgcaacgcaagcagaggaggtcgcgcggccgcctgatggtgatcggatgccggaggcgcgcggcggcacggacgggggagttgcttgccgcggcggggttcggcgcggcggttgggtgcggcccgcggggcccactgacatacacgtgggattgattatccgtagctacagtatttaatcatcgaatggaatggatcatctgtctatggctctgagacatctctgtgcccccacactgcctggctctatctaggcttagggtgtgtttagtcgcgaaaagaaaatttttaggtgtcacgtttgacgtttgactaaatatcgaaactcgaaaagggttttcagacacgaatgaaagaactaatttcataactcacctagaaaccacgagacgagtttattaagcctaattaatccgtcattagtacatatgggttaatgactcaaaaatttgtctcgcgatttccatacaaacagtacaattagttttttaatttatatttaatgctcctttccaaagattcgatgtgatatttttgaaagaaaaaattgggaactaaacgaggccctaatctatagcatgattggtgtctaaaataaaacaaaaatatctcaacagagtagagcctggattcaaatgcgatatttgtcgtggtccttatcgagctggctgtattcaaccataattggccaaagattaaaaaaaatttgaaactttttaacaaaatttatctgactttcatcggtttttggcaataacgttaacgacgagagttatcaatggaaacgctagggagggatttcagctatcgatcacattttgaaatcataaacagagcacaccaatacaaaagaggatcggttcttcatggttccttgctatcgcaagggatgaggcagttgtgcctccgtcaaagtttgtattagtacttcctcgcaaaaaaaaaaactgtattagtactaccaaagtataaaaaaagaaaaaaaaatcctctaatcaattgatcatttcaacaagactataaaattacaagtagctctctcctaggatttggtcagcagtgtggcagtgaagattgtcatgttcattctacatagttctaggtactaggtaatagcgcatgttctggcatacagaaagaaataaaaaaaaagagtacaatactgttatatttagacattttattaagtttattttacccctcaactattgcacttgcataaaatacccatttaactctaatatgaagtacaaacattgctgttattaatagggtagttcggtaatttaccataccttcatgttttgtctataaagaaaatgctagaatgacgaggagtagtgtgttttgttttacaattccgcggggccgtacctaataatctgagtcccctatacgaatcacaaattggtatttagaaaatgccaagaaacaaaagaataaattagtggtggtattttacctaagtcagaagaattttttttaaagaaataaattttagaaaaagaattgtggtgtgatgtagtgattttttgttatgtggaaaaaatagaatttgtaatgcccgaaacatactccctccgttcatattcaaacccagaattgggtttttttgagacgaagggagtatgttcgtatcattatcaccctctttaaggtggccataattagtagtactacttaccaaagctgaagaaacaaactcattctagttaaatctattatattattaaaagaatagaaaaaggagcttccacgttcgttctcatggcctagaaattctcacattaatcgaagaaaaagaaaaggcagagtccatatagaaatacaatttaaaaatagctgaaattcggaattaaaaataaggaatattagaagtagagaatagagtccatatagaaatacaattaggaaataactgaaattccgaattaaaaataaggaatattagaagtagagtatagaatccatatggaaatacaattagggaataaacataataaaattaaaagtagagtttagagtccgtataaaaatacaatttacaaataactaaaattcgaaattaagaaaaacatgggaagaagagtttaaagtcaatatagaaatacaatttagaagtaactgaaatttgaaattaaaaattaaagaatattgaaagatgagtttagagtccacatagaaatacaattagaaataataaaaaatcagaaataaaaataaataatattagaagaagagcatagagtttatatagaaatacaatttacagaaaattcggaattaaaaaaaaagaaatattaaaagatgagtctagggtccatatatgaatatatataatttacaaataactaaaatttgatattaaaaataattaataactaacacgtatataaaatacaatatgaatattacacattagtagttttgtaaagttattgcaaaatttaaaattatgttgttattttaatatatttgaataatataatgagaaaacatatatgttattatataagagaaaatataatgatgctagccgcgcaatctgcgcgggccaccatgctagttaataaaaagtaagagtacatttttttcaaaaaagaaaaaaagcgagtgaaagatctttaaacatattaaaatgcattggcataaattaagatatgaaaaaaaaatttaggacctctaattagtcatccacttcgtaggtagtccctcatcgacaacgttgcaattctgatcattcatggctagaatgaaattgattaaagaaaagtggtgattagttaagaacctagtaagatgtagccatgcaggacagcaagtgaaacaaatttcccagattatttgccgtcaaattgaggaactatattgaccgggcatgcatgaaaatactcgctcatgcgtgatgattgatggaatattatggcgttgctttgcttgggttgggtctaaacgtgaaggaacatcgatcgatcatacaagcgcgatagcgatgtgactcatttaccactgatctgacctgattctgatcgagagaaatcactgaaatgcatgcgcatgcgtgcactgcaacacaaacatattgattcatccatggatcgatcgacagatatatctagcttgagtttgaatgttgcatatataataatactagcagctcatttatgatttctcgatatatatatatatatatctgatgcgctcttgcgtgtccgtttgcactcgagatattgaagaagaagaagttgcattgcttgcaagatatatatgcgacagtaatcgtcacatctgtcctggagaatataatgcacaagtgttcattgcagttccactactcttctatcgatctttaatttcctgtattactattaatctgcccgttctaacgctatggtggtatttaataacgtaattaaacaactaaaaatatatacaatgtatgctttagtgattaagactataatgcacaagatagttttaagatcacacaaaagaaaagaaagagaattagattgtttaaacatcaatctgatatatatacataaataggtcaaaagtagacatgttcaatacaatacataaataccttcgaccagcagtgaaacacattgtctgctaaatcttcaggatgcgtttgcacagtatcatagatatagcagaaagaaaaatgctacgcatacgatttttgtacgatcaaacgtaacggcgcggacggcaggggaacctaacgcgagcgcacggcgcacggcgcacgcacacgcggcaggagcgcttatgggcccgaaagcccaattaacctctttgcagcatctgacttgagattatatctatacttgagattatattagaataatctaccaggtagtattcaatctaactaaatttactgtctaatctaaagggaaaagaagatattttgggccttctttctcacgactaaaagagcggaatgtttgaaacaagttctgcttcatcaccatgtgacatcaattaatgtgctgagcagcactatactttggcttttaagtttgtctctaggaagtctctatgtatctaaacatatgcaaaccttgtttgacattggttcatactacctccatcattttttaatagatgacgccg

SEQ ID NO: 62714 - DNA, 13044 bp, Oryza sativa
actattcgtcttattcaaaaaatttatgtaattataatttattttgttatgagttgttttatcactcatagtactttaaatgtgatttatatcttatacatttgcataaaatttttaaataagacgaatggtcaaacatgtgagaaaaagtcaacggcgtcatctattaaaaaatggagggagtatataattagaaagaagattgctttggttggctatgcaagcatgccaacgagagagcagaccagcacgtcagagcttgggctttggatatgggctcaacagggaagcgatccgtttcatcgctaaaaaaccgttagaggtcaggagagaaacgtttcatcgtacaaacatcgtacaaaaacaatcgtacgtatagcagtgctgatagcagaaagcatattcacaaatcttgaagcacaaaggaggtaaacaaatattatttggctctgtgacaataatctaacatctacaacactataaaaagtgatgtctaaacggcacaagtaggttggtgcagtagcgcgtaagttgcaacttaaaccttgaagtattaaaccttgatgttcaccctttggctctagaaactattcctctacattgttatcagccactgaggagtattatctcaacattgtagtattacctaccaacagagattgttttttttattttacattgacaacaagatccttgataccttgttctttgaagaggttatatgcctccgtccaatctgaaatagtaaaacaacgaacaaatcgtaagtgcaaaatatataaaaggtatcagaaaatgcctatcagaagtttcaagagaaacatgcttgacccttttgtatttcacaccataatcttatatagggcctgtttggtacagctccaactcctaaatttagctccaggagttgggtttggagtggagttgtggagctgcctaaacccagctccacaactctagtttattttgtgagagagctccacctagctccactcctagttttggtggagctgaaactgtttggctgagctccagctccaggaggggtagagttagagctggagctgtgccaaacaggtccataggctcctaaaacacaattcagatatcaagttaatcgaacaaaatggagtatacatgcgcaaaaatcattcgacattaaatttaattgtcaaaggtgacataatctttaccctgcaatattcatccatcatctcatataactccaagcattcagatttgtaaggtgcatttataaatttcgtgaaggaacctatcaaagttcatccatcagcttgttacagttcttataagtgatagttttgtgttgaacatgtgacggttttccgattgcaaaaaaacagagagaacttgcaaaaagcaagttgaattttcattaaaaaacgagttcagtggttgggagtatagaagaaaacaaagcttaaaatgtaaatgtaattgcagggaatgaaattgtggtgtaagcattgaaactgcaagcaatgcactgattaacttgactattacatgtaagtctgttctagctcaatcactaactgcatcccctttactgaccaaaactatagtcaaccttgagcaggatgagcacatccacaaacccatggaagatgtgctccaacacagaagaccataagcaagagctatgtaatttgccttcaattcagtgagtcccagtttcagtgagcaaaatccatcagataagcaagacaacatgaaaaggctacagaaaacaagaaaacttctgaaccactcacctcttgtcaacatgattagttttgttcctaaccagcacaattatagaaatcactgcccctctcagttctgaattcctctatccattttgaagtgtttaggaaatattgcctggctacagcatgtaaactaaatttaaggaaaagggcctcaggacaagaaggagcatttataatgcaaactatcaaaaatcacaattttgtgttcatgtgccatcaaatttgcttggcaacaatctctgccggtctggttcatccttgctagtttatatggcaccttagatactataacatgtgctaaagagtgaatcacaataagagcataccttcagtaccactccggaccaacaacctcttctcgggtgccaacaaggtcctcaacgccggttgctcagcatgtctgaatgcagaggaggaactgagaagctattcgatttactcattgctatcagctatcaacttgcatgtgtatctccatgccaccgcaatctattatacagtaaaaagttcagtgcatcgctaaataaaaataaaaatacttcaatctacatgtttaatttttatctaagggttatttttcaaagctactaacagtaattaataagttgttatctgcagttctaggaaatgattggtatgttaatgggcgaaatcgagtaaagttaaatggatttgcaaattgatctaaaataagattattaaaacagattattccatgataataactgtactgccagtaaagataattaaaacaacagcagtagcaggaagttccacgcccaatctaatttcaaaatgactgtaagaattcaagcatgaagataaataatggctgtcaaaatctgatatgatggcagtgatgtatataagtaaatttgatatgtcggcagtgatttgatataaaagtcgttcccctttcaattgactatacaacaaatctactccatcagaaattagaaatgttgttagcatattcagaaaaaaaaaagagtagagtttgatttagttgcagagcctctccagtctccaccaattttggtatccgacctgaaggccctgaaggtgctagttacagtcacagcacctttattttccttctggtatatctgcaagccttcgaaatgagtcaggacacaaataagctaatattagcattcgggagggatagaaagaagtaaaatccacaacaattttcagacgagtaatttcacatagaaactcataatttgaataaaaataatacgtcacatgtaaacaattcgattgtgaaatgtctaaaatttgcttctttcctccttggaaggcagaaccaggagttcaatccctaagacgatagaccaagagataaggaatatttacgtgaacacgcaataggtttgtgcgacagatcgcgcaaggcagcacgacggggcgggagggcgaccctccggtcgagggcaaatgggcaggcacaggggtagggggctgtgcagtgaagtctttactgtgtatcgggcgtggcggcttaaatgacacgacgacgacgacgaatggaacaaataaacatatagggcaaagcttgagctattaacctattattatattttttgaaaaactcacctaatcctgtcaacgatgtcggccctgaggccccaaagttgctatccattggaaccctgaaatgcacaagtccaaatttattagagttcaatccagtacaaaccataaggcagaatctcagtgctgctgatggtagtttttttctcatcggttgatgtaaacgttcagaatcatagtcattcaacattcacaaatcaaagaaacttaatattcttacttatgagcatgacatgacaaaccacatagtcattcaacaatcacaaatcaaagaaacttaatattcttacttatgagcatgacatgacaaaccacgtagtcataaaaaatgggatattactacttgattgcaaaaattattacttaaggtatttgtgatgaaagaagggattcacaaagcttgaaacatgaactgatgataaacgaacacttgagctcattgcctacacctaacatttggtttaatacacggtaaaaaaattaaaccacgttgacaaatcagaattggaacaatatagggatgtttctagaacaagacgattcagatggcttgatcaaaaaagaaaatcaaaccatctcaagctgtatatacatggaaatcaaggagtagaaaccaggagttggccaggtgcgcaggcatggtctacgtcatcacatagatgattcagaaaataaatattatcagcagatttcctagagccaggttaatcataacagctggctcaaaatcacaccacggattgagctacttactggacatttcatcgaacatgtggcggccatatcgtcgggcgtcatggtggggcacgaggggatacataccttcagatgacgcggggcgtcggcggtcgagggtggcgcggggcgtcggtgttcgaggaggcggcgcaggtcgagggcggcgcggggtcgagggcggcaaggagggggcgcggggcgtaaaggaggcggcagcggtcgagggcggctaggaggcggcggcggtcgagggcgcgccgggcggcgtggaggcggcggcggtcgagggcggcgtggaggcggcggcggtcgagggcggcgaggagggggcgcggggcggcgatggagggcgcgcggaggaaggggtgacggcggcgaggaggcggcgcgttcgagggacgcgtgggacgcgggtcgtggggcgtcgacgctttttacgcttttttggttccggatcgcatgtaactttttttttatttttttgtcgctccaaacgtgtcgatgtacgtttttaagttggattgtatatctgctttgattgtatattttctaagtagtagagattccccaaaaatctttaatctcttcactttgcttaggttggctccggttgacagtgacacggggaaaggcaatcggacgcggttgagggccgctttcgcaaacggtattgggccagaatgtaaaaaaagcccatagcccatttttgtcgatctgatttctaaacgaagcccatagcccattaacgaaaagagcccacggcctcttctcttctttcttcctcctctgcaagccgccgacgaggcaaatgagagaggagggaagaaaatcgtaaaggagagagagaagaagaagaagaagaagagcggaagaggaggggaggagccatggatgcttcagcgctcagcaacccgcggctgcaggccatgctagaggtaataataaacccataatgtattagggagatttagagatgagcggcacactcgagtacccgacctatggaaccctaacatggagattaattagcagcccccttcttttgatcccttcctgctcttcagcccatctttttgttggtacgctcgctattaattatgtgtcctttctagatctactcggagattcgtgaaaaaggctgagctttgggcgaaagtttgctgatttgggccaagtttttgcccttactgttccttccaacctttagcttattatgtatacattttatttattttgttcagttgttttagcaatattcttcagtctgcaggaaggttgtgccctaatttaacacatgtgctggaatttacagtttaggtggaaatcgatactcgaatcctagttgcatattaatttgcatattactcgatacccaagtacccagtaaccctgactgcaaactaaactaatttggataagtctagttttagccttttaggcaccatcagaatggtcctggtggagatgcgctcgtagcgcagtggcaggggtcactggcacgcaccccgtcggcccgggttcgacccttgtcgagcacgctcaccaggggaaatatttacctcttccttcttaaaatcattgacaccaagttcttccttggtgtctaacttttcttttttagaatggtcctggtggttcatgaagtctttcctaaaaatccccataacttgaaaagtttttaacgcttcaacggaggagatattctgttattcctaattgcttttgtggtgctctatatttaaggactatggctgttcactcattactaatagaagttacaattctctctcatgatatccaacaaattatttattgtcatgcagtagtttcttaaattgcagtagtcccaaatcccgagtgtgtagccgctaatgcatatagcacggtgaggtgttttattaaatttgatttgctaccagctttgttatgtaagaaaatgatagtgcagtgtattctggcatgttgcaaggagccaaggatgttttcccggtgacgtactgatatgtgggaaaagaagtactagaatagaaagatcatcagtctgcaaattaaacgacttgaggaaaaaaaaggaattgcctattttacatctagtatgctgctaggacctttgtcctgggtttctgatatgttcattaatggcagaagttgcttgcttccctttatgcacaagaaattattttgtgtactctgttctttggacaatggataattaagccatgtgttctttgtcaagatccactattcaattgcagaaccgtggtgattgttactcacagaaatgttactgacaattttgttttcttcccctcttcaggaggagaagaggaaggcaatggcaaacgagttcgtggcgaagctgactgatgtttgctgggacaaatgcatcactgggagcattggaagcagcttcagcaacagcgaagcctcgtgtctgtccaactgcgcgaaacgctttttcgaactgaagatgctcatcgtgcaacgagttagcagccctaggtgaaaattcgcataggtcttttctgcgtcgagaatgtagaatctataatagttgatgctagaaactagagaggcatcacttgctttttgctgcattttatcagttttggtgtttttcctgctatacgttctcagtgaaacgattgcaagttttgctcttgcaaggagattaaaagcgctactgtactttgactacttttgacctgaaaagaatcagagacaagctcatagcctggagcagaaaatgtgttactggggtgtactgtcttgggagagaatgaggtgtgtgttgaagtgaaatgagttcaaccagctgatgcaataatgatcagaaattcaacacctccagtgttctgccatgaaagactcaagactgaactataccactgttcttttttactcagataaactacacatcaccgccgttctagttcgtgtttaagtagccacaattaattagttatcgtatattccagaggcacgtatctcgagattatccaacggtggatggtgtacgccagcgcttagtggcacactgacacgactgcatatccacatatacatatatacatttggcgatttcatctaggggtctccgatagtggaactgcctgtgccccttcaagctcccctagctactctcacgcattccccagcaaaggcgacatcctcaaggtacacactcctcatccagtgcttcttgatcagctttctctccattgttttttttccctctagaatcctaactaattttctgcaagtcctctagctagttcctgaccatctttttgtagcaaattcgtgtgatttgttagtgttcttatttgtgtgcactgtgtaaatgtctgcattgagtttaactatgggtttgttgaacaaatggatattgtatttgggttgcctgaatgaccacctcgaagttgcaatgcattttgctgccatctttttaatttggtgcctgcattttcggttaatttttaagggggagtaggtaggactttgaaatgttaatgcttttgtgggaccaattaactccaatcagaatatccatgattcatatgccatagaaacgtcacattgacacatttgtgtatctttagtgagccagcagtactcagccaacaggccaaagtatgcagactgttctgtttctgattgttcagaagttgcacttttctgattttgcagatctatttctttttattcgatttcttcggtctacgttgtattgcactgaacaatgcttttttttatattcatcttgcgcacttattcttagcatatcaaattctgagacatcattcatcatgctgaaatcatacaagtattatgttcagactatttaatgacttctgcttttgctactgccagaatttctccaagagttcaccatggagaactcggaagatgaagcagagagtgacaaactacccttagacttggagccattgcgctcattagcaccaaagtttcctactattttgggatatgatgtggaaactcaatcaactgatccactgttagtttatgccacaccatccataccttgctcctcatcagaacagcctcaagaagccccagcttcattttctctgcccttaccaaagtcacccgtccctataaaggctacacccatctcagcggcatttccaacaccgcaacatgaagatgaatcatcagatcaagattacaagcccttttgcaagaataaaaaaccagcgatgccgaagagagccaagaggccccagcaagctgagaaatccaatgatgctaacatcaagcgcagatcaataaggaggaacctggacaacgagttcaacttgtgctcatcctcatcagacaacccaaaggaatcggtggaaggaatcctgatgatgtttgattcacttcggcgccgtgtactgcaattggatgaaaaagaggatgcaagcaggcgggctgacctgaaagctggcactctcatgatgcagaacaacctcagaatcaacaatcataagatgatagggcatgtgcctggtgttgaagtcggtgacattttcttctttaggattgagatgtgcattgttggtttacatgcaccagccatgggtggcattgattacatctcttctaagaacaaagatgagactctggctgtctgcatcatttcatctggaggctatgagaatgacgatgatgacactgacattttggtgtacacaggacagggaggcaacagtcgtcacaaggagaagcacgatcagaagcttgagagaggtaaccttgctctcatgaacagcaagagcaagaagaatcagatcagggttgtgcgcagcgcacaagaccccttctgtaactcaggcaaaatatatatttatgatgggctttatcgtatcgaagacacttggacagacacggcaaagaacggatttaatgttttcaagtacaagctgagaagggacccaggacagcctgatggaatttcactttggaagatgactgagaagtggaaagcaaatcctgccacaagagaaaaggctatattgttggatttatcatcaaaggttgaacacctacctgtgtgccttgttaatgatgttgatgatgaaaaagggccaagtcacttcaattatgttgctggagtgaagtatttgagacctcttaggaagacaaaaccattacaatgttgcaaatgtcctagtgtctgcttgcctggtgaccctaattgttcgtgtgcgcaacagaatggtggtgatcttccttacagtgcaacgggattgctggcaaagcacactccgatggtttatgagtgctcctctaactgtcagtgttctcataattgtcgaaacaggatcacacagaagggtataaaactgaactttgaggttttctggactggagaccgtggctggggtctgcggtcgtgggatcctatccgtgctggcacattcatttgtgagtacgccggtgaagtcattgatgaaactaagatggacatagatgttgaggaagacaaatatacctttcgcgcttcatgtcccggcaataaggctttaagctggaatttgggagaagaattacttgaagaaaaaagtacggctgtgataaccaagaactttaagaaactaccaatcatcataagagcaaacaatgaagggaatgtggctcgttttctgaaccatagctgttctccaaatctcctttggcaagctgtacagtatgaccatggcgatgacagctacccacatatcatgttttttgcaatggaacatatccctcccatgactgaactgacttatgattatggtacaagaggtgctccccctggctttgagggaaaacccttcaaagcttgcaaactcaaatcatgcctctgtggctctaagcattgtcgaggtttgttctgataaaagatatggaggctggtgtactaaagcaggtaaaacttgtttaacaatcgttccaatttataatttttaaaacaaaatctgcttcttcatgggaaatgcattcttccaacctatttatgcaactgaataatctcttttaaaagtagctgattcatcactccattcatgtaagtcaagaactctcaaaacaactctgtggttacagtcgcctgcagcacctatgtggcgattttcatgctttggtacataaacatctattttcaacttaagcttagcatgccatatatttattcaagaatgtatataatattgacgaactgaacaattagatctgaaactatggcaactctatttctcttgtgactgcctaatgcttccatcctacatttgcaggatattaaactactctatgaatggtagcataaagtgataaaggggctctcggtatttgtggtggtgggttagtggaaatgtgtagcaaggactgatgctttgcgtggcatgagatgagaccctcacattttgtgctgtacattgcccatgtcgtaggcgtgtagccactaatgcaattactatatcttttgctagttgctgtggtagcactaaagctctgttaacttagtggatgagatcatatggatgtgaagctgtagcactaaaccctgttaactctgtgaatgagatcatctgcattactgcatatcgttgtgctgctacgatgctatataggtcgtataggaaatatttgacttcatgtgcatatggttttgcagcttatgctgctgcttgatgatatgaagatcttttttttttgaaaaaaaaatcatgtggatgtggttatgctgttggtgtggaggaaatatttgaaaaagaaaaaagttatgctgttaaagttgctcgatgatatggagggtttttttgaaaaaaaaaaggtcatgtgcatttggttatgctgttgttattgagaaatatttgaattttttaaaataaaagaaagatcatgtgcatgtgcatgtgtttatgttattgttatggagaaatattttttgcatgtaattatgctgttgttattgagaaatattcgaatttttgaaaaaaaaaatcatgtgcatgtggttatcaagtgtttatgttattgttatggaggaatttttttgcatgtaattatgctgttgttattaagaaaaatattcaaatcgttgaaaaaaatggaaaaaaacatgtttgtgtctgagcccaggttcgaactggggacctttagtgtgtgagactaacgtgataaccaactacaccacccagacttgttgtcttaactgcctgtgctcgcctatttaaccagttcacgtttatttgacaaaatctcaaaatcattccttttcatatgaactatctagaggaagaatagaccacgtatgccccgaaataattctttttcatatgaactatctaaccacatatgcacgaattgcgcaagttataacaaactacaactgtttgaattctgacaactgatattgaactacgacggccaagtttcggaatttcatttcagttctttgaccacttgccatgtaacacttgatccgccatcaataaaatgattgtaaaaaaaaaaaaaactgatattgaaccatgcgaactacaaccgaatgaattgtggccctgtttagattccaacttttttcttcaaacctccaacttttccgtcatatcgttctaatttcttcaaacttccaattttagcgtggaactaaacacagcctgtgatctcaagcaaatgtgtgagaccagtacagcacatccccttaccacagaattatgagagaaatctacagcacattacgctgtataatgtacaatacaacacaacgagtatttaccagaaatctccacaagaacacaccccgtctctgaagtgatggaaccgggtacggtccctcatgacaatctctctaccatacacccgagatacaagctttgcgctctcatggcaatcggcacacacccggaggttcttgatgatcctaatgggagctcctggattggaagcgatcagagcaaaggcaatggcgagcctctcgctgtggtaggacagtgcatccgccttgtcctcctcctcgacatcaaacaacgcagatgaggtgctcgaccggtgtccgcactcgcttaatctggtctcaatatcctcaaccatggcgtatatctcctttgaggcaggatgcgtcttgtcacccaccaagaactcatggagaactccattgatgtctacaaagcttgatccagggctcttgtcaatgcccatggacttcatctccttcctcgccttcttagcgtcgtcccatcggttcgttgttgcgtagaagttggaaatcaggacatggtttccactgtcatccggttcaagtcgcatcaattctgcgatcatcttcttgccgagttccagcttgccatgaatgccacaggcccggatcagagacctgtatatcgcagcatttggcacgatgggcattccgtggatcagcttctcggcatcgttaagtcgaccagcccggctcagcatgtcaaccatgcatccgtaatgctcaatacttggctcaatcccgaattcgatctccattctgtcaaagtagtccagaccttcatccaccaatccagcatgggcacaagcacacatcacggacagcacagtgacgccatccaccggcacgccctcaccgtgcattctgtcgaacagggagagggcagcacggccatggccatggactgccaagccatggagcatcgcattgtagcagcgtgtgtccctgtccgaagcggctgcaaagacctgctcggccaggtccagcctcccgcacccggcgtacatctccacaagcgcggtggccacaatgcagttgacggcgagccggcgtttcacggcataggtgtgcgcccacaccccatggctgacagcgccaagctcgccacacgcgccgatgacggcgacgagcgtgatctcgttgggtttgatggctaaggatagcatccgcacaaacatctcgaggata

SEQ ID NO: 62715 - DNA, 14466 bp, Oryza sativa
gccctcacctgcgaccacgcctcgggcagccccgccgccccgccgccgttcacctccattcctcctcgccgccgctcgtcggtctccctccctctccgcgccggcgccgacgacgacgagacgaggcggaggagcgagcggaggaggcgcaattaatgggattggagagtggagtggtgggagagcgtgggagagagcgggggttttataaaatgatcccacgcacatgtactagtagggttttgtgtcactctctctctctctatctctctctctgtgcactcaccaagattaaaaaaaaatcccctccaaaatctactctactcttttttccaataaaaaatatttatctttttaggtcgatggaaaacggaatggtttatgtgaagtttccctcggtactaaatatgccgacatacgatggtcgaaacgacttaagttacacaaatagaaatagattgattatttatgtatggtttctcggttctaaatatgtcctgtgacagtcgaaacgactaaatttacacagagagtacaaatcggtaagaagtagaaatagactgatttctgtgaaaatttattggttttgagtaggtcatagaatcatccaatggtctaaatttaccactttgtttcaattttggcaaaaccatgaacctatccagcaagaaataattatgcatgtgaaagttgggctccaggagacgctccacagtgcaagggaaaaaggagaaaaaaaaatcacatgatacatgattgggtggtaatgtggtaataacattgcaaagtgtgttgaaggggggaggccatggctgtcgagtggggcccacagtgagggtgtcggtggtgaggagggtgtgcattaaacaaaaccaactggaggtcagtcagtttaatcaaggggtgtgtgtgaggtttcttgtgtggaggggttgagtggttactagtgatgatcaatcaatcttggggttgggttgcttatggctgctgcatgccacatttttagggttcctttggctttagccaaaagggcatatcatgcagcaaattggggagctttctgttactctaacagtgtggaaagagctgtaaatagatgagtgtactacaagggtcgaattcggcattgttcttttgtgcgggaactcgcacgggtgtatgtcatccaggtctccaaacttctgagtatcggaatggttacgttcgagctcttcttttagcaaatccaatgcttagcgttacacattttactacgagttgagacaacacagctgacgtagacatgaacaaagaacaacaagggaagagcatattcacaatgggaggatgggatctgacatcctacaacacattgtgagcttgtgttgcagccatgcatcccatgtggttttgtttgctggttcttctgacccaatctcaaataacaaaatgaaatgcacactgaactgaacaggcctcatgttcttcattcagtactgtcacaggctcacagttgggggaagaaagagacaaagcaacggaatttatttacagttcatgggcttttgtgcaaaatcagccaccatctgcagagagatatacggagggaaagctagacgactcccgccaaaaccgtcgcatcatgtgccagcgcttatcacgtgccacgacaccagtttcatgaaaaaaaaaagaaaaaaaaggagaaaaaaaatgagcaagctgataaatttttttggttgatgagaaatcaatggctgggtttacatgttgaccaaggcattattgcaagcgcaggagatatttctgaataatggtttggtagcaaatggtttgggacatgtacttggagccttcacagtaccagtttgcctagtctagctaggccctgtttttgatcattggatgcatattttttctttgcaaaatcacgagttccacataggggtctttaactaatatatgtgctatcttgcataagggagctacttctagctcttaagagcatcggatgaactaggactaacaatattggataaccgtctgggctcgtcagtatatggtaggatgtcagggttagtcgtcatagtgggttttgcttgggctccaaaaatattttcgagctcattattactcgagcgtatgtatcaccgtttctcgatgtggtttaaataattataaaaaaataccatataaaatgaataacataaataatttgtgtcacatatttttcgaaaaatatgtgatagtacaataatctaatagcaccgtcggttagccaacaaccaattgcatgtcagaatagcttattagagaaaaacaaaaatttatgtgtaaaatttttatatacgtgtgcacccttagcgacttaaaagccaatgaaaagaacacgttaaaaatactttaaaattaagttttacaatttaaattttggcaagggtttggctctttctagggcaaatgatggaaccttaaatcatcttttttttccctaaaattcactcgactatatatttagaccatataaaaatccatttctacaagtaccttacaccatgcccacacaaacatttattaaggcacaaagctaacaactttattatctctcttttggacatggcctacacacacacatacatagtccacaagacaaggcattaagggaggagaagacagtgcttcctccgacccggccacatgcagcttaatttcggctcctcttgccgcgccacaacatgcgcagctttacactacttcactcactaataaaccttccaaagtgatcactaaatcaattaattaatatagttgaatgatcctaaattggctttactaaagtacaatgcgattcaacgaagactagattgattattggtgattaattaattcgttgatgaaacccccaccattggtgacggcgccgattaacaaatcggcttttttctttctttctcccttcttctttgttggtacatggcagcaaaaaccgggtgttttgacggtaaccacgccatgatccccgctgcctaaccctaatgcatgaaaaatgaatggggtttgtgagacctactggggattgtgtagccacatggtgatcgatcgatcgagatctcgtttgggagaaacgccagctttcttgcttgcaaccgacacaatgcaaaacatgaacatgaataattaatggtctagaggactgttctccgtataaactttgtatatatacggtatttagatatacgatatgataatttgtgtaattatagtttgtttatttttattagattcgtgaaattagatttttaataggataaaccgtccgatgtagactaataggataaccgatattagaaacccaaatacgtactaactatgatgattgtacaacggtatcgttttccggccacccaaccatcccgagagtgaaaggatggtttaagatatcatgaaatgtaaacggcgaccgggaaacactcttcgtcgccctagggtcgacgacgtcacaactaactccgccactagtatcactcgcatcgttttctctactctttctctttgtctccgccttgtaaaaaccctacgtagcatctcctcctagatgctgacatcactgttcatgctctctctttagatctgatccggccagcaagaaaccgtcggtcgcccaagtcaactgcaaatgcaaattcagccaatgtgttgtgcaatttatggaaacaccacgggttgatgtggaatattcccttctacagcaacttccctgtcagtaatttactctccataggtatctctctatcttggcacccagtaattaatttatgttttgacagatgtactcccatgccaccaatttgcagtaaaattaactacttggaggtactagctagctagatgatctgatctgatgaatgatgcagttgacatttcactcctatttttttcccaaagttatgtatgagaattaattgttcagttcatggaagcaagaagagaccgacggtcacagcctcatctttttcttatgcttatacttattagctaaaatttaaattttcaacattaaatttaaagttgattttagggtttctttcatcgaaatttatttttcagtttttgtttttaggtcgctaagaacacatatataaaaattttattcacaaattgttttttatttgtaaatatgctatttcgcttattcctagagccgttttcggtgggctatgctgttttgcttgtacgtactaatgacttcactgtaccgtacaacatcgtttataagttccaagttgaaacaatggtaaccgtattttttgttattaatgacagaaactgcagcaatccggcaaaactattggcgatcgagaaggaaaaacaggcaaggaggttgcttgatcgatctgagctgacgaatcggcttctactactacttggctacatataaatgcagacatgaactactgaactgcagaatacttctctgcgagagtgtacctaattaagctgtattcgaatcttctgatcttctctgtaaattataagatacatagccctcttgcgtattgtcgaaaagaaaattctatctcgggtgctctaagcatgttctagcccaatgtaaataagttatgataagtatcagttgaccccaattgcagtattacagcagcagaacaggaagctctctgacgtcgagctccgaaacatgtgatcttgaacaattctttagctgaagattaatgtaagtcaaagaaagcgattaaacggtacgacggcatcgaaaagaatattgagttgtatgcaccaaccagttcggttatcccggaaaacttgaaccgacaagacaaaaaatgacgaacaaaacgttcaaatcttcagagatcgatgcttggcattgttcttcctccgatgcagtgatcgacacggcgtttctctgtcgaaaagggatcgatctaaagaagacaagcagagatgaacacgacctgcgaaaggtgacaccggtttacacgacgattcgctgtacagggtatatatctctgcatctcgatcgatttcaccgagtcacgaggctgtactgctgctgctggttcttcgctttggatcatcactgtcagagtctttggctagatttgcaagaaccaaagtgtgctctgacagcagtgagtgtgatgatgatgatgatgatagtggggatgagtacgtactgtatttacacagccccactttgtgcgctgcctgcaaaattccaggaccaagaaacagttgcctgctaattgccggaatttaatcgctcatttaatcaggcaggcagcacggcacaaagctgaccatcttgttcttgttcttgcaggtcaaacagctagtaaaaaaaaacactgtttttttaatcctgaaactctgaaaggctcggtgtcacatatacttggtgctgctaatcttcagactttcaggggaaaatcatgaatggtaggatgtgagagataatgctggattgcagatcaaagatgcagtgaaagatgggacaaggaaagttcagaaaagatcaaagagctttattctttccacatgaaagaacaagaactcagaccaacctagtactgtcactgctaaaaatcacgtgcaatgttctactaagttataactaacggtaaatacgatcaactgtagctcgtaaagaaactctgacgaggcagtaaacatttgcatatgcagatattactttcacctgagcacctgagctacagcattgtacaagcaagaacctgtacagggtatgctatgcaggagtggtcctgaactgtatgtatatatgtagctattgttctgcagcttctgaatatgtaccttggagacccagctccaccgtttgcttattggcttcagtcacagctaaaatttggattttaaagttgattttaatatttttaatcacaatttatttttcaatattacatttaagtcgataaaaatatatatatgtaaattttatttgtttgtttttttcacaatttatcaagtgtagaccaaattatgattaccagtagcagacataagcctagagcctgacccctaggtttgtctccaaaactcctactaaaatttatcaaaacttggcggagattttaaaaacacaaggtgtataagcaagttgagccctgctactgaagattttctgattttctggctccgcccctgatgatgatgatgatggtgatggatgacatggtgttggacccaaacagtgtgggctacaattaatacatatgtaatcagcttcttctaggttaattagagtggacgcatcaggaggaggaagagaaggaatcatggcacatggaagcacaggccccggaaatgccagatgccatgcgcaaagcgaggagatatgcatgagcactactatgagctttttggtcacccttttttctcgccggatttttgcggatacaaccttctcaaaaacctgaatttgcaaagataggcccctctcgcaaagagggaaatggccaaggggccacttatggcatattcgtgttgggtgctttcgcatcacttcgcaggtgacactgctgtgttaagcaagcacaatagttaagcctggggcatgtaagcttataggtaatacacgtacgtcatctaaagacacgttcatagaacaattgaggtattaaaagctttaactattaagtcaccaaaataatttttcattattcgcacttccttttacccacccacaagtaacaattttttcttttatcttaggcttagtcgtatttgtacgagcctagtatagtctcatactccctccatcccataatatagtaatctagtactggacgagacattttatattacaacgaatctggacagatgcatgtccagatttgttgtaatatgaaatgtcgcatccgatcctagattgttatattatgggactgagagagtagacaatacgtgttatctagagactcattcatataacagctgtgacaatcaaaggctctaaatattaaaccaccaaaataattttaattatttgtccttccttttgcccacatcacaaagaattttttaaaatcttaggcttaagaatcgtattgtatggctactaggctcataggcaatacacttcatctagagacatactacctccgtcccaaaataagtacagtcgtggatatccgtgcccaatgtttaaccgtccgtcttatttaaaaaatttatgaaaaaattgaaaatatttagtcacatataaagtactattcatgtttatcatctaatagcaataaaaatactaattataaaaaaattcaaataagacgaacggtcaaacgttaaacgtgaatagtgcaaaactgcacttattttgggacggatggagtagtcatcatacaagacaatcaaaacctctaaccatttagcctccaaaataattattaatcaactgtccttccttttacccaccctcacgtagcaaaattctttttatcagccttaagagtcgatttaagctcaatataaatatggagtcaaaatacaagttaattgttgttgtacatattctagtatattcttagggggtgtttggttcgagaagaaaaggggatacataaattaaacctaatggtagtgggaaatattgcgaccagagagcgagaggagtgatgcacaagggcattatacggcatatttctctttcctgaaaatgattcttaaaagtaagatttgtttttaggtacatgtgagatggggccactgtatgtctgtaggcagtgtaagtggcataacatatgcatgatgaatgattttgataaaaatattgaagaattttgttagtggccaattcaacaaactaataatgggcctcactgtagtctcttcggccctgggctctaagaaacagtagtgagtcttgtcggtggatggcccacaaaacaggttgggccagttgacctccatactgatacagcagaagtaacttctcaaaatctaagaactaacttgttgatagctagattttgagaatgtaaaagaaagaactgggtttttcagtttatacgttctagtctaagttctagattttataactaaagattttaagaatctaggtgaaaatcagcattatttggaagagttggagatttaagaagaagctatagctgctcctctaaacatggcctatacaactatgtttgacaatatactccctccatccaaaaaaaaaacggagagggtactttccaaaaaccataggccgtcgttgttgtgctagtacaaattcagtaaaaaaccataaattttctccacatttcaaacatggcctagcttaatttcccaattttctggtgcacgtgacgtaagcgatttcacagctttcatatctcgacatttcgtcaaacacatggtttgcaaatttcaacaaaaaaataaaagtagttttttttcttttgttattccgtcatttcgtcaagcacatggcatgcaacattcaaccgaaaaaaaacacacacaaaatttcctcttcacaacgacgacgctactcaccaacgcgcgagagcaacgggctgatcctgccattgttgccacctacgagagctcggattccatcttcagagcgccttgagcatctcctcggcgctgctggtggtgaaggcgccgccctcctcgaggttgagcaccttgacgacgccgtcgtcggcgaggagcgcgtagcggcgcgacctgacgccgagccccatgggcttgtcggagaggtccatctcgacgccgagcgcgcgcgtgagctccaggttgccgtcggagaggaggagcacgtcggcgtcgccgaggcccaggctctccttccacgcgcgcatcacgaacgcgtcgttcaccgacacgcaggcaatggcgtccacccccttggcgtggagctccccggccttctcgatgaaccccgggaggtgcttctgcgagcacgtcggcgtgaacgcgccgggcaccgcgaacagcaccgccttcctgcccgccgtcagctccgccaccgtcaccgtcttcagctcgccgtccgccgggtcgaagtaggacagcgtcgcgtcggggagcttgtctccgacggcgatggtcgccaccacggtggacgccgacgccgccgacctccgcgccgctctcgcccccgcggcgcggacgcctgttgcgagggggcgggaggagaaggagagggagaaggaggaggtgatgaagcgcttgccggaggtgacgctggcggtggagagggtggagagagctgctgcggtgggagcggccatggagggcggcgacggcgatgtgttcgaggaaatgcttctctgttgggatttggtttgggagtgcgcggcgcgacgcgagagataggaaatagtgggatttggttggtggggtggtgatggcgaggcggaaggaacgggtggacggcgtggtgttgcgctggattaggcgaggcagagccggcccacgggtctggtagcgacggcccaggactacagtgtcgggcctatttttgttgggccgaaacaggattgttcggcctgccttggtgattcgggttgggcctatgaaaatccagcccagttttccccgtttgactctgatggagttgaattttttttatttttaattttttttattaaaagttttacaaaaataattttctattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgaggggaggcatggaattttgcaggcggcccccttgccgccctcggcgagggcgattttgtactgtgcggggggccgcctgcaaatgggcggcgagggggcatggaattttgcaggcgacccccttgccgccctccgcaagggcgattttgtactgtgctctatatttttgtataaatatcaatagttatcaaatctttttatattgaaaactatacaagattaaaatctccaagactggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgtgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctaggctgaactgtaccgtgcgaaaccggtgctgtaggtcgcactgatccgaagctaggggcgctcgaaggcaaacgaggtcctgcgaggatggatcatcaagttacgacggggtgatgttttcgtacaaaaacagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacagcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggatgtaccgccacgaagtagtctcggtcacggtgcgtgggatacgcgtccgtgacagcggcaacgtgcggctctggggcgtctggagtgaaggtcacacgcgcacgagtgcgaggaaggtaccaacgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaagacgactgataaacttataacgcagcgaagttgcactaaccccacgtcgacaccagtaagtccccatcgtgggaccgtcctctggccactgcgcgctgcgaccaaccccatagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatgcaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgtagaatgaaatgttagtacaaaacactcattcggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtccacgggaccaactgctgctcccgccagcggtagcccgagcaggtacgacacgtcctgcagtgtcggagccatctccccacagggaaggtggaacgtgtgcgtctcaggtctccagcggtctacaagagcggcaaggagtgaccgatctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaattagttcaacataagtaataaatgttgaactaagcgaattactaacacatattaaacaagagtacaaacaaacaaaagtgtttactccgaacactcatcacgataacattatgatacaacaccgaataattcgcaatactactagtacaacaatagtcggaggtactcattacaacaacattgaattgaaattacacgatagaagtatttagtccaaacactcattacatcacaacagcattttatttcctaaatcgaaagcattgttacaccatggaatcgcctgctgcggacgacgccttggccttgcgcgcctgcttgttgttccttcaccaggtggtcgcctaccatcacttgcctatccagatggactagcatctgcgccgcttggaacttctgcattcttcgggcatttcttgtaagtatggccgcgcagatcacacttgatgcagcgtaaagtcctcccacctgcttttgactcatccatatcatgtctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccat

SEQ ID NO: 62716 - DNA, 11188 bp, Oryza sativa
cgcaggtgaggcagtactggttgcactcgttcctgctcatgccgcggtgcgccgcgcacgcctcgaagaaccgcgcgccgagcagcgaccgcagccacgccgggtcccggtccgccaacccagcagccatcgccgggtccgcggcgccgccgccattaccgacctccaaaacgaaaaaaaatgcagctccaaatcaacaccgcatcgccggagacgaagacgaagacgaagacaagaacaagcaatgccggacaaaccattgctcgatcttgctgccaagcgactacaaacacataccttcggttaccactgcttgctcgtcggagaatcgatcgatcgggagagtgaggatctgtgccagattcgattcaagattgctccatatttttttttcttcttcttgatgagattgggggaggagggggggattgaaagggaaatgaaatgataaacacgggaggacagtggctggcggctgggtttacacacactacggacgcgagcgttttagcataatgcgattgtttctatagacggatggcacgagatgcaggagggaggggtagcctctctctctctctctctctctctctctccgtgtgtttctcgatttttatgtatccatttttgtactggaattcatcaatgtgaccctaatcactaggcaaagagattaagagaggtaccaccagggttaattgtcaaaactagccatggcacaacccacacaaaccacaagggccatcaaaatcaaatcatagatgaaggaaaccactcaccactgaactgaacacatatgtgtaccttgcatcttcctgtgatcacaaagaattaaaattaaaccatacaaaaaaatatgttgaaacttagaagtatagataaacatatacgacacacggaaccaactgcaggatctcttaaatcaccatcctcaacccgataatatggaatcagatgagatgttgccattcggcaaagttttctagggaagacaaaattcaacaaacagacacccctaacctgtaaaaaacatacctcataagcgttgcgccgagtagtaagccaggattatataatgattagaagagacttttcgtcccatggggatcggtccagtaccaccgccgccgccaccaccaccacgggatatctcatgaatctatccgctataacaagacgcgcttagggggattagccctcttctcttgtgcgacacgatgaggagtacaccaaagaagagagaggagccaccatcaaggttggtggcgttggcaacatagtagactagttatgcgttcgagtcttccgtatgcggcaaatgctttagatcacatgcatatatataggcgcacacagaaccgactgatctaagtactgggccagtgtaacctatattgggccgcatataaaagtttacggcgtggatcgatgcgtatcatttaattagatgttggggcgcatccttgtacgtctatttttttaatttttataattttgtcgaatactatattggaaagcaatggtcgaaaaccatcatagaggacaaatatggttgcccttttgtggagagaacaccatgttatatagttcttttcatgcgtagtcttaccttttggtgatcaattatcaatcatataactctattgaattttggtaaaaaaacaactttatttgaatttcaatcatgttactaaaacaaagaaaaatatagctctatgcttaaaaaaatatcaatgcaatagaccaatagtacaggctacagggcatttgtgtcattttgcaagaaggcatattaattaaattaaatcaaacactatataaatgcactattttattcctcaacagtttgatgttagccataaattcttgagcctgtatcttcatatagccatacgtttcattcattactgagtagatatattcatccacccctttgaaaacccaagcaaaaaccgtgtttcatcgcaaaaaaccaaaacaaaattactccagtaggagcaaaaaagaaaaaacaaaattactccagcaggaagcatgaggtttgccgttttgtccctttctgttactttttttatttttttagaagggtacaactcagaacgcatacacacgctagaaatgagattgcactcataccacgacacacgcacacacgcacgctaggaatgagattgcactcataccacgacacacgcacacacgtgtccctaacacacgctaggaatgagattgggcctcagtatatgggaaacgtgcagtccacgacacatgcacacacttgtccctaacacacgctcacgctaggaatgagattgggcctctgggcctcagtgcacgggaaacgtgcagtccacgacacacgcacatacgtgtccagtcccactaaacgtgcacgcgtgtatacccccggggaaacggagaaaaacccctgtgagacacgtgagttgcgatcccaggatcgaacccgagcgggctgctcgctcacctggcgacgcttgctcggttctctccttttctgttactaggtggaatgaatgatcgctagagtaagagcgcccaaccgttgactcggcccggcccgataaggccttgtgaggccccaatccgaagcggattggattacgtgcggcccacgcgatctctcggcccatcaagcactccacctctcaccaccgcaagtccgtaaccaactggagctcctcctcgtcgtcgtcatcgtcctcctctccggctcgatctcccaccgcggcggcgactccagatcggcggcgaagcccaggatctccggcgagggcaggagaatgtcgagataaaggtggagtagtcgagtatcgcgtaaaagaaagagaaatctctccccgtctcgttgtctcctccgctcctcgcgccgccgccaagacgagtcgcgggggaggggcggcgatcgagcagagcaggggaggggaggggatcctggtgagtatccatccgcatcctctttctgattcatctctctctcccaccccaccgggactacttatgtctggaattttgcttgcgttcgttaaccctagtagcttctcttctagatctggaaggagctcttctcctcctccttaatttgagagccctaaacctctcttaatacaactagtagtaacagtttgggggttcaattcaactcaacccccatgtcccaagttggatccacccctgttgctattagggttacggagttggcaaagataatatggtggcatatgtttgcgctagagtcgaatccctttcgcaatgtgcactagcatcgaactccatgaccaggagcaagaaccaagtcattatcttgaatggggataatatcttacattctgaaaaaaatagtttgtgtgtttgcacactctgataattagatttgcttgaggagcaccttaagtagtagtattccacatagtgctaagtgctgatctatcctattgaattgcctgctatattgttttgagaatgaattatatgtttatgattatgctttagtaaaatttctcacttgagttgcattgttcagggaggagtgaccggagggaatgcaagacccaagaggtatgccacgagatgaattcgcaaccccgaagacgcacaagagaaaggtcgtttcccgccccttgcctcccagccaaataaaagctgaacctgagctgctgcggagggaggttccactcacatccggcaagaccaagaaagcccctaagataaccttcaagaatgaacctcgccattcggctccgcaatctgattggggaacccccgattcggtgccagagttcggtccagctgatgaatacagagcgttacggaagaagtacctgctgctggaggatgagaacggtgagctggacaagcaattgagccaggctgaagaggaagccagcgttctcgaggatgaaaagtttgcgctgctggatcagcttgttgtgttggaaggccttgtggatccttcacagatgcagccaccgagaaggctgtgagattctatgcgtgttcgttgcctgttcatagtccaattaagttacctgttactgcttcctgctagatatgtaaccaattgtaatggaagagcaaagacatattatatcgtttattatggaagtttgaacatttagagcacttgtttggagttctttttgtgcaatatgaaagagtgctatcagtttaactgaaatttaatcgtggcaaaacagaaagttcagcaagcatgaagctttgcgcctttgcctcaagtttgagttatgcttttaagaactacgcaactggtcttggggaaaaaagctgaacaatttgtgtttcatgtgatttaagaaactaaatctgttcatgtgaagatcaactgatcatcacaaacttctgcgtaatgtttgcacaaacacatatactccagcattaacataaaaaaaacaaaactcattcatcacggcgaattgacgggccacaattttaacagtatgatttctcaaaaatctttctacaatagcattgtttcgataaccttttctaaccaaataattaattaacttcataatctacagtatattgaattaatctatgaatttatcggctaattagctgacaagctgaacagggctgagactgaatttcttcatagtgactctgccgtgtgagtgctgacgcaatcaagatccaacaattttaggcccacataaactttccaagcccaactcatgaaaagcccaattctttttcaccttatataaacccgagcagcagcagcatccgcctcagctcaacggtcaaaaatctcttccaatttgaatatctctcctcccaaacggtcggctccggagcggcgcccggacgaacacatggcggcggcgatggcgacgacggcggcggcggcggcggaagaggcggtggtggcgctcgacaaggagactctgatgctgatggggtgcggcgacgccccgccggctgcgccgtgcgcggagtgggagacgttcaaggagaacgtgcggccgctgaagcgcggccgcaacgtgggcctcctcaaccgcgccctcaaggcgcacgccgaccccgcccagcgcgccgccctcctcgccgcccggaggtaccgccgccgctcccgtcacccgcgtctctcggttcttgggtttggtttgctctggatttcttgatttgggggcgggtctctggtaatcttttttttttcgtcctacgtttgattgatctactgattcaggaaaatgatcgaggcaatcgacgaatacagcggcgaggatccgctccaaccatggatagagtaagcaatttcccctttgtttcattgattcgtatactagtagtagtaggttgagccgaaagatttgccatgtcggcgatttctctgcggtttccgcaagcttgctgctcatggcatgcctttgtctgcttaatccacacgcagctgcatcaaatgggttcaggagtcgtttccgacaggcggggattgctccgggttggtggtgatctacgagcagtgcgtgcgtgccttctggcacgacgaccgctacaagaacgatctccgctacctcaaagtgtggctggaatatgtgagtttcatgaattcaggattggttctgaggtggattggttggattggattggattggtttggtttccttttgacatccagtttggcttgatcttaatctgtatgcaggcggggaattgtgctgattccgaggtgatattcaggttcctggaggccaaccagattggtcagagccataccaattactacttgtcctatgcgtcggtaatggagtccaagaacaagctaaagaaagctaatgagatttttaaccttggtattgccaggtgagaattttatgggggattggtagtttagtttcttcagatatgagaaaggttgcggattttcttcagtgctagtctgctagtagattattttttagtgataatagataagttccttctaaatttccatatagcctttgacaaagaattcctgttctagatttgaagtctgttttcttcggatttttagtcaacaaacatatagtcttacatatccccatttactgttttagttctatgaattatagtaactaaaatgcattaaactaatttggagtaagcttatgaaccgttgtagctgaaaacttttaccttctctatttgtttttggagggatatgacttttcttgccactctacctataccttaatacctaaagcatacgatttatgcatttgtttgactgcaaggtgtatagtcttccatattcccactcaccattttagctctatgtattataactaaaatgcattaaactgattgtggagtaagcttatgaactgttctagattaaaacatgtattcctgacttctctattttttgttggagggatatgatataatttctcaattttctgctctacctacaccttaatacctaaagcatactatttatgaattttgtttgatggaatggtgcatattaaaccgtaaaattctttggcttttttttttttggtcaggaaagcaaagcctgtggagaagttggaaactacatacagggcatttcttcagagatcatccaaaaagaaggcacatcctgaggtgtacataggctgatttagtaccctatttttaatctatattccactgcccactgaatgaattctattatctgttgaaacaggatgacacaactactgatgatcatccagtacgcaactttgggactgtcttgaaccgtggtgaaatcagtaagtttgctgtgatggtatgattaacatcaatttcaagtgcctggctgggtgaactaatgttgcattttgatgtggcaggaggccagcatgcagaaaactctcacctggtgaaaactctgcaaaggttattacttgttatacgcatgcaatcagtataaagaaatctagatgaacctggaatttttttactggtgttgatactgttgcaaatttgcagagttgatgtcaataggccacttgcagtttacacagatgagaattcgttacctagtcatggccttgctagaaccaggagcaacaacacggcctggcagacccttggatcacaagcagatcggaacaaagaaaataacatgaggcctgctaaatggacatcacacaaggttttttttttctcccctaagccactagaattcttcaaaaggtccctttttgcgacatgtctcgaggtttatcggttcagtaatgatcaatgaactgatgatagtattgcactgaacaacagattcctcagaaggttggatcgagggcagcagttcagccgactcgtgtaagctccattgaagtcttcgtagatgacgaatgcgccgagtatgctactgtgcccttaagttaacagttttgaatagttctttaaaaagagtaactgtaaaaacgtataatttttatataccttcctttgattatttcagggaaccagttccccaagtgccaaagagtacaaaaccatctattctgaagcttaggcaagcaacaagcagaaacctcaagcagtaagaatagttcagcttatattatgtttccagaggttctgttcctttctcatttttttttaatgtacacttgcttttttttaacagggaaactgaactgcttatggagaatcctctgcggaatttccctctaaccagccttagataatcaatatttatgtggtgtaatgctgtatttcgatcttcttttaccaatttattgtttgagtgtttgtgacattatgctgaaataagctttagcctctaaagcttaggcaggcaaagagcctttttaggctatccatgagtgttgtaatattgcacaataatttgattgataaatcctcgacgagggttgggggtgcttaatttggttggatgctgataaacataagtgatgctaatttttaatggtgctctgtttttttttcttttttgggctgaacaaactgaggctggaattgagtaaaccttccgggaaattatttcctttcaaataaaaatcataatgcattagattctccaaataattcactataaccccatcaggtcacaaacaccaaaacgtgattgaaaactgtcatgcaagtggatccatgacagtgtatacacaagatcaggtgtgacaacttgtttgcagacacagacatggcaaaaaacatgtttgccatggatagatctccaatgctatttttttttctcaggtcttatcaaaggtccccattgccagcataaattacggaactttaaggctgtgttcggaatcggacattcccagcgtgtaagtacggaaaacggagcggaaatgagaagagaagattagatatgaaccaaagcagggaaaaaaaagtgagagtagatgaaatattactccacttgatctaatccagcatagcaaaaatgatcacctcccagaacctcaaaagttgatgaccctattggctaatagcactcacaacttcaagctgcaagctgagagtatagtagtgacaacacactgggtggtaataagtgagagagagagagagagagaaaaaaatgaggttttgattatttgatatcctggcccactgtcacacacttggatggtcccatatgttattgtcacatgtgttaatataatcaaagtgataacggataaagcatcaaatcatcaaagtttacaacaataaatatcatattgcccgtacgttgcaatgggatttgaattaaagaaaattatcgctaacccattattactatcattttatgcatatatttgttaccaacatgtaggccctttagcttcacattatccattttcttctactagtcacaggccccatgcgttgcaaagggatgagatatcaacatggttctattttttcctcttacaataagggtttgtttagtttgttgccaaaattaaccttaccaaaattcacaagatttggcggaaatttgatttgcacctgtaaatcacaaatttctagctaattcacttaattgctaaaataaaccttaccaaacatttgccattgccaagttttagtaagataacaaacttaacattattttaccattgcaaccttaccaaactctaccaaaattgggcaattgtagaacattccactcacaaaaccataccaaaatttggtaaggtaccaaactaaacaacatcttaccaaaatattagccacaaatggtaaggtttgttttggttaggtgcgcatttgcttgtgtggtaattttatcttcttatcgaagagttaattacgtgctgaggaaccctcttgtggctgcagttgaagccaatctacaactctacaaggcgaccatactatactatggatggattccgagagtgaaccagacaaatgaagaacaaccagctgccagtccaaacacacaagattcataagattcatgttatctagacccgctttaatttgctttcgaataattaagaggaaagcgtccgatcaagtacatgggatacgaaaccacttaattaactagcgagttctcaatatatcatattccttacatttatattctttaagtgtgttctttgctgttgcaaaaaaaaaaaattctagttatgaacctgaatattaactcgggtatgtcaaagtttgtagttagagatggagtgaatacataataacaatccattttcctcacatgtatattttattttcataaagaaagctgccctatgtatgtgcttattcgtttgtatgattagaatagcgtaaaaagttttggaaaaaaagcgaaagctggtgttctttacttagtactctctcaatcggagaaaaaaaaatcaaattctagttatgaacctgaatattaactcgggtatgtcaaagtttgtagttagagatggagtgaatccataataacaatccattttcctcacatgtatattttattttttaaagaaagcggtcctatgtatatgcttattcgtttgtatgattagaatagcgtaaaaagttgtggggaaaaaaagcgaaaggatgaaaaacaaaaacaattccgttgccgggactcgaacccgggtctctcgggtgagagccgagtatcctaaccagctagactacaacggattttgctcaggcagggcttcattatatgactaattttagttgaccgaaaacacacaaaaatcaggatttgttagtttattgctaagtgtggggtgattgggtatactactacggtaaattccctcgcttttttttctggtaaggaaagcaaacctagggttaaaatgcaaaaaggctattattttttacccactaacattttttttagataatggttttaccgactaacatgtaatcgatatatataaaaaaatagaaatctatatgaacctggaggttcttgactgtggtgatactgatgcaaaaattctagaattgatgttgaaatttatataaacacctgccatatatacccttggaacacaagcatatcggaagaaagttactaagtgaggcctcctaaatggacatcacttgagattttttttttcgttcaaggacttgttaatgattttgaatagttttttttttaaaaaataactttataacgtactccctccgtttcaaattatagtgaaactgtttcaagtttaactaagtttgtagaaaaaaaagagtaacatttttaacccaagagaaatatattatgaaaatatatttaactatagatttaatggaactaatttggtgttatagatattaccatatttatctacaaatttagttaaaattgaagtggtttgactttgaccaaaattaaaattactaatagtttgaaacggagggagcacgactttcaatataccttcctttttcgttaattttagggaaccagctccccaagtgccaaagagttcaaaaccatctatcctaaagcttaggaaagcaacacgcagaaaccccacgcagtaagaatactttaacttattatgttaccacaggttctgtttctttgtcagtttttttttaatcacacttttttttttaacagggaagctgaactgctaatggaaaaatccgctgcacaacttcccttttaagcagcctttgttaagcagtattcatatggtgcaatgctgcatttcttttactgacttgtttgaacgatgcgacattttgccaaaataagctttaaacctct

SEQ ID NO: 62717 - DNA, 4574 bp, Oryza sativa
  unsure (1)..(4574): unsure at all n locations
gcgcggcttttgattgcgattttgagatcagctcggnacccgncaataaaaaacattaacttatgcaggaagataaacaattaattaatcaaagttcacaaaccttggcagggtatccagcctttttaattgcagncttcaagagctcaagaccctccttgttttcctgcaatatcacacaacacaaacgattcaaaccacatgctaagtatattcatttagatttctaattacggattagcttcatacatcaaaacagaagttatctcagcatctaacatcaagccaattccaagcaaaacagggaaacattattgaagggaagcacttcacatggatcaacagcatagtggaaagaaagataattgaattcactgctgcaggcataagtacctgaatgttaggagcaaaaccaccttcatcaccaacattggtggcatcctgaccatacttcttcttgataacagactgtacagataaaattaattaattttcaatgacgtaagatggggaaaaggtttaaaatgaagatgaaagaattaccttcaggttgtggtacacttcaacacccatcttcatggcctccttgaatgaagcggccccagtaggaaggatcatgaactcctgcaatatagagcacatcattaaataactttatgagcaacacatagaatgagaaaatcttagttcagatcactgcctgcatggcaagcttgtttccagcatgtgatccaccgttaatgacgttgaatgcaggtacgggcaaaaccagttgcttgtttccagcaaggttggcaatgtgctgcaaaacagaacatattatcagttggcaaattcataaacgaatagataagagggcaataaattgcacatcttaacatgcagcaaacctggtacagaggaatcttcttgatgatagctccagctttgcaaatggccagtgacacagccaggattgcattagcaccaagctgcacatattgataaaagacttagtagaatccacttacaaatggtacatctacaattttcatgactaaggcccatgaccagatggattagataataccttctgcttgcaccacccccactcatttttggttccatcaagctgctgaaccatgaagttatcaagctcagcctgtgacgtagggtcctgcagaagaaatagagcatataatgaattctggatttagtctcaaaatacaacagaataggtgaaccatgagacaaaccttgccaatcagagctggggcaataaccgagttcacattgtcgacagcctgaaacaacagaaaaaaaatgtgaagaaacaaaaacaacaaaaataaaacattgtaacaggtaccagaaacaaattgattttttataacccatgaaacaagtatacatcatgatgcaataggaccagtatagcaagttgactaatttatttaagcagttaaaaggtggacaagtcataattgatttgactttgtctttttttagtttagccaagacaatatgactttctcatctgccactaattatttgatagagagaacatagaatctgaactcttgagtagtttaaattatagcacagcaaggaatgcaactaggaacatgctcccatggctacaaggaatttaaccaaaaatagcatttgtttggattcaatctccgatgctaaaatagatattatcaatagactcactttaaatgctaagagagcttgatgctggtgaagcaataacattgaataagggcaggatgttttatgttaaaaaatcaactgatctcttacatagttaaatatctaaaatagtttgcaacataaaaagtatcaaaggcaaaccttggaaacaccctttcccaagtaatcagatccaccgtccctcaattcgagagcttcatagacacctgtagattatgaaagagatgagattagcttctagccaaaccataatcacatcatttaagataatgtgaaaccatggttatgagcaaacaaagcaaaaaaaagaacatctaaataacccaccagttgatgcaccactgggaactgcagcccttgcaaaggttccatctgagcagcacacatcgacctgatgcacatatgtatcataaattatactagcaaccaaataacattttgtcgcaacagcatgaaaacaaaatgaaacatttactgtatacatggtaagagttggatttagaactatcgacccacatcacaattaccacacccacggtcaacaatgcttcgacaataatgaagccacgagcaagtgcaggacccacagatctgtaccatgcatccttcaaatccgtagaaaaatgtatgacaggtgggggaattcgtgcacggcgcagcatctaattgatctaggcgataaatcaatattcgcattaaatctaggcgataccttaaccctcgctttaaatccaacacaacagtcgttcactgtctccagatcccacctaccctccacaaaacccctcgcgaaaaggggttaaaccctgcaccaaattccgcaaacaaccccgcaaatcgcctaaacccccaaacaacctcgccggaaaaaacgaatccacggtcatcgcgacggcctcagcgccccccaccccgcgagatcgacggaatcaccacaccggaacggcccatctggccagatcgaagcagggaggccgcgagaggaggaagagatcagatcggcagcgggagggagagagaaagctcgtctcggcggcggtacgtacctcgacggtggggttgcccctgctgtcgaagatctggcgcgccttgacggacacgatcgtcgccgccatgggaggaggaggagagcttctagaaggttctagcagcggaggaatggaggaaggagacggggttggtgctaataaagtggggtttcgatgaatgcgagacatttagggcagaccgcccatttataatggagggtggtgagttggaagcagccctaatagttacggtcacgaggagggtcgacgtccagtgtcgctgacagtgggcccggtttggggtgggattggggtgtggtcccacgtggaggtggggttgtcgatgttctcgatgcggaaacttgtgggcgtgatggaaatcggcgccgccctcgcgtcgcggcccgccgatggaaggaggtcttcgccagccgtcggattttgaaaagttgggagagagaggagagcaccggtttcctggctggtctcgttttttttttcttgcttctaagcggctgagggggtcgtgccattagtacggtgggtccagccagatgaaagcgatggacgcgaaagccgaatgaagccctggcgcattgggcagttgacaagggattgagaatttgaaatactcaacggtatatttcaccgcgcttttatcacatggagccaacaacacattagacttatatgttagtgataaaagcacggtgcattgactatagaggatcctgattcgttgacaaaaagatttaagcattattagggaaacaattttaatcatcaaatcaaaaggaatgttcccttgtcatctgaaaattttgataagaaatattaatgattccacgtatactcaaaagctcttatattttgggacagagggtgaatgtgaatagtttttttattcatgtgtttggtcatggccacatattttttagacgatcaacaactaatcagtgtgttcgtttattagcgcatgagtaaatagcatcattgcaatctccacctatgcatgcgcctaacaccgaagtgactccacacctttatcgatgagatttagtttcaaaatgaagagggttttgttgagttggtctcagcatgatttgtgaatagaccgaagggagagttgttgcgtttgttgacaaatgaatcaatataacataggttcgaatggtatgtaaaggtacatccaactcctgttagaacaaataagactagaaaagatgtctaataacaacccatggaatgttttaaagagtgaagtaaatgaacagtacataaacttaagcgggtgtgatatctaggtcctgaactctcaaaaatatttttagtgcctaaacatgttttgggtgttatgcaagttcaaatgggtttccgtaaactaacgtggggtgccacgtagcatctacatattagtgcgatccacatgtccgtcacaaattgaacggttatacttcatatcaaagtgggtccagtagttgtaaattgatgataacatggaaacatgtggccatgtggggagaaatagaaattatttaatactccctccatctacttttctacttttgatagttatatttccaaatctgaaaaatttatttttgataggcatatttcaatccaacaacttatcatcttaatggctttcttgaatttaatgcgtgactcttcattcttccacactagattggctacatgggcatcgagaaatgtaaatattaatgaatcgtttgtttacgaggaatgactagtagcatatttaaatggatgataagtagaatcacttattcttggtctatgtgctaaaatgaaatatgactatcaaaagtagatggagggagtataacttag

SEQ ID NO: 62718 - DNA, 10148 bp, Oryza sativa
ggcgccgtggtgagccaggtggggatgcttccttacgaggcgcgtgaggtggcgatggggatccatcgggacgcggtggcgcaggcgcaggcgctgagggtggcggcggcgagcgcgatcgagtcggtgacggcgagggcgccgccgttcgggccgccggcggcgcggcacccgggggaggcagggcgtgggaacccgccgcccccgtgcgcggcgtgcggcctccccgagaaccccggggggaccatcgtctgcgactcctgcgagcgcgggttccacctcgcctgggtccgcgttggccgccgctcatgccgccgccgccgccgccgccggccccccccggcgcgcgtcggccccgcgccaccgccaacgaggactggatatgccccgagtgcgagatgcgtggcgcccgcaccaacaggtggaagctcggccccgtgccgctcgacatcaacgtgcccccgccgagcaccccggacgcggaggaccccgtcgccgtcgccaccagagacgtcaccaggcagttatctcagctctcatttcctcaactccttttgcttacggctgacttgatccgttggtctaaaaagtgctgaaaattcatgccgccttgcgatgaaatgctggtgctctgcagatggtattcttggtgggactaagccacacccgttagcgtgggatgacgctatgaacccttttttgttatggttgatgttttaattcattgtttgccatggttacagacttaatatgtgtgttacgtttatctgctctgtttgactgttgatgcatttggatcttagtcctgttgcatgattgatgccgaaatgactgggtttcaattctatagttagcactatgtggcagtggccttagtctttttatagcttcttgttatagtgattactaaatttaggtgccacactgttgcttgtctcttttcttcccaatacgctacgaaccagatatattgcactgtgcagatgatttgatgcttttaccctttgcttggtatggtcaatggtattatattctgttgaagtcttaggatcttgcctatgtcatttgtaatttgcattctcagttgattcaagtaggaacctacatgttctcttcatggcagattggcaggtccatgtagtcaatttgtagtttacttatagtccatattgattttctgttgtagtcttaggatctttcctatgtcatttgtaatttgcattctcagttgattcatgtaggaacctacatgttctcttcatggcatattggcaggtccatgtattatagtcaatttgtagtttacttatagtccatattggttttggtctagactatgggtcctcgtgtgttttgtgtacttggcttctggtctatccatgaatgcattagcttgactacatatgctccctactaacatggtaacacagcatagttctgaaaacctctagttggcttcaccaatttgctcttgccagttgccacaaacaaataaggcatgggaagagaactagagcactagtttgtattagttcccttctgttaccatattgcttttggtctagactgagtcctcatgaatccctattttcctagcatgttacaagagatggacggcatcaaagaaactctgtacttctccaccaatccgtagttggcatggaatgaatcaatgcttttgtttttttgggggttgctgctatcagaatgaatcagtgctttggtttttcaggggagagcccatgtaattgacacacttacacctagtaagctccctgtggtgtttgaattgcaatgccacttttggctaccttttcatcctccattttggatctaaagcgtgcaccatcttgtcgctgttgtgcattgatgacctctatcgcaccatttggacctacatggaaagcgataccagttgcgttgcattatcttgtgttggtgtttctagcctcattgcaatgaccattcaggtttccttgctgcatcttgtgctgtcgagttactgtttcatgggcagacttgtatcacttgctttccctcatgatatcacattctcagcttttctccattgaccttattctacatcctttggatttttatgtttaaaggatttttttagtttaatcaaagttacatggccttctatttttttttgaagccattccaaatttagaacatttggtgattatttccttggtttggcacttgccattcttatctgatctaatgatgtgtaccatgctcgttcttcttttaggttgatcacagtccatcttggaccgagttcaatctccactcttctgccgcatttatcatggcctgttatcatcgattcagtttttcacttgagtcctctttttttagccttcttctgatttgttgcctttgttgtgacttgactatcttagtcttcttttcatcaccatcttgctaattgttgccaccattgctgcttacaatcatcaccaccttttttttttttgcaattgttcggtgaatccttttatgcctatactagccagtgtgattgtctttgtctctatgctattggttttatataatagatttatgcatctttttttctacatttccaccaactttttagatagtatgatgtgaaagtgactgtcctttgtttgcgtacgaagacttccgttttggaaggctaacatcatgtagagaggatgttgtttgctcttccaacatgtgcatttgatcaaatagcagcatagtatggcttgctgcataattttgtagcttataggttttatgtaagagtacataccatttaattttaacttttaaggctacttggacatgggcaccttcgttagaaatcaacacttggatttaggtgttcgatttggcaattaaacatgcatattactaattagaaatggacatgattcaatttggattcaggtgtttaatttggtaattttttttttgacatgggtgtttgagtggaatagcacttcatatttttttataatttactaagggaggccatctttggtcctattattgtagtctaatgatctcatgatagtgatttgacgataaaatgttactgttgttgggctcgtaggcatatgggcctattagaaccaatcataattggcatatttgtcttgaatgaatgccaacagatacatgtcttctgtttatgtataggagatgttgggaaaatgtttgataagaacatggaataggagatgttggggaaatgtttataagaacatggaaaccattaaggaattggaagacataggttatcgtggcagccgaggtggtcaatcccaaagattaaaagttgcttttttagatgtctaatttcctttttccatgttatgtacttatgtagactgatatcttttgtagttatttctgcctcttataagctcttggtaggaggtattttctatcagggccccatgtttgagatagaacaatcaacaaagtagtactcccgcaaagtctatagtttctctccccatgtgcttctctccttcaagccaatattgtatgatctccacctagtacttaccatgttatgagccaaggctcaagtcagattaccgagtatccatattagaggagagtgtagattgtatacccattttctgtttctatctcattttgatgatctcttgtaccggtatattggctagggtcctagttggctatatatatcacaactgcccccctccccaaccctgcaacaggtgtgagccgttttccctaattctatctttctacatggtattagattcagagttcttaccttttccggtgccctagcgctgctgcgtcctcttggccatgcgatctcgcacaccttctgtacgttgacgacatgtctgcactccgagttcgccatgacagaccttggcgacctccatcacttcttcctctgcatctccgtcaagtgctcctccgacggcctattcctgtctcaatgacaatgcaccgtggatctacttcaacgagcaggcatggtcgagttctactctactgcgacaccaacggatgcacatgctaagctgtatgtcagagacagtccacctcttgataacccagtggagtatataggagtctcgccgatgctttgcactacctcaagtcgactcaaccggatctggtgtatgtcgttcaacaggtgagcctcttcatgcatgatccttgacaagcggattctccgctacgtgaagggcactctctccatcggccttcacattggcaccgacaaagtccaggcttacaccgacgtggactgggctagttgtcctaactcatgccgctccacatcaagctactacatcttccttggagataatctagttgcttggtcttcgaagcaccagaccactgtctccctttctagtgctgaggcaaatatcatgctgcaacccacgtcgccgtcgagtgttgttggttgtggcaattacttaagaaacttcatattcggccatcattgtctactacgataacgttagtgctgtctatatgacaaccaatccggttcatcgtcgcgcgaagcatatcgagattgacattcactttgtttctgagaaggttgctttggggcaggttcatgtgctacatgtcctgtcttctcaccagtttgcgtacatcatgaccaaaagcctacctatttagttatttactgattttaggtcgagtctttgcgtttgtgatcctcccgttgcaaatgcgggcgggtattggaggaaagtgtatattgtataactttttttttgtttctatctcctcttttcgaggatctcttgtaactaccggtatattggctatatatataacaaccgcccccactgttgggggaatggctccggatgacggagccggcctccgtcagtagggaaactctgcccggagccatccaccaagggagaatgaccgaaggcaacagctaccccgatgatcgagtccgactaaaggcttcagagccgaccaagggctccgaagcacatcaccaactccgaagctgaccaaccgccccagtgcctaccataggcttcggagcagaccaacggctccggagcagaccaacaactctggagcagatcaatgactccagagcgaatcaatgactctagagccaatcactggcttcggagctaaccaatggctccgaagcagatcgaaggcccgaagtgtccggggagctaaaatactcgagcgtggagaaatggttcacgagcgtagtggggcaccattaatacgcactacgcatccgccaaccacctctgacatcctaacaagggcaagatggcatccgctattatccgggggcatgcctttacctggataatagccatcaccctcgggaagcgtcatcgcttccttaatgggcgcagccctccctgtctctaggggttttaccgactgccctagggctggcccaccggccagccgctctacatcttatctagctagggtaaagatgtaacttcctcttgtaccccatgtataaatatgtaagcattgtccacagttagggacagattgagtacaaaatacacattgaatacactgtttggactttgttccaacacccaccatatatgtgaagagttttccctaattctatctttctacaatccacacttttaacgtcacaacaaccattgacaacatgaacaaccaccttcaataacattgcgtctatggtagatgatattatatcatcattggtcaagtgggttatgttgttttctgtggcattttaatagttgtgctgacacccatgccaactccatctcaaacgatcgtcttcggctccatcactggccttgtcaaagaaaaagaagactcttatcttgagttctcttggtgttgacattggcagtggccaatgggacatgccttatgtcatgttgagcgcaacatattgccaattgttaccaagtcccgcgattagtcgtaaagttggtcaagccacacgactagagtgccacgacttgactgaatagcaagccacacgattaatcgtggttagttgtaaatttagtaagagatgatcgtgcatatctctacttgtaaatgatggtaagacgaccatatatagaattaatcaataacataccacaaacacaaaacgtttctcacatcactgaagaacgtatagatttagacatattgaaatagctaatctttatttccttgatggacaaacaatgtcgaaccatattttagatagctacaataacataaaatcaggaagtaaaacacatacggatgaatgattggaatgtaaagcaaagtttccactacttgattggagtaaaaaatcggattggacagattgaagaaagtattttcttacttgttttgcgtatggagtttggcacgtgagaattgtagctctccgcacaacggcttttttagaattgttcaactagatccctgcaatttatttttttagaattgttcaattggcaagtgagatgttttgtcagattatatgtgctggaattatgacatcaaatttattagtatatatatatatatatatatttattttaatgatgtcacaattttcgcgtgccttttcatggagttggtagacttagtctatactccctagaccttaccctttatatatggcctatcatcctagactccttgcaatccatctcctcaattgaagtattgaaaaaataggtggaaaagaggaagggttaggaagagatcatctaagagagggaagggggaagggtgagggagagatcatctctaacttgcttcttcagcgctcttttgcaatcaatgctgaatctctcttgaactgataggacagcgagcgattcgcaaatctgtccatctggaggtatagatctaggcctgagtctaatttttttcgttttctgttggtggtacaggtggttccgtgaggattttggaggggttaatggtttgttgctctgttcatctggtgctttgcatctagggtatcaacaattatagatctgcaattctttgaggcgtttaaggccttctttggaacataggaattttggaggacttttgtgggtgttgaattagtttggtgaaaatcgtgtaaaatccttgtgatccataggagccctaaaccttcagcacatcgtgcctactggttttgacataacatcggaatttgtgtcttgctatgttgatccttctctggaactgttctgttcatggccttaaccatctgctttaatatgcttgttttaggttttttttttcatgtagtgctgtttggtatcagtggagaaaagtagggggagaataatatcagatgattgaaatctaggaatttgagttttgggaagatgattcaaatctatgttgattgcatagctacaataaaatgatttacctgatccatgtgttccaaccatggtcttattgtttgaatcttgtttatgtgctatactgaaagcgtgctgtattctctatagttcattgtgctgcaatccttccatagttacacatgaataatgatatttgtgttttttttgtcaagtggacctgttttgatcactattcacttgaaaaatctgtacaaaggaaaacacctctgatctcttgaaattctggtttgttgcaaagcaaaatgaaactgcaagtaacccagagtgtttttggctgctctgactaacattatctgaagtttttggaagttttctaatgatgtttgtcatacgaacactattatcactaattaatatatccttttgatctgcagaacaaatgctgcagatggagcgcatttgactgagtttgctgtgcagctgccacattttgaggggcttcacttaaagaacactgctctttatggtaaggattagagaacaatcatatctaggcaagagagatgtgtagaagcttttggctggaaatttactatgccttcaaagccctgtaacttttttaagaacatttttttgtgttaagtgataaccatcaacatcaaatcctgctagctgctatactcagtgcatagttgctcaagaaattcatcgtatgttgttttgctcagttaggcataacacgtgcttgtctgtaaacttcaacttcatgataattcccagaaatttgtgagccttaccaatatttgaattctcctgcatggtgttttatgctgtgtatcttatacctgtgtggcttcaaaggtgactattattggtgcagcttatgacaactccactactttcttgttgcagatgggaatcagtttatgccagcatttggtcttgctcattgtctgagcatgagacaacaatttacttccatggaccgtgatatcatggctgatggaaacatagtgcaaaggtcaattcatttgcgcagaaagagaagggatcttccacagacatcatcattacccaagtttgctgagaaccacgagcttggaagtgccaatatctttatggatccatctttttacacaaaagcaacagagtctagttctacagaaaacaaaagttcatcaaagcctccaaaatttcttggggaaaatagtagccgtcgaccacatcatcgtactgtgagtatcttattgtccattttatatagttctctatccactgtccactttagaaattgcagaaccacatgtacatgtaccatactaccatcctaaatatttactccctcagtcccctaatataagggattttgacattttacttgcattgtttgatcactcgtcttattcaaaaaatttgtgcaaatataaataatgaaaagttgtgcttaaagtactttggataataaagtaagtaaaaaaaataataattccaaaattttttgaataagacgaatggtcaaacagtataagcaaaatgtcaaaatcccttatattaggggacggagggagtatatgacaaatgtatagaagacatgatggctggtttaaattctgaaaggtttgatcaattttgacttttcgaggattaattgatggcaggctgtgttcgcctcccgcacacgcaaaacggagtgactcattttcttataaataattaagtactccctccatttacttttgatagtcatatttccaaatctgaaaaatttatttttgataggcatatttcaatccaacaacctattctcttaatgactttctcggatttaatgcgtgactctctattcttccacacaagattagctacatgggcatcgagaaatgtaaatattaacgaatcgcttgtttgcgaggaataactagtagcatgtttaaatggatgataagtagaattacttatccttggtctatgtgtcaagatgaaatatgactatcaaaagtagatggagggagcatttattattattattattttaaaaatggattaatatggttttttaaaagcaactttcgtatatattttttttgcaaaaaaacgcaccgtttagcagtttgaaaagcgtgtgcgcggaaaacgagggaggtgagttgggaaagttggggaaagaactcagcctaaatggatctacatgtacatgtgggaaatctattctcatatgttattttccaaaggcacagacttgtagtttctggaattgcatatttatatgttgactcctatactgaatttgacaatattgctttgttgtgtatctctaggttggcctacctgttcaatatagtgatttctttatcaccagtttgggagaaatcgataaaaggccaagctaccataattcctaccagatatggccagttggttttacgtcttactggcatgacagaattactggttcactgttcgagtgtgaggtgtgtgacggagggaattttgggcctttgtttaaggtgagaaggatatcatgttcagtgttccctcttccagatgcatcaacaattctctctcaaaatagtacaagaaaggctgagacaatagaaacaaatgaaaacaacactttgcttgaagatactgctaatgatacagatgataatatcttaatgctcctatcagactcttctgagaccaatcaagatttgttatcatgttttagcaatgatatggagagcaaaatgacttctttaggttgcaatgatttgcatagttcaaataggtcggtaccaacagtaccgtcacactctgggactgacaaaattggcgagtttacgtttgagg

SEQ ID NO: 62719 - DNA, 6448 bp, Oryza sativa
aattatatatggtgattaattgctgcgcgttagattttacatgccaatatgctagtctgcaacaaacaatccatccctaaaaaaagaaaaaaacaatgaaagaatcttaaagcggaattgctaggcctcttggctgttactaagtaattcattatctgataaaaaagcaaaagcatgaacttagcctctaatatccatttatttgtaaccacagatttacctcgccactataatttcgattcctaaaatcttagcatgttatatactccatcggtctcaaaataagttatttctggagttcaaaatttgtcccaaaatatgctgatttctatccatatttttatactgggtccacaaatagggcatttctatctattcaataccatttacctacctaccgtattaattctcttcatactaatttgaatcccgattgataggaatcaatttattatgagaccaagggagtacatcttgtgttccgccggtgataaatggtagacgaaaaatactatattgtccaaatatagatatgttgatatgatttgttatccatggaaaatgattgaaatttccatgtattgtcatgctaaatttctactatcatcgtcagtcggtatgtaaggaatgttgccccctgcatgtttaaatcctggctctgccactgactcgtagttggaactgataaggttgaggggctattcagttgaatgaacaagattttgatgcgtactgcatgaatattcggatacttgttggatggtaccaactagtctttacttttaaaattacagatttatttgcttattgagagggaacagttgagtcaaaagggctgtaatgctgtatggtgtgaaaacagctgcttgctaatttatctttgcccaatatcaacattttgtcagcctgttacacaaggttggtttccggccaaaacctcaagtgttatctgaaaccatatcttatgatggctaaacccttcagttttgttttatttgttcagtaataccacatgttagaatctaatttgaggtgcaaatagtagcaggggtctctactgactatatttttttatagatattaaaatctctttaactaatttcaaagattattatgctgagatgagcattatgtacgagaatatttctatttcattgtttcttgtgccctaccttctatgtccaactacccaatagttatagatgggtcaccttttttcctttgatactccagacatgaaggaaatagctgacaaggattctgaagaagctcaagatgaagataaacatggggataatcataagggtgaagttgctgaccaattgagcaatgatgaggatgttggtggacgtgaaaatgatgaatcaccaaatgatgaactcgacacctcattgcttgtgctggattcagttccagatgggaatgacaaaacccttgaattatttgtcggtggcttgcctaaggactgtgttgaagaggacattagagtggtgttttctcaatgtggagaggttgaatctattagaatagttaaaaagagaaagcgcattgcattcgttcgttatgcagatatcagtgccacaaagaaggctcttactgaatttaaggatggaatcaaggttttgattttatgatgctttcagtcctttgaatggtttgactttgaatcagtcgttgcttatggagtaatgatcgtattccctctttcatgttttcgttaggtaaatggcaaaagtgtcagagtatctgttgctgaacctcatagaaaatctagtgagcagaaggctcttacgaaggtaataatccagtgccagtttagcatattaaagttgttctctgaagttctatttttcttttccttattttattccttcaacgtttttttactagcacctatttgaaccattcaatggactaggctttttagtggaatcctgattcagaaacaacagttcaagcgtcatgattgatgacggcatagaaagccatgagagcattggtggggagaggaatgttttgtacttaaataaaacttaaaacattctttctagtgctttggcttggaagttattttgcgcttaatataaaacataaagcatgctattttttcttgctcatattgctatttctgtaggttaaaacagtatatctggaacattttcctcgttcttgggatgagagaaatatcgaagaatgctgtgaaggatatgggaatattcaaaaagttaacattttgcggtcaaaaaagaaagttgtttcttttgttgaattctcatcacggaagagtgcgttagcttgtgtcgaaggaataagcaaggccaagatcaatgatagggaagttaaggtattttatatctttactcataccactgttgaatccaatccaagtaccacttttgctttctttgttttacctaatttggctgacatggcttttctcactccatatctagttggctgcaagtcttgctcgaccacaatctaaagttcaactggccaatgagagtagtaagggtggtttcaatgtccacagtggtgcaacttctaaaagtcctgataaatctaaaatgaaaaaggaccagacagacgagactattgtgaagaaatcacagcttaaattgttgaaaggtgatgagagcaagctgccctccaaagatgatgtggaagtgccacaaacatcaacccattccaaaggaaaagcgaaagttggaaagcgtcaaaatacatctatagatgaaaggccatcaaagaaatcacgggagagtggtatgttctctctgtcaattctatgatgtgaattataatgtgaaatagaactcaccacgttaatttctgaaaggtgagagcaagctgacctctcaagatgaaggggaagtcgggaagagcaaaagtaaatctgtaaatgaaaggccattgaagaaagcatcgaaaaaccgtatgatctctctgtcaatttcgattttaaaattatttgattaaggaagtggttatcaataataattcaccaatgtaaactactgaaaggtgatgacgttaagctggcttcgcaaagtggtttggaagaaccacaaacatccaaccgttctaagcgcaaaaagaaagtccggaagaatagaagtacaacttgtaatgaaagaccagtggagaaaagcatgaaagaatcgtatgttctttctgtcgattcttcgtttaataagtgttgaataatggattgtatttctgatactttatattctgcaggaaatattaagcattctgcaggttctcgatatgtaactagccaccaagcttaccccactgtgggtgcaacttccagatctaaaccacattcccatgatttggtagtatagcacttcaagtttattgatcttgagttattgacattcttaattctaatgaacattattcttgcatgtttgttttggtcactgacgtgttcatgtttttaggcacctcatgctggattcatccctccttcaagtcgtgttcaaaggactcctgcacgtgatcaccaaaggttcattttttttttcagcttgttacttctttggttctgatcagatctaagcctcttactaatcctattatttccatgtttttgcagaactgcaccgtacaatatccgtcagatcagtggttctccttatgctagaggtacattgttgaaaatgattcattctgtttacatatgcatgtattaatattttagtaattatcccacatagtatgcattatcagtgagatgagttgcatctgttttgttatctttgtaataatctttgttttagttttatctggtgttattttcgtaattctattttgttgacaaaacttatcgtgggtctacctggcatatggtagactgtttgacaactgcaattatatacctggaataatttacgctatggagtacctacttctgtgtcatgccctctgacattccttttgtgctcttgtccacaacctgccttgccatggtcttgttgtggccattttgcttaggctagtaccagagtctttatcagtcacacatatattgcaattgaagtcttacaactgttcagtgtacaattttttgcttagtctggctactaagtgtactatatacataaaacagatgttcagattctgtagaagtttgcaatttatacaataattttagaagctagcaaagcttgtggcaccatctaggtttgtgaaccctcaagttacccttctatacaatgggcccttttgattaatcgtaactctagtttaatactctatcactgcaagggtcatatgaaccataatcatggaaattttccgctgaacctagcatcaaaagaaaggaataagtacatttattccctccttttgtttgagtggagttcacccttaactataagcagtcaaacttccatctcataactataaattctgccagtgtattatgtgcacaacaagatgggactcccagtttggtactagtgaattgatattacttgaaatctttgtagtctgtcattagttgtcaagaagatgctgcctaagttataactttttcacaactcttataatttgtagtttaattttcgtttgttccttttgccagaaagagtagctccgcgaccagcatattctgttcacacaagcaatgctgctggatacgaggtatgttgattactgatgttggcatgcttgtttaatttacactagaatatgagctagaattggttaagagtcaatatgaatacagatctctagtgcccacatgcacctcgtttgaaagtttatacgtgattataaataaaagatacctcctgaagaagttactaacatttatagtttctactttctggaaataatctttactgttctgcagtaaatgtattgcattccaacacaggaaattgcatttaaaccagatgagagatacagttcttgttacctatcaacttctaaataaggacaaaggctctctttggatgtttttttttccttgaacacgcaagagactttggatggttattggggctataaaaacttcttatgccacgttagaaatttctgataactttggtgatgcacatttaattattcttttacagcacgctagtaatttttctaaatcagctttgacaatcttttggaaattatatcatcatattggccatgctgatttttcctttttttttgttttttttttgtgatgcccttgcaggctggatatgcatacacctaccttcccccaccaccaccaccttcacctagtatatcttatcatccacctcctccggcaagtatatcttatcatccggggagtggcccatacatcatacgaagatactactgactgaaaatccaggtggctacagcagtcaacatgcctcaccatggtctcatggtaacatactttacagctcagtggcaaccttgatgctggaaatgtacaagtttaattgaattgtagatagttttgtttgtttctttctttgtgaaatcagatgtacatgctttggttgttcagttcaaaaatgtcgttctagggaaataagaacctgtgccttgtctcgttggctattaaaaaaggggtgaaaataataagaaatgcagaatgtctgttgttaagcatgatttcttggagggggcacagcgtggaactatttgtttgtaaattaatctttgactgtacgaaatcattgtccactaacagtggtcaaattagcatatactaccaaaccacgccctatcaacacagtggtagattttgtttgtggaatatgactactcaccattaaaaaaaaagaaaatactgattggattgctacgtatacgtcacgtaggataaaaccgctctggattgaggtaaggggggtaatttgtccggaattaaaagttcagggtaaatgatgtctggttttcgagtttagggggtaattcgatcaaccacgatagtttagggggtaattcgtactttttcctataaaaaaataacgttactacgtgcaagatattttcttttatccttgtcatttactttaatataaaaaaaagagagtaaatttcataaaactgcaaatattttgtacagtctattataaaactacatatttaagaacttttccacaaaattaaagattcagtggcttcatttatcacaaaactacaggtactttgcacaatatatcacaaactacagatttaagtacttttataataaaactacatatttaatatcttcatttatcacaaaactacaagtttagtgttttcattatcccaaaactacaagtttgagcattgttaaaaacatgtagttttgtgataatagagacaataaatctgtagtttcgtgataaatgaagaccctgaatgtgtagttttgtgataaacaaatacccgaaatctatagttttgtgaaataaattcttaaatgtagggtacgagctggaattcaaaccacgcg

SEQ ID NO: 62720 - DNA, 3902 bp, Oryza sativa
gcgctgagacctactttctcgcctgcctgcaagtcgactctagaggatcccccatgtctctttgttagcttggggttataacatgattagagtttggactaggaattacttagccatgcttagttcaactagttcacaatggggaagatcttattaatgattagactgttggttctaatggttttgttggattagtgccaccgctttggtggtgcatggttttgctggtcgcacccatggcagttaaggaccggttcgcgggatgccctggaaaaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggacttgcccgctgccttgcgaggagtgggggtgaaacctgaggtgtggtgtgcttggtcagagggggttatgcgaatggtcctgtcacggcctctttccggtatgtcgtggtggcatgtcggcgcacggaaatgtgtcgtggggctgtgtcttgtgggtacagttgtacatctctgatcagagtaaaactattcgaatagccatgcctgcggttatgggcggtcaaccagattcaccgtgattagtctcaccctagtgtaatcttttgaaattggatagtttaagtggatggttgggcctgtcgcaacgtgggatagcgttggacagtggatagttaatattaattaattattacaactgtttaatctttcaacttctgtttataaatgctcgctttatgcaaatgaaccactttagctcttctttgatgattccctgcatcatgcctctattccggtatgacttgctgagtacagtgggtagtactcagtcttgctctaattttcccaaccccagagcacgagtatgtgtcagacgaaggtttctccgaggagtaggcttcgtccgtgccgtcgaggatgcctgtggagtggtgttcccgctgcagttctagtcaaggcttagcttctgttgtctttctttctttccgctgcatttatgtaagacttttatgatgtttgtaagacgtggatctgaatgtcaacattgtcgtctgtgtaccccggccggtcctggacggggattttaatgcacattctgcttggaattctattcgggaatttctgggcgtggcaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagtgagatttgtcaaaaacaagtcagtccagggttttagtaaaactgttgagatttattcgtcagtcagttgggatttgatgggtgaaatgcattaggtcctagctcaagaacatgggtagcaaggtatttatgctcttattgttattatagtatgtatctaatttccccattattttatcgttatgtgagtctgtcttatttattcgctctcatgcaaaatgatctatgcataaaatttcgctcttattcgattcgcttatttgagtcttttattgctttatttaaatttggatttgagcatgcattgatcctactcctttgtcttctctagatggccggccactcacccaaccaccgtggagaaggcatgatcgactttgtggcagagttggcacgtatgacactggtggtgggctaccccaacgcgccagagtacacgacggttccaccgctcagtggcgagcttcctcaccgtgttcgcttggaggtccacggctacgtgggtacctgcctagctaatatggtggttgaggcatctggaggcacagcagatcacgcctgtcaggaggcagcatacctgatgatggccagactacgggagcgccacaactacatcttccacgacacggcgtaccgatttcaccctcgtcgagccagtggtgatgatgtcagtaccttccgtccgacagccggcgagaacgacaccacctttggtcacatgtgtgctgtgatgagaggattggataggatgcactcggacctgcacaaggcgaccaagggccttgaatgatgggaagctcatgaggatcgtcgctctgaaggacgagatagcgcgcctgaagagggagaatgctcagttaaagggtcttcccgcgccaggaggagacgtggatctgaatgtcaacattgtcgtctgtgtaccccggccggtcctggacggggattttaatgcacattctgcttggaattctattcgggaatttctgggcgtggcaccgaacctatataaaaatccatgtctccatctcttttacctcaatctcgcatatatcctagtaccaacgatccccatattatgcaaataccggaatcgcgacatcaaacgtcgatagaatctttcaactcaaatttaagttgaaagtttttgaaatttaagttgaatgcttttgaattttgagatgaaaattttcaaatttaaattgaatgctttgaattttgagatgaaattttttaaatttgagttaaaagttttcaaacctgagttaaattttcaatctcgacttgattttttttaaatttgagtttgatgttttcaactctgagttaaaaattttcaaatcttcattgaaagtttttaaatcggagttgaaaatttcaaaaagttcaaaatctttagcttgaaaattttcaaacccaagttaaaagtttcaaacattaatttgaaactttttaaatcctgacttgaacgtttaaatttaagttggatgtttttaaatctttgacttgaaaatttaaattttaacttattagttttcaaatctgagttgaaagttttcaacgagtgaagagaaagtagattggataaggtgtacgctgcttcgctcacttccgtatgtctccttcaaatagaaacccctataatcgcagctactgggatgagggcctgtttagatttcttggcaaaattttacaccctatcacatcgaatgtttggacacatgcatggagtattaaatataaatgaaaaaaaaaactaattacacatattgcgtgtaaattgcgagacgaatcttttaagcctaattacgtcatgatttgacaatgtggtggtacagtaaatatttgctaatgacggattaattaggcttaataaatttgtctcgcggtttataggcggattctgcaattagttttgttattagactatgtttaatacttcaaatatatgtccgtacattcaatgttacaagctaaaactttagcagcatatgccatgctagccttcgtactactactttgtaaggaatttttttttcagattagagtttctatctagactctattttgggcctgttcactttgatgccattttcaaccttaccaaattttagtaaagttaccaaaaatatggctacatttaatttgctgccaaattttgttaactatataagaaatccttaccaggttttttttagcatcaaatttaacaggcgcttggatactgaaagattggaattcagttttctaccctttgcgaatttgcgaatcagaacagcaaaaacctaagcaaaccctagctccggcgatgcctcccgctgccgccgcggaggcggagatctccccgccgcccccggcggccgacgggggggccatagcggataccgcggaggctggtgtcgcggctgaaaaggagagtgacgggatggaggtggaggatcgcggcgaggtggtctcccaggaggccacggcggtgaagccggatgaggcggaggagcccgaggaggatcttgg

SEQ ID NO: 62721 - DNA, 71749 bp, Oryza sativa
  unsure (1)..(71749): unsure at all n locations
aaatacatacgattgttgtgattaaaattttacattgtaaacaaataaataatactgctccagtattttcgagtaattgatgaacggattaacggtggcacgttgtcaagcttttaaattgtgcggcttttaaaactttctatataaaaattcttctgatattgttttaattttttatggtaatattgttttaaatttattttaactttataattaattcattcatccatatccttatataaatattaaaaaatcatgaatttgctgtttagtgtatatccaagtactgcttagtactagtatttgttactccctccatcccctaatataaggaattttgacattttacctacactgtttgaccgctcgtcttattaaaaaatttgtacaaatataaaaaacaaaaagttgtgcttaaagtactttggataataaagtaagtcacaaataaaataaataataattttaaaatttttaaataagacgaatagtcaaacagtgcaagtaaaatgttaaaatctctcgagaatggagatgttaaaatctctatattctcgagaatggagggagtagcttcacgagaaaagaacgtgaccaacctaaatagacggcacgtgaccaacctaccaaaggatataagtatggttagctgcaggcgtgctagactggtgttactgctagtgtggctcgacgagaagagttgaatgaccgagacgggagcttatttggcagacagtgaccgaccacgacgctctgctgtgttcgaaccacacggttcggaacactttgtccctataaaaaaaacagagtaacccttatcacaagtgatgattaaaatgactttaaaaagtaaattaatataattttttaaacaatgtctttattaaaaaaaattaaaatacacaccgttttgccaggtttaaaaaacctttgtataaaatacaatctctgtcacaagataaaccaccctcatccaatacaagttggtttatttttctgttataaaataaaccattctcgtttggtacgtgttggcttattttgtgaagaaaggaataaatgtttaatttcggcggacattgaccgaccacgacgcatgcatcacgcatgcagtggccgattgcaggccggacaaacgtccattatattttattgacgaattaagctgacggcggcgggccagctactattccggccgcctacgtccgccgtgcgtggcctcctgtgcttcacgatgcagcctgctggtggtgccctgtaggtacgggtacctagcatctctatgtggcctcttccgacgccccgcattcgcaaataagggcctgtttgttacagctacaactcctaaatataaatataactctaggagttgagtctggagtggatttatggagttgcctaaacctatctccacaactctaatatattttgtgagagagctccacccaactccactctcaattttagtggagctgaaactgtttggctgagctccagctccagaagagatggagttggagctggagctgtaccaaacaggccctaagccgtcgtaccgcgtacgcgtacgtataacctcgcgtctttacagtctacaactacaggcagcaaagctatatacagtacacgttcttgccctcattgccacatagtacaatgtacacaaaaccccagatcgaatctcacccttccttcttactccacttactattgctaattaattctcaacatgtatatggatgatcctgaatattctcaactggatatatacattgatctgatcaactagactagagtcactattaattaataatcatcgattaattaagtcctgttaattcccgattctgccctccgccataccaagttaccaacccacggcttctcctgtacttccattcgactccctttatatatatcatcagtagctccatacttgagcatccttgatgcttccctttcctccagcagcgccattgctactgaatctgaagcaccaccactccatctccattgctgcaaactacaagccgccactaattaattagcaaaatggagaagccgggtgatgatgagaagctgacggttcctctgttggagcctaagccggctacctacaagcatcaggaagatgatgatgcagaggaggatgaggttggatcggtgaggcggcgagtggtggaggagaacaagaagctgtgggtggtggcgggtccttccatctgcgcccgcttctcctccttcggcgtcaccgtcatcagccaggcgttcatcggacacatcggcgccaccgagctcgccgcctacgccctcgtctccaccgtcctcatgcgcttcagcaatggcatcctggtaagtcatgccgctgattccctttttacttattattacagagttatcattacacagttttgggtttaaattattattactacgttgtaacaattcaaattgatctttctttttacctgtttcgtgttttcggcaactagctgttttttatttctaaaagctgactttgatgacgttaagttttgacttaattgtgccgattcagagactaacagcgccgcgcgcgctggaagttttttgttgtgctttaatttgcccatcgattaattgagacaaacaatggatgttcagttgctgtctttataggttcaaaacagagtgttcgatcttgtccagcattgttgtactatagctaagaagctataggctcgattttttttttaaaaaaaatggatatagtacatactgcaggaagaaaattaatcatgtgagaccttgcctccttggattttcaaagtactagtaaaactttgaagtagactcttgacctagccatccttcccttgcacggctttctctccagacattaattagtacttcctccgtctctaaatacttgacgccgttgacttttttaaatatgtttgaccgtttatgttattttaaaaaatgagtaattattaattattttcctctcatttgattcattgttaaatatactactactactcaaatttcttaataatattcacaaaagtttttaaacaagacgaatggtcaaacatgtttaaaaaagtcaacggcattaaatatttagggacggaaggagtatatagcatctacctcatgtattctttttgccgggtcttttttcatgtgtattcttgttggatcttctgatatatattttttttcttcagtaattaaagtagtttgtactacctctgtctactagctgtgcaacaatagcaaaagtctttacctagattttttgaacggaatatacaaataaaacataaccagaccatactacaagtcactcctatgaaaacttctttttactaaatattaatttgcactataagtcatctattgatatgcatataaaaacagtatatactacaaattaaccgtatatgcacattgttgtaaattgcagcttggcatggcgagcgcattagaaacgttgtgtggacaatcatatggcgccaagcaatatcacatgttgggcatctatctacaacgctcatggctagttctcttctgttgtgcagtcatccttctcccggtctatatcttcacaactccactcctaatcgctcttggtcaagaccctgagatctctgctgtcgctggcaccatctctctatggtacatccccgtaatgttctcttacatatgggcattcacgctccaaatgtacctacaagcgcagagcaagaacatgattgtcacttaccttgccttcctcaatcttgggattcacctcttcttgtcatgactcctaacagtcaagttccaacttggtcttgctggggtcatgggatccatggtcatctccttttggatccctgtgtttggccagctcgcttttgtcttctttggtggttgccctctaacatggacagggttctcatcctctgcttttactgatcttggtgctattatgaagctttcgctatcgtctggagtgatgctttggtaagtaacatggttatgtttatatgtatatatgaaatttttgacaaaaaaaattgatgatagcaaatagaaagttaatattttagatgctaattgttaatcaagttcttttatacaaataattagaagctcattaatttattctcatttttcttttaccttttcagtttagaattgtggtacaacaccatattggtgctcctcactagttatatgaagaatgcagaggttgctcttgatgctctttctatatggtaatatattccactccaatctgttgcatattagtttagaaaacaacaaccagatcatattgtatcatgtatatcattgtattgttttgtgtgtctcctctagtaattgaaaaggttgcttattgaacattgttgttttcacttgcaaaatttgtagccttaatatcaacggttgggagatgatgatttctatcggatttttgtctgcaatagggtaacttcacgatctcagctgtcactcactacgtggttcatctaactgatgcaacatgaaccataaatttgacatatacttaatgcatgtacatttttagagtgcgggtggcaaatgaacttggagccgggagtgcaagaagggctaagtttgccattttcaatgtggtcaccacttctttcttgataggatttgtgttgtttgtgctcttccttttcttccgtggaagccttgcatacatatttactgaaagtaaggcggtagcagatgaagtcgctgatcttgctccccttctagctttctccattttgttgaatagtgttcaaccagtgctctcaggtatgttactccatttgaaggacaagtatatatcaaagtaattcaaaatttaacaatgaaattactaattttctaattatatataggtgtcgctatcggatcgggttggcaaagtatagttgcctatgttaatgttacatcgtactacttgattggtatccctcttggtgcaatactaggctatgtgctaggatttcaagtaaaggtaaggaatttttgtatgatagaatttcactagttaatctggatttaagttgtgtccctcacttatgttcattctttatgtagggtatttggatcggcatgcttcttggaacactagtccagactcttgtgcttctattcatcacacttaggaccgattggaaaaaacaggttgccttttttttacctctgctcatattttctttcttatcctcttttctgattaaatatcttttttcaaataatataagggtctctctagaaaattcatgggtcattagaagagcatatttttctcatttaatgatgtgcttgatgtttaattttttttcaggtagagattactcgagagagattaaacagatggtatatggatgagaacgggcgatcacagaattcaataggaaatgcatgatctaaaacttctgcacacttgtaaagaattttgatgatttatgaatcaacctgtcaaaatgggattgtgctcggatttaagattttcaaggtttgaactttcaaaaaattcatcaaggtcacgtatccaccaaagaacaattttaatcatatggcttgggatgatggcttttccgccgggaaaagttattgtatatataccccttatcctattatttcaccaagcccttgcacaatgtgagctttacatgaatttttgtattaattagaaagagcatttgtatgcttccatgtaagtcgattgtattcactatgctttattatctatcgtgactaaatttattgattgaactatcaaatatgagaaacagtcaaatttcaccaaaacaaaacagagagaaactggccattcgtgttcttttcaaattctagctactagaccatagcgatcacacttttcaaaccattaaacactttgtttttttttaaaacaaaatattatataaaagttttatagaaaactcaaaaatgatcattttcaatctcaaaaaagaccatgcgctaattgagtatcggctcctataagcaaatcggttaatccagcaaaaagctatatcaaacgggccattctggcatagtgttttgtaataatgtttcaattttagagcatctccaagagataaccgatcatgttacctaaagctatattactttggaaattatgtctaaaacacagcctccaacatatacccaatcatggccctaatattccgacacgcccaattctatcaatgctctggcgtgactgattgacctggcagctaatggaaccctcacgatacccttccttgccccgacagctggcgcgcactcgcgtccaccttgctgacgcgatggcccagtgatgcgcgatcgcccaaaacctagcgctcgcaggtcgtttgcaacgtgacaaaaacgaaacagatcgctagaaacaaataattgaaggagagcccacctaagatgacatgacaaatttctaacattttgcaaagggcactgctattgctagagaggcatgattttcgggcctattttttaggaaaaagtttgaattacgcttgaactattgtggcagtacgaattatccatctctatttaaaaattagatattcttcaccctcaactttttatacggacgaattatcccctgacagactccggaatgctagcggttttggtcctacntggcgcacatgtaccattctaatcaccattaaaatatatatatataaggtagagcccgcatgtggtgaccgagaaaagaagcagaactgacaagtgccctaccattttttattttttatgctgactggactgccacgtgtgtgccacgtaggaccaaaacttctgaagatgaagatgaagattaagttttttacgtaaaacgaggcggtattaacgtatgattgattgagttttaattattaaaaacttgaaaaatagattaatatgatattttagagtaactttcgtatagaaagttttcgcacgaaatgcaccgtttagcagtttgaaaaacgtgtcacaaaaatcttaatcttcatccaactttttgttggagaaaagaacacgtgcttgccctccttgccacacgatccaactgttaattcctgttaatttgatccctcgttgtccgagaatcctgatcaggagttacttacatagtacagctaatttccccctctgccatccctacctacccgccatctgcagaaccatataatttaagggcaatctctcacagcaggttgtgttagagagaagagtattagagaaggctgaaaatatgcgcaaaacaaaacaagtcgctaacacataattaattgagtattaattattttaaatttaaaaaataaattaatataatttttaaaataactttttttatgaatacatactagcagtttagaagacgtgtggatataaaacgtgagcatcatgctttcctttcgctgcagccttcccttcttcaattcagacagctactagatagcagaagatatgatttgatgcaattgaactatattccacgatgttgaattaaatcgtgagttagctggtacgtagtggtggtgtgctgccgatgggttgacgagaacaaggtaacagggcatgaattgatgaataggatggccattttttttattattaaccttttttgtgtttaaattttaaataaacatcctaaaacttatttttaaaatttaaaacttttaaccacgccatcccgcctggcataacgaaactaaactatcatgttcatcctcatttgacttgacaatagtatttcaccacatcagatcagccaatacaattaaaaggtctactccctccgtcccagaaagagacgaatcctggggggagagctttgtcccgaaaaaaaccgatttctggacagaaaacgagaaacttcccatctatctcatcctgtgtgggccataggtggaccgcgtatcctctcgttcacaccacgcaaaccttatcgcatcccagttttttttctgtcgcgtctctctctctctctctcgttcctcctggatcgattccatcgccccgtcgcctctctctctcgcgtttctctccatcgctccctcaccccctcccggatcgattccgtcgaagcggcggcgtccagatgagcgacccttcgaagcttccgactccctccctactgccgtcgtgctcctccccacacatctctccccgctccacgccgctccccctcacttccgcaactccctgcggagttccccatccaccaggatgcgggcgcttcgatacagcgggggagggttgcgagcggttagatccgatgccggaggcggctcctttcgaaggatttgcctcgatggcagagttcgaggcagcggcggaacagtttagggttttcattcaagagacgaaagccaaggcggaggaggcgtatcagcttgcggttttgatccaaaaggcggcggcgggagggggctcagatgtggcagcggccttggaggtttgcaagaaggcggcggaggcaacggcggcgggtggagccagttcagatgcggcagcgacatcggagatttgcaaggcggcagatgtgatggtcaaggaggtggcggcgcgcgcggatctgatacaggaggggtcggcggaggaggaggcttaccgacctcctgttctgattccggtggcaacagctagggactttggcggcagtatgcgtggattgactcaaaggtatcttcaccttgttttccctacaaccaatctgttccccttatgcaatgagagatgctttcaatgacgtgtgtagatcagatgcactgggtgcggttgcatcccaaaatttttttgattgtactgcatagaatatcctaggttaatgttattcggtgttttgtatctttataatcatccagctgttatatgtcggtcagtgttaccaatgttgaagtaatgcgggttagctgggttttacattttgttttgtgcaaaatttggcatggagtgagaagggggttatgatgacatgtttcaaataaaataaattagtgttaacaaaaatccaagcagttttaaacctaaccaaagcattcctttctgttttgttgcccataggtatattctgaaattagaaatttttattgagtataggaaacaattataaactgtaagaaatttgatactgaacatgcgaattttatttctcaaagttttttttgactgctttattgctcaatcaagaggctgatgaaaaatccaaaattgtggtgacactgtaatgcatgaatattaatacctctgtttttaaatataaaacattattgacgtgtaggacatgatgcttgattgatcatcttgtttaaaaaaactaagtatatatggttaattattttgttctgacttgtttcaatatcagtaaagaaacttactcctgaatgcagctcgtcgtactcgctttgttggctgcagctacctagccagcgtatgttgcttgcttgacttgttcattttaacactgaaacctatcgttgagaagcttcaacttgctccaatagtacaactgcacccacagatagttaggctgtcattcatagctaattaaattaactaggtaaccttgatgttgttctacgagaattaccgtggatgctatactttgatttctgcaaatctttttcgattgttatacttctattattcactggatttgatcctttaactaggccacgcatatataaactgatgtactctacttttggctttcattgcgttcagtagtccatttggtctatacttcaatttagacattgcttatttacatgggtcagcactatctttttaaaaaaatgtatcgaatatataatgtaatcgaagtacatttcagtttgattccatgatagattcatctttacatcccatcttgtattaactgtcactgtgttttatccgttacaggactatgttgggagatgatagcgaccacatggccatgttcgagaagaaggcaagcgtcacgcaaactgacatgaaggagaagaggggaaaagctaaagatgttagcatcgacgaggacaagtcaagcgatgatgatgttgatatggtcattgggggatatgcgcaagatccatacgatgatagcggcctagaagaactcctacaagaccaagacgcactggaaaaatcggtaaaaaaatttctagagtgttttcatagtaaaaaatttagatgaatgcttcaattatgtgttgattgtgtgcctgtttggacttatgaatggtggcctaacaaagtacctcgaagtaggtacccttttggtattgtatgaaattatgtgtaattatggtagtactttagattaggtggttattgatagcagcctaagaaggtatgttaaagtaggcacccttttggtattgtatgaaattatgtgtaattgtggtagtactttagattaggtggttattgatagcagcctaagaaggtatgttaaagtaggcacccttttggtattgtatgaaattatgtgtaattgtggtagtactttagattaggtggttattgatagcagcctaagaaggtatgttaaagtaggcacccttttggtattgtatgaaattatgtgtaattgtggtagtactttagattaggtggttatgaatagcaacctaacaaggtatgttaaagtaggcacccttttggtattgtatgaaagcatgtgtaattgtggtactggatgagattaggggattatgatgatgcatgtaatgttgattttacattgtgacatatatataaaactccctcgttcccttttgatcagcgcataagtaaaactaaaatgttccaatttgatcaacgcattagcctaggacggtggccatgactcttagatttgcatgctgatttaatttttgcatgcatgcaaggagacgctagccattcatttcgcatactaggcactagttttaataaaaaaacggggtctctctctctcttccgttttgcatgcaagtaactgaagtgctaattgtgccttttatgaggtgggctttaaatgataatgggagaaatttacttcaccttggtctcgctgcacgattgcaatacgtcgatcaaaagggaacggagggaggatgaaatttaggcaaaagctcaaaccatgataaaactttccacatgacatgatactcaaatgctgatactgcattgtcatatatacaatctgaaatgtagccaacaaaagctgaaaccatcataaaacttcatattacatattacaaaagctgaaaccatcatagaacttgccacattgcatgattagttgcatttacttgagtaatactgatattactttatcatatatacaacatcacatttaaccaaaagctgaaactacgatagaccttcccattttgcataatttactgcacttgattggctaatgctgatatgaccttttcatacagttcacgaccacaactaagggtattagggagaatgtccagacgctctagcctctctttacccatatgaggtattctgtatccatttccaccatcagcttccataacctctaacaagcaagattgtagtgttaggaacaccctatttagcttgttgtcatcataggcctgaaattcctgctcaacattatgtattagctcatccatattcctagatatccttctatatgttaatgattgtagcgatgcaaagaacccaagatctaatgcattcatatctggggaattaggaggctgatgcataaggcggatgtcaaaccctgtttgggatactgcataggcaaattgataatcatccactggcacatgagcaggagcattgtcttgctgaatccatatagtgctgtgtgcatcgtctcgaggccaacttgatataatagctggtagtactttagcaatcagaaacgaccttacggtgtctcgatcaaccttgattgtcttggtgactagagttccccttggcctgttttgacttgtcctttgtgctggttcctatgtatataacattaagtaagttagataagcaattaagtttcacatcacatcactaagtaaaaatgcatatattaagaggttataatacctttttggtgaaaggccacaagcctatcttgccgtcaaaagtgcagataccttcttcattgtatctaggcctagcaactgctgccaagaacatcactttatcaatagaattcttgttttgcacgggtctgtacggatcatcctcccaatggaccaggtaaaaagttcttgtctttttagtggtattgaaccatttttcatcgatgtgcacaatgttgcgcatatcaacaaacttcggttcatttggcaaagtatgccaatctaacatggaaatacaccattgcagccttgatcgtttgttctcttccttcaacaatggctttaatgtgtttgagtgacgtcttatcagcccttctttcaacatcctatgaagcgtgctttttggtatacccgcagctgatgcaaatgaccgtaatgtgccccttagttgcaggggggcattagcaacatctgacaagtcaatttcattcttcttgcgaccagaattagttttctttctagaacttacattgactggaattccctgtgcacggcactgctttgctcttcgccaaatatcttgcactctaccccttttgatattgaacatttcagcaacttcagttgttgctttttttcttagtcttccattgatagttttcttaaccaatgcatcatatatctcttgcctttgtatgttggtaagatttttgtttggatgttcatcttcctcatctgaatcatccaactcctcttgttcaaaaacaatttccacatcaccagcatacacaccgtactcctgcatgtctacaacaacaattacaaggtgagtcgtctgtaccaatttagatggtggatattttattatcatggatcaacatggttgtaaacttatggctgattttagatttcagaaggacatagaaacattgacacaatttactttatgtgctgaaatgtcaaattgacagtccataatttgcaactaatgcatccaatgttatgtttagattattctaggtagttcgcatgatgtcatattagtatcttctaattaaaaacatggtttcagttaattaatcttattcttcagtggtgctttatgtacaaccacattttattaattttactaagtttgttatccatgtcagctaaaagtgctttacctgcttgcatttgtagatgttcctcataggcatcagagttaacatcaaaaggaaagccatgttggttgtgacctccataaatttgcagaatttcatccatggcatcggcaccgtctacaataacaattaccatgtgagtaccaagtctaatatcaatattttgttaggtacaatactattgcagctattttattacattctacaataaaataattatgggccattatactcagatagctcacacattgcattattacaaccaatcattagtgctgatacttgctatttgacatgccatgcatattggcctaactggatatgtgtgactaaaagtaataatgcttatactactcttccaatgtagccaaatacttctatgaataactgatctgttatgctatatatataatggaaccaatgattaatataggttactttgtgcagtacaacatcagcaaaggagattatcatatctgaaaaccacaatcaaggtaccaattttatatccatctcaaatttagttttgttgtctacctattttgttattgtactcttcaccttgtttttcaatagaggtccatgtcagctgtaaataaactcatggaagtgctcatgtttctttttccctaacttgtgctattcatgattgtgattttatcaaaaggtgcttgtgctgtagtcaggagaaccattgggtattttgctgctctagttatattatggccatacttgaatgacttttctacattgtacaaactttggtgctgaagttcagggatttttgtgatctgtattgaaggtgcaatctaactttgatatatactaatactagctcaatatcagtggtactgtaaaggaaattatacatgtagaatctagcatatgaggattgatcgtagacagaagataagcatcatgtgagcactatttgattagttatagctagatacatgtataacttgtgatattatggaagggaatgaacttcaatatgcccaactcattcacagaatcgagctggtaaagaacaaagagaaaaaaaaccaagaacatagcagttccatcaatgcacatggtatcttttttaaaaaaaaatgccaaagatttagagtgatttatgcaagtcatatgtacaaagatcgatcgtttactattcttgcttgcaaggtcacctggatggttatggttggcacctccctgtacatcacctccaagttgatcctcctcttgaccaacatgcatttcaacttctgtagccactggttcattaaggtcaggcacatcatgctcatctccctcatctgccactggttcattaaggtcaggcacagcttgctcatctccctcatctgctagttcatttagatctaaagccatgaaggtggtgtttttgcagactcatgaagtgataagttgggagggaaacttgtgagaatggttcattttgagcttttatagggtatcttgtgctggggtgtgctcaaatttgtatttcttgccgccaagcaatggtgttgtttgattcaaattagttggcgcgctggattagtggcctgtacagatatttggtgcccatgattggtgtactacttgtactactctactcaagttggctgcagatattcaacttgtattattattttatttgtaactaatgattggatgtacttgtattgagggcattgttgtcttttgtcacttgtcctaaagttgcattgggattctagggtttgtgattttgtgggacggagggagtagttttgaaattaaattttgtaagagttcatttttaaaattcaaaaaaaataaaaaggttcgaaaaaaagttcatcgatggccgacacgagacggcgactcgatgtcgatggtgtctccatgcaatgatgtaatgtttcccttcccgtgatctcctttttccgggatgcattcgttggcatcgttggatgatgaatcattttttgtagcaaccactttaattaatttggcagtgagccagtgaccgtgacgcagatacatgaggatgcactgatgcagcacagcagcgaggccggacaaacataccatttatcgatgacgttgataccggtaggccacatcgctgctagtagtactacttatattactccattcatccaagaaaaaaaaagttaaattctaattggacttaaaactgatgaagataaaagttacgttgatgtatataaaacgaaaaagttattactcactccgtattttaatgtatgacgtcgttaactttttgacaaatatttgatctttcgtcttattaaaaaattatataattatgatttattttattgtgatttaatttatcatcaaatgttctttaagcatgatataagtatttttatatttgcataaaattttaaataagacgaatggtcaaacgttgattaaaaagtcaacgacgtcatacattaaaatacggagagagtagtatatagttaattaagttttaattttaattattatagacttgatcgctcctcctcctccgtacgcccggccgtgcttcatgatggtggtggaggtacgtggtggagattacctacagtatccgtcggaaacagaatacgtatgacttttaaaagagaaagtacacgtgattgccctcctcgccacatgctgacatgcattatgtttacacacaacccctgcctgaatcgatgatagtattcccacacaagataaagataaaagatgatgatgatcaagtgtaaaataagttgatattaatatataattaattgagttttaattattaaaaaaataattaatttgatattttagagtaacttttatatataaaattttcgcaaaaaagcgtgtcacgagtatccaaaattttatctaattttttattggagaaaaagaacgggacttgaataattgtttattaatttcttcccacactgccctccctacctacccaccatctgcagcaaccacagggccaatcatgtacttcctcgctcgatcgtctctggccccgccattaaacggtagatggggagacctgagcatcatcgatggatgctttcttttccctccctgcagccttcttcaattcagacagctactaatatctgcaactcaaagtattcgtactcctgttaactccatcgatctccattgttgtgcactggagagctagctagctagcagagtagcaatggagaggacgacggaggatgatgagaggctgacggatcctctcctggagcctaagccggcgatcaacggcggcggcggaggcagcaacgaggaggaagaagaggttgggtcgctggggcggcgcctggtggaggagaacaagaagctgtgggtggtggcgggtccgtccatctgcgcgcgcgccacctccttcggcgccaccgtcgtcagccaggccttcatcgggcacatcggcgccaccgagctcgccgcgtatgccctcgtctccaccgtcctcatgcgcttgagcgtcggcatcctggtatgcctgatgaacgctgattattcttgcttatacggtagtacgtagtactacttaatttaattacaggtacaagttagttttcgttagtacgtgtaacagttcaactcgattttttttcacatgattagtctttctgcaactagcaacatttaaagacaaaatttgatacatgatattcacaaattatggtagtaattaacccttatttactaatacgcaccatcaaaacatggctttgtacgaatacaccttaaaacatcgatctactccctccatcccaaaaataacctaatcctacccaggattagttttttttcttttttgaccgaggaagtactcagctaagaaaagagaagacatacaaaatgtcgattattccctctagtcttcactcttgctagggttcaacagcgagagagcagagagactaggagatagggatacggtctggttttcacacctgagagggctgggctattctggtcgttttcaaatatgctaaaaatgataaaataatagatatgatattttctagcaaattaacacgttcttttaggtgtcctctggtcaagccacgttttgggagtatccctaataaaatcgctctttggatatcttgtagtaaattttgccaattttaaaaacataactttaataatgttggagtcatgacttaattatgtctatcgatactaatagcgtcactaagttttttttcttgaatttaatttgcacatcgattaattcgtacaaatcatgtatgtttggtttgcctttatactttcaaagtgtttttttccaccattgtactatagataagagttaggctcgatgtaaaaaaaaagacatgaaacgtaccgaaggaagaaaattatatgggatacttgcctcctcacatttttttttcttcttgagaaggggatcatcaaattattcaactttcaaaacactaattaatatttgaagcaggctcttcatctagtcatccaccccttaatcatggcattttcttcatgcaataactatatagtgtgctctttctttattcttcttggatcttccatatcctatcttcttcgtgctacctctgacaaccagcactgcaacaataacaaactctttatggtacaaaatatacaaataaaacataaacataccttactttaagttataaaaatgtttatcttttactaacaatcattttttgttacaaatcatcttgtacaaaatgcatacataaacaattcactattaacaattaattgatagttaaccatacatatacattattgtaactgcagataggcatggcaagcgcattggaaactttgtgtgggcaatcatatggtgctaagcaataccacatgttaggcatatatctacaacgctcatggatagttctcttctgttgtgcagtaatccttctcccaatctacctcttcaccaccccgctcctaattgcgcttggtcaggatcccgatatctctgttgtggctggcaccatctcactatggtacattcccatcatgttctcctacgtctggggcttaacaatccaaatgtatctacaatcacaaagcaagaacatgatcgttacctacctctccttgctcaactttggactccatctcttcctatcatggctcatggtggtcaagtttcaccttggccttgctggggtgatgggctccacggtcattgcctgttggatccctatatttggtcagctcgcatatgtcttttttggtggttgtcctcaaacatggacagggttctcgtcctctgcttttactgatctcggtgctattatcaagctttcgatatcatccggagtgatgctttggtaagtaactgttatgtttatgtatacatatgaaattctggataattttgatgatagcaaacaaaaggcaatatgttatatcaagctagtgttaaccaagttctttcctatagctaatttggtagctcattgatttgttcttgttgttcctttgcctttcagtgtagaattatggtacaacaccatattggtgctcctcactggttatatgaagaatgcagaggttgctcttgatgctctttctatatggtaatatgttaatatactattgttgcatagtagtttagaaaataatagccaaagcatgcatgttgtatcatgtacatcaatttattgttttgtgtctatcctttagtgcttgaagaacttgcttattgagcactattgttttcacttacaaaatttgtagccttaatatcaatggttgggagatgatgatttctattggatttttggctgcaactgggtaacttcatgatcttacttgttactcattaagtggttcatctgactattccattatgtcctataaatttgacttatacttaatacatatacatttttagagtgcgggtggcaaatgaacttggagctgggagtgcaagaagggctatgtttgccattttcaatgtggtcaccacttctttcttgataggatttgtgttttttgtgctcttccttttctttcgtggaagccttgcatacatatttactgaaagtcaagaggtagtagatgcagttgctgatcttgccccccttctagctttctccattttattaaatagtgttcaacctgtgctctcaggtatgttattttatttgacagatgaatatatcaaaataatttaaactttcactttgaaattacaacgttttctaactatttataggtgtcgctattggatctggttggcaaactatagttgcctatgttaatgttgcatcgtactacttgatcggtatccctattggggcaatactaggctatgctctaggatttgaagtaaaggtaaggtcctggttgccattgtaaatttcattaggaaatcttaggtctaagctgtgtttctcacttttattaattggctctatagggcatttggattggcatgcttgttggaacactagtgcagactcttgtgcttttattcatcacacttaggactgattgggaaaaacaggttggctttattatctttttgctcatattttttcttatcttgtatttaattaaatatctttttcacataatataagggtctatctagaaaaacatgtgggccattgaaagagcacacttttttagattttaatggtgtgctctattggttttttaggtagagattgctcgagagagactaaatagatggtatacggatgataatggaagatcacaaaattcgagaggaaatccatgatatgaaacttttgcacattcataatggaattgtaagagttcaagatccttcacgatcacatcatccatcatcaatgaaccaaatgttaatcacaaggcatggatgatgtttttttcccccgaagtgtcagaccaaggaagaaccacgatggttagtgaagtaaccttgaatataagccccttatcctttttttttagcatgatgcagcatatgcttgacctttatgtgttttatataatttttttttgtatttgttggaaagagcatgtatggctaagtgcttgtatgtgaattgattgtacccattgggttttgttttctacctttgagtaaatttatggattacactatcaaatgagagaaaatatccacacaaagttgtgggtcatttgtccctttctggaatgaagtgctttgtaaaatgattccagttttaaattgcagaagatatgatttgatgcaattgaagtatattccacaattcttctcctctcctgcaaccaagattttttttagccatttgacgcgctttattgatatcaaaacacacagttataacgttcacaacaacgtttagaagctagggggttcaacccagttacaagaattcttcaaaatgaaagcatgatctagataatttatgtgctacacaatttgcctctttattacaatgttatatggagatattctctaaatcaaatctaaagcatagggacattggccaatgcttaacccttctctgccgtcatctgaaaaaaaaaaagctgcgtgggctgggccgaatagacggccgaagaaaccaaaaatggtgaagctgtgaagcaccagtgccccaacaaatggcggcgccggtgaggtcggtgctccccgtcgtgctcctcggctgcggcggcgtcggccgccacctcctccgccacatcctctcctgccgccctctccacgccaaccaggtacgtacctcgtctgaccgcccctccctctccccctcctctccgattggatgctctcatcgccgatacttgtatagggcgtcgccatccgggtgctcggcgtcgccgacagctcctctctgctcgtcgccgacgacctccactccaacggcttcgacgacgcgctcctcgctgatctctgcgccgccaagtccgccggctcgcccttatcttctctgctctctcgaggtatccccattctatttcgttattccttttttttcttttttagaattctccatagcttactttgtcatgaatttgcatttgtacacgtgacatgtaaagtaatggatggttggattgtgcaattttcagggcaatgtcagctattcaacaaccctgaggctaggaggaaagtcattgacactgccagcgttcttgggaaaacaactggtctgtgatccttctccctaagcagaatacattgccggttaagttttttaaaattttctatgggatagaaaccagtggggaaaaagatggaatctttgatatgctgtatgattgttgattagttctttgtttttttaaaaaaaaggagtattaatatcttcttcggttcttatcttacaatcctttttgcaggtcttgtactagttgattgttctgcaacttatgatactgttggcatgctaaaggatgccgtggatcgtggatgttgtgttgtattggcaaacaagaaaccgcttacttgtgcttatgtaatgtcctccttaagtcttccgtctggtatgtttttgtcattttgacatgcttaccaaatgtgttttttttttcatgcaggaggatttcgaaaagttggtttccaacttccgtcgcatgagatttgaatctactgtatgcatacgccactagtaattccttcgtttcactattgaatgttattatatttgtttttcatggaaattctttcctttatttgatctgggattgtatgatatgactctggccatatgattaagcacagcctttttttggaagtttcttttattattgcaaaggagttgagggtctctgctgatatttactattcctactcttaggttggagccggtttgcctgtaatagcttctgtgacccgtattattgcctctggagatccagtttctcgtattgttggcagtctgagtggtacacagttattatcttatttgtttgtaaaaggtgtttgttttccaaatagcagagcaatgtaccacttccattctatgattctgcaggtacacttggttatgtgatgagtgagctggaggatggaaagagatttagtgaagttgtgaaaactgccaagtctcttggctatacagaaccaggtctaaaaatttattcattcatttgacattataacatcaatgtgtactcagtattcattccttatctgtaattacagatttcatgtttacagaaagtctactgatgcttgtgataagtgcacttactcagttgtttaattttggtagatccacgtgatgatctcagtgggatggacgtagctagaaaggttaatttttcatctgatgaattacatgctactctacataattcactttatctgtgcctttgttaaccattgccacaattttattctactcctaagtccatgaactaatatatcatgagctgctgctgtgtatctattttttgtgcttaattgtatcatactatgatttgatccaaaatatattcagtaccacatcaatatcataaatactacagttcaggaaggcctatatcatgcactgaccctatttggaatttcaataataaccttgcaaatagacattggcataagggaggtttatgttcaggttcagatgttttatttgattatttcattctttgtcaattaggtgatgaggtctaacaagttcatctttgaatgcaggcattgatcttagctaggcttctggggcaacggatcagcatggagaatattaatgtatgcatataattaatcttgatggtatttgttctaatgttttgtgtaaacatagcttggtgtgcacgggcttatgttttcactaacataaatgaggctggtagcaagtgttttcctgttattctggctgttcaaaaaaaacctagttggtttaaaatgatacatttcttgttgataccattcttggtgatagtttgcaagcattacttggaaccatccttttctctttagttctacttctataatatcttggcacatggattctatggataaggacagacactcttctacaatatcaggtcactggatatcaccatagatttgtgttcaggattattggggatcccgatgaattatacaccttatgtatcttatagtctgaaaatgaaatgaatgtcctccaaatcttggaagttgttatttagtttatgtagccattagctttgttgagtggccgctagttcagttgttttctatgatacaagaactttgattttgagatattttaacccctaaatcacttattcagaaattttctaatcatgcatagcctatttatgcacatgttctgttgtacatccctgttcatagaaaaaagatcaggtctgctaagtttttgtaattatcttcaggttgagagtttataccccagtgaatttggacctgatgcaatgtccacaaaggacttccttgaaagtggtttagtacagcttgataaaagcattgaagaaagagtaaaggcagcatctttgaaaggaaatgttcttcgctatgtctgtaagattgaaagcacagggtacgtatccttttattgtgctatgcccatctgaatcactaagtagtgttttgatactcaaagcatactattgtcagagacacgtaggcctattctgtgcattttgtaaaggtacttttaatggtagtgtagactgtagagtaacatccccattttgtaggtgccaagtgggccttgaagaactcccgaaaaactctgcactgggaaggttgagaggaagtgacaatgtggtatgctaatccttttttttcctttctctatttctattttattcaatgtcaagcggcactgtgcagttggtagccttaagggctggttattttcaggtgaaaacaaaagagcctacgagtgtgagcagggtctgtattggcataccattccccatttcttctttgcgttgttcaaacgagcttggaagttggaacactaaaactaccaaagacattgtttgtgttggcctataacacgttagaagtagattgatgaaatccatttttctgttttgagaggattaaagaatgtttgatatgtgattttttactgttggtagtgagtgatgtgaaacgtaaaagtgacgctgctttgttcttgggcaggtggagatatacagcagatgctacgagagcgcccctctggtgattcagggcgctggagctggcaatgataccactgcagctggagttcttgctgacatacttgatctccaggatctcttccacaaaacggcttgaaacctatgtcttctaggtcgaaccgcagagttgattatgagtcttgtgacttgtggggttgttttggtcacagtattacttaaataaatcttgagcagatatcaatttttgtactgtacgcagaaggtttttgaacaaatttggaagttggaaccaatgagcagtgtcatccttttgcttatggttatgcttatctgtatggcttattagcaactaaaatttaatttataagtaaaacttttatatacatattcttagcgattcaaaagcaaatgctataaaataaactataataaaaaaatcatataatcaattttaaaattaaattttaattttaaattttgaattataagtattaacatgagtgaaacgatggggctgctcatttatcttaccttgattgtaaatttgtgatctgcaatgcccatgcttgaactgccttttaaaatttatcattactggattttggcaatgcggcgacaagagttgtcttgctgacaggtggggcatatgtcaaggatggtagtgggcccacctgtcatcatccgcacgagtgaaggagatttcaaactagccacccttgcatttcaaacccggaaaaaccccccctctcggtgttgctcaccccgaccggcgggccgccgctccaatccaccacccctcccatggcggcggccaccgagcagcactgcggcggcggcggcggcgacaaggagaaagacctcctgtcggcggtggtgggcgacatccgctcctattccggctccgaccccctccgcccatggctccggtacactctctctctctctctctaccactccgaatcgcttccccttctcctcttctcgatgcatgttgcttgatggatcgattcgttgtttgctaggggcatgaggaagatggaggcggcgctgccgcccgcgacgctgcgggcgaagctgcccaggttcctgcagaagtgcgcccaggagttccaggacgacgcccgctaccgcgacgattcccgctacctccgcgtctggatccagctggtcagccaccttcttctacatccagccatccgccatatgcttcctttcctttttactgatgttgtcatatatagtggatttcatttcgttggggatctgttgagatagcctgagaggttcattggctgcagttccataccaaaatcaatttgtttggggctcgagctttgccctgtgccaattgaatctacagtagttcgatagtgatttcaatccgatgtcctcatttcatactattgtttgcttgctcatactataacttgcatgttactcacagcatgaatcttttgataagaatattttcttatcttattatctaggctttgttacgcacaacagagatcttttgatatgaatattttcttggactgaaaggtcctaatgtgatctttgcattttttttcaatggtgtagatggactatgtgaaagatgcaaagccattgctaaagaagatggaaaagaacagaataggccttaagagatcagcattttatatggcttatgcagtgtattatgagaagcacaagaggtttgaggatgctgagaacatgtaccgcttgggaacccagaagtaagatttttaccaccattttagttgctggtaccatattttgcggttatcattgcttaaaatttagttcaacagctacatctcatatgtcctaaaggaaacatctgatatgtaaggacacataaaaaaaatttcatgtactcaattcaattgtcaatggacgtatcttagatccgcctactgcaaaccaatggagtaacaaatccttggattgcagtttgcaagtgaaacctcacaataaaattaatatcaatacgaagtaccttgcaaattaaaggtaggtacttaccatttatcaatgtattcaatagccttgcagagcctgttggggagctgcagaaagcacatgaacaatttattcggcgcgtggaactatacaagaggaggaaatctagagtgcagcaggaacgaatgcctaacaaggttcagtccattgctatatcaaagaacgaagttgaaggtacttctaagtggaaaaaaacatgtatcaggctatgcaaatcaatattttcttatgtgaccagtgttacctttatcaagcttcttactgttcgaagcttactgatcaagactatgaaagaaaaataccttcttggcagcacttaaactatcattattcaagatccatacttttgaactgtctttttgcatatttgttggttgtttcatggaatggttcttgatgttggaatatgttgcaggtcaaagcagaagttgtacaaaaccgaagtccaatccagtgcaaagatcaggaagtggttctaatcctcatttgggttttccgcatcccttagggcgtccactatctagaggcacttcaggagaaacaatgagtttgtctcgtcataatagtgatgatactgtagttgtaaggtttgtaggctctgcattggttgggaaatcagaaactgaagatgcatgccatcatggccttgttgaacccactataaacactaaagaggcaatggatgctatcagtagcatgtttttggagccattggaaccagaaactaagctcaagaggcgctcaaatcgtgataaaccaagttttaatcaggaagcaagtgcatttgagatctttgtcgatgaagatgaacctaacaagagtggacccagcaaactccaggacaaaaacatgaagcaggataatccaaagttaagtcagcaggcaagcgcatttgagatctttgtagatgaagatgatccttactgcaacaaccaaaatatggtgcagcataggcactttaataaggagaacacacaggtaaatcagaatgcaagtggatttgaaatctttgttgatgaaaatgaggctcatggcaatggtcgtaatgccatgagccataagagtagtggatgtcctccaaagccatcgcgtgattcaaagcagcaagccaattttgacttccagaaaccattcgtgggagggtttgcaatactgcctgatgatgaagatgaacagcttgagaaaaatgataatggtgttaagatcaattctggaactgtgcaactaactgatgataaggacacttcactctgttcgagacaaactgattcaaaaataagatgtgatgacttacgtcctgcaatatctggacttcgagaagacactgtctttcatagatttgttggatcagctgttgttggagagcctaaagtggaaaatgcttgccaccatgggttggtcgaaccaactgtcaatttaaaggaggctatggatgatataaataacatgtttgggataccactgaacttcaaaggtgataaacctaaaaacaagaaaaccactgcattgtcagagagaaaagcggcactgctcagtggtttctccatattagctgatgatgaaccaggcgaaaatccagcagcccaagttaaaccaagcaatgcttccaaatttgaatgtcagagtggtctctttgagcccactattactacccgcgatgtgatggctgagatcaatgacatgttcggaatgccactggacttctaagactagtgcttaaatggaacagaataactcttttgacagaagagttttcctttaccctctcactcactccttgagagtgaggtaaggttcccaagatgtcagaatatgaaatgaagtgctatgtagtatattggtgcattcttgatgataagaagagcttggttttttttgttgaatcctttgatgcacagctgttgtgtctagtgaatatttacatgagttattgaaattacaattctcaaagctttatctgattcatatttccctgataaaatttgaagtgtagcaaatgggcattagtttgctgatttatactcttggtaaatgagcactatctccttgaattgcaaatgtatcttacttttgatgccctgagttgttttgctgtatcacttaaatgagaattcctttttcccgctgttgatgttgttgcggatgtaattgatctctagaatttcctccagagtgtatttttgctagcatcatccaatctgaatgcggtattgggttaactgctgcttaaatatgattatattttcctatattgtttgttccactgctgtgtgattcatggtgttagtgagctgcaatctctgcatattgaaaccaatctcctgttgtaattgtttccatttagtctgtaataaacatttctccctactttcaattgttgttcttcagctggttgatgataactacaggtctggataccattacatacccatgattgattaattaatttgttaatcccatcctaccaaggatcaaggtaagtatgaaagaaaatattgcaggcgtaaataaactactatacattgtcaatttccatcagatatatgtacagggttacatgctacagagagactgaaagaaattctacatcaagacgacgacggcgaggcgacataagggaaattcacatagaaccctaggttagcagtggtggattcatgggcggcccatgctgatcgcagcaagccggccggcgatgtccactccggcgggggcaccctcctccctcgccacgcgcagcccggcgagcctctccgcgaggccgtccagtgcggccagcgactccgtcaccggggagatggcgccggagacggcggcgcaggcggcctcgtcgaggaagcagagcgcgaactcgtctccgcactccggctcctcccaggagagcgtctcgccgtccatcctctcgaaggcgtcgcccgggaggatcgggtaggcgaacacgatgcgctgctgggcgccgccgtcggggccggagtacaggacgagggatcggccctgcgggcggaggaatctgacggcggcgtaggcggcgccgaggttgtgccattggccgccgccggtggcggcggttgcttggcggtggaggagctggactgggtaagcatcggtcgccatgggaagagctcgagataggggagtgtttccggaggaagacgaaggagagagaggtaattaattcgtcggcctgtgcgacagatgatctcagccgttggattttgtttaggtctaaacactctccaaacccgggcactagcaccgttggattatgtttaggctttaatacgggcaaaaaaagaataccacccgggttcaattctcggataaatgatttgatccattcggcccatctgaattttggtagccgcctactactccccacaaaatttgaaaatttgaccatttccgaaaactaatttcgcaaatgaaccgcggccaaaacttattttaaaaatgatatttttttcagcgtcaaatcgtatgacactgagtttagacacatcagcatcacatcaactggcgctaaatgctgtgtcaccgtggatgggaggctgagtcgacgtgccaacgtgcattcagcgccgtactatttagcgctgatatgtctaagtttagtgccgtacgacttggcgtggaacaaaataatcatttttgaaataagtttttggccgcggtttatttgtaaaatagtttttgaagggtcaaattgtcaaatttcgtgtactactccctatccaaaaaaaacttaaagtagtatagggtagaacataatctattctgttttcgttgtactgtattattttccatcatacattaggtttggtttctttagaaggaggaagtaactctctatttggtatcaagatcgtgaacccgcaactgagtcggtcgattgcttggtgagttgatcttatcggttcgtttttagatctttattattgccgtgtttaattagttgaattaattaagtgatgtttaaatattttgtaatcaaaatgattctttggtaaatgtaccaaaattttaaactacctattcacaatgtataaagataataattgacattaaggccctgtttaggattattataatttgaattattaggagtaaactgaaacaaacaagtaaattattatgatagattattataatctataagtcagattactataatctaataatctcctctagaggagctttttttgattactgggtggctaaagacccactacccctagatgtctctaataattaaaaaaacaaacaactcacagcttattctatgttaacttattataatccagcttatagtaatctagatttatattacaataatcttaatctgaaacaaacagcgcctaagttagtgtctgcatcctataaaaatcacatcaaaataacatagaaaagaagaaagagaaagagagcgtattttatttcatatgagtggtagtgaaggtatgacgaagagttataaaggaccattttgtggatgctcgaattataaggtacggtgtgaagtttctaactcatcaaggatcttcaaggttatgcgtctaaacctaaaaaatagaaaacgaaacgtgcaaattatggatttaattttgacataattgtgtcatgtcgacttatcacaagattaataggtatatatacatataactcctttcaaccctttaatactttgttcccacacgacagtacgtggtcctcctgttcataacaccaaatatgaatattatatcacaaatatatatttaagccgtgagtccttttctccccgttcgatctctcttgactctccatcttctaaatattgctcggcagattagttgttactcaatacaatactcccttgctgacaagtgcctggaaatgaacaaagacccatatctaactttcaaagttcaaaccacttgctggtaatataccaataaaagaacccatgcttgtggcaccatgtactacggcgacagtatgagagtatgtaaaaaggcaaaaaaaaatataactaaaatcttttatatttatgtatacacatgattagcatcgctcttcagctcttgcgttgtatgttttagagagtgagcgtgagcatatactccctctgattttaatatatagacgatgacattaatttttggtttgacgtttgatcattcgtctcatctaaatatagaagtgtccttttttattgtaagatactttactaattaataaaactttaagcatgacttatacttttattttttatatattaacagtaaatattttgaataagacacatgatcaaactttatatcaaaagataataacagcatctatttaaaaacggggtgatatctagacttctataaaaaggtagtggtaaggaaaaaggcaatgggctagatgacctacatgttaaccaccgtcaccaccaactcattatttttttttgttagtatcaaatatacgcagaaatcatgatgattttctttaactttaatcccattgtaatatacacacagtatacaagtaagtgggatattgtaggaagcacgtgggatattgtaaatatgagaaaaatgatgtgattgatcgactccattaaagtgggagcggggctgagacaacgtggaactacaaacgcccacaagatgcaagatacacgatcatctatcattcacatcattattatgatcgatggtgcataaatatggcactaataatataattcctcgtgacctgccgtgtgatgcactgataatatactagtgatgaactcctgtatatctgcacaatttctacaggagccctggattgcatgatctgtcattatatgttttgctaccaaactatatatatcataataaataaatgcaatttggaatatttttcattcttatattaaaaggtcatgtacatctatatatggattttatttcatcatttacaatattttaaactacacatggagttataggctgcacgtacaaacattgctgacctttggccgatcaattggggtctcgatcactctcactgtgcctatatatgcatgtgggcattctggcaaatagcttttggatgaagctagtggacctaccatcatatatactgggtgataccccgcgcttttctgcgggatttatggatgagtatatgttaaatattgtcgaaatgatgaaagttaaaatattaagaaaataatacgaggaacatgatttgacacatacatgtcgatctctataatataataaaataggctagaatagtaattgctagtgagtgaagatgtgacatacttgcataggattttaaattaatgagctaaaatagtaattgctagtgggtgatgatgtgacatacttgcatgttgagctttagcttgtaataattgttagtgggtactatgtagaaagtatatatatgcacagtatgagaacatatactccatccgtcctgcacagactccagttttgggtttctatatctaacgtttgaccatctctatttttttaaaaaaaataaaaaaatagttacacataaaatactatttatgttttatcatctaattacaatgaaaataataattatagataagacgaaaaatcaaacgttatattaaaaactaaaaaaatggagtttgtgagacggagggagtatatctcaaacacgttgttccattttagaccacgtacagaggggatcattgagacaatgtaacgttctgaaagtgctgacactgcttttacacaacaaaatgcgcatgtctgaggtaacttttaaattctgagaaacgagtggtaggaatcttgagaagctaagaaaattagcttatggtattactttattttctttctagattctacatctactttttaaattttcgatcaaaagttatggtttggaaagcttcagattttagaataatccgtaactgtcagaaactcccaaatagactcaatatatcatttgagcttcacgtaaaatgactaacctgattatatatggccttggggttttatatctctctgaaccttaatcagctagctataggtgtcttcaaccataatttgctattcagcttaattatcatccgtagctaaaatttaaatgttaatttaaattttattttaaagttgattgtgatgttttttaccatagtttattcaacgtatattggttttttaagttgctaagagcacatatataaaagttttactcataaattattttttaagccgctaataagtgttatggcttataatcaatcatctttagacaaaaatgatgggagtgcatccttccttagaatcggttccgatttttatatatctttacatagatattgcgtgtacaataaatttcccattttatgtaattcagaaatatatttttatttttggattaatatgtctgaaattcaaaagtcatatttaccaagttgtatgtggaacaaaatcttaaaaatttactgtttatatgttaaaaattcccaaagtctgaatttccaaatatcaactactagtaatttgcaatagatttaaaaaataactagctaataattatgttattgtgggaatgagctcatacaaatcgaattgctaattcattttttgttgttccatgttttatttgtttatcacggtaattggacttatagcatattctttaattaaatcccaaatttaaaaaattgatagaatagattaatatatgatatatcgatcactacacaaatatgcaagtttgaaattgacttctaggagctgaaaaaaatataattgtgaccacacgtatacttaggaagattgaatttaaacttgtatattcgtgatatataatatatcaatctatcttactatttttataaaaaaaatcataactattggatggtatgcaataactaggggacatatcctcacgagggattaaaaatccatttcccaagagtgcccaagtttttaccttttccgttttgtttttttaatgtaaacctgttgtaaatatcccaatgcttacactgctgaagaatgcctcatcagtcccggtttgtaaccccttttagttccgggttatgcgtatgcgtattctcgaaactcaggtgaatggttgaagctttttttttctacttttctggttaacacacaaattttgtatgtagtaagagttatatatagttggacagataaattgcttacggtaagaaatgcctagagaaattaagtctgcgtttaaatccacgggtgtaaaattttagcgtatcatatcaaatatacggacacacatttgaagtattaaacgtagtctaataacaaaacaaattacagaatccgcatgtaaaccacaagatgaatttattaagcctaattaatccgtcattagcaaatgtttattgtagcaccacgttgtcaaatcatggcgcaattagacttaaaagattcgtctcgcaatttacacgcaatctgccatttttttgacaaattgacccttttggaaaacttatttcgaaactaacccctgccaaaaacttcaaccaaaaataggccgtcgcctcagcgccaaacacattggcgctgacgttggccgtgtcagcgccaacgggactggcgctgacattgtgccaccgtggcggccgggccgatccccagctgacgtggcagctacctcagcgccaacaggactggcgctgaggtgggacttggccgcaacccccaaggcccagaccagcaaggcttctggatggcttgcgggtttggacctcagcgccagccataatggcgctgaccgtgggacactcagcgccagcccacaaggcccagaccagcaagcctgctggatggcttgcgggctgggacctcagcgccagccataatggcgctgaccgtgggacactcagcgccagtccacctggcgctgaggtgggccttggccgtttcgagccttctggatggcttgcgggctgggacctcagcgccatccataatggcgctgactgtgggaaactcagcgccagcccacctggcgctgaggttggacttggccgtttcggccgtggcccagcccagcaagccttctggacacaacacaggccatttagacatgtcagcgctgagtttggacatgtcagcgccatttagcatggcgctgacgtcccagccctgctaaactttagcaaaactttgcacacaacacaggcaaacatcaaatcacagaaatttacaggcagtaatatatccagagaaccatacaaaacatacatccatccatcaatcccaacatcattccatacatccatagaatccatcaatacatccatatatgaagtccatatatataagaaataaaaacatcccatcgatcctcgtctatacatccagtcgagtccatacatccagtccatacatccatcgaaccatgcatcaagtccatccacccatccattgaccaatgcactcacttcctcctacctttagtgcgaggacaaggcacgtcgggggtgtacctccagtcttggaaagaggcccgccggcgtcgtggtcaagacgggccgggctgcgagatatccggctgtgacgactctggtgcgtcctctagctgcgagggaccgagctcatccgcctccttttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagcaatgtaccttggtatttaccggttaagaaagtgccatcaattgctagcaccggcctcaagtgcttgaatgcttctatggactggccaaatatccaatatgcatgtccaaatactcgcctctgtactccatccaccatcctggacttctcgggatgagcctcaacacggaaatgcatggtagggttctttgctttgatggcacgcatcagtgtaggcaagcgaacatacgcctcgtcccaatctccccaaatgaccttcatagcaacttgcttagcacgccatgctttgccatacgtaggccgatagtgccatatttgctcaactgcctcgacaatcgctgctggagataaagttggttcagctcgcacaaatgcatgtaacctgtttccaataaaccttgaagtaagttgcaaatgcttgccggttacttccgcactacatcatgtgtggtcttcgcccaccctagtcacccgccacctatctcctccactcttccttgcattaatctgccatttgcaatggcgatcgagacaagccacagtatactttactgacgcgttagattccttcacatggtacggccggtggacacggatagaataactctgtagccatattttcagatcatccatcaatcgaaactccaaccccttccttggttcatcacacattggttcgaaggcaccgtcatattgtggatccccatcagcaattgctagcccagatctggtaagatcctcgaattgtgttatttccggatttctacccaccagtttcgcaaacacagtcctttcatgctctgacatcttacgcactggacgatcatcatcggagtcggaagcggactcatccaattcatcctctgtatcatactccaaccagcctgggttcaatccactgcgtatcatagcctcctcacactcctctcgggtatagaatttcagcctagccaactcccttaggcccatacttacattcttagcattcgcttcttcctcaggcaactccacatcatctcntacctcccgaccatcctcaacatctccttcctctcttaccggcacattctcctccacattaacttcctcccttaacggcacattgtcctctgcatgtacttcttcccttaacggcacattctcctctgcatgtacttcctcccttaccgggtcattctcttccctgacctccacatccgccatatcatttactccctcgcccccctccacgtcttcctcaatcaattcttccttcctactacacctctccgacagttcgtgacagctaatgggtgattctatgagtgaactttcattaaggtctacaagttctttctttcctatcctaccatctttcttccatgcaaacacctcaagagatttgaaatgtgaccccaatactatatctatatatgtttgccattcgatctctccattcaagtctaacataaatttatgtgacatgacaccgccgcccacatcgtatctcccttgcataccaaccgactcatcattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacctccacacttcatccccacccatattatccatctaataatccatccttagccaactattatcaaaccacgtctacaaccaaaacaatgcaaaatatccaataaaactttggggaacttagggtttatagaggggtttatcttctcttccgatcccaaactcaatgccgcacaaatcaccttcgattagagaggtttttgggggagattgggcgaggagaacgcggtggcgaccgaaccctaggcgggcggctggggaaaaaacggaggaataactggctggggcggcctcggccgggctctaagtagccaaggtcagcgccaacttacttggcgctgaggttgggcacctcagcgccgaagcggttggcgctgagttagctgccacgtcagctaggggatcggcccggccaccacggtggcacaatgtcagcgccagtcccgttggcgctgacacggccaacctcagcgccaatgcgcttggcgctgagccgacggcctagttttggttgaagtttttggcaggggttagtttcgaattaagtttttgaaaagggtcaatttgtcaaaaaaacggcgcaatctgtgtaattagttattttttcgtctatatttaatactccgtatatgtgtctaaatatttgatgtgataggatgtaaaattttaccaaggaatctaaacacggcctaagttagtcatatccatgggtggtttgcatgggagaagtcagtgccttttaaattagacacagtgagaccaagcagtagtacgtacaggttggagctagctatacagacatacaacagtctttcttgctagctttaaggtgtggccgtgtcattgtcactgattcatgtgatgctgttgacagaaagagaaagcatcctacatacagacagatcgatcgatcgatcgataaccagatcaactgacttgctagaaagtgaaagtaaatcatctcatcgatcgatcagaaagtggcttacatcagagatagcaagtgaaaaggagctcactcactcccaaagtccccagtctcctagctatatatatctctacactcaagcacactgtcggaagctcaggtagcacagagagagacgaccgatcgatcgatcagctagctgcagcttccagaaagagtagttagctcgatcgatcgatccgggaaggatcagagttaattagtgagtgaggaattgtagccatgggccggccgccgtgctgcgacaaggaggggatcaagaaggggccatggacgcccgaggaggacatcatcctcgtctcctacatccaagaacacggccccggcaactggagatcggttcccatcaacactggtacgtcctaattccccaattctgtgtagtttcttactttcttttgtagatgaactatagctagccaagtagccatggtgatcgatgatgaactgagaagaagctgaagctgtgggtggatggatggatgcagggctgatgaggtgcagcaagagctgcaggctgcggtggacgaactacctgcggccggggataaagcgcggcaacttcacggcgcacgaggaggggatcatcgtccacctccagtcgcttctcggcaaccgctgggccgccatcgcctcctacctcccccagcgcaccgacaacgacatcaagaactactggaacacccacctcaagaagaagctcgccgccgccgccaactccacttcatcctccaaccgccaccccatcttcgccgacgccaccttcccctccgccgccggcggtagctacacggtgagcagcaactccgatgtcacccagatggcagccattgctaggcgctcccccttcgccgactgcccatcctcctcatacgcctccagcatggacaacatctccaagctgctcgacggcttcatgaagaccaactccccgtcgccgccgccgccaccgctgcagcactatgacagcggctattacgacgacgtcaagcccgccgtcgatgtcggcggcaaccccttgctgtcgtccttcgactgcatgtccggcgccgacctggactgctgcttcgacgttcatcagcagcaccagcagcagcagccggcgtcgttcatggagtacggcggctatggcggcggctacggcgacgagagcaagcagcagctgatgaaccaggcagcgccgccgctgtcatcgatcgagaagtggctgttcgacgaggcggcggcggagcaggtcgccgacctcatggacctctccgacggttgctgctccgtcccaatgatgttttaattagctcaagtaatgaaagaaaacactgtcacattcgatacgtatactgtgcacatcaataattaattttacattaattagctagatgcatgtctaggttaaactattgttgttactatacttgaagctagaagatttgttttatttgtagttttggatgtgtgaccggttgtacgtgtgtcactggcatcaaacgtcagcacaagaataagagatatcaacaggaattaacaggtgtgattatatatgtaagcatgatgtaactcatcaagattatttcttattcattttttcgaatgaattcataaaattatttccacagagtgtctccagtagccaacctatcatgcacaaagagctggaatattggaatataatatcgttgtcaaaatccctatccaatccattattgttagactcctgtttggattaaagaggtctttaaaatgacaatcttatcttcctttcctaattcttaatttctagtttccacaatttcagcaatgttagatggtaattggactactctcataatgtataaagttcactttagaggtttaattaagactcacgtttatgtctgcattgtggctgccctaaggaagtgccagaaggtaccatattttctaatgtaaaatttgatatctcttatatttctggtatcaagagatacgaaaatttgcgttaaaaaattttggtgcctcttaagattataaaatttctctactaacaaagtaataagtgctccttcttgtctcaaaacaaaattattttgaatgtttttaaagtcaacattatacaaatatggctatctagttctttagcagaaattttacaaaattacatgtgtaatactaaaaaagatattgtaaatatgattttttatggtcaaagttaactcgtgttgagtgcacaccttttaaaacgactgtgagaccagagggaaatggtgaaagttccagtttattttttgttcctgaatggagtgggctggtgcaatgatttatgaaacagtttcttcgtcctcttatgtacttgccgtatgcccatatgaatgcagatactatactattcttacaaagcagctgcggagagaagaagcttaaacagactccttacctgtcggcaactgtgttggtcccccgatcacattcagtgcaaacgaaatcagctcccaacttttttttcttgccctgttctcattcattgagtgcaaagataaacagtgccctaatctttcgtttaatgccggacctaccctgcaaattacaccaatgttagggcaattggacaggtcaggtccctctctatgagtatatttttgcaaatagctaggcttcagaaacttgtgtgttgatggtgcatagctactctaggtagtcatcagcatcacagcaaatgcagcgttagcttgttaaacatcaactaaaactcatagatggtactgcactactgagaatagtggtcgatgtccagcaaattgagtgattatacctgattatgacatggcctgtgtcgtgtctctctctgttacacgtcccttttatgctaacctgcagaatcctctgcttctgcctagtgaacctgcttcagtgtacaaattacaaactccagatcgcctattaaattgtacgtaagacgagaggaaaacctggcattgcatgaacaattaagctgatgaagtctcaacctgtcctagcctggctcggtgatattctcaactgcctgacgccaatcagctacttcctccgtttcacaatataagtcattctagcatttctcatattcatattgatgttatctagatttattaacatcaatatgaatatgggaaatgctagaatgacttacattgtaaaacagagggagtagctttgtacagcagctatgtgcttttttgtgttccagccccagatcaggcaggctttggaccagcggggtgaggccgaccaggttacatttttcctggcccaaccacatccaaccatgctggcattgctgccatagtgccatggtccataagaagcacatttgataccttcatggagttcttcaacaaatgcaggactccaatccttcagtcctgccaagaaaggaaagcattatgatcaaccataccggttcagaaagaaaaatactctcaagatctccagatgttcaagtgattcaagtctactaattcaaaacatctggaattctggaagtaactaaattttgttgcatagtttgtatagagttgatcgaaggcttggccataattactgtatgttcaaatcaccctgtaaaatgatctctccagaaaaagaaagtaatgcttaaatgcttaatagtagaaattagaaaaaggaaaggaactgcaattcttgacaacatggtattgagtggaagtatacatctcagtcttcatgtatccatcagagtagatacgggaccaaggcagtacaaatatagctcacgtgtaattaagagttgccaagggagtgtgccatgacaaccaaccggcagctaccataagtatgagaggtctatctgtgtaacctcgggggagtacatagacaagctcaattcattcttccaggaagcatcctgtagcacaacagtaaccaggaaaatgtaagcattagccttgtcaaattaagaacaattgacacatcatatgcattttgtgacagaaagtaaaaccgacgttcagttctgaaagtggaggtagtgctactggtgtatgaacaaaatccattccaaaaagataaagatcagtggtagtcaacagccaatagcatggcagtctaactgcaaaactatacctcaaagtagttcatcgacactaacagcaaaaggagtcttaatgtgtagagaactagttcttgacaagtccaagtgcacattctgtaactacttcgtcaattagcaggcataagttgccatcgtatttctgtcagaataatggcacatacttgaagtagaattctgttgacaccgatttgaccccagctataggtatcctgatgagtatgtatacacagcatatgaaagggactcatacaatgtgtaagaatagtgttgttatcaggtatttaattcatctttaataggcaggtgttgtaaaaaagatcaaggacccaaatattttcatgcatcaatattttaatcaagaaagaatctcaggtaactcaggaatggcttccaatccagattttgtaaaaaatggatttatatgacaaggtaaaatctatgctaaacctgacaacacaaaagtgagcatgggttaacttatctttacatctccaaaccttgctagaaaatcaagtaaatggtgactagcaaactcctagcattttttttataaccacacaatggcacaaaaacttaccacgttacaatgtaaaaccaaatcaagatgtgtagctgtggatgaaatagtcggctagtttataatagttactcaagacattagaatcaccttcttaattactcaagaaaatattcactctgctaatagttccactactttactagtcaaaataactctgagtaaaaaaaaatcagccacagatttttgtacgtaggaagacagttttaattcagtgtctaattgagagggggggggtctgtacagagcaaacattgcaccaggacttgattcaagactaaatagattatattgccaatttaaagagcatggtattgtaagttgttgtgtgtgctgtgtggttgttcagctgaccgcaggtagttgtttttcttttccttgtaacccgtctgagtttttacttctacttattgaaacacaattggtaattcttattccggtttagtttaaaaaataagtagatacattttgccagaaaagtgtaaaatggtaccattgtactaattttccattccgtggggatggttagtaaaaactactccactaagtaacaccacctaaatgcttgaccccactttccattgtcgaaaccattaaatttgcaacaaggagagatataaccatgacctatgagaaattgatggggcatttgcaaatttgccaccggttttttcaattttgcaaggatgccactcgaatgacagttccagtggcatttttgtaattttctagtggcagttttgcaataacaattcaaagcagtggtaaatttgcaattgccccgaaattgaaagaacaaaaaataattgttcatgaacttttccagaagatctatccattcaaaaatgaaaatataaccaactttgtgaattatatagtatagtacgtacagtatagatatagtttcagagaaaaacactaagtggtatggaatatacattacaagataataatgtcggctcagcctattattcataacatcgttgcagcaaggacacctttaggcagttcttcagtttgttcatatattagttcacatgaaaggacaaacctacagcataatcatcacaaagagtgagtagcttacctcccaactactaaccaaactagcaccacaaggaccacctcagcaagccaattcttttgctattgagcatgactgcctgaacaccctagctaatgccttcagtaaagacttacaatcctgttaccttgctattataagaatgtgatgtgcatcgttctttttaaacaaatattgtcatgctcagaagtaagacttcttaaatgcgatagctaaaaagagcaagaagatccaccatcagtatattctgatgttgcacattgctaatgtaccttttcttcaagaaacctatagtgccatatactttggagtggttgcatagagtgcaatgcttatcagtaatcaataatcatttggagttgttggataagtggatggatctcgtatctatctgtacaggtgacaacaaactagaaagagtacaaagacaaagatacacaagttgaagatgtctattctcagaaataaatgtagctacatctgctatgatacacatgttagtatttgaggactgctagccaaaattaatgaatattcaaaaaatatgtgacgctcttacatacttaagattggaatttagtagagaaagctagtataacatagagccgcaacaaggttggtgctttctagttacctggattttgataacatactctgtgcagaaccatcttatataacatatccaatacgatatgcctccattcatgaaacatcgttaatttgttaggtaagccaacaatgtttatttataccataaagcaaagacaaaataaaccatttttcagaaccttatttggtgcatcacatcttaggcagatctacatttatgggagagttgtcccgtaaccaactatgcgatgcagattttcccaacggtgcactatcaattggcctgatatgtggtggcacaatccctgttaccctgctatatgttccaacaaaaatgtcaaggtcccattcaagagcagagagctagattaagatgttgaaccatttggcatatctagtgtcctctgcaagtagaaaaaatgatagatagcactatctacttgttggaaacattaatatgaatttatcattttaggcatatgagttgattgagcattttgagataggtacaactacgataggtgactgtcatgtggtatatatgacctgagtcagaagagatatcagggattggtcagttaacattggttcccagaatctctacaacattgagagtttggccagcttctttgaggacaaaccgaaagtggttgaacttttggtggctgacatcaaagaagaagtttcgatctggagagcggccggtatttttgatagcgaggagtagcaacttggtctctagctccctgtaaatagttttgtttttcttctgtttcggggtcttccccgactcggcagtttaatgtcgtgtatacctatataactctcttttatcttaatgaaatttggttggcgtccttccgccaacccggcaaaagagtttggccagctggagccagtattccatccatccagcgatgaacaatggattgtgcaaattttgccacccttcgcaccacattctcaagtgtctttaagaaaataacaagaaatcaataacctgtaaacccaattgtttttttttctctcgaaaccatcaactccaaaatagatttgttaaaaataaaagacttagcttcaaggagacaaatcataagagattaagaaaaaggttaaggccattttacaagtaactaaaagagattaattaagagcatctgcataaaaggacaaattggaattttctaactcaatagaaggccatttcaaccaacataagaaaatttactgccagggaatcttgaccaatcagttgtgattttcgattggtttattatcagttaatagggatttgacttctactgttgactactagatgaattccatgaacacttttgataagacttcgcgtaaaacaagtaacgagcatcatgctcttagatctgagtggaagttgttgcatcatcagcgtagtggttcttgaagctcaagagaaccaatgatgtatgttttctaaagaaaatgatgtgcagttgtaaatatagaataacaaatgctgttacgagcatgcctacttttagtagccttgtgcctcgtcaatcagaatttaaagggaaacatcacactaattattccagtcacatagaattagcataggaccactaattggttgcaagtcgtacaggaatataactctgaaatttgagcaattattttgtggtttggcgattgagaacgacctacttaacctacaggagaacatcaggttcagaccacataaacaacactagcaaggtatggataaacctagttgaaagtggcttttccgattgatggaaactaaacacacatacaaagcactgatttgaattaaccgttaccaatcaaagtgatgatatgtgatagcaaccgtatatgtatatggtaccctttcctacagaaaggactcataccagctgagggattacattgttagatgtcatgtcattttcaaaacttgaacttgtccttgttgcatcaaattcagttaaaaggttagtcaacatacccttatccttgatcagtggactaggtcattttggaacaagcacatgaacttatgagctataaatggggaacatcatagcaatttccgcgaattatatgggcgaatttggttcagggaatgacggaacttttggagaaaggatggtttctccttttcttttctgaaagttgaagggaatttatcttgacgccctgtatatatatctagaacgctcggtaaaatttgtgttactgacctactgacgtgcaacgcaacagaaaagtttatttataaaagagatagaaataataaatggaggatgttgagtggctaccggcaaagtttcctgcgatgctggcgcgatcaagcttggtcgatggcgccggcgaggctgcggatgaccggatgggcagccggcggcggtctcctctcttttctcttccatcccaaggagcagcagcgaagctggagagagaaaaaggacaaaatgggccaagaaatctgctctgcaataccgcctggtgagtagtgacaaggcccatagaagcacacttcacggcccatttcatagaccaacagacaagtcaggcatgcactcacaggcaaatccctatttgctctgctgggagaatacaaaatctgatgattttgtccccagctgagctcaccaagtttatctttacccatactttggcaaaaaaagacgttccctgacctatttccagtttatcacaactctagctcacagctatgcatttagctatctgatatacaacaacagacaaacctaaaacagtgtgatcagacttgtaaccagctacctaagggcctgtttgggggagcttctagctgctgcagcttctctcagaatcagaagctccctcaaacagtccagcttttggtccagattctaaaaagttgtagttgtagaatccagaaaatgaactagaagctggaaaatccagcttttccaaattctcagaagctggctaccataccaatcagttgcttcttagaatcttaaactccccaaacaagccctaaaacatgttcacaaacatggaacagcaaacaaggtatcttgatactagaaattttacatgatgagctgaaatggaggaacagaacgtagcaaacagcatgcctgagtaagaatgtaatattgtaagaaccaagaatgtagaatagaatttcccctactacctataacatcaaacagcaagccattttagggactatgaccaaatttcagaaaggtaggaattgtagttcaatttccttttatccaaagagattggcccaagccttgtcgaactgtaagagaactcacagaaaaccaaggtcttcatagtcacaaaccttactcaactgaacatcttcacacagaaaaagaaaaacagttagttctttaacaaagtcacaattttattgacttgatccagatctacaagactacgatagaaacttcaacattggcagggagcaaaccacaaagagaaaagggcaacttttccatttggattattagaattgaatatctgctaaattttatttcttctattcatcttagccctgtgaggctgtgaagttgtagacctgtagtaattgattgagaaatgtcatgtaatcacgttggttcgaaaaactgaagttggcctcctatcaatgtctggactggaatcccttctgattaataacaaaattagaaggaattggctataccctttgggctggaaatcactataaaatatctgtcacaaaaggatttgttctgaaacagtatcttgttcttattgcatgaacaatgaaacgcaacagcaatggaccagtgcattgaataaatgaagtttttatttagagtgataaatgaccaggatgcaggttgctagattagctaatctctagctgaattttatcaagcaaaagaacaatatagcagatcccattgtatttgggaagaatcccaaccttatcttcaaggaagctaccgcacttattacatagttcacttcactcaatagagagaaaccaggaaatgaaataactaataaccccagcacataaagcagatcccgttgtatgtcaatcaattaatcgagattacgaaagcatcacaacacacaatggttaggaaatagtataatgcatattcaaagtttacactttacagacatctacctgaccaagataaggatgcatattctaggtttgcagtcatctactgtgactaagaaaacgaaatgcaacaataggtctgaagttatgatgactgcacaaaaaataacaaggaagacacttatcagttacactaaaaatatcaagtaactgcaatggtacaagattgattacaacactaccctacaatagaaactgcaagcttatgggaatacaaatacaagcatcgattccatctatctagtatgaaaatcagcaagcaaatataccttgccccttgtgtgttagaatcaggtttccatctgaatctattgatctatcatttgctaataatggagcagttacactcagcaaacaatcttcccttcagtaacacataaaacacagccgttgaacaagtaaactctgaaaatcaagcaatttttgccaggctgctatccctaactgagtgaagatcatgtggggtgatgaggaaaatagaacatgccatgtaccaccagatcgatctaccactccaccagccctcaagctcctttattttagagtgtttaatcaaggaatcaagcctcaagctcccatcttcatgggaactgaaagaatcattagcgctagacaagcacatgtcatcatagcttctctgttaaccgaatcatgaaagagctgacagcaacaacatcgagaacaatccatgatgactcaaacatgtcatggaaatagtctgcaccaatctcctcggcagctgacctaaatgcattaccaaatgcattccccttaacagcccccagccttggcttcccacatacccccacaacaagcactttctcaggctcccttgctaagcaagcgcagataagtggcttcatccttgctcctcgctctctcagtgcgtccattaggaaaaagcagaatttggtaagagcctgaggttggcataacttatctgtatccactggatcatcaagcttcacccaccgaaacttctttgcactccgaatgaacccggtcttggtaatcgctgagcttccttgcctcagtattgccctctgtatctcaattgcagactgcatccctttccgcagctgatcgacattgctcagcgacaatgcagagtatgcaacccagaattgctcagcagcagaagaccccttggagtccttggactcagcattcagtgattcaagcaaagctgtgacgccataaacaacatctgcagcagaaaccttggagcggtacccatgcaccctcaagaaactccgataatagaactcggtgagcccatactcaggcaagaaccgatcaaactcatcacgcatcttccgcttgacctccatgctcatgtactggaacctcttctggcagtcggcgagcgggaatcccatccttgccagaagcagcttcagcttcttgaggccattgtcgctccaggtcttgagcttcgtcgcgacatacgacgagcagagcatggagtcgaacagactccactcccggagcagcatcagccgcggctcgtcttcataggcgatgcgtgaggcctccggcgcccggatcttggtgccatccttgagcgtcaccaccgcgcccacgccagatggatcgagattgccagatccattgatgtgctgctcgagctccatgacggcggcctggtagcgctcgttggtgatgcgctcgtggacgaactggtcggtgagggagacgcaggcgaaccagaggagctcgttggtgttcttccgcagcgcgtgggcgagctcgtacatgaggcaccccgacggcttcccgtggaaggtgccgagccggtagtactccctcctcagcttcccgaacagcctctccgggtcgccatccgcctccgcatcgtcggagagccgccgcctcttcctcctcccaccctcgccgtcggaatccgagtcggaagcatcggaatcttcgtcctcctcggcgacgcggaggtggtcgtcggcctccccctgagcggagaggtcggaggcatcggctagggaggagacgtcgaagtcgtaggagagatcggcggtgtgctcgtcgtcagtggtgaagagcacgacgacgcggtcgttggccgccgaaaggttgtggaggtggatggggcggtgcgaatccacgacgaacgcggtggcggcggggggcagcacggcgcggaggtcgcggtgggcgccccagttgatgaggaggaggcagagcggctgggatgcggagaaggaggcgaggagggaggcggcggcggcggcggacgcgacggggtagatggagaagcggatggagtcggcggagaggacgtgggtgagcaccttgagcgcgcagagggcgtcggcgtcggcggcggaggggaggatcaggagcggcgaggatgcgtcggcggcggacgcggcggcggcggcgtggaggcgcgcgtagaaggagtcgaggcggagctctcgcaccattggcgcatcaatcgaagtggtgaattggaggattggggatctgggaggaatgggttggaatttggagatggagaaggggacgaagaagaagaggatgaaatggggaaattgaattgaagggatttgggttggagaggggcagcgcggggaggaattcggaaattttgggtttgggagggaaaccactcgatcgaaatttggggatctcacgattcgaacccccgcgaagtttcagtgactgacatatggagccgattgctcgtaggccgtcttagaagaattgctcttgggccgcacgtaaaccgcatctccgttccggtccaattaacatgggccgcacgtaagtcgctgcgccgttccggcccagttccgcctgcgttggtccggcggatcgtcacctgcgtcgtaggcctgcacttgttcccccaacgtcgccgcgtgctggtccatccgtcctccctcctcccgcgccacaccgccgctccgcatacccacttggccggccactccgccgccaacgccggcgcggaaggggttagagcatctccaacagagtggccatttcactatctaagttaaattttggtaattttaagtaaaaaaacgggctctaacagacttgctaaacggctgaccatgccatatggctggctaaactcctccctacgctggccaactgtggccagccagagttgccttgcaaaatcgtgggccccacgcattttttcccatctcctctcatattctctctccgcagtcgcaagcgcgccgctggcgccagcgccatccctgctgtcgtccgccgtcatccctaccgctgtccgatgccaccaccgcaatccctaccgccgctccccttctccttttgcatcggcctcagaggatttggtggtgctgctgctccgccgttcgtcgtcactcacagcggcgccgccggtcctccggtccgccgctccgctctctccggtctccgccgcccgcgctgctcccgccggccttcaccgccccgcctctcccgccggcgtccatcgcctccaccgccccgtcgtttccatcggcctctgccactcgcgccgctgccgccggcgtccatcgtctccacccccgcgccattgcaatgcagagaagagaggagaagacgagagagaagtggatgaaaaagatcacaaataaaaagtgtgactgacatatgggacccactgttaaattggagatttgaatggagagactgttggagtgaaattcaaatttggctctctaaatttttggcaatttgctaaataggacatttggagaggcaaaaatagccatgttgttagagatgctcttaggatgagagaaagaggagagccccgccgctgctcttcgtggtcgtcccggcgccctgctgcgcttgcaccgaaaaaaagaaagggagagacagattagtagagagaagggatggcatgcgcgttccattttattttttttaaaatttattttatgactggactatcacgtagttctcgcgtcaacgtaaaccgctcttaaaacatttgagagagtttgttttggactgttttacttgttttgcaattaaggaatataaattagatccatccactagttaacggagttaaagtgaactttttctatggctgaatggccaaggattatctgcatgtaggcccagtaagtgatgagatcaaatactactagctttgcatgttgtatgtgcatgagttgattcgaaaattacaaatattatctatatctacatacctgaatatatgcacaaaccagtcatgcatgttcaaagtctgagacattagttgattggatatatatgttgagctgcaatcaaaactgttgctattgctagctccaagatgtttttggcatacctgcatgccgcctcctattagttggtacgaatgggcccaagctaagctagcaggagtagcgctgaatccaagattgtagctctagtttcacacgctaggtcctcctcgtaaaattggatggaactatggaactcatgtgagttgtgtgagctttaggtttggagccacatcatccgagagaacgatttaccccttctatttacatgctgaacggactatgcttaaattaattatagtgaagagtaaattgcacttgcagtaaattaacctgtcaggttcctatcttgaatgtatatatagtcttagtagttaattgttctcacatattgtccttgtccatattcatatctaaaaatacactcttaaagaaaggatgttgtagatgaaaaaaatactagatagacacacatcaattcaataaaaaaagtatagtataagacataataataatcgtaaacaaaaagatatgaaaaaccaaaacaaaatgatgcaaggagtagaaacatagaaagagaaaatagagactaagatttcaaatataacatgtctcatgcatgccacctcaagtcctaatcaacgacaacttagtaaaattagcctttcggtgtcattttaactttggttcacacgcgtcaaacaagttcatatatcaaatgagtgttttacaagttcatatatactaacttttaactaatataatttagagatgatgtttttccccgaatcatgtcaattagagatggatgcttcattacttcataagcatggatcaatataatatcatgatgatattgtgtaaagtacaccaatttttgcatggtttcgtaaataattgtggtctcaatcactataaaaagatgatttttcatagcatcaccctataattttcgttggcggctatacgcgaaaaccgccaacaaaaacgtaacgaggggtggagcctatggactgacaacgaaaactggccgcgctaaaagatctgccataaaaaactctatttttcgacgcgaaacttcttaagtgtccgccaacgaaaatcacgttttcgctggcagtagataaagaggaccgctggaaaaaaaatccaccgcgcacctcaccgcccaccaaacgccaaataaaatccctctctccgcctctctccattctccctcgcatctctccttctccctcccatctccaccaccgccggctaccatcgccaccccacccacccccagtaccgccgccatcatgccttgggagcggcgcagggaaggggggtgccgtctctcgtcatcagcggcgcgcgggagggggcggcgggagcggatccggcacctcctcctctctccccaccgacggtggcggcaaagaggagggatggcggctcgcgcaggcagcagcgatgcttgggagaggcgaatctggcgccgacatgcctcaagagggtggattaggcaccggtgggcctccagagggcggatccgccgccgccaggcctcgagagcggcgtggggaaggaggaggcggcgggagtggatctggcgtctcctcctccctccccaccggcggcggcagcaaataggagggatggcggctcgcgcaggcggcggcgatgctcgggggaggtggatccaacgccaatggtgcttgagtccaaccatgacaacctcgagtgcgacgatgctggtggcgggtttgcttgggccaacgatggccagcggatttttgtgatgatgatatcttgttaatatgttatgttgctgttaatatgttgatatttgtgatgctctgtatttggattgtgcttgaatgatgttcatgtccattttcaatttttttttggcaacttcctggatgagatggtagaaagggattctggggatttattttttttcctgaaaatcattttcactagcttttggcataatcttgctgactgcagaagtttatttttgctgggagttcacttaatcttgctgccaacgaaaatagattattttcacttacctacgttgacggttagcctagccgctagaaaaagcatattttagcagtcaggaaaaaccatttttttcccgtagtgattatgcctgcatcaaaactcaactattaaaagccatacatgcagctaaagcatcggcacgcatgaagcacgcgcagttcaccatccatatatatccttttaaataataagtttgcagctgacatgtcaatttaaatggccgcgctctgcagctgtactgtacttatctcgctcgtgcgtgcacaccaactacactgtaactttctgtacgtgatggatagatatcagccccgtttagttcctaaatttttttcccaaaaacaatcttttaagcctaatttgtctcgcggtttccaggcgagttataaaattagtctttttatttgcgtctaaaaatcttttttaacatccggtcaaacgttctatgtgaaacaaaaattttcatttcaccaactaaagacctgatatactcttatcctgcgtacgacaggtcgacagctttcctagctatccgcctgacgccactatctgactatctccaatactcctcattcacaaaaaaaatgtggactctttagttagctacccgcgactgatcagctcaacagcatgatgtgcatgaattttgctgttgcctgcatgcctacgtgtcgtgcatatgcatgcttcaaattaaagggagcatgtataatataattgccaacaattaaaagagattctaaagagcttacaaattattggacactcgatccttattagctagtactatataagttgcaattagcatgcatgttcttgcttatgaaggtgtgaattgtctttatttaggcctatatgtactgccttatttctcaaattaatggatgatgttttgaatatcgacatgcatgatccttaatgcacatctttaatttattattattattttaagctagacatttataaaaacttatataaaactataactatagaatttgtttgtaaaaaatctcctaggataacattcagactttaaaattccactatttttgtattaatggtttaaggtttagatcaggcttgactacacatattctagattctaggatatcatcattttaagacggagatagtatcaaataaaagaggagtatacatattttaaatatttcaaatctatttaatatttaaaccaaacgtatatgcgtagaccaggttcctaaagtgtttttagtaatatgctagaatttagtggtaaacaacacagtgactagatgaaataaagaaaacgtggtgcccctatctcacataagtatggtcgtgtttagatctaaagtttttcttcaaactttcaacttttccatcacatcaaaacttttctacacatacaaacttccaacttttctgtcacatcgtttcaatttcaaccaaacttctaattttggtgtgaactaaacacagcctatagagagagtttgcttgtatattcaacttccactgcatgtcaattatatatgcacgaagcctagaatggataggatagagaatatacattaagttgactcaatgactccaaacttatccatttcaataaaaatccaatattaaacgctattccatgcatgctcataaaagtagaccaaccaaagcagcaagacgccatcagggtttcccaaactgccgggaccggggttaccacgcggtaaccgtgaaaaactgtacaaaaccgtataaaatttattaaaaattcaaattattttttaaatttatttaaatttaaggaggttaccgcggtatttatattaccgtacccccgcggtaagcccggtaaccgcggtaaccagcggtaagggaaaccctggtcgccatcaccggccacaaaaacatataataaaactaacaatagttgtctgcgcaatgcatggcctttcttctatttttgtttctttttttttctaaattcacttaattctggatggttaagattgctacaggatccattcaaaatttctccatgttttcccattgtatgtcttcatgaggtatttctctattgttgtatttattctacttgctcagttttgataagccattttcattcccatctgtaatggattggttccatgagatccgagatgctaccacttcactcccacttccccatagccatggctaggccccaccaccccctccaaatctctctttccttgttaataacttatcctcttcctccgattctcaccctacagtacactcttccaccccacccatccttattggaatgatctaataaactaggggtgcttgttgcatccgccatcaaatatatcctcccacattatctctcttccttaatcaccagacttgctttggttggaggttaaaaaatggagacaattcaagaaatgccattttgacaagcattcaaattcaaaaaaataccatcgacgagtgtgagttccaaaaaatttcagagtacaaacgactttatcccaaaaatgtcatcgccgttagggttccgtctatcccgcgccattaagtgctataggatgaataatgtatttaacggcacggaatggacggagccctaacgacgatggtatttttgggacaaaatgattttggacgatgtcatttcttgaaactcacacttatcgatgatattttttggatttggacatttgtcaatggcctttcttgaattatctctaaaaatgtggaggttcgatcttgaatcaaccgatgtacatatgtagtacaactaagaagaataaaagataaactaaatgaaataaatattttattagggagcgccaaaaagtagttgcatagatatatatcaagagatagactcatataatgcacaaaaaccaaaatgtgatatccaaatcacattgcatatgcatcaaaaagctgccaacgacccaatcatacactgggacacatgcaagaggatcgatcgtgtggttgtttctgcatgatatgtgtctatgaaagcgaactagagctacatatcatgatttatatacctggcatgcataaattaaagttttgttttgatagatggatgttggccaaagaacaagtcacatggacttcgcccgtgcttgctcactcacctaaaaatggacctgacctttttggagggtcaagtatagtaggtgaagaatatatgggcatgtgtatatatatactttgttaattagttagctgagaagaagaaaaatgagaaatacaccaactttgtaataagtacagtaagttaaagaaaattaaatatagttgcatgaccatgtaatccagttgatcactactcatgggtataattaaatttatccttaatcaaagtcaaaaaaattatccttaatccactcgatctgaaaagcatatataagagaaaatcctctgaaaagtatcaacaaacattatggtttcggcagtgacagtcagatacagagatgacagctctgaaaatgatgcaaaaattgacatttgacaactaaatctcttgcatgctccagaatagacagtacactgaatagatttaatctgaagcagctaaattgtatacctaaactctgaagaattgactagtaaacagtacctctcaatcttctagagcctatacaccaaactagaggccagcttcctttctgcatgttgattttttgattccttgttttttagtacacaatatttcttttcatgaagacaaacgattttatttacccatgatgcaggaacctagtctctgttgtagtgttattgccattagcctagctttattttaacactcaagctatgctaggtaatcactttaacgacagaaacaacaaaaaggagttgatgtttaaacggctaacagttgacctgcagacttagagtatatatatagctctaatacttttcaggcatgaagatccaaatgatgaaccctcacacatgctagtgacaaaataacatactataataaccgcacccacaccttaattttttcttttagtaaaatgaaagccatcaagtaaatttgtgctacggcagctcagaagtcagaagaagagaacaacagtgtactaagcagatgataaccaccaagaaagtaccaactgctgcaaaaatctgttcccagcatatgaaagttaagtgacaattaattcagatatacaactactaatagtcaaacagaaaagcacagttattttagagaatataattaagatgttcatctgaatataatctgtacatggacacagcagttacatgaacgcttcttatgcgtatgctttttaacatatattatgttacattacacaccatcgattcaccaaaaatcaaaatatgaaagaaaaaaaggaagagaactttttaatcggttcatacacaatcagattcattcatccaccgaatcctttgaatgccaaatcgccaataccaccttacctactgatgatgctgatctactcgcacgacgaggccgaatcaaatccacggcgatcaccggcggccggtgccggaggaggtgtcggaggagcagtcgcattcggccgcggcggcctccacctctcgcctgtggaagctctggtggcagccgcaggcggcgcagaggagcgcggcggcggtgccatcggcgcccgacgccatgaactcccggcagccgtcgacggcgtggccgccgatgctggcggcgtggttgcgctggcactccctgtaccgcaccaccttgttgttctccttcctccccgccgccgccgccgccgccgtgctgccgttcgcgtacggcttggccgccgaccggtcttgctgaggccccatcgatgatcggtcacagatcacacctcgccgccggcgagcgtcgacgacgttaggtggcgaggaggagaaagggaggaagaagagaggaatggaaaagctttggtatcacggctttggatggtacgtacttatatggaggagaggagatgagcaaaagtttatctttttctttttttccttttttttttgttgagaggaagtttctcttttttattttgtcttgttaattactttacatgtactttgctttcttgatctcaaatatattactagggcgtgtactcttttgcttgtttatgcatattgttcacttgcaaacaatttaccttttttgttaaacaagtcatgcacatgagcgaaagagtatttggtctagtggtttgcagcgacctagtatcccaaagttctgagtttctatctctatagaagtgaattttagattgggttatctgagggactaaattcttgacttaaaatgttgtatatatccggttggatatagagacgtgataaaaaaaataccattcttgaagaaaaacgtcatgcacaggaactagcgcggcactggtataataaattaatatctttgagaaattgaaatattggtaccactttctattctgtacagcaattgtaccttttttgcatgatgattaaattagcaagcaattaactttggttgaacatattagtggcatgagaggactacattgaattgttaatcagtagatactctcagtgatttttgcttatcatttttcaggtaagtagataaatttgcactcgtagttaagttggtttctcagagaagcattgagccttttgaacttattatttattatattattatttccatagaaatggtcatgttgagcacgttggcacattaagcatgatctagtagctagttttggttgttatttctgttgctagtgctggaatattttcacttggaaaaagccatatcttatcttgtcctcttgtgctatttgccagtaccaaaaggcaactgcagagcattcagtttggtgactcgtgtgtgccatttagttaaggaccaccatgaccaactaactaagcattttaagtaggtcctttagtggacaggattagatatgaattgacttgacaaaacgtcttatgcgtctcttaggttgatggagattcgtctaattgctaagatggtgaccggtttttgttcactgacatggacatcttgaagaaaaggtgaagtagtgtgggggagaaagtcaaaattcagagattcagtgacttgtgcacaacacaaagcacagaagaagaaggaaatttagggatgagaggaagtttcttggatctacatgggaggttggattgagaagcactcttctccaattgactcttctgttcatcatctgtctgctacttgcttgtgccaccttctcctccatttttcaggaacaagtctgtccacttgatcaatggtgccaagctgtattctctgttgtgtagagaattatggtatgggaccttcctgtacgtcttcagaacatacctaattccaatgatgcatatatgtcctactgcccacatttgagcatgatgaaatcatgccaattttttccttgaaactaaatcattaggagaactaccaattatatttcaataaatataagtaaaaaatccaacagattaaaagaaaaagagaaaaaacaacatctcgacaaggacaaaaccttgccgaaagcttcaaacggtgggcggctagagaactaaacttacaacaccagctcgctaacaactaaacaatgacggagcacaacacaaggcatcgttgccgagctcattgcaaaagcaacacagctttggctttgttgcgaaatcatgccactttttcatgaattacctttaatctcactatcaatcaaccacatttgatctgtgtgtgactgctagctcttgtcacaaacctaagactttaagctagttcttccatgcttggtaaaacgacatctaatctactgaatgcaatgaacgtggatattgtcccaggttgaggtttggtgatatatatgaaagattccatgacatctgctttatcaagttgagatctctcctcaggaaatggaaaatgatgggctgtagaaacgataaaagtagatcactgatcgccgcgacaaagatacagaaaggtcgtattcagcaaccaaacttgtcttctgtagtggaactggtcatcaaataatttatgtctgatctatcaaaaataaggaaagaattaggtgccctagtgacaaaaacagcacacattctttgctttgcttaacttttaattattcaggtgaaaaagaggagcatgttctgaccagggaataccattctgagccttgtcaagttaatttgtcaaagactagtaaattaggtgtccttacaaagaaaagaaaaaagaggacatgttagcatgaaccgtgaagtagacttgttagattattaccacctaaaagtctaagaaatcaatcaagtaactcgatcgaattctgctcctgatcttgctggcattatcgatggaccagttattttttttctctcaggattctagaaaacatcactgcaaaaatgaaaggaatatctcaaactagtaccacacctgaagtccttttcattaaaacataatctcttaagaccctatgattagtacaacgatgtttttaatatctccatcaactttaaataacttataatatatcgttgtacatgtgccattgtctcttcagtttaaaaattaaaatatgcacttgatgaaaagtactattagttttctctacagggggttatgcactaaagttctaaacagtccatgctcatatttacttacacccaaacaatgaacttgagtaaaatgcaagaactaacttatcatcataagttgaaagaataaacataatgatacagttagttataccccacgggatgcatctcatcagtcagtcagtcatgacaaccaaatctttgaaaagttaaccaagtacaccggattaaatggatttgcaaagtactgaagtactcttgaatctccatgcttgagtaaggaaatatggggctcaattttgaccttatgaagtactagtagcaacaacattagggcctactggctggtggataacgtggaatttggctccaccaatcaaatcattacagaaatattaggacaaagctggggcacacctcactttaaggttcatcaactctggtgtcttctaatgctatcctctggcgattagaatgtttgttattatcaaagccattgcccatgaagagcaatcaaggatcagatgtacacgaatggtttgagtcgccatcactggaataataattcagctcatcatactaatttattttttcagcaaatgacatgtacagtagtgttggatagaagctgagaaggatgtgaaggtgcagggtcccccacgagagctgtttatgctttgatgtggcgatccaacaacatacagtggttgttgcaaattggctggcgtccattgcaatattgcattgcattgcaatgcgacgtatgtgaaattggcaaattgctaggtgcatgtgagattttgtgtttgtgtgtggcttgcaattgaagggcctttcttttcggccagcttatcctccgcaccgcaaatctggttgctcgcttcaatgaatgtcccagcctgcatcaatgtctgtcaaactcacaattcacaactggattgttcaacaacttttcagcaaagattttaaagaacaagtttggtttgcgcagcaggttcagcggcatttagcacaattctgagcagaaagcaaaacgtcaagaaaccaaaactaactaaataacgctgatgcttatctgcagatgtcaataaaatcggtggataataggctaggtgagcgactggagaagcatgaagagggtgagtagggtcagtgtgcctgccactgtaacaccgtgaaatggatggtatctggttggcgtccaatcgggcgtcgcgagcaagcgacactctgaaacgggacggaaggagttggtctcggagacaagaggcatctttttatcttgcaatcgattgatctcctcctattctttttctgttgctagtgactagtgatggcgattgcaatagcaaaacgggatagctagcatctagtactacctctatattccttccccatatcgttcgccagttgttgcttctgggatcatcgcgtggcatctcacgtagtatggtgctactccatccgtgctagtataatataagagattttggttggataagatatgatcttagtacaataaaatcgggatatacctgtctgttcacattcattgtaataggatgtcgtatccaactaaaatctcttatattatgggacggaggtagtagttttcttcttccatcttggagcatcaaagcttggtcgctgacgccagcctgacagtgaagcagtgatgcatgcgtgacaaagattgagatttgataagagaggcctaaactgaactgagatgcagcccacgagggaattaacgggcctcctagtacttatggccctcggcctataaatatatgggccgaatgcttatgggccttcacacggcccatgagtctgctctcgtcgcaaccaaaagtcttcttcttcttccccttcctttcccttctcatccatggctactccagcctagggagtagggagatcgatccacctccgccatgctccttcctactccaccaatccggccatgaccggagctcgccgccatgccgccgcgcgcccgcaccctcctcatgccgcttgcggcggcgacgctcctcgtcgcctccaccatcttcctcttcgccgccaccggcgctcgatggcgacccgccgacaccggcctcccggtccccgccgccgacttctctgcggccgtcctagagagcgcagtgaccgacaccaccgccgccgcgaaggagctctcgttcgttgacgagaatggccgccccgacgatcccgcctccagctcggcggccgccgcgagatgcgacccgacccacgccgccgtcagggtattcatgtacgacttgccgccggagttccacttcggcatcctcggctggtcgccgccgacagatggagccgccgacgccgccatgtggccggatgtcgcagcggcgccgccgccccgcggtaccccggtgggctcaaccagcagcacagcgtcgagtactggctcacgctcgatctcctctcctcctcgtcgccgccgtgcggtgccgccgtcagggtcgccgactcccgcgacgccgacgtggtgttcgtgccgttcttcgcgtccctcagctacaatcgccactccagggttgtgcctccggagaaggtgagcagggacaaggaattgcaggagaagctggtcaggtacctgatggcgcagccggagtggaagaggtcgggtggcgccgaccatgtcattgtcgcacaccacccgaatagtttgctccatgcccggtcagtgctgttccccgtggtgttcgtgctgtctgacttcgggagataccatcctagagtagccagcttggagaaggatgtcattgccccttacaagcatatggctaagacgtttgtgaatgactccgccgggtttgatgaccggccgacattgttatacttccggggagcaattttcaggaaggaggtaacacgattaataactatgcttgctcattcaatctctacaaatgaagttcatactctctgaggtgttaatataacataatgttgacagcgatgtagtgtttagtttctttgctttccttaagtattatattttcattgcaactgctatctaaagtaacaagaactcatcttttgtgccaaggaaaggcttgtagccaaattagacaacaaaccttgagaacttccagggtatagaatgtgtgtttgcaattagttgtttatggtaaattgttgataaagtgtttgtttagctccttttttcccttcaatgatactcttgtgtatgttgttggtcactggggtagtaactgatcaagcacacgtcgtgtctacctgtatcttcctaaattgtatcaaaggcatgcatccctcctgcatgttccctcaaaaagaaaaaaagaatgagaatttgggcaggataggttaatagagggtgggctaactgcttcaagtcaaatggagcttgttggaactgcaagcttttgtctagggctcaaggtagacaagagtagttctgtttgctcaaagtgcagaaatcatgacccattaatgactttggaataaccgaataaatattgctttgactgcaccggtgcagaactcatgattatcaacttcttattgagtatatgactacactagtactctctgatattccaaagatcagcaaattaacaggtgttccaaataaatgatttgtcaaaagtttctgtcaagttagacaagagtagttctgtttgttcaaagttcagtgcttatgatcctttcataaatttggactaagatacgttttgactgcactggtacagaactcatgatctatgatccatttatgaacttcttactgagtatgtctacatgtcaatctccaaaatttcaaagtccatcaaattaacagatgttacaacatatgaatcatcaaaagtttgaatgccgacatatcagcagatgttccctgtttcagccatctggcatcaaataaatttactgtgtcaaaactttttttttgtcagctggatgtgtatccttctttaaaagttaatgttgatacatgtagactttaggttattagtttatctatattatctatatgctacaaaactagcgattcatggactaataaattgcatcatttttgttcagggagggaacattaggcaggagctatattatatgctcaaagatgaaaaggatgtttattttgcctttggaagtgtccaggaccatggggccagtaaagccagtaagggaatgcacgcatcaaaattttgcctaaacattgcaggggacaccccttcttccaatcgcctgtttgacgctatagtaagtcattgcgtccctgttatcatcagtgacgacatcgagcttccttatgaagatgcattggactattcgaagttttctatctttgttcgctcatctgatgctgtaaaaaagggttacttgatgaggctgattagaggagtaagcaagcatcaatggacaaggatgtggaataggctgaaagaagtggataaacattttgagtatcaatacccatcacagaaggatgatgcggtccaaatgatctggcaagcattggctagaaaggtgccagcaatccgcctgaagtcacataggtctagaagattttctagatatgatagaggaaaataaacatggagaagatccattagtctagaagattttcaagatctggcacaggaagaaaataaacaggaaggcggtgtatgcatgttatctagggccttggctaatctaactagcatttcactgacacatccgttgcacacgtctcatggtttcatgaacataatcggacagattagcaaggaacagtgagatgtaaagatatcaggttaattgttggctcatagcttaggttaggctgtccaaccgaagtgtatactggcaggcaaaagattgttgattttgtaacatatactcttaaaagtaaattaaaagagggtggcaaagttctttttctgaacatgatgttgtgaacagcattagacttggtcatatgcgaggttaagccgtcttatgtattgatgagtaatttttgcatttgctgttccttggttagttggtttgatcagctcttgggcatcagttatcgtaccctaggcttacaatagagcacaccgttcggggacgctattgttgaacagaaataaggtccaagaaaagctcagaattcacgggcaaactcttgaacggcattactttcctcctatattctgatagcagcgaaatctgtattacagctctattctaatgagctatctgcaattctgcatgcattaagcatttaagctacctgaatctgcagtttgccgctggcaatcatcaggaaaataagaaccacatgacagttcattaatctcttttaacagggtaaccatttatacatttgatatgaagagaaataacatagttcttattttcagagtacatttgggaacagggaaagcaaagcaggtgatcatacagacaaaatacccaagcttaagctagccttagtcaacctaaaactaaaagggaagtatcgagtcggtgacaaacctagccttagtcaacctaaaactaaaagggaagtatcgagtcggtgacaaacagcgatagatcagcaacaaagaatgaagaagccatcgacaacaactggtagtagaaaagattaaatatgatcttcatgactgcatcagttttcttcaacatactcgccatcttcccgttgttgcaacttcacaccaacgttcagagtcatattcagaagttaccctcctttgcttacacagcagcagcttcatccttgcttaaacctgcccactattaaaatttgtacaaattcaaaagatcacatcaaagtgacagtttttgcactcaaaacaagacttgttatctatatgttccagatatagcaatggaaggccattactccattagaatgatcacataaaggccgtgcatccaacagacggattgtaggcactgttgtagtgctctgcacggcttctaaaaccctacaaacttatgcaatgttgcaaaccaagaaaagatgctgagctgattcaggttgatacaaaaatgcacaagtcaagtcatgagggctttttttttaaactttgaacgtttatttagtcaaaaccacattgtggaagaaaaaccacgattttcaaaaggatcttgcaattagagtccgcatcaaaagttcaaaaccgaggagaaattagagtccacatcagccatgcatagcaaaaaagacatggattttaacagtgcgtcttccaaatttctcaaggacacaagaaaatatttgatttgtatatcattgaagggactgtcctcaaaccatcaaggttccgtttggtccacagaatagaattctgtatatcatcctctttaagctaataattgattgatataaacctacaacatcatcgaaaacatggcatgctaatatacatgacattgaactgaagtggagtgatactgtaatatggacatatttaaaaactaaactacaaaactaggatgaaaacaaggtttcaatgataattaagcaaaattcgatatgcccaaacttacaaagtaagctcaacaagtacaatgctaacatatctatgcacatgttcaattacaaaacatttgtatactatcctaacacattctacacaaacaaaaagcgcttttacatccactattgccaaacaggatctacgaaaccactaacaacccaacgcacattgactaatacgagaacaactaaatgaatagaactccgaataaaaaaatcatcaataaaacaatggcagaaaaaacgcaaaacattgtgatctgtttgttgttttggtgaacccgcgcggccatcatcgcacgcgctccgaccgcgggcagtcgtcatcgctcaccgccggcgagcgccacggataccaaacccgcctctttccccgaacaaagcgcgccaccttcccgccaaccgtacgaggacagcggtggcggcgcgaatgccggagaggcgactccggcagccgcggcgccgccggacggcaagctcagataagatcaagtagtgttcgtgagggtcgaaaccctagctcgccgcctcctcccccacggcctttttacaagcgaaaaacgcgcccaccaaatgggctcgcgaaggcccaactaattctagcccagcccataatggcccactaactatcccccatggcccactagagctaaaccctaatcccctcgctataaaatcgctctctcgaagcgatctctccccttcgccgccgcctctctcccgcaccaagctgcctgagccctagccgccgccgccgccgccgcgcgccaccaccgcaaccatggccgccgcgctcacccgcccgcctccaggcacggtccagtgcttcgggcgcaagaagacggcggtggccgtctcctactgcaagccggggcgcgggctgatcaaggtgaacggcgtcccgatcgagctgatcaggccggagatgctccgcctcaaggcgttcgagcccatcctgctcgcggggcgctcgcgcttcaaggacatcgacatgaggatccgcgtccgcggcggtgggaagacgtcgcagatctacgcgatccgccaggccatcgccaaggccctcgtcgcctactaccagaagtacgtcgacgaggcgtccaagaaggaggtcaaggacatctttgcccgctacgaccgcaccctcctcgtcgccgaccccaggcgctgcgagcccaagaagttcggtggtcgcggcgcccgcgcaaggttccagaagtcgtaccgctgagcgctcgccggaccgattcggagcggtgttctcttttccaccctatcaatggagctacttggcttgttctacatctatctagctactgcattactttcaagtttagtcttttaaaacttagccctgaaccttgcctttttgacattgtgaaatggatgtgattgaaatgtttaagactctactctagtctctggaatatggttttgcctgttacctatgttgagttatatttatgttgttaagatgatccatactgcaagtgttatgctatgttaagatgattctgcgagtagtgttgctgtctgctttggtaccgctactgttatgttgtgattgtgacatgctcatttcaggtagttagggttttcaaattt

SEQ ID NO: 62722 - DNA, 16144 bp, Oryza sativa
catccagatccccatgttaaacgagcgcgaggtaccctctccctcccgccgccattgccgccaccttcccttgcttgctttgctttctctctctctttttttttgagttcttttgcttcgagatgtggaggggtttacttactcacgatgagattatacggaattattattcattattattattatactttttggtttacttactcatgatagttattaaattatatatatttttgttttacttactcacgatggaattataatgattatattttagtgtttttcggtttacttactcattctgatttacttactcttcataagtattaattattttttggtttacttactcacgatgggaatattgtaatcgtggtaatattaatcagttaattactgtgtgttgtgtacgtgttggggggtgtaggtgtaccagctgtcgatcggggcggtgtgcgggctatcgtggccgtcggatcggctggtggtgcaggtgctcgacgactccactgaccccgtcatcaaggtacgtactaaaaacacactcctcctaataattcactcctctgtaattaaattactaatctactcctgtcctactatacacttaattactgaaaggcctagcctacatagcagcagcgtaattaatctcaaccccatcgccatgtgtacctgtcggtgaggaagactgaagaaaaagaaaaaaaaaaacctcttgctgtcggtgagtgagagtcaaatcgtcaatggagtgaggctgtctctttttgctcttttggtgaaaaggaagggaggaagggcaaaaaaaagccgtgaagctggggcactctgccgctgtagcctccgaccaactttctctctttcctcctctcgccacgctaccattacagttggtatgcaagcgaaccgaacccggcaatctacttatacgataaataagtggtaacctatgaatttttacatcatgattggatttaccacacctagagatataagtagtttgacctataaatctatttataagttaaattagtaggcaacctacgagtaattttgcctataaacaggttcatgggttagcccgcttgccgtccctacatcacagtacggacgccacagtacagtgtgtggctagctgctagtagctctcacactcttcatcactgctttagcttgagaatttgggtggaagctgtggccataggattcgattcgtcaggggggtggatggatcactgcatatgaaggatttttgggggcgttttttggttctttattctgtggattttagtggggggcgtattgtctttatttgtgctggtttttagtgcaaaatggcgggaactctgcgagtttgttatttccaaaatggtttaaatatgaagccggcatgttttttaggtttatttggaatatgtggattttttttggggtgtgaattctcattttcagctaggcctttatattgtgtatagatggccggaagagcaagaaaagtaggtttacttcaggggaggataaacagtacactagctatggcatttttttaaccgaaaaattaaagattatctcttactgaatcctgacagcagaagaatcatgtcactaggcagtagtttactcctgcctgtcattactgctaatcacttgccatcaccgggatcaatgggtaagcggcgtgcaggccacgttgtacactgaaacggccatgttatcgctggctattttcccagtactagcactagataggtgtagtagtagtagtagtagtagtacaattgggtaacagtgtgcataagtatgtgctgttactgtcgataaacaagacaagatacttggcctagaagagctatattaaacaacttgtgtcaattagtactataagctaagctaggatagccatcatcatcagcttatttctaggttggcccatgcatgctagtaatttgtccatttggtcccatgcagaagctgcaattggcttgcaacttaccatgtatcattctcatgttaagccaagcagtaataagtactaaattcaccttgttgttaatatcatattgatgtgattaaattgttgttgggtggagatcagtatgtggctgacaagtggggccattttctttttgcaggagatggtgaggatagagtgtgagaggtgggcccacaagggggtgaacataacgtaccagatccgggagaaccgcaaggggtacaaggctggtgcactcaaggaggggatgaagcatggctacgtccgcgaatgcgagtacgtggccatcttcgacgccgacttccagccggaccctgatttcctccgccgcaccatccccttcctcgtccacaactccgacatcgccctcgtccaggcccgctggcgtttcggtaagtatagtataatcgatatctatcccgactctacatgtcatccccctatatctcgtgttgactagacatttgcgtgtggtgtcggttggtgagtgattgggggtaaataagggatctcatattccgcgaattttatatagtcggaatattgtccagttgatctgggccatttatgggtgatctaatggctgggccgtgcgatcgagttgttggttgggcgagtgagagtgagtgtcacttactgacggggcatgtgcagggtacgttgcacatttctgacagctactagagtatataagcttaagatcctcgtgcccttgtctcatactagcattgtactggcaactaccagcatcttgctagatcttctcatcaatcgtatcgagccggatctctcaatccgatcatgatgattatcaactacctcattcgttcaaaaatatggttattaggatctcatcgtttggcttattcatgccaaacgaaatatttgaaaacgaaaaataatttataaataaattttttatatacatatttttagcgataaaaaagcaaatgctgaaaaataaactttgacgaaaaaactccgaaatcaactacaaatttaagattaaaaattgaaattaactaataaacataagcataaacgaaatgatgtgaccgatagatttaggtgatgttaaatccaatactaaataattatattttaagatggaatatatgcgcgtgtcgccgacgatcgccggcggtgctggctccaccggctgggccaggggtgttgctatcgccgtcggtgatcacggcggcatggagggtcgtcggtgattgcgtctggcaattatgcgtcccatttcttccgggatgcaaattgtgttcacatattattttttagggtttagttggtacttgttggtagggtatgtggcagtgtggacttcattaagtaaagatgatggagaagatccacgtgcctcgtacttctatgacgactcgcgatagcccgaccgacagttagtaagagctgaactttggtcatatgacctaaaatatcattttttatttataataaattaaaatccgatctctatatctaacatgattgtacaaggtcagacctaaattaacaattggtttataaaatataaaatattataggattatggtcttataaacgttttctcactatatgattcatcaaattgtctggtgctattcgtttaaaaaaaagatatcagttggttcatataaacaccttcttctatttggttcctataaaatcctctaaagtaagcatagttaacaaggtaaaggcaaagatcttcttcacttaattagaactaattatatttccattagcattgatccaatcgctagcacaaacacgagtacacaaggaaagtaaagtacaagccccattccttccttggcttccatgcagtagaggagctgtgcgtcccagggcggctacgtcagcacagcagcagcttgtcctgacactgaagctgagctgagctgagctgacccatctcgctgcagtcactgtgacgtggggcccacccgtgctgccactgccgccaccatgtggcgtgtacgtgacgggtgggcccatctcgtcggtgatccttgagccctaggtccggccatgtcctgctgtcaaatgctgcagcgattagtgtagtaattaattaggggccgtgccctctgaagctccagcttaattggtccttctctccaacagtggtgtgatcaagttgcaattattatcaaagcatagcagtacagtgacagtggcatgtgagatctccagagttttggcacgagcagaaattgtgctgcgatgtgcattggatcctgcagctaaattcagagattagtgtggagtagtttgggtccaattgattattagtattggccactgcccaaggttactgtttagtagtagtggtagtagtactagtcttaatacagtagtagtagaagaaacaggacaaaacctgccaaaaataaagaaacaagcaaataaataattactacagaggacagtgcagtgcaggcatccacagttgcacaatttcttcacaacagtgtagcagtagtaaaatgtttgctactagtctggttagctgagaactgtttccaggtctctttgttttaatgatgtatatagtacagttgttacctgtcaagtatttctcatggagctatgatgttgatcttgtctttgaactatatgatgttgacattgtctttgaactacaatgatattgatactgtcttttgtttctaccagtgaatgcagatgagtgcttgatgacaaggatgcaggagatgtccttggattaccacttcacagtggagcaggaagtgagctcctctgtctgcgcattcttcggcttcaatggtaagcttcaaccttcagtaatttcatctgttcttcaccaagaactttgtctctgaagattctaggatatagaatatgcattctatgttatgatttttatacataagggctgattgattcggtgaattttcaatcaggaactgctggtgtgtggcgcgtttccgcggtaaacgaggcgggaggatggaaggaccggaccacagtggaggacatggatctggcaatcagggcgagtcttaagggatggaagtttgtctaccttggagatgttcaggtacacaccaatcatggatatcctacacatgatcagcttgagatagcatccaatgcatcctttgtcattgctcttgctaagttgctattgcatttcccttctttttctttttcttgaggaaatagtacattgattcatgttgcctaagagagaaaaaaaatgagtttaacaagaattgcgtcgttttcaggtcaaaagtgagctgccaagtactttcaaagcctttcggtttcagcagcacaggtggtcatgtgggccggcaaacctgttcaggaagatgctgatggagattgtgagaaataaggtctccccaaacatagtgccaagaaatccagaaaaatttaagccatgcagcttcttgggttggcatctaacatgctattattgacattgttgcagaaagtgacaatctggaagaagattcatgtcatctacaacttctttttgatccgcaaaatcatcgcgcacatcgtgacctttgcgttctactgcttgattatcccggcaactatctttgtccctgaggtcaggataccaaagtggggctgtgtgtacattcccacaatcatcacccttctcaattccgttggaactcccaggtaagattttcttttgattttattataatcctagttgaatatgatcaacagtaatgctcctttggtgaatcaacagttcatgattgattgcatgtttagttaacccaaggaattgaactgtttgcaggtcttttcacttgcttttcttctggatcctctttgagaatgtcatgtcactgcatagaacaaaggccactctcatcggcctgttagaagccggtagggcgaacgaatgggtcgtcaccgagaagctcggcaacgctctgaagatgaaatcatcaagcaaatcatcagccaagaaatcgttcatgagggtatgggacaggtaagaaaaattgatcagaacaaaaactctgccaaatctttataactgttttctcagctcatgattcactgatttcgagtgacaatttcttcccttttttcaggctaaacgtcacggagctcggcgtggcggcattcctcttctcctgtggatggtatgatcttgcattcgggaaggaccatttcttcatctacctcttcttccaaggcgcggcgttcttcatcgtcggtatcggatacgttggcacaattgttcctcaatcataacagaagagaagcaaatatatatattttcgagatcggccgccttcaaattcaccatgtcttcagcaagagtctagtagttatataaatcagtttgaagtaaagatcatgcagcatttttttactctcatttttctctgtttcttttcttttctttttcttttcttctttgcctttttctctgttatgtgctattgtaaaaaatagtgcagtgtaaggtcactgcaggaagaaaaaactagggcaattggtgtgatctgggcaaggaggaggtgaggaggatatcgtgatgtgtttttgcttgtagcaaagtacgtgagtggtatgcttaaagaggagcaggatgactctgcttccgttgtactgtaataacatacagaaaaaaaaaaggtcagacaagtgctggacaaaaccaaaatgttcagccttctctcgcattccactacatcttttattttgtttccttcgcatgtgttcttaccacttgagctaaaatgacatcaaagtagtaatatttatttatttttttgtcgggaagagaagtacagtaacaacattgtaaaaaaaaggggggaaatgtacagtaacataatacacaaggtactactatacatctcttaatgaaaaatactcacgtgcttccttctcaaagacatgaaacaaaaagcaatagtctcccaaacagagaggctacatcaagtaccagagcaccgtgtccgtgcaccacagcaacgtctactacatctaagaagacatggagatgcgtccaaaaaaaggacacgaaaacgtagcaaacatgccacataccaacatactttttttatgcagttaggagttagaaccttcattcgctattttttttaattaaggaaaaatacattcttgggctagaaaattacaaagaagttaaaagagtagcaacaataaacaatatcagaagcagatgatttttcatcattcgttcctttcccatcctgacaatctccgtttttcactaaaatgaaccagaagaagatttcacaggatgggatttttcgttaccataagcaaaacagaatttgcagaattagaaaccagtgagatattacgaccactcgctcaggcagccgaatcattgttgactaatcattattggtttcagttcagtttagttacaatcaaaattatatctgtcgcaagatgaatctacattcctatcagatgttgcaaacttgccagaaacatcaaacaaatgatcaatacaacgccccagagcgccccccctaaacacgacataagtacagaccatgagaatgagaaactaacacccgctacactacccactgcggctaatagagtgaaagtgggtagaaaatgagacatatcctccctacctgacatgtctcctctatctcctatggaataacctctacaatgaatagggttagtccaacagagaaaattgcaccgggtactcctggcggatcagatcaaaatgccagcacttgcaggtgcctcaaacaatttacatggtggcatcaagatcgaatgctcgcacatggagtaccaattcttccttctggaacctaaaaccacaacagaagtcgaaaaacggtaggctggtagatacgaggtaaaagaaaacacagtcagggttgaactcttgcaggggtaccggaacgatgtctaccacgctaccctccttaagcgacgacataacagaagactttgtatcatctatcatcgatctacttgacagcaggataatattcttttgctgcccgagaggcttctaactttggagtctacaacggagagtcctacattatgatgctaaggattcaagctctctcctcctcctcccacctctgtttccagaccttgtattgtcagctggctcaacgcttggaacttgatccttactgtagatgatacaatcatctagagtgtagaccctgagcgcgagtgaggatacagttgatgtcttcatagctgctgtgaaggaagaccagtaccaccaatcgttcttcaagaactcagcttttatcatgccctccaacaagttagccgccaaaaccatctaaaagaggatggatgtcattaatcaggaaattggataatgcaaaagagctctcaagtaataatttatactgcatcttcacataatgaagttaaaaaaagaaagggctaaattatagctcaggtcttggtggcccataattcctgtatcctgtttacttgtgtatctagacttacaacttaggaactaaccacttgaatctagacttactgctaaaaattttaaataaatggatcctgtataagtaattttacagttaaattgaactgttgcagacacaaacaaagacatggtaaattaacgctgcatgcttgagagtatatcttagaatttcggaacactatcaatttgatgaacgtaagccaaatgcagtatgccaagattacacattaagctacatagatatatttctgtaacaaacagtgaatagatagattaaggtacctgggatattgattctgcatctttgacaaatgcacgccatgaacgccttcttatttgctgacactttgaggctctcagtgcctcctcaggcaaggctgcttcgatgtcaagcaagtttatcttttgctgcttaagtatgtgagagtttcgtcctataagaggcctcaaggatgactctggaaccaaccccccattaacagctagcaatcgtgttggcttgcctgttgtagaatgtgcttcctcaccagaagtattatcaggggtgggctttttagatttttgcaccttctcatcacccacattgccaggacaactttgaccagatttggaaacctcttgaactagcttttgagcagacattgcattgcattcctctaaagaggaggtccaatccttgagttcatcatcttttctgttttgactttgtacaattgcaggttcaagaaaaaatgcaggtgaaggcacaaatgatggaactccattggacccattaagtccaatctgctttactgtctccttgttcgaatcatttgtgacgaactttctgcaaatttcttcaaagtcatatgggcattgcatcaattttctgtcactggacggttcaatgacagagctacattcaagggaatctttttccttcgtatcagatttggtaaccttcacttttggctcatcattttctctgctttcatcaggagactggtggattttactgcattttccatcattatgcccctcaaactctgtagatatgagataagtctcatgacatgttaaacaatggtatcgagaaggccatacaggttccaaacagtcgcagcgatatgttctatcttcagaacttaactttatcttctttcctcgctttttcggtagatcacttgtgtcctggtccaattgcagaccatacttttgttccaaaattactgcagccttggtatttggaagctccataagctgttcaccctttggaccagaaattggaggatcaacgagaggagaactgctttgatgacagaaatgtctttgccactgcaagatagagtctttcagttccttctcccttgggtcatagtctcttaaccagtcaagaaggcactggatttcctcatcagattcataaatgaaaatagatgctgaattccaacctttgcaatcaaaagcagatgggggataactgttaaccatactgatatctctctccttgggtttcagcatgcttccatcagccaccaaccaaggacgtttacccggtcttcctataacccagtataatcgaccaatggaatccttacccagacactctcttctcgatgatgccatattaatctgtgactctagtaagctaattgaatcctgcaattttgaaatgtcatccgataaagtatccatttcattattatcagcatcaagctcaattgatttagttgatgatgcttcaagattatcttggaatgatgtgctggctctttcatcaggcaactctcttccaggtgtgctaaattcagtgtctttcaagttcaagttatcacatgtactgctcttggcacctaatgacctcttctcacaactctgggacccttcatcaatagcatccccatcaatctggtcaatagccattcctgatggttgttcagaaagtcctgaagatttgcgttcttcaaccatagatgcactggatatgtctttgtcacttttgtaaggcttgcctacattcaattgcccatcaggaaccccatcagctgggttgtttaggttaactccaacattaccctgttcagcctcttccagatggtccaatgctgtgggcgtgcactgctgttgattttccacgggtccagaactgttgttaaaatgctgttcagttttactagatctactttgtctagcatatgaagtcctcatctcctccttatatttcaaatctttcaattcaaaatttgaagcacggaacttctgctgaagatcgcctaacttatctgaacattgatctagatgttctctaattagagcagtgttgagcatttcgtcgcatagaaatttcagtaaatatatcctctgcatttcaaagatcacaataaaatattaaaacaaatatgtaggtcactttgtcaactatggaaatcagcataccagcaaatgcttaggcaatcatagtattgtacagtacaataatagagggcaggactcttaagtaaaaaatcaaaccagactaaaattgtatgcaatgtccatgaaatagacatacttataacaaggtatatttgaaatggtaacaagaactgtatccagcagtatatatttaccactgagaaataagaaaaacacatcaattccttacgtgttgcttaacttggatgtccaaagcaacaaaacattgtagctactatactattccatggatgacaaaattaacttcaagctccaaattattgacctgaccttaagtccttataggtttaggggcctatagcaggtccaactttgtcttgtatcactcaaaactctaagaagcttattttgagtcattattttgggattgaggagcctcttggtttataccacacattaacaacagagaagcttacttcaaatacaaaggaaaaaagaaaaacaaacctcttgcatgttaaggtcccaatattccttctcttccattgctgtagctaatttattaagttcctcttgaaaggcatgggcttcctccccaacaaatttcttttgctgccgtttcacatcttgaacaccctgatcatgatgtgctttcgtttgacctaacatacatgatggacagtaccagttcccttctggtatacgggctagtgggggattcaagcagtaagtgtggtattctgagtcacatttgtcacatagcagaacactatcatcgtccctatcaataccacatactttgcaaacgccatcttcccatggagctttaggtaagctgttcgctgcagttagaatatcatgtagctcctcgtgcatttctgaaccagcattcttgtccgagaggtatttgtcaaatttctcaacaaggtcaagcacctgcaccagccaagtagaagggaaatgagaagataaaagacttctacataaccctgactataatgttttaaaatatgaaactataaaaaggatctatatattcgaatcagcattagcaatcacatgagataacacacaaagaggtggttttttttttcaagtaacaataacattgtttccatcattagattatgaaactaaattggataggtaaactaaactgataatcgtttacaacaatggtctgaccaatgtagctcaagggtgcaatgaatggtgacaaaacccatgaatggaaaatgtaatggctattggtattttgtacaatatctagttattgtgatggcatttggaggaacaataaagctgaacagaaaagcaaagatgcaacagaaaaataggattaaccaacctctgtcttgtacaatgactcaaaactctgagacaatgcaacaaccatttcaagcacatcagggcgatcaccaaatgcagtgtgcaggttgcgtattacctacaggaaagcataatggcagcataatttgaccagggaacttcttgcagtcgaagacagaatattaattagaatatgtttcagtatttttgcactgctcaattagttatgcaaatgaacagctcaattttacatgtaaatgagcaagaattactatagtaggttcacaaaatatcaccataaaaaattcacaaaataaactaactgctgttccaagttgttacaacagtgcaaacagaattcattggatccacattagcaaaacatacatgaaaaatcttgcaaaatatatcatgtgcatcataattgaataatattataaatgttaaagtaaaacatacttcctggacatcctcaagaaaagcctcccatgatccatagtaagctcccatagccaaccttatatcaattgtgcggaagtccaaagggcgggacaccataccagggaatcctagtatgccttcatcctcattttcattggaattcactagagtagttccgagcaaattcccaaaaagtttggattcatctgaggaaatagcagagcgcagggcaatacggcacttcttcaagatagcctctgagatggaaatagcatttctctcttttcttggcttttctggattatgtggtacttttacacgacatgcttctgtcaacacagatagaactgctttctgtaacaaaaaaaaaaggtatgcaaccaaacaatattttaggcatagggataggaacttcttaagaacaaaagaaacacaaaatatcagcatggacatcaaatttaatctaatgccagatccatttcttttgaatgatgtttaagcatggccttgccattagatcactttttggcatatacactactccctccatctcaaaatacaactacttatgccctttttttttatgagattaaggtaggggtgaggaatggttgtgataagttgagatgagaaagtaggtaaaaaattaatgggaaaaggttgtgattggttgagaggtaggcggagaagtagcaatattgtgagacggagggagcatattagtagaaatgcaatttcaacacagagctaatgtcaacatttttccagctaaactaagccatggaagcatcaagcatcatcacatcagcagaaaatccgacacagtcatgagggaaggcatgtgagctgaaattaagaaagttaaaacgtatgacctacagctacaagagctattaaaccttgactaaccaactagataaacataaaaaactcattggaccaccaaagcctctcatcaaaatcaaaggtcacagtgattgttctcatggggctcccttttttcatcacatcttttttagggaatacaatagacatagtaaaagcacaaactattggggagatacggaactatcatgcaatatgtattacatgatgtatgacaggaactcaacagatgaattaatgttgtatgccaacttggcaagagccaaacatatagggtacatgaggactcccaagtcctaatataagcagaaaaacacatggtaataaacctaaactaatatgagaccatgctttaaatactcttaacataaagcagtatgtgaaaatcattattttgcagaagattgagccatagttgcagggagcacactaaccttagttggtccagatgcattacccttgtagacctctttactgattgaatgctccaaaattttccttgcccattccggaggttttctctccaaagattcataaacgcattttctaattcgtgtccccacatttgttggtaattttctcacaggctccagtgattttgcccagtcaggcaatgttttattatcagtagcagacacctcaggagaatctaccatgtcagtatccttttgatccatcataaaaaccttactttcttcattcaccgaagatttgcatatcaaattttcagcctccacaagcagctgaaaatacaagaagattagtgtataaagtacagcataagaaaaattatattttctccttagagaacacaaggctacttaacatggagattgtatttgtagttttctttacacaactgcagatggaaatgaagtagaaaaagttacagataagttatatgacagacagtaacacattaacgcatccttccaggtcagatttatattcagaatgatgtagctggacatgtaattgctgtagctaggaaatctcaatttcagctttgttattcggaacatgaaaaaaaattctctagtaacataagagaaaaataagaattttgtcgccataggcatcatttaacagcaaaaatctctaaaaacaggtaaaggggctccctatagaaccataggaaatatcttcctagatttggttaactgattatcctgcactgataggcaacatcctttcatctattattcatagaacaacaaacataaagaattatacaagcagaataaggggttctactgttctccctcaagataaggtaaaagtgttgatatggttggtaacagagaatgttctatagaattataataatgataaacagtgcagaaagttcacagcatattatgagatatcaaaattttttgtccagctagctagttttgctagcatatatcttttcctcacaacttaaaagaagacaaaatcgtataagggtagaaatataagtaaaaaacttgataatgtttaaatgaatgagtggaaaataaaaaattgaagaaaaacacgaagagaagatagcaaataccatcttatatgaccgaagcaagctaaaagttacatcggcgctactaaaaaaagccaacattccatatatgatacataaaaaactagatatattcatcataaacagaagttcagctaaaccaagaagcgattccttaccaacgcatccttttccatgccagcaaccccaggtagtgcaccacacagaataccaccatcaccttgtagacagcggaataatttcactccttctcgacttgaaatatcagataaatccatgcacccacttatggacgaaatggctaaaatataccttcttgccaattccggccaagtcaacttgttagctgttagcatgtcaaatttaaattcttttgctgaaatgagattctcagtgtctttctttcttccacgcctagtttttgattctttaggatcaatgtttggatctacaaaaattgcaaccttagataatagctcaccaaaaagaaccctaaagagtgtaaggtgaaccccaggcaacactacgccactgcatcttccaagcgtctgagctgccgatttatcttgagcagctttcttcatagaagaagtttcaacagggatgaacaaagatacaatctcttcattactggttagacccgattcaccatttgaatatgatgtagaaacatttgcaggggaattaatcggcgaagtgtgatccctgtgaatgtcatttgataacttctctttctgatctgcacaaattggccatgggtcaataagttcatcttctagctgctcatatgaaggaatttctttcaggccaattatttcagagaaacgtcccaggaattcccatatctacaagaagattgcaaggaatcagatgcaataattagtagatttggacaagtgtgtacaggtacattcgatcaaatagaagagaaatggaaaacatatgcatagagttatacctggagaacctctcctgccaactctggcggaagcttattgctaataggacgtcccagaggaagttcacggattctaaaacccactaggctgggtatgatcctgtagcccagtcaccacagacccatgtctgccatatgacatga

SEQ ID NO: 62723 - DNA, 8614 bp, Oryza sativa
tccgggttgataatattagtcgttttgaatagggcaaagtcaaactttaaaatctttgactataaataatttctaaaatatttatcttaaaaatatggaaaccatatgtgtagattagtcttaaaaagtacttcagtaaaatcatatatttgttgatattcctatatatattataatagaaaatagttgccaaagttactttttggagaccgtgcacttgtccaaaacgacaagtattatcaatccggagggagtggttctgaagaaataactagaggaacatccctgcattgccactcaatttataatattttatcttaatacaggtttttactgctgctgctgctgatgatcgaaaaagtattgtgctgttggcatttgaaaccatggaaaagattgttcgggactattttccatacataactgagactgaaaccacaacatttactgattgtgttaaatgtcttattacattcacgagcagtaaatttagcagtgatgccagtctcaatgctattgcatttcttcggttctgtgctgttaaacttgccgaggaaggatttgtttgtcatgaaaaggatacagatcaccagtcaaataacttagatgtttctgatgggaatgccactctgcacaaggacgatcatgtttatttctgggttcctctgcttgccggtgagttattttttctgtcacaaaactagattggtctttctgcgttagtcgattttgaagtgctttgcgcttgtaacatagttattgctttatgccttcaggtctagctaggttgacaactgacacaagaccaacaatcagaaaaggtgcagtagaggtactctttgacattttgaaggatcatgggcaccttttctcgcagtccttttggagaaatatctttgaatctgttgtttattctctatttagcactggtagctctacaccaaatgggcacattaatctaactgaggatgactcttggaattctgaaactaaaacagtagcagtcaagtgtttagtggatttgtacattaccttttttgatgagatgcggacagaactttctagagttacttctgttgtcacaaactttatcagaagtccttataaacagtctgctagcacaggtttatctgtttttcagcgtttaacagaaggacttgaaagcagactctccaaggaggaatggaaagagatcttgttatgttttaaagactcagcaatgcaaacatttgtcgtgtttgacaagatagttaggatgatgcaagatatagaaattccagatagaaatgaatcttatcctgaagttgaacgatattcagataatgacatatacaatgatgatgaagaggaagctaatatggaaacaacatcatacgctattattaaattgaagaatcatatggcgcagcagctcttagttgttcaggtacttacagtttttgttacttctgtcaataattcccttatgtaacatgccctatatttaatttaatactatactttcctttggccatccaactaaaacagtaatataacaaataaaaaatagtcttcccacatgttctacatgccaacaattgttctaagatcaaactcaccactggtttcttttcagggcatagttaaattgtatgagacacacaggtggtctttttatgctgagcatatgggaataattttagagacactatcagccattgcgtcacatgcaagtgaagtgagctccgaatctaccttgctcatgaaattccataaagcatgttcccttttggaggtgtctgagccagcagtcattcatttcgagaatgagtcttaccagagctatctcaaacttctgcaagctttggttcatgaccacccatcaatctcagaagatatgaaaattgagtcacatattatgcttgtttctgagaaaatactacggaagtatctcaaatgtgcagggcgtgaacgatctaacgattcatctggtagagatccagcattacgctggaaactgcctttgggcactgctaagaaggaggaactgtctgctagaacttcattggtccttcatgtgatgcagttattgggtggcctagagagggactgctttaggagaaacctgcccctgtttttccccttattaactaacctcattcgctgtgagcatagctctggagaagttcagcttgcactgtatgatatattccagtcatcgataggccctataatatcaacatagtatatatatcatttgttcagcggttgtacaatttttccattccaatttcataaggtatagcttattgatagtggttacatgagaatataagataagaaaaaggtaccagcttggcactgctgtaaatgactggcagttggaacctgcgccttcagaattctgtttgaaggtgaaatcttttttctggttcttcacaacttaatatgttgaaactttcaactaaaatgtgggattaatcgtacaccatttgttgcagcatcatttaacatcgacccaggtgcctggagatggtcttttgaggctcatttgacattctttttctaacatacatttcaattcgatgggggttcagacttcagaggcaactgaatattggaagttagaacaagtctttctgacttccaggtctgctgaggttttacaaagaaatggtttgctcacgaatgacaaaaattttggcatgtagcattttgtcctttgtattacttgtcttttgtatagtattttcttcagaaaagagactttaaagtcgtccatcaagttgttctttttttccgctttaaatttatatactcgaattgcaggcaacatgtatttgtcattcttagtggaaatggatcaataaatgaaagttgattggtaacagataactctttgttttacagaccagtgtggaaataatctgttggtttatttccctttgtcaggaaaggataacatattatttttagtttagacaaggataacgtattgcctagcattactaagttacttatcatttataggccccattgaagcatgatcatccctacccctagtggtagttgaactattttctactacattcgttccaaaatacaaaaaaatttagggttatacacggaaattgctcagactcatgaactttgcgagctaaatctcaaatactaattcgtaagcttgcatatgtatgcaaatttctactgatatcctagtagactagcactggatttttcataattcggtcctcttgagaaacttatttcgcaaatagactgctagaaaaacttatcccagaaacggtcatttttagggcgctgagtcattggcgccgtggtccaatggcacagcgtaatcatctctgccgtcgtccccatgccactatggagggtcggcgctagggatggcaacgggtcaggtcaggcacgggtagagcaaaaccatgcttgaccccatgcccgtcttgcccgtccaaatcctacccactagggttagcgggcaaaactctgtgcccatacccatgcttgatgggcacgggtatgtccggcgggtacccaatgaatctcacgtaaataataactctaaagatatataatttaacaaagagaaataaaattaacaatttaccaaattatcagttatcaacaataatttgaattacattacaacttattattagttagtatcacaaatgaaccaagagaaaggggtataagaattaagagataagtcaaaattagctaatacatatgtatcaggtcgggcgtgggttacccacacgtaaaaaatgaaacccagccgttacccacgatatcttcgggtctcgggtgggcgtgcccatagataaaaaatcgacgcccgtacccattgggtcgggtatccacagatacccgaacccatgggcaaaattgccatccctagtcggcgctgacgtggcaggggaagcgcgccaatgtctctgcccccccaccccccacccccaccccccttttttttcctttcctctctactgtagaagagagatgtgcaactttttttttctttccttccccgttagaccacggtgccaatgactctggtgctcaaaaaggaccatttctagaataagtttttttaaaggtctatttatgaaataagttttttagaaggaccaaattatgaaaaatccagtagactagcaggtatccaaatgataaaacaatatgaggtgtatcaaatattcttcttatccctcattatttgttaatgccaataaaattacaacttcttaaagtaaattttatataacctcagaaattatggtcctagatacacggtgacgtacaatctgagctcgagcctgatcaagctttagctgagctgagctcaaatccatcccaattgagtttcgaggttgaaatgctcaaacttgtgccaagttcgagcctaaataattggggtttgcctaagctcggctcgttgacatccctagtttgagggatgtagtatatgtaccgcccatcaccacaaaaataaggagtgggttcctcatagccaatcaagaatcacccatgatataataacaacaatggtcaatgctgataaacatgtatcatgtatgtcactagaagccatcatcctctactttttgttttgtaccatgcaagggcccaaccactcttttgtcaaactaatctttgataccttcgaagtcacaatccatgacaaaaacatcacctaattcctaagttgaaaatcaccgcctaaccatgcatcaacacgcaattttcaagacccccaagaaattgacatctatctttctttccaacatggccagtaggccatcactaccagcaaacataattatattactatgtaattttattcatcaaaattaacatcatttttgtacattcttgatggaaagcattacgcaacaaaagctagcaaaactgagatatacagattaatttaagctactgcacatcacaggatgagtgaacttcgtaacttaattgatccactaattttttgcgaacgcgcaaaaggattgcacgtcaatattagttgatccactaattaatcgatgaaaattcactagcaagctgatgctgtagtaggctgcaggtatgatctcttgatgaactccaagcagtcggcaatggcctccgcctggaaagagctctcgccgccggcctccgccggcgccgccagccgccggcgccggcagtcctggctcagccgctgtgccctcatcacggtggtcgccgccgccgccgccgtcgccggcgaccacctcctcgggcagcaattgagctcctccaggcaccggagcagcagcccgacgacgccgaacagcctcacccgcagccggagcaccgagcccagccggacatgccgcacccgccgtccccggcggccggtcgccggccggcagctgatgctgatcacctgatgtgtcattacgcaagaagaagaagatgatgatggagaagaagaagaagaagctacatctcttttcagtttcactgacctgaaactgaaactgaactgaaaatgtgcagaagatagctagctgtggtctactgcttggccatggatggcctcttatatagcagcaaagctgcaacctgtcactctgaagttatttttttgtgaaaaaaatatattaaaattatgtgatctagaggtagtacacaagtacacaacacacttggtgtgggcccaagctggcagccattgtgcttctttaatacattatcacctggagaaaccacttgtcagttgtcatgctgtgtaggatggatttctctctcttttttttctctcttctcatggccttacctgccctttgcaatgttttttcttagttgaatatatagacatatagttgatgtccttcactagtaatatagtatggctacttctgccctctgaagatttggacattcaggttttgtggatggagttgtctatcagacgatgttaaatctgcgtgcccctaatggtttcgcgcattgttaattcgacaaaatggagattacaatagtgaggattaagagctcaacaatatgattttgctcagatgtttaccaaccttgtacttgtgagttgggaattctgaatatttttgtgcctttgttttgtgaggttgagactttgtctgatcactctcagcctcacacctctgttgcatcactatccttctggaaattgaatctgaaaaatggcaactattgctatgtgatttcgtcatgtcctgcactttatgctggcaatggggaccttgatgagacatgaacaaaatttaagcatttttagttccatggcaaacatgttttcgccatgtcggcaaaacaaggttgtaactaaaatacgtgatcttgggcccacttgcatgacagttttcaatcacgttttggtgtttgtgacctgatgggattaatatttaaaaaaaaacagtgtgaattatttggagaatctatttcatttatgattatttatttgaaacaaaatacttttaggattattcaattccaagtttagtttgtttgtatgtcgattcaggaaaagaaaaaaaaaccatagctccactaaaatttagcaaatgatcagatcaccactaacatgagcatatgcaaccaaattaagaacttcttattgctttttgataataccgaaggtcaccgcaatccacatcgaggagttatagtcaaaccagagtacaagattacaacattcaaactctcaaagcaaagcctaataaggctctgcttcttgtctaagctttagaggtttaaagcttattttggcaaaatgtcgcatcgttcaaacaagtcagtaaaagaaatgcagcattgcaccatatgaatactgcttaacaaaggctgcttaaaagggaagttgtgcagcggatttttccattagcagttcagcttccctgttaaaaaaaaaagtgtgattaaaaaaaaactgacaaagaaacagaacctgtggtaacataataagttaaagtattcttactgcgtggggtttctgcgtgttgctttcctaagctttaggatagatggttttgaactctttggcacttggggagctggttccctaaaattaacgaaaaaggaaggtatattgaaagtcgtgctccctccgtttcaaactattagtaattttaattttggtcaaagtcaaaccacttcaattttaactaaatttgtagataaatatggtaatatctataacaccaaattagttccattaaatctatagttaaatatattttcataatatatttctcttgggttaaaaatgttactcttttttttctacaaacttagttaaacttgaaacagtttcactataatttgaaacggagggagtacgttataaagttattttttaaaaaaaaaactattcaaaatcattaacaagtccttgaacgaaaaaaaaaatctcaagtgatgtccatttaggaggcctcacttagtaactttcttccgatatgcttgtgttccaagggtatatatggcaggtgtttatataaatttcaacatcaattctagaatttttgcatcagtatcaccacagtcaagaacctccaggttcatatagatttctatttttttatatatatcgattacatgttagtcggtaaaaccattatctaaaaaaaatgttagtgggtaaaaaataatagcctttttgcattttaaccctaggtttgctttccttaccagaaaaaaaagcgagggaatttaccgtagtagtatacccaatcaccccacacttagcaataaactaacaaatcctgatttttgtgtgttttcggtcaactaaaattagtcatataatgaagccctgcctgagcaaaatccgttgtagtctagctggttaggatactcggctctcacccgagagacccgggttcgagtcccggcaacggaattgtttttgtttttcatcctttcgctttttttccccacaactttttacgctattctaatcatacaaacgaataagcatatacataggaccgctttctttaaaaaataaaatatacatgtgaggaaaatggattgttattatggattcactccatctctaactacaaacattgacatacccgagttaatattcatgttcataactagaatttgatttttttttctccgattgagagagtactaagtaaagaacaccagctttcgctttttctttccaaaactttttacgctattctaatcatacaaacgaataagcacatacatagggcagctttctttatgaaaataaaatatacatgtgaggaaaatggattgttattatgtattcactccatctctaactacaaactttgacatacccgagttaatattcaggttcataactagaatttgattttttttttctccgattgagagagtactaagtaaagaacatcagctttcgcttttttttccaaaactttttacgctattctaatcatacaaacgaataagcacatacatagggcagctttctttataaaaataaaatatacatgtgaggaaaatggattgttattatgtattgactccatctctaactacaaactttgacatacccgagttaatattcaggttcataactagaatttgattttttttctccgat

SEQ ID NO: 62724 - DNA, 14750 bp, Oryza sativa
cttgcctgcatcagctgttggcacaacagttggctctggaataaacttgacaaccaaaccaaagaaaagaactccagcaaaaaactgcaaaatattattattagttaacaatggttgctgcttattgtatgagatagatcggcattacattggcatggatactataagtataggcaaagcatgactgacccaaaggttgcccttcaagaaaccaatagaattcaatgcattgtgtgccaaatctagaaaggaaatgctcaacataagtccagcggcaaaaccctgtattcagtaacagcaagagatcaatctaccaagaaccaatagcaaaaccagaacttgcttaaaagatagtgaagttgctccattactatagagaacaaagcttatcacctgtagaagcccaagcatcttaagattaggcgtcggattcaaaatcacaaacagcgcacctgaaaaacagaaaattggagcttctaaagtgggaaaatggcacaaagaagccttgctggaaaccctccacatagtattagggacagttttaaaagagagtactcatcgctcaatgtcctgagatcattcacggtcgcaaattgttaaccaaacataaggaagtacaatgttgaaccctaggggttaaaagtttttgaccatgcaacgacatttattacttatcctgttatacatagtacacataagagaaaaccacaccctgccactaaacctgtccagttatgccacttatttacaaattacaacaccccattgctgaccttaaaacaaaaaaatctgatgaatcattgtgatcaattaattttcatattcagaggcctaaatagcaaaacattcatcactcacaagccaaaatggtacaaaagggagatactcactggattctgaactctctttcttaacaaaaatcctaaacactaattttcgatttgctaataaaggatgcatctgaattcgcatggaagtcacctatacgagcggtagcaagacagaattcgctatcgacacctgaaactcaccagaaacacagaaattcccaggaacgcgagattgcgagatgctcagccacttggcgattccttcaagcagcgagcccgcaagctacacaaaacggccttaaatccacccgcggaaccctaggaaaccgcgcccgaccgcaggcagagcagcatccaaacccccgaaacgaaactgttgagaggggaagaggcgcgagggggcggggccataccgatggacgtgctgaggccgccgacgagcgagagggcgagcgccaccagcacctgcgactccattggcggcgagagagagctagggcttgcagggtatcgaggcggggggaggcggggaggagaggagaggagagggagatgggggaagggaagcttttgctgcggcggcgtctcacggcgtgcgtacgtcagcagtttgatgagagagagagtacggcgtcttttgctaatcacatgcttatgtgctttgggtttgggttagtcaatagataggggaattttgtcttggtaattttttttttcttctgttcttttttttgttgtctttgtcagggcatattggcaacttgtgttcttggaattttgtattttttaaaaaaatatatatatcgcgaatttgatatcgtggatcgtgcagattcgacggtcgagatctaactggatgagcagatatagcaggtcgaatttagatttggttgagatgaagttaagccaccaaaaacaaaagaaaaagtcattaccatgtgattgattagttgagttttaatattctaaatcaacttctatatgttacgtccgtcccataatataagcgattctggaggaatatattttctagtattacgaatctgaaccgtctcttagtctagattcgtagtattatgaagtgtcacatctctttatgattttagtaatgtgacgcggataacatgatgtagattttttaaggagaaacaatgtactatactccattcgaactggtaatacttatcattttgaagcagagtaaagtcaaaccttcaaatctttgactataaataatttataaaatatttatcttagaaatatgaaaactatatgtatatattagttttaaaaatgtacttcaataaaattatatatttgtgatatttctatatatattataatagaaaatagtggtcaaatatgtttcttagactatatttttaaaacgacaaatattatcaactcggagggagtagtaatatcaatattatttatcagtttcataaaagctaactgaaacaatgtagttgggctaatacaatagccagccacatgaatcatgccatccacccacctactcctgcgtccattctataagcttgagcggcagatggttctccatgccacaaaacgacttgtgttaaagatgtttaccgttttcgataaatctataacgatctgaatgtattttaaacaaaaaaaacaattaaaaaggaacaaatcaattcatatgctatatttaaattgccataaaataacggttacaagcttacaagtgtggatttgagcaggtacaacgtcagaaaacaaattaagcaacatgatatatatatatatatatatatatatatatatatatatatatatatatatatatatatatatatatatatatatatatatatatatattcaaccacaattcacaaacacgtagatttaaaatataaaccaaaaacaatcaaattagccaacgaattagatcatatatttttaaaaaaaaacacaaataaaccagccgcgccgccttctcccacgtgagacaccctctctctcactctctctctcctcgtcatcaatgcaggcagtaggcgaggaaggagagcacgacggcggcggcggcggcgggcgcggccgcgacggcggtggcgccgctggcggacccggggcccggcgcggacgccggggactcggaggcctcgaccgcggaggcggacgccgccacggcgagcagcacggcgcaggcgatcttcttcatctccatcccgggcggcggcggcgaagtgctgggctctgcggggtgggggaggagacgggtgatgttgtcgatcgacggcttctcgggctgcaggcgcgcggtggtggcgttgagctgcgaggcgaggcgaggcgcgcgggggattttaatggcggggcgagcggccatgagcgaagctcggggtggagcttcgccaaaaatgggggtggtgattagtgggtttgccaagataggggtggtggtgattagtggaggtgattgctcgatgaagttctaatctaatggcgtttgccaaatttcaatcgaattttgctgtttaaaccctaaaattttcaaataccattcgaacccccccccccccccttctcaaaaatatgatttctagcctatctcgaaatcacagaaaatttcgcaaaaaccaaccagtttttatcaagattgttcatgcgaattttattcgagcttcccaaaccattcagttttatgaatagttccgtttgaaatttcatcagaatttagtgaaaatagtgctgtgcctcacaattcaaccccaaaacgagattgcaaacccgcctctcgtccctgttgatgatgcattcttgtttatatcgtttacaggcgtaaaaactcaagacagctactggattaacttatacagaaactagatcacaagttcacatccaggaaacatttaagattttgattatacacatatgcagtgatgctaaagatcggccccagtttcagcaaaagagcaggaagttcagattccagcctgaacttgcaccacaacagaagcagccaatctcacatagatactagggatcagaatatcagacaatctgatctgtcaaagataggcctggttaacaaactcgatgaaacagaattgcacaagccacaagggaggctgcaaggcgaatcatttgcggttcttggaacgctttttctcgagcctctgacgagcttgctcaaactcctcttccgtgggctccgagctgctgctcccctttgggtcacatttggacatgatggatgagagcaccgagtcgaaccggtccttccgctgcgccctgcgctgtgagatcgcgaggatcagatcgttctcctcgctcttcttcttgttcttcctgtgacgaggtttgaggcaaatgcagtagtgagcaactgatggtagacaacatctcggaaggcggattacttgggagataagagaatgagagcttacttcactcttctctctaatgggtttgtgggaggttcaatctcggagatcttcttggcccatttatcatatgcttttgttgacttcagctcacctacaaaagggaaggaaatggaaaggagtttaaccattagagaagtttcagggaatagattgagttagcatgataagctaaacactttgccagcgcttcattgtagaaaaggaatagaaaaaggtattcaatattatatgataaaattatatggcaacagcatataatcatttaccttcagcaattgcctcatcaattatatctttaaagcgatgggaatcaagctttggatctgagcaaatcattgaacaaaaaagcctgcatacaagggcaccaaattaaaatagaaatggaacccaattattcacttgcaattcattgccttctgtatagaaaattaatcaacactaaattttgtaagccacctgttcatgttgcctttaaattttgtatatagatccttcaagtcctttttttcagaatctgaccctctgtacttagcttcaaattcttcaatatcagcctcagtaacctgcagaagtgtaggtcatcaccgatcattgtataggtgaacagatagcacaagtttttttgttgatatggaccaaaaagatacctttttgtaaacagctctgaagtactcttgaagattgtctgcagcttctccaaccagtgcctacaggaaaagacaaaacttcagaaaatctactgggagtgaaaggttggaaatcacactacttggaatcaggtgctcacatcatcatcagcaattccagtctcatcatataatgcccttttctcctcatccccaagaatagatatcaccttctgaagctgctgaaatttctccttggcttcctgacatcacataacagctcaattgagacaaatggcacttaatccatggaaaaaatttggaaacaagatcctacctcatctccaggattcttgtctggatgaagacgtaaggccaacttgtgataagccttctttatttcctgctgtgaagctgtcctctcaacccctaagatcttcagaatgaagaaaggaaacatcaaatgagttacttgtgttataaagaaagacaaaactgaagcataacaattgtttctgattgcatatgtactttaggttcctttctacagcttcgcttaaaaataaataatttaggccgattccactgagctagctgcacctgcaccacagacaactgctgcaggaagccagcaatgccctttgctaggggtcactgctagggaggtagcagcacaataagtctcattggttgcccatattctctaataagccatataaaaattaatttataggtaaaacttttatatatttgttcatagcaacttaaaatccaacactaaaagaaactacattgaaaatatcttaaaatcaagttcgaaaattcaaattttggcttttgctttggcttattaggccaaccgatggggctcttaagttgcaggcttgcagctagctcagcctataggagccactgtttctggttgcaatcttatgatttgtggcctttttaaagtcaattacatgaatttccatgaactctttcagctcttctttggcacttcattaagcttaggtttcagcaacatttccttcagtctagaatttttttaaaacgcgctaaacagtctagtagtgtgcgccaattaattacaatttttcagcacagatcaagacaaaaaaaaaatactgatgtctgaacagctgggacatatataaggtttattgaattaagttatgcaagtaaggtaatgctattgtacttgcttttaaaactaatagtggtatagcttgagatcaaccgccaatcacaacctcttgtacctcttggctcttgcacactttacccagtcattggtgttttctgattgatcagatgatatgagaaaccctttttatttgacaatataaatttttaacgagacaagctagcaaggattgaactatgtcctcaatgtatgtgcatagtagagagttagaggccctatcacacccagccacgtaactgtttgattgtttgacatttactccagattccagaacatgataaaaattagatttaaacatcagttgaccttcataaattctgtggcagtaatacttaagaggaacaggtatagctcaaaggcaagaatgccataccatcaaagagcaattggcaggaaggccagcaagatttaaagaagattaagtcactataaaatccttggagaggtactactactgcgaagcccaaaactagagctgaaagttaaggccaaaccaataagcactctcccatatcagtcataaggcttcacaagtgaaatgtgagccttcaagcaactgcctccatgtttgggatacaaaatgtttttcctattgcataagtacgcacttcgtactttgggttcatcagtagcataatcttgcccaattgtttttgcacattgaaatggtacacacagttgcttcaattcgaggtaatctggtatgcaaatatgggttatacttgtacactagtactaacacacgatcaatccgcgcagcgaaccacgaaattccccaacgggcggaacctgacgcgacaccggataaacaagaaaacgaaagctatcccgctatcgcatcgaacaatcagatgcgctcctcaccctcgaatcccggaaaaaaaagaaaaagaacaaaaaaacatcgatccaggcatccagcacacgattcgatcagaccaacaccaccccgccgcaaaatcaaccgctacccgtacgggtaacacctcgtaagccatagacctagggtttggagttggggatttacctcgtagaggctcttgctctctgcggcgaccggcgcgggctcctcctcctcctcgccgtcgccgtcgcgggaaaccctagccctcctcttgcggcccatctggtggaagcggcggggtgaagaggactagtagtgtagaggagaaggcggctgcggcggcgagatctttataggtggagatggcgcgggtgcggggaaatttttcccgcgctttttggttcgcgccgggatttggcgttggcggcgtctcgtcgaatgaaccacccgccatggggatggagggttcgatggaaaatgcttgtacaccggaggtgagagatcacttcacggtgcagttgtaaagagcgtgtggtttccattttaaaatctcgtgtttaatttttgacatgtttatcaattcattttacaaaaaaaagtttagaggggtatctctcccttcaaatctcgtttttatacaatggatgtgtagtagagaggagagatcagccacacgagcatacataattttgcaaaattcctttagcatgtgtgctgggtagaatcggtacaatttgggtagatagaatttgtctttaaaactagggctcgaataaatgtctaagtttatttagggcacatacatagttaaaagaaatatatgcgatgtggcataagattggctagagatctccaacaccatcatatatgttacaagaaagcttggtacggttcgaccgggtagtatatcaaatgttacatactaaaccgagttttgtcctaaagaaaatgataattataacggatgagtaatgagttagagctcctccacagtagacgaagatgggaaataacatgaggaatttggttaagacagtactccctccatcccataatataagggattttgatattttgtgtgcactgttcaaccactcgtcttatttaaaaaaaattgtgcaaatataaaaacgaaaagttatacttaaaatactttggataataaagtaagtcacaaataaaataaataataattctaaatttttttaaataagacgaatggtcaaacagtacaggcaaaaagttaaaatccttatattagggacggagggagtacaatgttgtaggaatcttctttttctctacgtattaaagcttgttagttaggttttatcaacaactcaaacaataccttataaatagtttacttatgaaatttagacctaagagatcaatatcatctgctcaattgagatcccctgcagagcatgtgcggtacttcaggctgacatgtgggcccgagggctgtgggcccacatgtcagcctgcagtactgcagacgacttgtgtccatcatctgctctatactctatgctatttaaacaaaatatgtagagctaggtaacaattatctgcgcactggggcggaaaacaaacatggagcaactagggttgaaaccctatacctagctccgtaatccttattatatttttaaaaaaatgctatataatttgtgaaaaaaatagctcttatttgtttaggctgaaatcgctccgtaattcttattatattttttaaaaaaatgctatattattcgtgaaaaaatagctcttcattagtttagccctatgcgtgaaaattttcgagctctgataccgtttacacattcttctttgcaaaatagaatggaataaatggtgcatatttcaggttctatatatgcaaggatcataaaatttatcagatactctcatacatgtaattgtccatttgctgcttctcacaggagtatgctgaaatgactcataccaacatatattagttcacccgggtatctaacgttttgatgaatactactctctccgtcccataatataagggattttgagtttttgcttgtagtgtttgaccactcgtcttattcaaataatttatgcaaatataaaaaacgaaaagttatgtgtaaagtattttggataataaagtaagtcacaaaaaagtaaataatgattccaattttttttaataagacgagtggtcaaaccgtataagtaaaaactcaaaatcacttatattatgggacggagggagtacaatacaagatcttacaagcgttggttaagaaaaagacaaggagaaagtacatatgctgacatgtgagtctctttccatgtgtcagtggctcaattacacaacagttaagtcagatgatcccttttcattggagaaaattgacatttagccatcgtcaggatggggtttcgccagaatgccactccggattgtggcttcgttataatgccattttcgaacgacgccacattgctactttgccatttcgaccaaattagctgatttgcaaatgatttccaccgtggtgtgacaaaattgcccctgtgaccatttagttgacttgcgtggaggagatggatccctgccctggcaccggcgcggctggggacggatcgacgcctccctcctcgccgacaacccaaactccaagctcactgtcacctacttctccccgctcgcctccgtctccctcgccccgtcctcccccatcgcttctccccgctcgcctccgtctccctcgccccgtcctcccccatcgccgtcgccacgctcccgcccttcgcgcagccgccgcggaacatcaccacgctcgccttccgcctcgaggtggatggcgcatacgtgggtcccgacgacgccgcgccgctcaagggcgggggcgttggtaccatggaggtccaggtcaggctcgccgccgtcgccgtcttcgatcgcggtggctggcgcacgcgccggaggttgggggcagccttccccacccacgccggcgtcgtccccttccccgtccccgtccccagcttagctggcgtcgtccccgtccacagccacgccatcgagccgtgctgtgtatatgcaacggagaggaagaagagagagatgagataggataaagggtattttagtcatctcagcaagaaaaaacactacaaaaatcattaaattgagaagaaatggataaaatggcattacaacatgttgcccctgtttgaggatggcattttaacgaaaccacttttgggagtggcattctggcgaaaccccatcctgacgatggctaaatgtcaattttctcttttcattgagcacctatattactaagtgcatgtatgctatgccaaatgtttatacctagcatacctaattagctggtacgaaatcaacgacttaatccaaacccttatgattgaactaaatcctaaaaatgtattcttacccctatatcaatactaccaatcatccatagttaaaagcaagttggtctgaccatattctttatttttattgttttgtacatgataaggtatatacatgacgcaataaggtagagtgctatgtcacaataggtcgtctcttgcttaccatgagaataggtttatggtcctctagtttttcatctactccacatgtggctctcttcttctttttatttggctccgcttataaattttattgttcttaatacataggtgcgcaactcttttgtgtattaaaaaaaataattttcatgaacacaagagtgtcaagcaggcaaaaattgttttatatctaggacaacctatatgtttcatttataaggcaatatgattttatagggaatggttatgaacatgttgttcttttcatctacaaaagttagcaacaatttatacgattatcatatgaacacgttatctttttattttataccggttcatattatttcacagtattactgcaatagaaaaaaactaaattccagcactataataagaaaggatttaataattaaacacaagtatcacaccaacaataaagagaaggaaaagggacacgctctccctctcctccatcttcttccccagcaagaaagaaaaagcccctactttttataaccccacatctcccagggacccaaccgcaaaaccccacaccctccctccgattcccatccgtccaaccacgatccaacggcccacaaccccaccacgtggcgtaaatacacgtcgaggcgaggggcaaaccggtaatttccccgtcgccatcgggggctttcttttttatcagtgtctctctctccccccacccccaccttcccctgaagagagagagtgagagagagagagagagagagagaggagacgccaccacgcgcaccgagctcgcgattccaatccccgcacgcctcctccgccaccgccgcctcggcctccgccgccgccgcgaccagggttagggtttgccctcttgctccccctgcctgattccacccccccccttgagtttgtgggtgacccgtttgatctgtgggcttctttttcttttttttgtttttttcttggggtcgattcgattcgatcgatcgatccgcgtggtgctggtgttggggaggggggatcggttttgggttggtgcggggatctgatgtggggggtcgttgtttgatttggtatttgatgtggttggttattggttattgggctcgaggggaaagcgtttatgtttgattttttttttcggttgtgtattaggctatgtgatctttcaggttgaaatgattagattcgcgtgagtttcctgatctttttttggggttgatttgttgtagaaccgtgggcgattaatcattactcggggtaaatgtgagtgggtaaaacgtgttacagcagatttacggtgtttgaatttgatttcgtcgaaatggataggcgcgtttggttgataagatgaggaatccacttttgtgatggcgatttcgttgcgcctcatagaaattaggatcttgtttcataaagtgtaagctcgccgcagtgggttataggttattttaaaagtcacaattatatggaaatttcgataggaaaattgtagcaactaggtgcttcttggattatcttaccgcccgatttaattggacactagttgatttatccgtatgttaaattttaaatttgtttcttatacgcatttcggtattgagttttgcattgtttgtttgatgaacagatcacagttgcgatggaacacaaggaggctggctgccagcagcccgagggcccaatcctttgcatcaataactgcggcttctttggcagcgcggcgaccatgaacatgtgctccaagtgccacaaggagatgatcatgaaggaggagcaggccaagcttgctgcctcctccatcgatagcattgtcaatggttgtgacggtgggaaggagcatattgttgctgccagtggtagcacggcggtggcggtggctcaggtcgaggcgaagacgctcgttgtgcagcctaccgatgtcgcgggcaccagcgaggaggttgctgtagtccccaaggtcaaggaagggccgaaccggtgcgctacctgtaggaagagggttgggctgacgggattcaactgccggtgcggtaacatgtactgtgcgttgcaccgctactccgacaagcatgaatgccagttcgactaccggactgcggctagggatgccatcgccaaggccaacccagtggtgaaggctgagaagctcgacaagatctaaggcggctaggggcgtggaatggattgcaacctacaagatttcaacatccacctttgctgctctatcctcacacttcttcttgtcggctgctacatttcttaaattgttcaactttgtgatgcacactgcatcctggcagccgaaagaattcatcctctcagtcaagtcaagtggtttgcgtgttgggtatgttgtgtaatctttattcttggtggttttcggtcagtattgtggtgtctcatttagctagctctgtgatgtactatgtcccatgcttgctacatttcaatcagtaatagttatcagcaatggtccatcatattgccaacatgtccattattcatttttccttaaagattatttatgtatgcacctttatctggtgcgcattcaaattcatgtatgttcaaagaagtttgccggattgtgcttggttggctgggtctactctagattgaaaatcggatctgagaggaaattgtgacaaatgacaagttagttctcaggttattactctatccccaaatggtcattctttaatgctactgagaatagttgggattagatctgcaacatgtaacactgaaagttcagcatgtgaagctgttctgtttcagtaatctgggatgtagttaataatctgccttaaagttcaaacatctattaacttgtgatctgaaccagcatacatattgttgtcacgaagataaccattttgttcgattaatttcctggtgcaaggcagctgcagttctgattcgattgataatttcacagattctgacatctgctaccaaattctgccccccttatattatccaattgaaatccttaggtggataatttcacagatgcttacattttgttatatcacttgattggcatgactatggattggcatgactatggattgcagaataaaccaagttgtgccaaaaaattctttgcagaggatgacttcttttcccccttgatttgtgccattgtggttgggtgggtttctttaggcatgatgggtacattgatcaactcctttgccgggtgttaagccgaaatgcattaaacaatgcaggcactaatggtgagctctgatcagctgagattcctcagtagtttattgaattggatagaatctccagtttgtcgtcctctcagtcgctggagatgtattttatgagacttaaactgctgttacctgctctgatcttatattgttatactaatgccattatagtgtatatcacgcaatcctgataagaacagatgatttttttccctcttgtgtttaccggacaaaagccagaacaatggagataaatgatacttcctctgttttatattataaatttatcctaagttaaaccttttcaagtttgatcaaatttataaaaaaaatatagcaatattttcaacacaaaattaaaaatatactataaaaacatattcaataataaatttagtggaactaatttagtgttgtaattttttctataaactcggttaaacttagaaatgtttgagttaggacaaatctaaaatgacttagaatatgaaacagaggaagtagcatctactgcatcatatatgttgcagaatggctgtatttcaggctttcagcagcattttcaattaccaagatacgaaaatgccacagaaaaaaaactcataattgcacaacattgcactgaactcagtaaaaattatcctacaatttcagaagaaacaaaacgtttcctctttggctgcatattctaaattacagtatagtaaggacaaccattattctgaattcttgattctttctactaatgagtaacctctttcaaggttcaagccccaaggttgaagtaaaccgtgtagaattcgtctctcaggctgtacaatggttcaagcaggaagttcctcttcaccccctttgcaatgaagctgataggatggtactgcctcaatggagcagcctgcacaaagctcgcggcctgctcgaaaatcccgttaaccatcgggaaatctgcgactgacctgatctttgtacccacggagtaatccacgcctatcaccaggaagcat

SEQ ID NO: 62725 - DNA, 14676 bp, Oryza sativa
cggaatcggcggagccgcggaggcgtcactggcgagtgctggccaaatgggccggcacggtggaactgtagcagggcccaacacggcacgggcacgaaagcccatgggccgtgccgtgactgggccgccaccttggaactcgctgtgcgcctgtgcttgagcagcatagcaaggtcttttagaaaaaaaaaaaaaactagcaaggtgtgtggaaattgaaagtggaatattacgatcagtaagcctaacaaggacaatcaactagacttatgattcggaaccatatgctctctctctctctctcatcatctgctattcacctgggggaccaagtctttctttcggtaccaatgtgattcaagacttgttctatattctgacagaaacacgaagtacagttgcactactgttgacaacaaaaactagtggattgattgcactacgtttttcgcaaacaaaaatgatacttacaccgttccaacggaatagctgacgttctgataatatcaatatgatatctaggtgttctgataatatcaatatgatatctaggtgatctagtctctacgtgtaccacgtttaatactgaagatatcaaatccgatatatataaatatcatactgacgtcatgctacattagttattttcgttggagcggtataataatgccgttttgtagtctcctcttttataatctaatagctcattcgtacaatggttagctataaaaatatactacactattactacccggtcccgcctctcatacacacataacgtcttgaagtctgtgttgtagccggctataaatatgtagcatgcttttttctctcttgtcttttcttctcgatatgtggttatagctggtttatagcttgctattttagagcaagttcaatagtatagccaagtactagctccaattcatctatagccaatctaatagctcattcatacaatagttacatactacacaattaatacatggtcccatctgtcatacacacaccgtgtcttcgagtccgtgctacagctgactacaaatctgtagcccgctacccttctctcttcttatttatcttcttaaaatatgtttgcagctagcttataacctgctattgtatctgctcttacatgctctaacaaagcaacacggaaaccaagtgcgtgcaaattgtccacgtaatgctagctgctaattaatgatcatgcatgtgtgccatcttgaatggtggagaagtgaaagagatatccgaaccaatcgatcaaaacaggcaggaaccggccatttgactcacgtattagttgactctcttcactagagacagtagcgtgttgtatggtgagctcaggaagacatttttttgcttgatttcaccagttgaatcggtgtgatacacgtacgtacgtggctccgttttcgcttcagatttcagcaggtgtagcactgcagtgcagaccatttgtccttgcacttcctcgcactacacgttcgagatgtttactactaccaactgttgaatttcctctctgaagactgtgtgctagactagagtcaggtatttccataatttttgatcaatgattccagccagtattccaagttgcttggacctcaattttgattagcattacatcatcatcattctagacagacaggacagtactgttgtagcagaaagaacttttaaagtttcagaaaatgcatgcctccagtcaaattttcagaaaaagaaggatcaatctagacagacaagacagaaagaactcttaaggtgtgtttaaataaaaaaaatttggccaaaaatataacatcaaatatttagacatatatatggagcattaaatgtggaaaaaaaaaaccaattacacagtttgcatgtaaattgcgagacaaatcttttgagcctaattgcaccatgatttgataatgtgatactacagtaaatatttgctaattataaattaattaggcttaataaattcagcacaaccgtctgacatgtataccagtgaaagtccagccacaatctcttgcatgcatttggagcatgccgtagcatactgtttcagcacaaccgaatgattcagaacatgcactagctgtggcatatttgctactagtaagactatgttatcgaaattaaacagtccaaaacgatttgaggatactactcacatgtgtgcttgacttgacgatgtaggagtgtagtattgtccaacagcacgagctagtcaaaactcaaaagaggagtcaagcaagccgcaaagccaacagcctacaagtacctgacattgacctggtgatgaaaagtctcagcttacacccaaccattttcacatttgccaacaacataaacaaagcaaagaaatgagcttgccaaacctttcctttgttggtttctgtacaagaaaaatgatggattaatgttacatcatttgatttcgaaatattgatgaaactgaaagcgtccatttcattcgtcttgtgcgcttactctgattcatgccaggtcaagatttaattaggttaattaattgcatgtatgatatggactactacaagttagtactgaccgttatatacaaacacggtcaaaattaacctaattaattaaacagatgaattgggaaaaatatatataatgtaatgaatcaatgtttgaattgagcgaaatatcaccatgtactctgtacgtagtttggaacagggcacgcgattctgatctgacgacacatcaaaactatgggcacgagcgtgcgttagcttgcatgcacgcgagatcacacctagtttaattggtcaattttgattcgcaaattctgtacgtccacgtgtacgtacgtacgtaagcacatgttcttaatttgtttgtattgttcaatggtacatgtgtattctccaatcaaattgtacacagttgatgatccgtccatattgtactatctgaggagcgattagatcgtgtttgaaattccagaaacgattagtataggactagctaggatttcagttcattaataattagtaattattaagttaggtacaaataagcatgtacgtagtactatactatttgtagacaactaagaacacatattatcgatcattctctcttttcactcgttaattatctggtgatatcagacctgaatgcaatcatatcgttgttgtcatgttgtggattagtccaacaacataccaaactcttgtaatatgatcacttgaggttgaagcaaaattaaattacgtttcaacacctagctagctaacatgtacagccactcttgttgattaccatgccacatttaatgaggcaactaaaagatcgttttgcttcagaaaaaaatagtttgatgccaaatccccatctatatatgaatttcttttttaaaagatttttctacaagtaaaatatatgattggtccttaaacttgagcggagttgtcacttaggtcaactaaaatttcaaaattgcatgtttaaattcatcatcttggtttaatgaactacgataggtccaaaactcgtttgacgagagcttactgatgacatggcgctccatgtaggcaacaattttgtatccgctctcttccgcatcatagtgtggccccctcttaccccaaagcacccccaaatgctctaaatctctatctccattgtcttctccccgatggctagagttatgacagcgagggtaatgtcgcacactcacttgccactctccctcgcaatcttcgtattaggggagaatgggactgggagggatttggggggattctgtgtagtttgtatgggaggggtccaaaagcaaaattaccgccacggcgccacgctatgacacggtggagggtggatggaaaattattgcctaaatggagcgccacatcattggtcaactttgttcaaacgaggtttggactgttgtggttcattaaattaagatggtagaactgaacatgcaatttttaagtttaggcacatctgctaaagtttaagtattggcaatgtatttccattttcctagataaggttaaaccctgataattttaagaaaaagtaaggtttatacatactaatttttctttttacaaaactcttacaaaggaagatctcaaccatttgatctagccgattggtagttaataaaagtcaaaatgaagtcacaatttgccacgtagtttttataaaaagtttgcaagtttttttttacatgtatcattttcatgtaagaaagagtaaagacagatgagttttttttcatgataatcattttttctctgtaattactattattttctaaatttatttgcatatgaaattttgatgacataatttatcattatatttatattattttattgaacactggtatggtatccaaaccatacctaaaagattcatttcctaagaagaaaaatatcaagggttatttctaaatttatttgaaactaataaaaataagaaaaaagttgtccatatataggccacccccctgtctcccctcaaccgtccgtccatcccctgtcaagttcgccgcgcgcaacactcgcagcagagcatccaccgatcgtcgatgctcaccgccgccatgcacatgctcgactcctccacctcctcctccccttggcttcctcccgacctcatgcctcccccgccgtccgccgccactctccaccgccacttccgcggcgccgccgccgccgccagcaccagccgccgcatcgccaagcgccggccgcgcccgtcgcggcgcctgcccaccacctacatcagcgccgatccggccaacttccgccgcatggtgcaccaggtcaccggcgccgacgacctcccgcctccacctcctccatctctctcgccgacgacgacggagctcctccgccacgccgctccagcgggctcgcccggccctgcaggcgcgctgatgcttcccacgctcgacacctcggcgttcctgctcggccgccgcgcggagccgacggccgcggccgcgccgtgcgacgtgtcggtggcgttggtaggaggagcaggtaatagttacagcaacaacagcagcagtagcagcagcggcaactgtggtggtggcttccccaccttggactcatgggatctcctgtaaatctagatcatatattgtcgatttccgattcttcatggctgtaattaaccaagacaagatcgatgaacaggttggagcatctatctctctgattctctgttcgtgtccttgttaattttaagcttatgcctcatatacacatggacgagtttttttatcagtagtgttattttattgatctaactttaatttggagttccttctcttttaattgaggcgactgttaagttcgttttgctcttccttctgctgtttccagcatcactgcatcagcctcaaggttcttaatttatgcaggatttgattcttgtgaaactcttttgctttgtttgattgattggctcttgcttttccattggttttcagtcttgataaacactccttccaacagtacaactgctccagcaccatctcactgaacatgtggtttctgatcatttggtgaacaaaatgtaacaaaagatgtttttttatattagtacattttagagaggtgcttagtgcattaattcagctttagctatataatcaattaatgcaccaaaccactgtggggggcagtagcatgtaaatgctgcttagacactaagatacgttaggatgaagctaacagttcaattggagcagagcagggttgagaatcagtacttggaaaagattgattgtgagatacaacaataataatatcgtaatcatcgagccaggtttttttttagaaaaataaagtattgcaatcatatatgcacacgcatactaaggttcggcggaagagtaacattttttttttttgaaatctaaggcggaactttgttccacttttatatttagaagaagataattgacccagtttataaagaaaaccggatccgaaaattatacaactgcacggttaattacagaaaaaccgactgaaaaccaccgctacacaactaacaactaactttacattgatctaccagtagcatcgtcagtagaagtgatattaacataattgtactatcaatagttgatgtgatagtataaatagatataattcattgtaaagagtactataaaacacgcagggcggaaaatgaaaggaaaaaaaagaaacaaattgggtgtggaatcaacatgcatgcttaatgggaagaaaaaacaaatttgaagtgtatttgttaaacacatatgtaggcttgatctagagctgagctgtttggtgcttacaagtaaccacctctagattgcccctaaaatacaatgcaaaaagggaagttgacaaggaaaggactatatcaacggagaggaagaatcagaggcacgagctgttgactactgagtctgcgtgtgatttctttctcctcgatttgcagtgtacgtgtgctgtgccatcaacaagtgtggctctggctagcacttagcagcccctggtcctgatgtgatgatggtcaggcagtcggtccaaaccgccaaaagtctgggtccgttcctggacgatgttaacacataggagtacaatacaaaccaacggctgtcctaattacttctcgatgtcgtttaccgtactactaataacttactaataatagtagaattagcatatttttttgtaaattaacaagaaggagaattcatggtccagcatgcagctgccagtcaaaattcgcggctactctaatgagtttgtagttcatagtttcccctccgtcccaaaatacgtacagccatgagtaaccgtgtccaacgtttcaccatccgtcttatttgaaatattttttaaaaaagtcacacataaaatactactatttatattttatcatctaataaaaaggatgaatagccagtttagtccttcaacttttgctcaagggtcgaattagtccttaatgttttataatgtccaaacaagaccctaatgattatcatggagcttaatatagtccttagacccacttaaaacgccacgtggacatgccatgtcattcatgcatgtaagacaacatttaaatgtccattttaatcttcaattttctatcaaataaagaaaagaaaaataagaagaagcaatcataaaacaaagaaaaatgtcaatttttttagctatcaatgctacatatttttgccaatggtcaaaaccagacatttaaatattgaatttgaatgatgtggcatatacacatggcatgtttagaggatctaaggactatattaaatcacacaatgaacttaaggtacttgtttggacaatacgaaatgtcaggaactaaattgatccttacgcgaaagttcaaggatcattttaggtattcaccctaataaaaaatattaattataaaattttttaaataagacgaatggttaaacattagatatgaacggtgtaaaagcacacttatttttatggctacgcagtgagagcgacgagggatggatgttggccgctggccggccacgcaggaggggacaccaccattgcacttgcaacgatcgatgcaattgactgcttggtttgcctcctctccggtctccgctgccgtcctcatcaatgtcttctcacttgttgtttgtttggacccagcatgccttacctctacagtgcatgtgattcctcacagcccacctgacctgacctacctcccgcccccgcgcgcgcgcacacacaaatgcttacatcatcattgcgtcatgctcatgtcataaatgaacattgttacacatcgctgcaacatctttagaaaaatagaaggcagaactgtgttgttcatgctaaacacatcactgtcgggtcagctggatcaacagcaacccttgcttacacaacggagacaggaaggatgcaagcccaagagaaaacaggcaccgactgtgtttgccagacagataaacagagtcagctggcgcacacaaccactgatcacaccgcgttggcaggatgaaacagtacaccactgcttcagataatgacagtttgaacctactcacttgacctactacatataacaatgtacaagatctcaacaccatgcgtttgcaggctcaggcatgccatcacggtgatatggttacttactttgccgccttcagtacagcaataccagtaaggaacacgccctagatatttcactaccaaagaatttctacacctcaactgttaggggcacaaaagagagctatgctcgccgggcatggacgtggagctcattcgttagcaaactgcagctgcgacaagccactgcgtacttctccgtgtcgccaactatatatccgaatctgcctaaacctagaacgaatgcaaagagcaaaaaatattagtactgataaactgatcaatgataaatctaatcaacgagtgaattagaaatgctggaacatttaaacacaacaagaaaatcagattcaaatccaggctgggggtttattgatttattttactactagctatgtggaattacaagacaaaacagtcttgtttgaccttatccatttcttttgccttcagagacactactggttgttcctcacaagaaacaaaagaacaaatggcacctttagaaccaatcaacatcattttaaattgcaaaaggtacaaaaaggtggtttgtgtggctttggggaggtcaagctacaataattccataacaagtccacatggttgttttcaggggtggcagaaaataagtccgggaataagagacactggcaaagagttattgtgcaaggttacaagaacaagtcaaagtgtctcacatggctggtgaaattgaaaacaacaggaaataaaaggatgctcagagacgtacataatgcctactactacgtgtaatgaaatgtagttgatatcacctagatataaatcaggaaataagttatatatatgcactatcgccaatgtacccttgttggaaaagttattaaatcagacactcgcctcaacaaattaatatgggaacctgaagtaaggatatcatataacatgtccatatatataccatcccagattacctatttcacagtaacttctttgtgagctttaaatgatagaatcacgttccacgcaagggctacaaaattagcagcaagaacctggaaaaattaacagtaaggtgagaacagcattcagtcatgctaaagcagacagaaagaagcaaattcagctccagagtacagtattgcactctaaaatattttatgaaatgaaaatgtgaaagatttcaaagacctgaaatttttgtgggacaaagtaaaaattcaagaactgaaagggtatccacaattgccaattcgcaatcactgatgataaccactcctgtaaaattacaattgaaaattagctagcagtaaatgagtgcacatacatattatcagggagcagtggggattatctgcagtactgctgatacagtagcagatactgacgtatggacccggacccacatgtcagccactgctactgcatcagcagtactgcagaggatctgcgatggaaatgagagaatcaatcagaagaggttcatgtcacctgcttgagctttggaactacaagagaaggctttccctccaaggtgacgagtaaactcataaacactccaatgaaaatgggagagaaaatgaactgaaaggaggagataaaaaaaatgtcaaaaaataaatacataaatgcagaaacaagctagaacagaacaagcagcaacactctctctctgggggcagaagggaaagaggaaaaggacatgcacatacctgatcaagtaagaggcgagcaattgcacctgatgcaccattgatcgtcactaatttactcaagtacaagtacctgcatgtggcaacgagtaatgaaacaaacagcactgggcagagaacacatgctatcctaaacctcaataaacattggttgcgattaccagacatgcaatgttggccccaccaggacaagtcccaaaaatgtgaatacaaacgttctcttcaaatctagctttggcactttatcaattgcaagctggagcagtagcaaacaacaatggtaacagtaaatatcttgtaagaaaccgtaacaagataccacaataacaagaacagatgaaatatcaaatattttgcccaatccatggatgcaacccagtaggaatatacattgttttttaataatggaataggacactgttgctggagtaaaatccgttgaggaatcatatgagttacggattagcataggctaaagactgacacagttgagtaaagacaatatattcagattatggttgacgcaagattggataaaaagatatggacctgaaatttgataagaccataatagcctagccagttaagaatttcacatcatgtcatatttagaaaacaaggaaactaaaagagtgcagctaaggcagaaaagaaccataactcggtaaattgatttccaagtggtattagcaatggataacatttcaatgttgttttgaaggaaaattggtatgatttgaccatttgatgctaatacccatctaagcacgcctggcaatgtgctattgcagagtgacaggaagccctctacaagaagagagggagactactggttcattgttcgtcaaccaattaagtagtactaagtaatccactagggttgcaatggatggatgtgaaaatgcgggaagtagaaaacaactgcaagtcacctggcagatgaggtctccggtcagggttaggacggcagaggtaacagccttagtggtgatgggatgcttatcaagagccagcaggtacctgcaaatcatggcgcatttcagtaattttgcatttagatatgagtatggcaaaaagcgaggcaaatgaacatgggcagtgcttggccgcaggaggcaccaggaatcaggaagaggcggaattggacttaccaggctaacaggagacgccaatccattgctccttttgctccaccaccaccagctcctcctccggtggtgactccggcggcggaggcggaatcgcagcaagaggcggcgtggagcttcgagaggcggacgcccttgcgcgggtggacgactgcgattgtcgcggggagcgaggcgaggcgggaaggaagggtgaggcggcgggagtggaggagcggcggcgcggtaggcctcggagtcggaggggtggagcggtgcacgaggaggagcgggagggtggaggccatcgccatgggtggtgcttgcgctgatgctgcaaataactgcaatggtgtgaggaggagcttgggttttgggtcgcactggactagggttctagtagttgcaattttggggagaagatgatgaggtagacgaagatgctagcaatggatgatgggctttgcatatttgggctctcggcttccttgttgggctcttggcccacctacatttatttaggtctaaccttttttttttgcggggatatttaggtctaacctaactgtgcccatctcgccggcgccgcctccattcttctcatcctctccactgcggcgcggcggcgcggcctcttagcgccatttcctcctccacttggaagcagcagaagcggaagcccgtcgcccgcctggctcgagctcaaggccatggagtagtaagtaccaatcccttgctgtccattgctacctacctgtattttagtttgcccctgtatttctgtctctgtatatgtctgattgattgattagcgaagattttcatgtgttctgtcccagtgatgagcagtttagtaatctgagcacttgattcagttcagttggtgctccctccactgcaatatgctgtgaggttgaaggaaccgatcgatcgataattccatgtgcactgttgagaataggcattctgagggacagacatgattcagtttagtttgcttcttcgtattttagattagtgttttaatcttccttttcatttcagtgtgattcttggtgttaaatacttttgctggtggaatggagttggagcctcagtccaggctttggttttccctgatcagatccagtcctaattgcttgtttgtttatcagttatgatcagtcacttactctgatgattcggagggaggatgaataacgatcacaaaacgagatgattgattcatgtgagatccgaacacccatcttgagctgtattttctttcaagttcttgacggtctggaatcctaatgtgctctctttccatgggaaatttttggccatttcagtttcagagcggcaaggagccaaggatgcagcagcactagggtcctagtccaaattgtcagctgggggctcaattgcaatggcggagatggtgaggctgcccgaacagcagcgtcgtaggcctctcaccattgccaacctccctgaagaaattctgtcggagattctgctcctgctaccgccaaaatccatcctccagtgccgtgccgtctgcaaagtctggcgggacgtcacctccgaccgcgccttcctccttccccaccactgccgccagcctccgcagcgcctcctcaccttcatccgcgacgtgggcagtcgccacgatgacctggatatcctggactactgtgttgaagccgttgacttccgcacacaccagttccagtctctggcccggttcactggccaagattacgactgctcactcgaagacagcccattcaccgtccacgcttcttgcgatggtctccttctcatgtcctacaacaactatttgcatctctgcaatcctactacacgtcaatggctttgggtcttcccgccggcgcttcaacatgacaccgtcctggggctctattctcatggccattcttctgaataccgagtattgtattatcgagaaattggtttgggccctgaattctacatcagcattgttggctcagggaaggagaggagcatttggccccattcatcgtcagcatccctgagaaagtggttggcgaaagggaaggaggaaactcagttcaacgagcctttcctgtttcatggaaacctgcactggctgccgcacttaggtggacagaacaagatagtggtgttcgacactctcgatgaggtgtttcggtggttgcatgtacctttcaagatgcacaatatgtcgtcattactcgagattgagggtagccttgccatgtcaaacagccatattggatcatcaaaggtggatctttggcttctgcaagattataagcatatggtatgggtccacaagtatcgaattgaattgccagttatagagattcgccgttttgaagaagatgatggttggtatcttcatattgtttctcaagagggtgatgtcttggttgatggatttgattggcagtttcactacgacataaagggcaatttgctggagaaatttcaatgtagtggccgcatgctgaacattactccacatattctccaagaaagtctcgttccacacgaagtgtgccaaattctaaataatgaaagtagacatgaaccacatttcttcagggggctgtagagcatactttctttaccgtgaggctacttcacacttttgggtgtctattcattggatactgcaattttagcgatggaacttaattttgtagtgaatggtcaatgatctgatgttgcaaagggcagcattcactctgatcagtatttctgtacctccacatgttcatcttcaacattgagggtatcatttctgtactgtacatggaaaattaaatgcctgagactgttttttcctggtttgtggaagtctgagactgaacagttgattatgctcgttgtttatttcaacattgcgagatggttactttttattggcttcttgcagcttaattttgccacttgggttgcgtatataacgctgtggtattgaaaggtcattatctacttgtgttggtgatgcgtatgtctgatgagatccttagtgccatttattttgagtttgttgtgtcttgctggaattgttgggttacattccctgtttgaacaatgaccagtcatgaactgttgtcctagtagtcggtaaggaggtcttacagtgactcaacttgaattatgactgcactttcactgggctgctggaatttcctcaacctttgtgcttgttgcaggaaccgagttaccagcttgatgttatctacggaggcacggagtgatggaatccaacaggaacaggtactattaccatgacgacccagagccagaattgtaacatgcattgtaaacaggagaggaggcagtatagtcaagcagtgtgtgtacatatactcttgtggttgagcgatgcgattcaagcagcggcatgagttgagggaggcatattaaacttattccaatatttaactgggcttacttacggcccaaagactggtccaatcaaaagtgaactatgacgaatgtttctctccccgtagcagcccaggtgcacatgggcccagcaaccgcagccgcagccgcagcggaggcagcactcgcccgccgcgcggccgacccgctgcccgcgctccgccgccgcgacgcgctcccgctcccgctcccggcgcgcctcttcgcgcagctccacggtcttctcctcacaaccggcctcgcgcgccactcccccaactt

SEQ ID NO: 62726 - DNA, 17483 bp, Oryza sativa
atgcaccctgaagctgttacaacactcactaatcattgatatctgaacagttatgtgcacaccagcatatgttttgccaataatacaagtatacaacaatcaatgtgatggaatcacagaagcagtctaagtaagtgccaagcacatgtattagagagcagagctggtaccttcttccttgctgatgttgatagaagaatcagtctcgctggcacttatatcaacctgggactgtgcagaaatagctgcttgccctgcagctacagcaacatctgaaccaacaatggctgacaagaacgcaacctgggaaaacaatgctattagtcagtttgccgcatcaattgttacccatattcaaaaacctgctacataagaaaagcacatagcaactattgacttgaatataggattaactgtgatgttccagccgaagtgacattcttagataatagatgtcacgtctctcagttagaatttacaaatatagttttcttggcaactatggttgcaagcttgcacgttgcagtctttgttccaagtataagctacaagtgtatcgcataatcaagaagtcaagatataacaacaattaacttcaaatggataattactgatacagacctgggccatgattggattgctagcatcagccagtggcgtgaggcgtagtcgttttgagatatgtgatccagattcttcattgagatcacaatcattcccaaactgaattttgtcctccttgggtcccatgaactgttccccaaaaggtaatcgggtgaatctagcaatgcagtccttttctgatcgactaccaacatgatgagaaacctttttccagtcttccccataatgcaggacggcctcaagaaggtgaagagtttctttatctgtccaatctgattttgcgtcctcagtaatttcaattcgcttgaagtctgccgaagtaagacctggccggtaattggcacggacatagcatctagcacagaggcttatatctgcctggtcataagcagaatttaaggagtttagtagtgtttccaattaaaagatacaaggaattaatgagactttcaaaatacaccaggatgatatatgacgacagtatctcaactgacgtataaagtttgcgtgactagcaatgaacttcccagacttaaaagtgtcactaagttattataatcgtttgcaaatacttttcttaatggtaattggtaaaacacgactgcaaagagtatacttgttcaaaatgagttactggccacctccttaacaagcaatggacaaatgagctgtcgtgcacgcttttgtgagagactggcgcttgcatgctagatcaccgcagcaagcagcaaagttgtgcttgattgtccttggccacaagaaagaaggcaaagagataagttggttgctagtattatctaacatgctctgttaggcagtcaatccatatagttggaatttattgcctctggtaaactttgctaggaaggtgcctaagaaaataccaaacaaaataacaaaggttgcaagaacacggatacccagaactgcctttcacagggaacaagactattgttggtttcaagaacaactgctcagagccgcagatatccccttttctcaatacccaaaccacatcatggagtttcaacaaaacataggtaaagccaaatggactgttgttccggtaagaagggcaagctctgaactgaataagtgcaatctggaaatatttgcactcttactgtctaattgaaaccatgagttttacaaacctaaagacctcaatttgtgtagaaatttgcagcacacatgtttgattaccctctcaatttataatttcataagaaactaaacacaatagttaccaaaacaaagtatatatcagactatttgtcaacaactttgtctgctcatctgtcctgcccttcctacgggacatgccaaaactagctaaaccaaatcattgcagccgaaaacatctccacacccaccaaatatatttgtttacaaatgcgtaaactcataactgcaaaagaagagaccctttgttccattccataagaaactaaacatctgaatatttacaacactgcgcagtaggtgggaggcttggatgctcccaccacccaagttcaaatactcttaagcttaactttggtgtttctttcttttctactaattagataccaaggtttttgctgcttctttcttttctactaattagataccaagttctgccttggtatcctcttttttttttccattcgaaaaaatatttaccacttcccgtatcaacagccaagcgctgtcatagcttatcagaaataattcgtgaaaaacagctaagataattctacagtggtaaacgatgcatacacattgacaaacttgtaatacaactgtacacagcactgcataaataactcatccgcaaatcaaaacaagagcaaatcactcaccttctcacaagagaaataagcaagcccgcacacggtgcggcacccggtgcaaagcttactgggcattgttgccccaatcggcaaagaggactgcgataacgctgcctcctctttcttatctctcccctgcttcgctcccgacggcgaagctccatagtttatcagcccccattcctcaaggaagtcgaacacgcgacgcacggagccgacatctccgacgagcccacgcctggcctcggtgagcgtcagccgccgccccggccgcgcccggaacctcctcacgagggtgtcacggtagtacttgtaagcctccgggcccctggacccggacgccgccgccgcctccccttcgaagaactccggcatgaggcggcgctcggtctcgtggatggagtcgtaggagaaccacgctggcgaagagggaagctagggtttcaggtctcagttcagcctcgtcacaacaaggtgggggcgatggagggggttacctgaatagctcgggatggtgatggtgcagggcgactcctcggccgcggcggcggcggcggcggcggcaggggcgggggcggcggcggaggcggctgaggaagccgaggtggatggcggcggaggggcctccgtcttgacggtgcctgccgtcgaggggggctgggagaacggcgcccccgaggacggcggctgcggcggagcgagaggcatggagttcgccgtcgccgtagtcgccgccgccgccgcctcggccgccggcgctggcatcgacggcgtggccatgagagctcgagacagccgcgtctcgtgttcgtcttgggcttcacccgcagtggagcctatcaagccgcggcccaccaagaggattgggcccaaccgaccaacgcggcagagagcgggagggcggtttcgtggtctcggtttagtaccacctcgccgattctgagcgggaggaggcggggagcgggtataagaagacgaccgggggctgagataagattaatgtatgttctgatcttattcttgaataagttcagaacatactggaataagttcactttgagtccctcaactttatatcgagtttaatatcggatatgtgggccatgttcgcatggcctgcttctgtatccaaatatttttttatggggaaaggcccattagtggttctgccactagggcccttgcgcgttgccgaggtgttgcactgctgcccgggccggcgcaccccaaccaaaactcagttccaatgtttgtaattactagaaaattccaatgtttgtaattactagaaaaaatacggtgaagtttattttaatcttattgttattaagatgaaatttaacatggttaactgagtatatggtttagttaagatgaaatttaacgtgggatactatatagagagaattacactttggaccaatttttattaccttgcttacatattggaccgggtataggtaaatattttcacttagggctagattttgttaccaaattttgcatttgaggctattggtccacatgtcagtaaccaacacatcatcttcttcctgagcagtcttccaggctttattccgtgcatgtctccagtgagcttatttcgtcctcacacagacaagctcctcttccccaatctctagccacctcgaactgcactccgctacttgacaagcctgagcacataggctttgaactaccaaaaatttgaactcatggtttgatgtcaggagcatggagaaagagacggggctggagtttgaggcgatggagaatataagggattgacggagctcgagttaaaggtggtggagttggactgttggagctcgagctcaagcagcagaggaggtatagctcgagctttgaggcagaaaaagagttgaagctcgagttgggaataatggaggaggcaaagcttgatattggggagcatggagatcgaaacctgcgaggagaccttattctttctttttttccaagcatcagcaagaagagctttgtatgtatgggcatggcaaagcttgagctcgacctgccttgctctgactcagtggttcacagtggctcttggaggagagacgcaggagagagaagctagaggttgaaagtaaaataccccctccttccctaaatatttgacgccgttgatttttttaaatatgtttaaccgttcgtcttatccaaaaacttttgtggaatgtgtaaaactatatatatacataaaagtatatttaacaataaatcaaatgataggaaaataattaataattacttaaattttttgaataagacgaacggtcaaacatatttaaaaaagtcaatggcgtcaaacattttgggatagagggaatattttgcaaagatatctagcccaaagtaaaaaaatggatgtttaacccttgtccaacttgtaactttggtaaatgcaattcactcaatatatatatatttaaaaaaacatgagctgcagttaggtgtccgatcgtcttaagttaacatgcgagtttttttaaacatatttcttatatgattcctttggtattatcaaaagtgaacgatcttaaaactgactcaaatatggatatctatttccaaaagcaaacgaacgtaaaaaccgactcatatatggatgacgtaccaaaataccggtaaaaacattttagtttttataatagtagagataaagagtagcaataatgcccgtgctttgccatgggataaaaaagaattatagataaaagcgttgccatgtgtacttttctttaaaaactgaacaaaatgaaatctttgattgaactcagcaatgattatgcaagacaaatgataactatatgtatgtgttatctatggcaacatatcatatacacacaggtcctcacgtgtacacacgtgcacaccaactaaaaaatatcaccaaaaaatctagaaaaaatcatacacatactttcaattgtattacacctagggttaaaatcttaacgtcaaattcattatattttagccgtaacaaaaaaaacaaaaaatctaaccgttttaaggttgcaattttgtcagaattttatcttttttgttattctctatgtagaataaatttgaagatgcgactttgcacgtaaatgtaatactattgaaagtacatgtatgaattttcctagaattttttttgataatttttaattggtgtatacggtgtgtacacgcgagggcttgtgtgcataggatacgctcccgttatctataacatatcaaaagaaaacaattaacctccgtgtgctttcattatgtccatgaatgccaaattgtctagctaagattttgtaatttacaaaaggcatttaaatttaaattgacaaatagaatctggactccacctcaccactacccctccccccctcccccaaaaaaaaaatctacaggtcatctaaggctgagttgaactacaacttcaaacaattttctcgatttccttcagcacaactgctaagggcacctacaaaagtagagaccggtatgatctctacgttaattagatgctatcatgttacaatagttaagataatacggtctctaatcattaatgtaccaaaatactttcttactagttatcttttctttattagactcaatgcaacgaaaaatttcctaataaatgctaagagtcgactctatgccgttgtcatgcgtagcaaccatctttctatttccttcttcctctctcttccacgtcactaaatatgtttgcatgacaataaagagagaccgctaataaaaactattgtatatgccttaagggcagtcccaaccctccacctaggatggtgtctatggcattaactacattgccatgtaggacttttagcttatgtggcactatattaattaagagagagagtaaagagagaaagaaactgggtctcatgcaagacatagcttcaacatgagaacctatgcactagacactatcaagttttgtattgggagagaatagtgtcttcataatagatgaagaatgaatatgattggtagagaagagagatgatgtatttattaatggcccactttaagaaaccataggttgtagagtgtagtttctattgtgatgtggcaccatagacactgcttacggatactatgggttgggactaccctaaacggtggttttgtggacgagccaaccagttgctgctaagttgcaatttggagttgtcagcctaagaaccactccttgccaatggaaaggagacttgtctaccggtgcacaacgaattcataaaagggtcatcgtcgggaaagcctactaaattatgaacgctcaacctcaccaaaaataggatctgtatgaggaagaaaaataagatcacatggctcattttcaacttcacaaagtcatttttcatcaataagcagttatgactaactgaataaaaaaactaaagctccaagttatttatctagctcattttgtacctgagtttgttttagttcttttagctctattgttatagcataagaagagcagccctcaggattctatttacaatagaaagtattaaagaacagtgcattgtttcagcattttagattaactggcagtacctctttattctccacggctcctgatctttcatttagcaaaactatatgatatatttggttcggaaagcttcagaaatataacaattgttaagactgataagttggttcaacccggcaaatatttaacacaatgggtgctatgagaatctgagttgctgtccctatataaagttttatattacatcctaatgctctcacctagttctgcaaatactttaacctgcatgtaattggtaatcaaacagaaaacaatccaaggcaaaaaggaggataatctttgtaccatacaattttccagatcacaagttctacctatgaaaccaagaatattcagaaacaccatcgtatatcatactcctacatgaatgcagcttctgtttcgaacattacaagctccgctgaaattggctgttgttctgagtccagatgactgtgaaaagacacagaggattcaatacaaagagcaaagagcattttcatgaacaaccgtcaaccctctccaacgagctcctcatgcacatacaaattcaagacctcagcgtcgatggaagtaggcggcggcacctcgatcgcactgtggctccgtttgagaagaagattgcgtcggctcgcgtcagcggccgttgccgaggccgcgagaggagggcgatgcggttgcatgagggatctgtacttatggatacagctgcatgtattctctcagccaagtcaaactcagtatgtatgagagatgcgtgccaggctaggaggacatgagcaaccaaacacactctttctgattctcttgcgataacaacaacgatcgaacgaacgatagcgtgtgttcttgtgcacgccaaatcacacaacgtgttcccgaatcggccatggagaggatggacgaaacaatcggtgagtacggaattgtcttcaaattttataattggtaactgatatatcgtagtttagttacaatgtaattacatttcgattatactatagttatagttacaatgccctttttttagatattttatttttaggttcactaataaattaggtcaatggattgattgacttaggttgtatgaaacagataaagtggtttacaattatttgatatgtcatcagataattcaattgagatatcagaaattttttgaattggtttgttcgtttccttttgcagaaaatctgctaaagataaagataaagataaatattaattgtttcacgtaaaatgaggtagtaataacgtgtgattaattgagttttaattattacaaacttgaaaaatggattaatatgatattttagaacaactttcacatataaagttttcgcacaaatatcccgtttagcaatttgaaaagcatagccaccagtatatatttttgttggagaaaagaacatggtatatacttttgtcggctatgcattgcattgcattctgatttctgacatggagatgataattgcctggcttataaactgtcataactgatatgcacttcattagatcaaattctgtaagtatagttgatatgtcttttcatgcacactccaattgaacaaactgaattccctaatccacgagatgctaacaagtaaccacatatatatatgagacgtaagaaaaagtaaagaaaaactacgagatcccaacgttgtcagttgtcacgtcaggctcacgagaagctccggcttttattttctgacccttatgaaaactaaagcaaagccgtgaccgccggcatggagtccgccgtcgccggcaacgacggcgccgcgatctgggttcgaggcggccgcgtctcgtgctccaacaaggccgatgctgagagtagaggcccatctaatacattggcccacccagaaggcttcggcccaacatgccacggagcagagagcaagaacagcttcgtctcttcggtttagtaccacctcgcggattctgaggggagggaaggaggaggagcgggtataagaggagggcctgggtaacaatgcaactcatacctttctcggccttttggctaagatcaagtgtagtatctgttcttatcagtttaatatctgatatgtgggccatgtgcccacttcgatattaaatttattttttgtgggggagggcctatcacagtggcttgccactggggccctcgcgcgtcgcccaggcgttgcactgctgcccgggcctggcgcaccccaaccaaagcatcaattaaatttttaccatacaatccgaagctgcagtttcagtgaaagccttttgaagtatattgatccatataaaaaacatattttcaacatctgaatttccaatgctgtatgatgagcaaatacattaggagttagattatatttgttgttcagatcggttaactcacatgagattcatctctcgagattatattttttatatgatgctcaactttcttccaaaagattgagagttgagactccatgattattaactgaaattctagctaaacagaatgttggtattatcattcacagtgtaggtccagctatgtacactcgatgctttccatatcataaatcaccaggcaaatgaggaatagggatcccaaagaaatctgaggaagaagatgcatgtaaactgtaaaggagctggagctggaagagcaggaggagatggcacttcatcctgcactgagcatcaggatgagttgatctcgtcaagttgtcagcaacctagctctctcccctcctctctagttactccggctttgtttcgttttgcagcaacttttaggaagatcagttgtcattgagatactttgttgactatgcaagtaatgcatgcagtgtattctgatttctggtaacttgactgctagacttacataataactagagaaaatagtttgatgcacactaattaactagagaaaaactactgggcaattgaacgtcccaaaccatgagatccttaccacgtatgtgacctaaattaaagtaaacaaagctaccatcaaatatattgtcaggatcatgacaaactccagctatcagtctaccaccaatatcgtcaagctttcccagcattcagtttccactcttcagtaaaagcaagcaatgatcagtgttcatttaccagtctccaaagcaaggtaggcagcatttagcatgtcattacaagaaaaaccatggtgctactgactaaaagttacagaactaaagatggcaacaatgttttaagtgggatggtcaatggagatcatcatggcattgcagccaacacatatgaccgatcacaacgttttaccaccaccaccaccaccacttgacatgagtgaggcggcagcagcgcctgcagtcgggacgattccagtcgaattgcctggtttagagagatgcagaagcctgcagtgtgttttgcagtcaaaagtgagaaaattcgtttatgccagtctagtaataatcttgagatagctaaggaacacttagttacttacggtgctagatattcacagaacgaagtgacggctgaaacgacatcgttgtaattgtcagcagcagcaggggccgtgatttccactagctgtattgcaggagtgattggcacagcttcgttggtagcatggagttttgtcatcttgctaacagaggtaacggtcacagttatctgggcacctcggtggaaacgaaatgcaaatcctcccttcagaacttcatgatctaacttgtaccctataccgtagaagtaacgcaatacattgttgctggctttgctctctacaattgaccgcacaaggactgagatttgctctgcaccagcacctctcatggcacctccaacatgtcttatggtcctacatgaatactactggattcagaatatcatcaaatatcacaaaaatgtaaattttagcagctgaaagaaaagttaccaggatggcgtggactgagctaagtcacacaataaacgaacctctgatgggacaactcctgtatgattggaagatgtatatgagtaacaatggcatatgatcagaataatgaaaaagttgcaaactgacctagatttggcccacttttaagacagagctcatgcactctgacacgttcttttgggacaccagagaggccctggagaagaacctcaagagcatcaacatgctgcataacaagaagatcaaccaaaagttacactgatgtcaaagcaatgaaaactaaaaaaggttaaatggtgttctaagcacaagacattgacatgtgtatataaattaatccctttattgtaaaattacaaaccatataagtgatatgattcctccaattgtatataaaatagaaccatatcaacatattgaaaagagaatcaaaaaaagtctgcaagtggcagaagtagtgccctcagagtggagaaacatggttgaccatatagtggtcagcatgatcaactgtatactttttttttattatcctgaagggaagtgttgatatgctgacaagaggaagctataagagactaacaaaaggtcatatagagacaatggatcgacgacaaagtcttaatgctggcatgaattattattctctattccctgatgtgtttcgttcaagaaaaaagaaattctctatggacataaagttccaatactacttcatgctatatggagtgaaaaaataactttgttcctaagtaggactattgagatgtaatttgacattggggctatgcagttgatagatttgctacctgggatagcttaagtgttacctttcaaaaggttttatcacaattacatttacagaggtctgttttcaggcaattgacacctccaacaacaaaaatgctatcttaaatcaagtgatagaaagttcatttagtaaacgtcgaaattctacattccaactcctttggataaggttactacaaagcgaaaggccaaataaccttatgccaaaaattaaataaaattcagaattctagatacaacatacaagtaaggagcgcaaatgtcagatcagcaaacttgactagtaccgatttcccagaaaggcctaccatcatacaaaaatcaagaatccatgaagaacatcacatctaccatcactccggcttatgttacgggccatgtatgattttccgggtaaaagttcaaattggtcatgttttacagcataaacagacaaatcagtttcatatgaacaaaaatgcatcgttgcatagctacagatcactcattctcggaagaaactaccgttcacttcaacaaccgctcacacagtcaccactcatacaagtctactggcgaagtgagaaagaagaacaataacctgggtctcgatgatcccctgcaccacgcactccatcaaccccaccgcttctcgctaccacaatccctgcaagagagacaaaccctgaaaccacgctgcggaatttcgtcgaacagctacctcgcagcaacaaaaattcacccccacctttaacctaacagcaataatccgcggcgcggcgggggctgaggcgtcgggaagtgagccgatccgaggcgcaagagctccccccacctcgcaaaccccgcgtccccgaacactcccctctccgccactgaccgctcgccgtcctccgccgcctcctcctcctgcagcgatggagacgagaagaaagaattccgagaaaccgaggggggtaaagtgataaaatgcctcacccccgcgcgaagggtcgcggcgtttttgcatctaggcccctggaagaatctgaaatttcagtcatacccttcctctgacttctcctcttcctcttcctcccccacgcgctcgtctcgtcttcctctcgaattcccattttcttccacctcctcctcgtctcgaggtctcagatccaatggccgcgacggcgacggcgacgaccaccgcgtagagcgcgtgagagtctgcgtggacggctaactatggcctcgccggcgggggcaatcggcggcgcgtcgccgtcggggcgggtgctgggccctgcgctggaccggatcatcaagaacgcggcgtggcggaagcactcgggcctcgtggcggccgccaaggcggcgctcgacctgctctcctcgtcggcgtacgcgtcggcgtcggcgccgtcgccgccgtcgctgctgctcgggttgccggcggccgccgcggacgcgtgcatccacgcgctcctcctcgcgctcgagtcggcgtcccccaaggtcgccgacccggcgctcgactgcgtcgccaagttgctctaccaccgcctcctcgtcggtgatctcggcggtggcggcggcgacgacgactccccgtcctccaagctgctcgccgccgtgctctcctgcggcgcgctcgccgacgacgccatggagctctccaccctccgcgtcctcgtggccgccgcgcggtgcccctccgtcgccatccgcggggaagggctcggccagatgctcaagacctgctacaacatatacctcagtagcagcagcggcgccaaccagctctgcgctaagctggcgctggcgcaggtgctggtgatcgtgttcgcgcgcgtggaggtggactccatggatgtgcgcgtgcgcacggtgtcgatcaccgacatgatggacatgtctgaccgcaacctgaatgactccagcattgtccatgcggcgcagagcttcataaacgagacgatggagggaagcgatgtccctgagccggggtccccggttgagccggccgagacggatgggaaggaggatgttgtcatgagcaagatcagggaggatgggttgacactgttcaagaacctgtgcaagctgtccatgaagttctcgacgccggataatcccgaagatcaggtcctgctgcgcgggaaggtgttgtctcttgagttgctcaagatggttatcgacaatgctggggcattctggagaacgaatgaaaagtatgatatgatactcattattgtcttacttctgtgcattttaacagctcaacttgctgtgttgcctatctatataaatattgttgttgcagtgatttagaagaatgcagatggcttaaatgactaagggaaggaaggcataaaatgttcagtatagtaattgatatggaggcttcatgtttgcctagtagtaactcagaaattatggatacacatttttctgatactaatacattattttcacaatccaggcacgctttactattatctgcttggatgtgtcaacattttggctatatttttttaatgtattatgatggatgaaaatttttctagggaaaaaagtgcagagtttaatctatggtggtagatacatgtttacgtgacctactattctgtatttgaattgccattggttcttttaaaatgtttcaaatgatgtcctgatgataatctgcatttgtatgttgttctcttaatttgtttaagtctcttcactaactaaaaaaagaaaataattaatgagctaacaatacactggaaagggaataaaaacatgaagtgttgatttatgagctccagatgtaacatgatggccaggagagggcacaagcatcacgatattttatttataacattaggagtgactgaactttattccgttctttttttccttcaaaatatgctcatccatctaatttgctatgctgaaaaatatgattattgttcaccaagcttcctgcaagtatacggttacaatttaaaaccttttatgtttagggtattccataaagagcattctgtttactctgactccaatgggtaataaaactcttatactgaagtgttcttttctcttttttttttcaatgcaggtaccttggagcaatcaagcagtatctttgtttgtccttgttgaagaacagtgccttgtcagcaatgagtatttaccaactgttatgctccatatttttgggtttgctgtcaagatttagatctgggctgaaagaggaaattggaatattttttcccatgcttgttctgagggttcttgagaatgtccatcaacctagctttctgcagaaaatgactgtactaaaccttttggagaagatctgtaaagactcccaggttattattgatgtctttgtgaactatgattgtgatgttgatgcaccaaatatctttgaaaggtatgtagttttgttcttgatgaatggcaaccttaagttttgttgtcacagattattagcagcaggtatgcatctatttagtggcctgtaagtgctgcatgagaatcgatgcattgaactgattacagttctgcaaaaattaagttcactctctcttcatcatagttaaaacaaccctttaattccaacagatctttgcaggattgtcaatgggcttttaaagactgctctaggggttcctcctggatctgcaacaacattaacccctgcacaagaccagacatttcggattgagtcagtcaagtgtcttgcaaccataataaaatcaatgggttcatggatggaccaacagctgaaaattggtgaattttcacccaaaccttctgaaatatctttaaattcgatagacattcctaacatccttgttggagaagatgggggtgctgttgattatgaactgcaaacagactctggtaacccagacctatctgacgcttcctcacttgagcagcgtcgtacttataaaatagaacttcaggtatgttaatatttgcatgctttctatttaaattaactccaatgttagacattttataaagggttaacatttggtttactgaactgcaaaattccttctgcagaaaggaatttccttgtttaacaggaagccttccaagggtattgattttctcattaaaagcaagaaaataggtcattccccagaagatgttgcttctttcttgagagatactgctggtttaaacgcaacaatgatcggggactatttgggtgaaagagatgaattccctatcaaagtaatgcatgcatatgcagatgcactgaacttcgaaggtatggactttggtgaagccattaggtattacttgcgaggtttcaggttgcctggagaagcgcaaaaaattgatcgaatcatggaaaagtttgctgaacgatactgcaaatgcaatccaaattcttttaccagtgcagatactgcatatgttcttgcttattctgtaattatgctcaataccgatgctcataatacgatggtcaaagataaggttagctatatcactgatcccctctgttatatgtcaataacagaagttttgatcattaaatggattttcgttacgcagatgtcgaagtctgatttcattcgcaataaccgaggaattgatgatgggaaggatttgctgaacattatctgagtacattgtatgatcaaattgtcaaaaatgagataaaaatgagtgctgattcgtcagttccacaaagcaagcagcctagtagtgtaattaagctcttaggcttggataacattatcaaccttgtcaactggaaacaggctgaagacaaggcacttggagcaaacgacttactcattaagaacatacaggagaaattcaaagcaaagagtgggaaatcagagtaagagagagttactcatagacaaataacttgcgtcagctaacactttataataattaaagctcttgtattcgcagatctatatttcatgttattactgattctaccattttaagattcatgatggaggtttgttgggcccctatgatggctgcattcagtgtgacacttgaccaaagtgatgataaggctgccacatcacagtgtttgcaaggattcagatctgcagtgcatgtaaccgctgtaatgtgtatgcagacacagcgagatgcctttgtgacatctgttgccaaattcacttacctccattgtgctgcggacatgaaacaaaagaatgtggatgctgtgaaggtaggaacttagaaaagccaaacttggttctcttttgttttcttgaaataaaaaatgattctcatgatttaaatgcaaatgcacacatactattgcattttcctattgatattatgtagacaaaattcccaagcttatatggtcccttggtctatttatggtgaggacacttagatggcttcacagtacattagagcttgaactattcaaagcatttacacttgtactggattaaaatacttgattctattttttgtcaaaaccatatcgactaatatatatatctatatttgttagacatagtcctattcgtcaatattagaacaagtaatgatgtgtgttttcttaatgtctttttacaggctataatatccatcgcaattgaagatggtgactatttgcaggattcctgggagcatgtactaacatgtctttcacggtttgagcatctacatctccttggagagggggcacctactgatgcttcatttttgacagtgcctctggttgagtcagaagataaaacacagaagtcaagtagcactacagcttcga

SEQ ID NO: 62727 - DNA, 25987 bp, Oryza sativa
tagccctagggtttgtggcggcggccacctacagcaacacagtaccggggagggaggagaagtgaatcagtaagagggagaggaaatgggtttttatatctagggttagacacttagacttagatgcttagatttgttgttgggccttgggctgcttgtattttctgggctgaggcatatgggtatttttaacccacgggttaatgggttcgggtggatggagaacgttccaggacccggcccacccgatgggtgacgttttagcccgataagagacccatgggtgcaatatttggaatacatttgactcctaatagagtaaaaacctatcgggtcgcgggttatgggtccccgttgctatccctagtcgagggcacccattgtggatggcctcaggatcagttaagccaacagctttgcatatgatggggatatgacattggggcttttgcttcagctttgttggttttgcccctatcctataaagccatggataaaggtgaagggaaaaagaaagcaaatagttcagtggagtatgactaggaattatgaccctagtgcttggaagttgtttgctgaaaatgatccctttgatactgtttattgcaaactgtggaggacacttcagcatgaaagcctgacagttcttgatggcctttccttgagaagacataaatcaaaccctcgtgcctatgttgatggagattgtttggtggcctttgctgtacatacatgtgttcacgatcacaagttcaaatgtttggtcgagtttctgcacgtacatattaacatagacagcgtttagttccctttaaacttccaaaagttacgtcacatcaaatatttagacacatgcataaaatattaaatatggaaaaaaaaacaattgtacagtttgcatgtaaattgcgagacgaatctttttagcctaattacgtaatgatttgacgatgtaatgctacagtaaacatttactaatgacggattagttaggcttaataaattcatctcgtagtttataggcggaatctgcaatttattttgttattagtctatatttaatacttcaaatatgtgttcgtatactttaaacacgaccatacatgtgaagataacataacctaacaaagtacacaaatgctgtaaaggtcataattttcaagaaaattccgaccgatgatttccatttctagaaaagttctgacaggcggagactttccaaaccgtttttttcacctagaagtctatttcttctactgatgtgcaatatttttacgcgttctcgaaaaaaacttttcaaaccttttttaaccctgatttctatttttttgtctatttacgttgactaaaattcttcgtaaccaaatattacctccgtcctaaaatatagctattttagcacagtgacttgttccaaaatgaagctatttttttacctaccattttctctcaaccaatcacaaccgttctcttcacctactttctcttctttatcaatcacaacccttctctaatcatttgtatctacttttttcatatacgtgtctattttaaaaatgtttacattttagaacagatgaaatagtaagatcaggtacaatagcaggttataaatcagctataaacatattttaagaagatgatagacgagagagaacagctgtagcacggactctaagatacagtgtgtgtatgacaggtgggaccatgtattaatagtgtaacatgtaactattgtataaattgattattaagttgactagagattatttagggctaatagttagctatactaatgttattactctaatcctcaagattcacatgttgcagcgcgagttcctgggatgaaccctttttttcatcacattcacgcatatggtcagcagggtgagcgagcgagcgagcaagcagcagggggatccatcgatccgtccgaatatgctctgctctgctttgctttgcggtgggcatcgggaggcgcgccgccttttggggtttttggtggcgcgcacatcgccgtgcccgactgcccgtgcagtgcatgcaaagcgacagaaaaaccacagcgggggggtactcccccttttcgctggagccgcgggactcatggcatgggcgggcgcccgcggcgagcggagcggagcggggaccaaaacaccggaggaaaacgtcgcgctcgcgctcgcgctactgcaactgcacgatcatcgtcagttcccccacacggccacacccgcgcacgcgcgcggtcctactcctcctgcaccgcacccaggaaggagccactgctcggctaccccgggcggctcaccgacgaaaatttcattaaacttctatattgttataaataaatttatgatgaaatttctataacaaattacttatatattgttatagaaatttaattagttataatgtagttttgtccgcactcaaaaatctttctagctccatcacttactgtgccccgtttttgttgcacctccattctgaaatagtgttttcttttttcccttagtaacttctactctcttatttttcatgcacatattttacaaaacactagatgatagcatgttttcttaaaaaaatattgaaaaaataattttataaattatattaatccattgttaagtttttaagctaatacttaattattcacgtactaatctaccgctccattttaaggtcgaggaaaaggattcccaacttactcaaaggaaaacaaccataataccctactttattaaaacccaatacaactattctcaactttatctactcttagagtccaagtgcatttgttccctgctttcacaattgctactgcctttgtttcgggttataaaacgttttgactctgcttcaagtttgactaagtttgtaggaaaaaataataacattttcatcccaagacttattctacaacggaggggtagccttttagctacacgtgaaacaaataaatcattaacgaatgattaattgagtagtacaacctccgtttcatacaataaactgtttcatttttttctaagtcaaaagtttttaggtttaactaaatttaagaaaaatataatattaattttaacagaacaaagaaaattgtttctatattagatgtaataaaactaatttagtactataaagtgcttctatttttttataaacttagtcaaacttttaagaagttttgacttataaatgtcaaagcgacttataaaatgaaacgaagggattattagctgctcccttcatctaaaaatataggtctcggattggacacaaaataagtggcgtgggttcaatccgatataacgatactaggttgctatatatattttagaataggtgaaatattacaaattcaaaaaataagtttattcttttagaaagaaaacatttatataaaaagttcttgaaaagaatacactggctagaacttcaggaagagtgctcatggaaaacgagaaaattgctaaatcctagtaattcagtacccaacaggcaataagactaagaccgagttcttttcagcaactcgaaacggtgtttttttaaaaaaaaattatatagtacaacacatacactcacaatacacgcacactcacccctatgaacgcacgcatgtaatccctacctctataaacatcttcgaatactgggctgataaatcctttgggattgacgaagtcaaccgaacttaacgtaccgttttgtgaaataaatatagtataatgtattatctctatcctaaaatataacaacttttggctatgaatctggtcacacatttagccagattcataactaaaaatacttatatttgggacggagggagtatatattttaaaaattataattgttacccttgctaatcaccccgtctcatttcgcgtgcgagctgaacggctcaaacgaacgtgcctaaatcaagtttaaaccaagctcaaaataaatatagattcaccgccgttcgtcggcaaccgtttaattatcacggttactgataaatttgatagggatatgcctttcgactatcgttcgcattttgaaaccctggtctgagttgtcattttctcacagtgctaaagtcaacaccaaatgtccaatgctgtccatctatttttattcggaatatatgtgttttgaatactaccttcgtcccaaaatactcgtcgctttgggttggtttggtttgtggcctaaataggccttaccaaattttgtcaatgccaaattctggtaagttttggcatgactaattttggtaaggtaaaattatgtttggattgaagtaaaaatagcctaagttcactattgaaatggcctattttattaggcatgccaaaatttggcttcaaaccaaatagacactaaacactattgaaattgccaaatattggtaagtctaatttaggcctcaaacaaaaccagccctttaagtttttgtttgtaacttttgattattcgtcttattcaaaaaattacgaaattattatttattttttggctttattatcaaaagcactttaagtataacttatctttttttatatttataatatttttttaaataagacgaatgataaaaaaaaagttagagtgataactaatttaggacggaggtaatacatacgaaatatgagccagaaaaggccagccaaatttgtgggcagggatatgggggaatcttcttgagattgcccatcatctataagcatctagagacatcctatccaaatttgtaccaccataacctttccttttacataaggcatacgaatgcatattattgagagcaccacaccaactaggctacttatataggtcactgcataagaggagataaaggcatgagcttttgttaagcaccttcattcgttttcaatctacatgaaattttggtcaggtgggtcgagccatggtgtatgttgacgtgccaaatcagtgggagcaatgcgcattaactgagccgattacaaaatatatttaaaaatactcaatatatttttatttatctcctatccatttcaaaatgtaagacttggtcccgttcgtttctgtactgaaaaaagtggatcaaaatttggatatgtgtgacactcttttcaaattgctaaacggtgtgtttcgtaaaaagctttcaatatgaaagttactctaaaatatcatattaatttatttcaagtttgtttggtacgtaaatattaagattaagaaaaaaaatcacgtttcagatcccagtgatcaaattcttctcacggactgattggctaaaaaacgtatggatttttacgcgttgaaataagtacactagaaatgcttatactatgatacaaattttaaataacagaaatacttatattttggaacactaaactaagacatactaatatgcattgtttaggggcttatatgagaaatttcaaaaaacgagggcaaaacaacgaagcaacgaaaacgataaacatggagcggagaaagcgagcgcgcatcggcgccaccccgacaaatggcgatagagcccaaatccaaaccaaactcaaactaaaaaaacaaatcccaccgaaaacgatataaaattcgagcgagggccaaagcgaaaagccgccgaatccacgccatttcccacccaaattccacccgaattccaaaccccaccaaatataaatcaaatcccaacgtgacctcccccgcggccgcggcctgcttcacgcctccctcctcctcgccgcctcgccgcctcgcctcgcctcgcctcgcctccaccgcctctactaaaccctccgccgccgccgccgccgcggtgatcaccggcggccgaggtaagccgccgctctgacgctccctcttgacggacggcgcgtttggtctcgccgcctttggcgttccgtgtttttatcttcgcccggattccggatggattttgattttgattttttttttgtttctgtttcccccaaatacccggggccttgtttgggttcgtggagataaacgcgtagtaggcggagttgctgcgggcgccgcctcttttttttcttgttcctcttttgtcaaatggacagttcgttggttgtcgttggcgcggtggagttggatttgtgggatttttttttctcgggcttaatgcaagtggtggttaaacaatttgcttcaacgctatcactgaacttagaatgtaccaaaaagatccaaacagtttgatttaatgttattttactaacaatttgggggggaggctgcacctgttagtgcttaccaggactatacttttggggatttttaaggagtttacatctgtactgagttcataattatctgtactgagttcataattatctgtaccgagttcataattcatagttcaagttgtacttgcagtacagaagtttgtgctggattatgagaagctattattatatcttaccaattggctgtaaaatatagcatggacatatgaccatctaaatttatgttggtttttggttgttcctgggacagggatggagcagaatggagagaaccatctcaaagatccacttcttcaggcagatggaggcggctccggtgcttctcccgccggggcgtcgccgcggaaggagaggaagacgaggaaggtcatgttcaatgtccgggggatctcgtgtgcttcgtgcgccgtgtcgatagagacggtggtggctggcctcaagggagtcgagagcgtctcggtttcgccgcttcagggccaagctgttgtccagtacagaccagaggaagccgatgtaagattgccttgagctgacggtcttgttctcaactgcactagatttccccagcatgggagggacaattttgggtgtttctcatcatggggcaaaataggatttaggattcaatgcatatctatattgtccttattcaagttattgtgggccagttctctatttgactaggagtatatgtctgcaactctgcatgaatttaattccagcaatatggtggttttgaattccaggagctgaattttatcctgtagatgtcatgatttaggtaattaggatacatgaaaattttgatttcagctttatattggtcattcatataaggtccacgagtaagtactacgaaccagtgactatcttaacaatcttttttgtcagcgtgggccaaacccttgacaatgactgtgcaatcatatgatgacctttatacctcatcgagttcatgttctccaggcctggaatattgaattacttcgcaatcatatgatcttttttacctcttactcagaaatttttactagcagtttggttcgaatcagtatttatcaaggttctaaaaattggtaactggtacttgacagttagtgaccatatagcctgtgatgtcaagttcaggctcatgtagtctcatgttctttgtatacagttgccatcatgcaattgccagttaggctgtatagtcactaatgagtgcaccaactggtaacttttgtctgcatggacatgctttcagttcactaaactcatgtatatttcaagttgcactcatgaagtaatgacaggatattttacggtttggcattattttccatctgttctcagtttggattcttattcttccaggcaagaaccataaaagaagctatcgaaggcctcaatttcgaggtcgatgaacttcaagaacaggaaattgctgtatgcagactccagataaaaggaatggcatgtacaagctgctcggaatctgtggagcgagcacttcagatggtacctggagtgaagaaagctgcagtgggacttgccctagaggaagctaaagtccattttgatccaaatatcacaagtcgtgatcttataattgaggctattgaagatgctggatttggagctgatctcattagttccggggatgatgtgaacaaagtccacctaaaactagagggtgtgagttccccagaagacatcaaactcattcagtcaagactggaatctgtcgaaggtgtgaataacgtggaatgtgacacagcgggacagacaataatagttgcatatgatcctgatgtcactggcccacgattacttattcagtgcattcaggatgctgcacagccccctaaatacttcaatgctagcttgtattcaccaccaaagcaaagagaggcagagcgccatcatgaaattaggaattacaggaatcaatttctttggagttgcctgttttctgtgcctgtattcatgttctccatggttctgccaatgatttctccttttggggattggctgttttacaaagtatgcaataacatgacgataggtatgctattacggtggttgctgtgttctccagttcagttcattattggttggaggtacaatcccatctctcgaacagcttcttcttgatgttgtttcatgttccttatctcaagtcttttgtttattgtatttagcctaaatataatgttgccttcgtttgtttccttcattgcacacatgcactataaatcatgtgtggttattcactatgtgttattttactgacagattttatgttggagcttatcatgcgctaaaacgaggatactcgaacatggacgtgcttgttgctttggggacaaatgctgcatacttctattctgtgtatatagttctgaaggcactaacatcagagtcatttgaaggacaggatttcttcgaaactagtgctatgttgatatcttttatattgctggggaaatatctggaggtggtggccaaaggaaagacatcagatgctttgtcgaagttgactgaacttgcaccagaaacagcttgtcttcttactttggacaaagatggaaatgccatttcagaaacggagatcagcactcagttacttcagagaaatgatgtcattaagattgtccctggggaaaaagtccctgttgatggtgttgtcatcaaaggccaaagtcatgtgaatgaaagtatgataactggtgaagcaaggcccattgcaaagaaaccaggagacaaggttggtattttttggatcctgattgtatttgctcttgttatgaactagtatcctgatggttcaattgacttgtttttaacaggttattggtggtactgtaaatgacaatggttgtataattgttaaggtcactcatgttgggtcagaaacagctttgtcacagatagttcagttagttgaagctgctcaacttgcaagggctccagttcagaagttggcagataggatttcacggttttttgtcccaacggtaggttcgcttgttttctcctgcaaattcccttcgtgctatttcccaccagcgtttacaaaattgcaacattgctatattctacctgcctagctactggttaataacaactggctacggaggtaatcgaggtatttatcctagacagtagacacatagtcaactgcactggaaactttacctgtactggtcactagttatcgcactaataatttcttggtatttctaccctagacttagtcagcattcatctggaaactttcttgaacctaccccagcttctactgtagaatcgtagagcaaattatattcaatttagtggagtagcagttttaactctactccttaccaagttcacctcctctgtaaacagctggttacttatgagaaatgttaccctgattgatacttgcaaatgtttcctaactacttttgatgcttctcatgcatactttctgtgagatcgtctctttcttcatctcatattggtccctctcattttaaggttgtggtggctgcatttcttacatggcttggctggttcgtagctgggcaattcgacatataccctcgagaatggattccaaaggcaatggatagctttgagcttgctctgcagtttggaatatctgttcttgttgttgcatgcccgtgtgctcttggactggctaccccgactgctgttatggttgccactggaaaaggtgcttctcaaggtgttcttattaagggtggcaatgcacttgagaaagctcacaaggtaactgagatgatttctatgtcatgtattattttttctcacatcaaatgtattctattttttttatattgtgacactaaactattccttgtatttctttatgtgcaggttaaagctatcatatttgataaaactggaacgctgactgtcggtaaaccttctgttgttcaaacaaaggtgttctccaagataccgctactagagctgtgtgatttggctgctggtgcagaggttggcttcttagatgcaaatgctaataatttttgttgaatgtcgtgtgatgttcctagtttgctgtctcatgtcatctaaccttaacttttttctaactttgtcaggcgaacagtgagcatcctctatcaaaggctattgtagagtacacaaagaagctcagggaacaatatggatctcacagtgaccatataatggagtccaaggactttgaggtgcatccaggggcaggggtgagtgccaatgttgaaggcaagctggtgctggttggaaacaaaaggcttatgcaagaatttgaagttccaataagttctgaagtagagggacacatgtctgaaacagaagagcttgctaggacctgtgtgcttgttgctatcgacagaaccatctgcggagctctttctgtgtcagatcctctgaaacctgaggcaggccgtgccatttcatacctcagctcaatgggtatctcgagtatcatggtgacgggcgacaattgggctacagctaaatccatagctaaagaggtcgggatcggcacagtatttgccgagatcgatccagttggtaaagccgaaaagatcaaggacttgcaggtgcaatcttttctccttgcagcaaaaacaaagttggaatagatcacagattttaccaccattattccaacttacatcacatcatttgttcacagatgaaagggttgacggtggccatggtcggcgacgggataaacgactcgccggctctagccgctgcagacgtaggcctggcgattggggctggaaccgacgtcgccatcgaagctgccgacattgtcctgatgaggagcagcctcgaggatgtgatcactgccatcgatctctccaggaagaccctctcaagaatccggctcaactacgtctgggctctgggctacaacgtcctgggcatgccggtcgccgcgggcgtcctgttcccgttcaccggcatccggctgccgccatggctcgccggagcttgcatggcggcctcgtcggtgagcgtcgtctgctcgtcgctgctgctccagctctacaagaagccattgcacgtcgaggaggtggctgctggacccaagaatgacccggatttggtgtgaagactgaagaagcgtcggtcttgctgtgctgactgaaactgagcatgaagcaaacgccttgtttgcagtggccctcctgactgatttctgtacagtagtcatgttttgggattctctgtttttttttgggtacttctgattgattcaataataatttggggagcttaattgctatccagtgatatatagatgtgaaattgtgtttaaacagtggagaacagttgttgtattttctggcaagtgaccattgcgacgttgtagcattggactagttagtaactagttgaactgtaaactcattgcaaaagtaatctactctttagttatcctttggaacactgcatgcttatcttgcggaaaccgaactgaatcctctgaaaatcctataacatttcatctcaaatttgtaggaatatgttcgtcgatacgcgctatttcaaacaataaattcaaaagagcactgctacaccaattaaaattttcttactaaactcttaccctcaatgatctcaaccctcaattatctcaaccgattgatttaactatatgggattataaaaaatctaggatatattaatagcatgacacatcaatgctaataagagttcagtaagaaaaacgtagtaggtatagtcttttccaatcaaaaactttctgctctaaaatcatgtgaaaattcgtcgagatgtcaggacgggaacggaaggaaaatgatcggtaggcaacgacgaggaggaagaagcagcagcagcagccgcgcgtcccgttggttcgcgccaaaaatagcagaaaaaacccgcgcgcgcgacacccgcgtcgtcgtccgctcgccgtgtctaaacatagctaagctccccttcccgccgtatatataatccggcggcgcgcccctcctcgacatcgccgtacctacaaagatatcaacatggtttcctccacgagaaggacgacctcgtctctatccgccaccaccgccgccgccatcgcggcggcggcggcggcgctgatggtgtccgtggcgttcgccacagcgcagtacacgccggccacgccggcagcgccgggggctgcagcggcgggtgcggcggcgggggcgacgccggcggcgccgtacacgccggccacgccgggggcggcgggggcggcgccgtcggtgccggcggggccgctggacatcgcgcagctgggggcgaagggcgacgggacgagcgacagcacggcgttcgtgctgcaggcgtggaagaacgcgtgcaacgcgacggggacgcagaagatcgtgatcccgccggggaactacctcaccggcgcgctcaacctcaaggggccgtgcaccagcagcatcatcctccgcctcgacggcaacctcctcggcaccggcgacctcaacgcctacaagaccaactggatcgaggtggagcacgtcgacaacttcgccatcaacggccacggcatcatcgacggccagggccccctcgtctggacccacaaccagtgcaacaagaactacaactgcaagatcctccccaatgtaagcaacccacacccccatcgtctctctctatagctacctcctcctccgtttcatatcataaagtagttctatttttctattcaaacttatttaaattcagctaaatttgtatatacaaaaaagtaacacctataacatcgaattaattagtttcgaataaatcttatactctctcgtttttcatgcgcacgctttacaaactgttaaacgttgtgtttttttataaaaaatataaaatagttgtttttttaaaaaaattatattaatatatttttaaagtttattttagctaacgtttaattaatcaaatgctaatagatcactccattttgcctttgggaaggtggagtttccaacctccacatctgaatatagcctaagctggtcttttaaccagcaaacactattgagtatcacagtccatttataattaattgacatgggcaaaataaccaatgctgtgatagtaatttgtattgttatcttcttgcttctctgtatgactaataatgggcaattaattaaaacaatggatggatgcagagcttggtgatcgactactcgacgaacgtgacagtgagggggataacgctgaagaacagcaagttcttccacctcaacatatacgagagcaagaacgtggtgatcgacaaggtgaccatcacgtcgccgggggacagcccaaacacggacggcatccacgtcggcgactccaccaacatcaccatcagctccaccaccatcgccgccggcgacgactgcatctccatcggccccggcaccaagatggtccgcgtcaacggcgtccgctgtggccccggtcacggcatctccgtcggcagcctcggccggtacatacatacatacatacaactgcccctttccttccctatagctaagctagctagcacctgtttagatcgtgaaaagaaaattttttaatgtcacatcagacgtttgaccggatacgaatgaaaaaactaatttcataactcgcctggaaaccgcgagacgaatcttctgagcctaattaatctgtcattagcacatgtgggttactgtagcatcattcgtagtattttgaatatctatttaactattcgtcttattaaaaaatacgtaattcatatttattttgttctaagttgttttatcactaaaatagtactttaagcatcttatgcaattgcataatttttttaataaaacaaatgatcaatatgtgtctaaaagtcaatgacatcatctattaaaaaaccagagatagttaataactacttagtagataatttgtatgtatagaacccgataatattaacttctgttgtgtgtggttggccatctctgcaggtacaaggacgagaaggacgtggaggacatcatcgtcaccaactgcacgataaagggcaccacgaacggcctccggatcaagtcgtacgaggactccaagtcgcagctgagggcgaccaagttcctgtacgacggcatcaccatggacaacgtgagctacccgatcatcatcgaccagaagtactgccccaacaacatctgctccgcgtccggcacgtccaaggtcgccgtcaccgacatcgtcttcaagaacatcgtcggcacgtcggcgacgcccgaggccgtcacgctcaactgcgccaacaacctgccgtgccagggcatccagctgcacaacgtcgacctcaagtacgccggccaagggaacaccaccctctccgtctgcaagaacgtcgccggcaagtccagcaacgtcgccaaggagctcgcctgcgtctgattttcatcttattatactactcttccgtttcatattacaaagtcatttgtttttttttaaagccaattttttcaaagtttgaccaaagttttttaaaaaatatagtagtattttcaatatgaaaagaacatattatcagaatatatttcatattggatttaattagactaatttaatattttatatgttgctatattttttttataaatttgtttaaactaaataaaaattgactagaaaaagtcaaacaacttataatatgaaatggagatagggggagtaattgtcgtctgattatatagttgtaagttaatcatcgttccctccgctacattcccctcacttgtattcttcatctaattattttcctctctctccctcttcggatttttttaattattttcttctatttatttttatgtttgcttcttcttcgtttggaatatatgattcttgtcctgatttcatttcatttagtttactcgttaattgattaattaattaattgttatccgtttagttgtcgtagtttaatctcttcagttcaattatttttttgtttgattcttatttgtttggaatatatgtttttctttttctgattctgattcggatggaaactgatctgattcgtacaaaatataaaaataaccataccataagccgtataaggaacaaacaaagaatgatcacatgagctctgtctaaatctagcttaattcatcatggccatcttgaattttgcaaatcaacgttctcggtgcttgtttgagaccatacaaggctttcttcaatcggcaaacaagaggaattgctatgagattcgtgcgtacaaaaggtgatttgcaccagggtttcccaaaccgccggggccggggttaccgcgcggtaaccacagttaaccgtgaaaaaccatgcaaaatttatcaaaaattcaaattattttttaaatttatttgaatttaagaaggttaccgcggtatttatattaccatacacccgcggtaaacctagtaaccgcgcggttaccgacggtaagtcgaaccctgatttgcacccagtaaaacattttgttgtgtttttacttttgcttttaccagatagcttgctaccacgtactagcatagccctgcaatacatgcagcatgcacgagtggtttcaccagctcacctccaaaatccaaaccaaaattttggcctcaacgttctgaaccgttcgatcatgcgaccaacattacatcgattttcacatccagcattgcatgccaaaatcactgagacaatgacgacttcaaataagttcttattgtaactggagaacattaattacatcccttctgtaaagctcagggaagcataccttattagtatttttaccatcactaagcactaaaatatagatgtaactagctagatacattgcctcattgcatgctttcttcagagattattgacacactgatgagatgaaagcaggctatcctctatatgttggatcatggaagtgcaggcagaaccttcccagtgcaggttccgaatccgacattgtagccttcaccctgtaaaaacatgtagatggatggcatcaagatagagcatggaatcttcaaagatatttgttttagacgaaaagagctctaaatttggtttgatcaagacttatgagattgctgtaccttgcaacaagctgtcaagatgacctcatccccatcttctaggaacttgcgggtcgagtttccaactgatatctccttctgcccattccatgttagctccagcaaacatcccaaagattctgtctcctgaaagaaggcagatgtttagttgtaaacatgcacgataacttctagattggtatgtttatggtgatatttgaaatggttattccatacaggtccgcttagtgtgccagttgcaaacatatcccctggtctcagattgcatccattaacagtgtggtgtgctagttgctgtgttaaagtccaatacctgggaaaaaatagttacagtaaggacaaagctaacaaatacatatggtaatgaaacggcaatcggaaaacaggaagcatccttacagatgcttgaagttactctttgcaaccattgatggttcactttgctccttgggcttaatccagaccttacagaaaatgaaatgcagtaataatcatcagtttatgttttaatcaaatatctattaatataaaaatataaaagaagaaatgccatgagaaaatcctacctcaagaggaatatcgtagtttacgtggttcttttcagctaagtaaggcaaaggttcaggttcctgccacgcaaagcaatttaatttatccatagaacaataaaatgatgattctcaaggaaaatatggttaactatatactataatactaagacatgctcacctgcttaggagcttcacaggtgaaaggctttagggcatccatagtaacgatccagggtgatactgtggtacctaaaaatcacaaagtaggaaggaaacatgttacattgacgaaagataaaagcatagtccattgcggaaatcatggaagaatccactcaagtaattgtcgaggccacagtagaaatatgatcatgagcatttgtaaaaactaagcaataaatgtgcaggaaacttttcaacagagagtggtgtattagtgaacatggcataagtataactgaaaaggcatcaggtgtcttactgaaacttttcccaaggaaaggtccaagaggtatagtttcccaagcttggatatctctggctgcaatattatacaaaactcagtttaaccaaagtatgcaactgatctgaacgaaaactgaaaagaatacctaccactccaatcattcattatcattaggccaaagatatgttcttcagcatcattaatatcgataggttttcccaattcattccctggtccaacaatggctgcctgaaagcaacaagccaacaaagcgttatgatatatttgatccaggggaaatgaaaatatctataactaattacatacggccagattttataccacaatgacaaccaacagctcaaatttaacaaacatgcaacaggtatgtcaataacagttcaagaataccaaatactgtgagtcaagaggtttgtaagaaactaaccatctcaagttcaaaatcaagcttcttagaaggaccaaaataaggtcgagaatctcctgttggatggccttgccctctaaaaggcagagaaagaggacattattgacatatcaattggatattatgacaaaaataaaatgtaatatactacacatatgtatccatctacaatacatcactgcatgcaacaaaaagttgaatgcagcaaacatcatcgaatatagtgaattatttgaaagagggcattgagagcaataattaagcaaaatagacacttcagacttcagaggttatgtaaaactagaaacagctacccgctatccaataacactaatatattcaatcattcaaacaatagtaataaaactatctcgtaatctgacaggaatttgataactatccgaatctatgggatgcgtacttgggtcgaatgatgtctgttccagatacaatcacagaggatgcacgaccatgataacctactggaagctgaaacctgatgaagcaaacatacattgcagattagtgtttatgtcaaaacccaagtctcaagtctcagcacaaggcatggtcaagaaaatacattaccaatttgggttgactggggtctgtggcccacggaagatgaacccacaattccttgcatggtgcacagaacaaaagaagtcggtgtagtctcctaccgtgattggcagaagcatctctgtgtcgctctaaatgataaaaacagagaagttagtgatttcataaatggtcatcctgtttctcgtaacaaagaaaagagtagttgatcaagctcaccatgggaacaaggcacttcttcttcaaggcctcgttgtcacgcaaaaccggctcatcagctgcaaagattagagaacccattaaaaaaaagtgtaagtctacctcaggatctcataattcttggatagttttgaacataggcggttaatcgatactttcagttttgaacataggcggttaatcgatactttcttgcatcatgatacattggcacaacatagtactaacaacacaactacaggtagaattactcatcagcatcagaatttggggggcagaagccgcgctactcatcgtgcattactaacagcatagtagactactacaagatattgggaatttgaagtgagcagctaaagtgtgaaacctgagaggatcttctgcagcgtggcgcgcgcctccttccaggccggacgccccatccccaggaacatgttgagcgtttcctgcatgcacacgaaacaaatctaaaaattactactacttgtaaccaccaaaaatcacagtggaatcaaccacccaaatctccaatctccgcgccgcgcaaattgctgctaagcttagctcaccaccagcagatcaaccgcaacacaagacgagtaggtaaggtaaggtaggtaaggtaggcagggtgcggacctggcggaagcagggggaggcggagaggaggggcccgtggaagaggcccgcgtcggagacggcggcgaggtcgagcgcgaagtccccgatggcgacggccgggcgcggcggctccggctccggcgagcccctgcggcggaagaccccgaaggggaggttctggatggggaagtgcgaccccggcgccacctccacgaacgacctcagcggcgaccgcgacccctccgccattgccgactcctctctcgtctcgtgtcgtgtcgtgtcgtgtcgtggcgcagatgaacagtggaagagcgaggcgaggcgaggagaggaggaagaagaggccgcaataaataggcgcagatgaacggaagcggcgccggatactagcacaacgatatgaagtgtcctacactcctactactggtaaaaaagaaaaagaaaaattagctgcgtgatttatccaaaaaaaaaaaaggagccatgtacgatcaggtctctttctatggactctataaagtattaaggctgcgcccccacactcgcaccctttttaaactactaaacggtatatttttttacaaaaaatttctatacgaaagttgcttaaaaaatcatattaatctatttttgaaaaaaattagcaaatacttaattaatcacgtgctaatcgctgctccgttccgaacgcagcctaaagcctcatcgattatccacattttctctaataattttaaacggtttattgagaaatacaaattaattcataggtgaaactttgatatatttgtttgtagctaaaaaggaattacgttgaaaatattttaagatcaactttaaaattaagttcgaaaattcaaactttggtttttttctttagcttattagatcaaccgatgaagctcttactctctccatccaaaagtttagaacttaagtatttctattgccattcattaagactaagaaaaaaagttatcatgcatataagagcaagtttaataagggacttattgtttaggttatgcttatacttatggttataagccaaaattttaattttagaacttgattttgaatttgatctttttgttttctcatcgtagtttattttacaacatttggttttgaattgttaagaacacacaaataaaacttttactcataaatgatttatatttgcaaataagtgattcgaataagcatatgaataagcgaaacaatgggattgtaagtaaagctaactattggttattagttcatattagagctatcatgcataatagattaactataagtttcactttatttttttctctcgctataattttaatgtgatattttggagcatgtgtagaactagcttttgcattagagccaacacccatcatttttctttacctctttcacattagcttatagttggtttatatagcccactattatccttgctctaacaaagatcaagagctatactatgtatgtaaccaatgggcattaaaaatgttgcttgggttccgatcaacaatttaatctagtattgtaaaaagaaaagacaatctcttcatttcagtcttatgtacttaaagtctataaatatgtctattttatttagaaaaactaaacaaatagaatatgtataaaacttttggatggagggagtagtaatagatttaaatgcttttggatatagtcacggtaaaaatatagcaccatattctttaatttgatttcagcttggtttcccccgtgtgatcacttttatgtatgttttgaaactctcctatcttctctttcgagcacataattgattggtttttacaagactaactataatataagtataatataagtattaaaatttacatgtaactatagtgtaaatacatataatttgtaccgtaaaagaattaattatatttggtgccacaaatagagttagcctacatggttatgtttcgatgaaggcatgacgagggtctaaatagagacatggtcttgtaggatttttttttctggtttatctaaaacgtttgtgtggatttttgtggtgtcaaaactcaaaactatccaaggattatgaagcttaatttaaccgtctctaaacttttgaattttaatttaacttcgataaatttacacagtgtcatgtagagccgttgtaaacaaaggattttcctattaataattcggccaaccaatcaaataatagtaggatttttcgcaccgaacgaaaataggtctctccgtctaggaaaagcaaaagctgacgatcgacgatcgagagaaagtaggcgcatattccggttcaagtaaagtaatttacggtacaactgctgtgctcatacttctaggttagttatctctttggtaaaaaaaagctcatcatacatgcatagtgtaataaaaatcacttgagttttttttttcagaaaaggttgaagtacagaagaatggaagtagagttcaattcagataattcttgttgacgcacacgaatacacggtcgttgctactgagaaaaggacacaaagagtagaattcttgttatgctcttgtgcgctagctaggaacacatttatctttttgttaacttattggcaacaaccaaaatttaaaatttacaacactcccttataatatttgacgttggtttgaactagccaacatcttcaaatataacgaaacaaagagggctttttaaaaccatcaatgacaagtttttttttctatgaatcacttttgatcgctacacagatttttttcccactacctgcttaattcaaacggttttgaagaattttaagaatttaactgatttctatgagaatttgtaaaaccttttcgtttaaaaaggggtcatcatgaactgttttagaaggaaaagaaaaacaatttcttctcccatgcttggagagagaaatcgcggctacatgtgagggctcagcacgaatgagtgacgtgccaggttgccaaccgcccggcaccacacgcaccggcgatccgatccatccatccatccagccagccagcctacgtgtccagattcttctagaagatatcatcatccacacaacaaaccaaaccaaaatttccttttagggctcccttcaattggaggatttgcatagaaattttggaggatttaattttctaagaattttttcctatgaaaccctttgattcataggaaagtataggaaattttccttaggattgtattcatatagctcaatttcataggaaaataagcaagaggttcaacctcttgaaaactatcctttgctttgtttgtttcctatggtgctatcaaagggaccctcttcatatttcctgtgttttccattcctgtaggattaggaaaacacgccacttcaattcctacgtttttcctatttctgtgtttttcctatcctgcgtttcaaaagggcccttaaccaaacgagccccagcaacaaactctgatctagtcttgtatggttggcaaggcacgctctatagccaacttcaacttatagcctgttacttcctccgttgcacaacataagtcataatgtgggaaatgctagaatgacttacattgtgaaacggaggaagtaagatggacgtcgttttgaaccatatcattttttcaaaaaaaatgacaaatatatggatgtatttagtttgttaccaaacgttggtaatgcctacagaattttgacaataacacatttaatctattctactgaaatttgataatgttaacttacaaaaattttgtcattgccaaattttgaaaaagtttattttgcatcaatctagcccttaaacacttctgtcatccagtctgcctgttgcaaaatcagtctcaggcattttcagcctcacatgtaaaacaaaattacaaatacatcatctctatgtacgaggtaattcacaatccagcgagacaatatatgaatttatgatttaacttaagataaaattgaaaacaaaaaaaaaaagatactcctccgagtcacaaaattagcaaacacaagaacaatggggcatgccgcacacagggtgaaaaaatgactgaaatctcagcttctgctcagtgcacgcggatggtgcctcccggtgtttgtgcagggaaaaaaaaaatctctgtggatgttcagctacagctcttcaggcaaaacagacagggtgctgttagaaacaactaaggagggcacgagaacagcagcgacgtgttggttccaccaaacccaaaggaattcgagatggcagctcggataggcatcttctttggggaagatagaggcatgaacgcgccttcaaacagcgtgtctggtttttctagattaagtgtcggtggagcgatgccctgaaaatcgaagataaaatgttatgcagagaactcctgaactcaaactgttggtggtcagtaactgtagacaacatacatggtggatggctaatacggtgaagattgcttccactgacccagctgccccaagcagatgaccaattgctccctgaagaatgttgtgccatttgtcgtgaatgggagacgaaggaattgtgatgaattagttgcacatgagtgtgggggctatacctttgttgaggacaatgcaagaccacctgatgttgcatggtcaccaaagacagatttgattgcattagcctctacagcatcacctaattgtggttcaaatcaaaccatcaccttttatcattatagctacagatgacgtagaaccaagaacatggcttataatgaaaaatatatatatgaaaaaacagaagtgctgtcagtccagatgaggctttgtcagtctgactgtgccacttaccaagaggagttgaggtcgcatgtgcattcagataatcgatttgatctgcctgaaggcctgactagaataagaggaagaacattatcagaatgtaccataaatagccatgatgcattttacagttccttaacaacaatgtcaaatttctaaaatgtgccacacaaaaaatcacaaaggtgtatgacattgcacctgatccaaagctcgtttcatggctaaggtagcacctctaccatcattttgtggctgagttatgtggtgtgcgtcacctgaaagagtcattcacaatgaaaggcatcctaacgacagaataaacaaaactctttgtggaataggaggataccagacattccatagcctctcacttctgcataaatttttgccccacgttcttttgcatgatcaagtgcctacagaagagtatatggttaaccctcttaaggtcaaataagatgaactaaatgacactttccagacatagaaaaaaatgcatacacgatagagaaaaagaattagaatattaagggatcaataagtggatatgtgagtcaaactgatcataagacagatcaaagtattaaatggctgatattaaactacactcaaccagaaacttcagaacgaaggtgtaaaataccaacatttttctgaactcacctccaacaccataactccacaaccttcaccaatcctattaattattttgaaacaaagataagaatagccacacatgaaaaaggaaaaaaagaaagggggtatgatttgataaaggatgacatacacaaatccatctctaccacaatcaaatggcctggaagccgcttgaggaagagagttatattttgtagacaatgctcttaatctgaaaaacaaataacatcacaatgaaataagataaggttggccacactaatcagaggagcagacgcaatagggaatagggaacactgaaaaattagagataaagtttgcatatggatatttatggaccatgggtgttttgtgtacatagttggttgaggtcccctattacttcctacagccataatgtgaaaggtataccatataacctaaataaagcattgaaaaaacttacagcatttgcataaagagagcatataaaagagtattatggaacattagtaaacaaaacaagaacaaagatgcttacctagaaaatccagctatagacaaagcatcaatgctggactctgttccaccagccaccattacatccgcgtctccaaattgaatcatccgtgtagcatcaccaatagagtgggcacctgtggcacaagctgtcacagcagcatggtttggaccctaagtttgaaccattaattatctgaattagcatccatgtacgaaatgaattatagaatgaaaagcctgaactatggcatatgacaattcacctggaaaccatatctcatgctgacatgaccggatgccatgttaatcaaaatcttgggaatgaaatatggactgaggcgacgtagacgctgtgccataataaaaataaatttcaaatttcagtgctgaagttactggaagattgtcgtttacattgcaagtcacctatggcactgcttagcaaaagcataaaagaatgatgacgagtagagagttcagcacgtagaaacacaatagcggtcaagataaatcatctagaaatatagaaatccaactgccatatctgccacaatagctaataataccaatagaaaaaaaaataaaagagtgtggatacaaacattttcaagtatcatctgcgatgcatctaaaatgtctgagatgcttccaatccctccaccgattgagactccctgatacaactccaatcagacaccgcaattcagaaacacataaaaaaaatatatagttcataccaacagcagtttgtaccgttct

SEQ ID NO: 62728 - DNA, 16847 bp, Oryza sativa
acttctcctctcctcgacccgagatttccacccctctgctggttgcttcctcgcatactgcaaagttccggtaataagtcttcttcttcttcttcttcatcatcctcttcctccaccttggggttccaatgtaccatagctttgacaagaggcgtttcgctgctgactcgccgagttgttgattgggatctttcctgtgttcttgaggaaatgaggagggcaataggttcagttgcggtaaaattccaatattgggtagttccggtaattcccttgctccaccatgtgttgcagctgctgctttggctcgtcagattctctagtggctagtgccacccgactgaaatctcatgaattcactgccgaatttacaagttttggccataagttcgcagttgtttccatggctgcaagatcgggttcagtagcactggcgaaaggggcgaaagactcaaaatggaggtaaaatctgtttctttgatctgtataagtttgtgtccggtttggagtccataaagtgagccctcaggttgatatcagattaacatagtacagatgtacggcaaattgtttacttacaacttttgtggtccataaacgtgctttctttattgtacagctgatcactaaaatgagctgagttgtgtagtccctttttctttctttatcactattcacttgtgctttttttaatatatatatagcagtcactcgcatgcattgatccatacaggctctctccccacagaaaaaaagttgagcacattatgtgctatcattgtacttgtgccgtgcttatgagaacatgttcaaaggaagagctcagcttgtgcctgtaaattcagtctggaagctgaaaacaagatggatgagcttctacgggtacagagggagcttctacgatttcagttactgctatccaagcatttccaccgatggagaaatattgacatctaacttgtttcaggcacagtaatagctttgacaggtcaggtaaaatagccagattctagagggagtgaagactgtgcaacgaatgaggtgaaacttaaaagtgagagtgacagctaaagataccaagattgctctccactttccctacaaaacttctctcatggtggtactccaaagcaaagaatcctagaaaaaaagggcgcaagcacagcactgcagcttcctatctcctttatttggtcttccattgcttcttgttgctgaggttgccttcctattgcccccttcccttttccactcttctactaacacttgcttcaggctactgagggctttggcttctcggtgttgtcgctacaggtgagcttggcattctgtgcatttttgcgttctactgctaatctggtcttgtgctaagctccactattagcctcttgtgtggtcataggtggctcctaatttagcttcttgtgtgaatctgatgtccaatctttttctaaatgatctgtaaattcgctttgattttggtctgattagattattttgtttatttctttgttactttcctctcttttatgggttgatagtatacaattatagcccaaaaatactgttgaattcagagatcttcattgtgataactgactgatcatttaaagagatggtgcttttccacctacctgttgaatgttaaaccattacagatgattttttttttgaacatgcaatttctatagatctctaactaaggaagctggaatgtcaccttatttgagcagtttgattgtattgcacattattaaacttgtgtttcaagtataaatcttttttttttcgccgggccggcgtaagatacgcggccgaagtttattaagattgggaagaggttcaaactagtacaacaattacagctgccatggaggctagagctgtacggccgctattgttcaagtataaatctttacttgtttgaatattcaccataatgttatagtgatgaattgcttctctctttcctatttccaggccaacgttttatctgagggtaaaattcaagaagatatatatggcttttggtgcaaatgacattgtgttgcatatcaagagactaatgtattcatctgtcagaattggatatcaatttgcttgtgattaccctatagtactagctgctggcgttttgttgctgtttctacacaggctttgcccttctctattcaacttcttgctgtcttcatctccagtcttcctgttaactgcacttctgcttggagcacttttgagttatggtgaacctgctgttcttgttcttggagagaatcaacaaactttgtcctttaaatccaagatttccattactgactgttcgattgacaaggttgagactgttgctgtcgaggagcacttggataaaacaactaccagtaatgaagtatatgtcagggaaagaaattttgagggtaatatacatgacactcactgggaagagaaaaatggcacctacatgacagttgataccgctctaaatgacgaaatacatacgaaggatggaacttctgattatgatttgcaggatacccaccgtgaaggaaaaggtatcacatcagtggaaactgatactgttccttgtgtggcgccttcaagttttgcctacagtggtgtaactgtggaaactgaagacgttggggagaacagcaagaagaatgatgagctgcaagaacttggaagcatcaatcctgaaagtgataacaataaagtacaatatcaatatcagttaggtgagtttatgagttcatgttgggaacctgttatgagacaggagccacaggatgcttgttctgattctgaatctgatcttactgagagttctcctgatgcatcaatgactgacattattccaatgcttgaagagttgcacccattaatagacttgcaaactggccacccttcattggtctccagagacaacttgaatacttcttcggatgatgatgaagatgatcttgaggaggaggatgctagcacagatgaaaatcaattggaagggaaaatagatgattttgctaactggaaggatgttattgatctaaattacttggatatggacaataatagcaagctggagggtatgatggatctgcaaagagcaaagaacattctgaaatttgaacttgacaggaggttaatggacttgcaagcagctgatgcagtacagaaaatggaggaggcatcacgcttccgtgtgcaggttccctccatttccactggaaggcagaacccatttgattcttcaaatggctcagatgaaataatagagttaccacatgttcctgattcagcaccgtcttgtctccttccacggaaaaatctatttgatctttgcagtcaaccaaaatatggcccacgatagtccattgcaagaaacttggactcctctttcgtacttttcagcaagacggcatagaaagcatggaaacttatatgttaggcactctactagcctgcatcacaatagcttcaaactggagaaagatgaaataagtgaaaatgatgcccataatagtcagtcagactgtgatgccaagcaagaagggaacaacagcaagttatttggttcactggaagcacatataggtgaagaaatcaaaatattaggcgcagcaatttcagatgtgggtgtattagaagtaaattctggaatggatagtggtaaccaaaatgctgatttcagtgatgatatcagtttatctcctatccagaagtctagacaaagcactttcgaagctaaggaagcagtacatgcaggtaaaactgttttttaaccctaagtaatgtattgcaatttgcctactggaaatgataactcaactgaagttgatgtcatgcaggtattgagcaattaacatcgtgctccccttacaaggtaaataattttgaggcacatattgttgaagcagactccattgatgaatttaactcattgtttaagtgccgtatggaggaagtactagtgcaatccatctcagagtccagtatcagtcaacccttgacagttaaacttgaagatgaattgagtgaaccattatcttcagactctgggaccgggacacatttcattgacgggagttcagttgaagattcggatccacaatttgcacagctcaaggatgaagcactggtatctgctacttctaacgcaacatgtcgtaatgagtcaattgaagagaaatcaagtgaagcattactggcaggaaacgaagattattcagaactgccaaatgaactgttaaaatcaggagatccacagtttgcagatagttctgagattcaaatgcaggttattgaggctacaggtcactgaatcatcacaagggcctaaaacaaggccaaacagccaatttctcagagagatctgtaaagcatagatgtcctgtcttagctctctgaacaggtttctgcccccctttgttccaacttactctatggcgtctggatttaactattcctcttcttaatacaaaatgtgcagcaatcatgctgtttttcctccaaaaacttttctcaggaagtccgcaatgtcagaaatatccaaggaacagtggatgtacatatggtttctgcttatttcttctcttttgtttctgcttatttgctttcggttttgggctaataggttagtagataggagagtagatgacattgatatgaaacaccagttgcagttgggtgtgatatccattcagtcaagccggtctttctttcgctgcctatggagtattaatttttcttgtctgccagacaggcattggcaacccctgatcatcactttgtttcagtaaataagatgattggatgtctgtttgcctgttggtaaaccgctggactggagttgcagcttctgcagtttgcttcttcaacagttatcctgtcagtaatcattgagtaatcaagtaatgctttcacagatttttttttaacacctcctcatgctcattatctgcttgctgttggtggtttcattaagaaaatcacagttccttgattaaaaaattcatagtcctttacattacatacatgatgcattgatgcttatgttgggtatactgatctgaatctgaggcgtgctttgttgggataattgaagatacgctactcccctagaaccattttcaggaaatcactcctttagcttgaccttgctaaaatgaattgtttgcatgatactaacaaatagatgaatctttggtgtagaatcgcagtgatgaataaatctattttttttcatctgtttgtagagccatcttacagatgagagcgtggtattcttcgactgttattctgttaaacaaataaaaaaacttaagagtgaagtacatgggcacacctaaacttaagagtgaaataaaaaaacttacagaagacacacctacatctaggttcctgaactcgcaaaatacatttttaggtccctaaacttgtcatgtgtgtcacataagtcctaacggattcaaacccgctccatgcgctgacgtggcattgccacggtggcacctacatgtcgagcatatataaaaaataaaattaaaaaccatattttctcctcgtaggtaaacagaaaaaagaaaaaaaattctaatgtagagaggagaaaatatgtatttttaaaatttttttctatgtgactaacacgtgagtccgactaacacaaagatgctatcgtgacatgccacatcggcacgtggaacgggttagagctcgtttggaccttgatgatatctcaagacaagttcggggactcgaaaatgtattttagtttaggttagggaccgctcatgcatttcactcaaaagttaaatatgtaccgaacatagggtcaaacatttgacaactacccaacacacagaaatatcgttattttcaaaatcacttcaaagttgaccaagacaccttcagcagtacacgggcgccaccaagtttaagctctttcatgtcatatccatgtcttctagctttgaatgggcaatattcagagacacgatacgagccatccccctgatcaaccttgaagaccaatggacagtatttagggatatcataatccgagccatccctatgaacagccttgaagattaaaaacaaaggtgtattctccaccacagcaactacaaacctatccaggtcacatggcttggaaatgacaccatcaaagagccgaatcttttcaggaatttgaccgatataggaatataaagataagcttaagccattgtcatgcacttgtgatatgctaacttgtattgtggcctccactgcttcgtggaaaagggctcgactaatgtcgaccgcatcacaatcaccttcaatccgttgcgtaaacactctatcgggaagcacgaattcgctgcagatgatggcaccatcgatgagctgaaaatcatcgtcttgtgtctctccgttcttgatcttcatgtcaaactcgatgagcacacgaacttggtttccaatgcctctcttggggcctgacattggtatcaatgaattatccgaatcaacgccattgtcttatcccatgatgaaagggtcatccctggtgcggttgaagatgtagttgcgtagcgggtccaaatgatcccggacagcaaagtatccatacaagtgaactgggccatcaacagcagcagtgatattggatagcttgagcgagaatatctgcatcatgaattgcacactgtgcgccttgcaagcccacatgtgtggccggcaattggttgggtttgacagcatcattgcctccatacgagctgaacagccagccatacacgtcagtggatgacagtaagttagattgttaaccccaatattgaaatgagcaggaaagaaacaaatagatacaaataaggtttaaaacagcaaactccgcactatcatggacccaaagcaatatatacaatatactagatggtgcctttaagagttttttgaagtagtacttaaggaatatctagtgttacttagaactagattatgttatgaaaggtctaaatttgacatcaagctagacagatatgttatgaaaaaaaagggtttaatttgacatcagttccatagtactgagcatacacaggaacaaattagatttttttttattattttttttccgtgctgaccaaagacccctcagtccatatttccttacgattgagaatatgtacaaatttacaagtttagaattctgacaagatgatatcgaaactgaatggagtatgccggagcgccctcccaaaaccaaaataaaagggattgcatctctattcttactctcctaagtttttaaagactcctgcttccttccagattacgacctcttctttgattgcacccaagagggaacaaattaggtgatacagcaatatataaaattgaagttaaaagagcgtgaattgaatagcatcgatctgaggtgctaacaagtgaagctaaattgaaagggaactaattaagggcagatgagaggattgtagatgatgcaaagttaaattgaaaaggaagtaattaaggagatgaggattgtaggtgatgcatggtggagaggggaaaaagctagggtttgcaagaagttaaaacttactctctcgggtatcgtcgaccttgtaaaacatgtgccaaaaatcgtcgccgctgtagatcgatccatcgctatgtttgctgcactcgaggatgaacgcgcgattcaccccgtcctggctacctgctgctcgcctcccattcttctccgcttccgcctccgcctccaccagctcaagctcggactctgccgccgcttcgccatgaaatcccctcgcgattcaacccggcctcagcctctctcccttcgatctctctcgttagcttcatcttctccgtcctccacccttgggttttattttgatttttgcggcaacaaatccgaaaccgattcatattagtagtagctttgaaaaaactattatcctctcaaatagcagtagaaaatagagagaataggatatgggctgctttctgggcctggatatgggccgtacttccattttccgttgaggcccatctagacccataaaagatgaagtttcttccctaacctccggcccccgctcccttttcttgtcttctctctttctgtagtctgtatatgtatttttgtgttgatgcaaggtaatagtttattgttttaagttaaacacacaaatacgattttcttattgtttcccacgaagaattgcatatttgtgtagcaccatatctaatttgtatgaacatacaagaatagaaacttgctttcttacaaataacacagtgacgttctttgactgctaaacttacacaacaaataaataagcttaaatatgtgctgaacataggaccaaacatttgccaacaagacaatacacagaagcatcgttattttctgcttagcatagactatgtatcccttgggctgttcaaaatcactccaaagttgaccaagacagcttcaccagtatattggtgcaaccaagtttgagctcttgcatgtcatactcatatccatgtgttctagctttgaacgcacaacatccaggaacatgatctgagccatctctcttgtcaatcttgaagattaaaatcaagggagtattcaccaccacagcaactacaaacctattcagatcacatggcttggaaatgaatccatcgaagagctgaattttttcagggattctactggtataagaatataaagataagctgaagccattgccatgcacttgtgatatgctaacttgtactgtggcctccaccgtactgtggagaagtgcaagacttatgtccaccgcaccacaatcaccctcaatccgttgcgtaaacactctattgggaagcacgaattcgctgcagatgatagcaccatctatgagctgaaaatcatcatctcgtgtctctccattcttgatcttcatgtcaaactcaatgagcacacgagcttggtttccaatgcctctcttggggccaggcattggtatcaaggaattatctgaatcaacaccattgtcttgccccatgatgaaaggatcatctctggtgcggttgaagatgtagttgcgtagcgggtccaaatgatcccgtactgcaaagtatccatacaagtgaactgggccatcaacagtagcagtgatattggataacttgagcgagaatatctgcatcatgaattgttcttcgtgaatattgcaagcccacatgtgtggtcggcaattggttggatttgacagcatcattgcctccttgagagctgaaacgcagtatgtaggagcattttacatcagcggataaagttaaattttaaacccaaattgaaataaaggagaaaacaaacaaatcaagaggacggacagaatattgatacaattaaggttttaaatagcaaacttggcgctgccatggatccaaactcccaaagcgagctatacaatatcgtataaggtggttttaattctattctaattaagaaaggcctaaatttgacatcaaagtagatagatgtgttatgaaaaaaaaagcttaatttgacatcagttccatggtattgagcatacacaggaacaaattaggtgacacatgaatatatagaattgaagttaaaacttaaaaagagcatgaacgagttcacagcatgaggtgctaccgagtgaagttaaattgaaagggaactaactaattaaggagatgagaggatggtagatgatgcatggtggaaaggggaaaaaggtagggtttgcaagaagttaaaacttactctctcgggtatcggcgaccttgtaaaacctgtgccaaaaaatcgtcgccgctgtagatcgatccatcgctatgtttgctgcagtcgaggatcaacgcgcgattcaccccgtcctgactaccagctgctcgcctcccattcttctccgcctccgcctccgcctccgcctcggcctccacctgctcaagctcggactctgcccgccgcttcgccatgaaatcccctcgcgattccacctggcctcaagctcgatctctctcgtttgcttcatcttctccctccttctcccttcggttttatcttgcggcaacaaatccgaaaccgattcgtattgctaccattaaaaagacgaggaaaagaaagaaaaaacgattcttatatcctctcaaataaatactagcagtaaaaatcgatatgggctgatttttgggcaaatatatgggccgtacggccatctaccggtgaggcccatctaggcccataaaagatgagtcttcatccctaacctccggacgactccttgatgctgcgcctcgcgatcgagcggctccagcgctaagtagcctctcccttgtctcacaatcattccatcccccttcctggctaccttgctcgccgggatcaggagtctgctgattgggttgggctgcggacctgcggtggagggattcagggtttctcttgtccctgatccactgcctccacgaccaacaatggaggacaacgttcttgtctcctcgaaaatccatggaaggtgactcccaactcatgcaccttttcctttatttgcttgtgattttaatacgatatggaatctaaacaaaggcccccgcaaaaaataaataaatagagaatctaaagaaaggcatccttacatggcagaattccatcacattatatgcttatattcatttatttgtgtactgttactactaataataatgcaaaataccctctgacatatgtgttattttgctaaaaaaaatagtttcaagaagtcaattctgtgtgctacttaaaacttctgaaagaagtatcattgcatactggcagagcatgcatgatatctttcaccaacattagccagagttactgcccttctttctttttcggcatgcatacctgtagggttgtactgtaatcaaacttgttgaaaaagagagagcatcttacagatgttatgctgaggcagaattcatggttattttcatcaccttgttaatcatgctgattgttggtttcaggagtaaaagcacaacagccaaaaggaattgtataatttgcggacaacgtattagtaagaggagaagaacacaacataattttcagaagataagtcgggggcagcttaatttacagaggacaagaccatgtctgcttaattttcagtctcttcccaaggtatgtcatatcatgacatgaagtcatgaaactctcaactccttttgtgctaggactaggaggctgtattctgatgcttgttcaaaatgcattgtcaggatattgtactaagggtaatgtcaaaattaacattaaaggaagtcgctcagttgagtgttgtgtcaacaaactggagacaggcttggacattccatcctaatctgtactttggtattaaaacagcccttggaaataatgccaagagaaaaggaacaagctctgatctgaactgtagaatatcaagtggtaacaagttcattaaaagggttgatgctattctggaaaaacattgtggaacaatggtaaataagtttgctgttaagtttggtttgtcaaatgagcatgctaaccatgtcaatggctgggttgcgtttgctattgcatcaaaggcaagggttatcattcttgacttctccccagattggaaatcacatgaaaacaaatatgactttccttgtcatattttcgacaaacataatggatcttaccttgaggctcttcggcttgacagtgttactttgaatccacctctagatttctgcggatttgcaaccttaaactgcttgctcttgacaatgttaggttgcaacatttagagcagttaatatcgaaatgccatgttctagagtggttaagcatccaatcatgtaaccagctgcataatttacatgtgtcagaaccattatgccgtctgcaatatttgtcaattcagggttgtcatttacaaagaatggagttacatgctccgaatctcacaacatttgagtacgacggttccctggcattggtaacgctcaatgaatgctccaatatcaaagcatcaaccatcagactttttgatgagaaaaccctccaaaatatattaactggaattccaagtgtattacctcatgttgaaacgttatatgttgaagttcatgtcaaaactcaggtctgattattcttgtactctctatatacatttaattctattttattttctgtttcacatcttgttgtttgaacctatgtgtggcctggtcaccctccagatgtctggatttacacaatcacctctcaagttcactcaattgaagtgtctaactttggaaataacttttgagagaggttcattcgatagaaattcagtcttccagttgactaatcttttcgtagcagctccatttttggaggatctttatttggatgtaagtagctatatcatttgtacttcactacttttattgccttcttccctagccagttacagttcgccttttgtattctcattgaccgattacctcttttttcctatttaatgttatttcgttggtttggaaacccaatcagaataacctgctaagccagtactgtcaatctaattaggaattacctgcttgtccaatgtgccctatgcatgattcatgaactcataagtcccagaaactggaacattcgctgcagactattgatcctttttaacgatcatcagaccatcgaacatagctttggcaaagtaatattgttcggcccggcgaaagtagtattgttcagcattagttggcaactgcatttttttccatttgacagtggactttgtaaattttaatcataattatttgggacatctgtagaagcttttgctatatcgatgtcactgtttaccctgagcatcacatcaccatatttatgcactgtacaagataccaaatagtatgaatcaaggtgataatatgtttggaaaccgattagccatgtgtttccttgattgaatatatttgtatccaaacagagcaaaagcttctttttttctaacaaaatctcagaattccatcccctgcatttgttttgacaagatatatgttcaggctatccttctcttcctcgatcatgaatctttgatcttcttttccctaattattacgtgttagcttgctccttgttagtgatgccataatttcttgcagatgtattgtagcttgaacaggtgccctttggatttggatgacatcgtggatcagcctcactatcatctcaagatggtgtgcatatttggattttgtggcaacacaggccaggttgagctagcaaaatgcattctcagaaatgcgttaatattggagcaaatgatcatcgacccaaaagggagatatcggttggatggatattttgggcgccaggaggcagatgagaagcttgttccagaagatatagatggtgtactcacaattctgtaacttatactccgtacagtagcaaactacagtcacaagttgaagtgttgttccttcaaggcactagtaactaggagtaagttttttttaacagagtttacagagattattcggtactgcaagagttgtggttcactgttcaatacgattatattagtatgtatcccttccgattaaaaatgtttgacatttaggaccatatttagttgcatttttaaaaatctagacatcaataatttgtcaaatgcttagttttcaaaatgatatacgtagatttgtctcataatattataaacttattggattatataaacttattctggtgtaaaatagattgccaaaatttttaaagtgtggccgaagtttgtgctaaacattaaactacttgagaaagtatgcactattcatatgttacaatgagttttaatctccaacccatggaccttttttttttaagcttcaattcaaaggatgccaaaggggtgggagttttaatctccgtcccccaagggactattttttctttccccaagatcgagcttttttttaatgtagttttgtgcaaacacatttggatagttttgaactactagtatatcacatagtaggaaataattgattactatggaagtattcttcacagacaaaaagcttcagttttcacacacatgtacacacacatggattgtttagactagcaatgcatataagaaaaataattacttcctcgaatatgcggatatcttaagttggatatagtagaatactagaatagataaacatctcatcttacgcagataagtgcttctggcagagaagtgcaagataacaaccacattcagacaggatcatataaaaattagagtaaagtccatcaccggtccctaaatttataccgttttgtcatcccggtccctaaactcgtaaatcgaccattcaggtcctcaaacttgttcgactgtgtcatcctagtccctaaacttgcagattactcgtttaggtcctccaacttgttcagttgtgtcaccccggtctctaaacaggacggtctaaaaactttatatcaaaaaataattcataactttttcatgtgaactctaatgaagacaaactttatatcaaaattgtagctctggatgcgacctacaactttgtagttgaaaagtttttgaattaaaactgttggtcccaaaatattgttgcatgtttatagattttgaaattttaattttaaaattacattttgggacaaaaaatgacttaaaataaaaaaaaattcaactataaagttgtagatcgcgtcgagggctataagtttgatataaagtttgtcttcattagaattcacatgaaaaagttatgaattatttttaaatataaagtctttagaccgtcctatttgacccagatgatatttaaatccaagtttagggactagggtgacataactgaacaaattggaggacctaaacgagtgacctgtaagtttagggatcgggatgacacagtcgaacaagtttgaggacttgaacggtcgatttgcgagtttagggaccgggatgacacaacggtaaagtttagagaccggtgatggactttactcaataattaggtacagtatgaggcaccttgagaaaaatcagtgctagaatggaacgttctctttcagatgattacaacctacggagtagcttgtacctaattccgtagtaaacccccataatatttgactctttcattcacattcatcatcgaacccacgctagccatttccttgatcaaattatcacacctactcctgcaggacatagtaaataaagtagcacgttgtcttaaaataatactactccaccttttaatctcataaatgaataaacggagaaatagaaaaaaaatcaggattctgatagaaatgcaagtgcaaagcaggtgattgaaaacacagaaaaagcatataaataaccgtttattggaccgctggaaaaatacagaaattgaataagagagatagacttaaaggaaaattttcaagagattattcatttcataggaatttcaaaggatatgataggatatgatttaatcttttgtttcaaaagcattcataggaaaattttctatatggttgaaatcctccaaagttcttatgtttttcatccaaatcaaaaggaccctaagcatttttagtatttaaaatttgtaacacaatatactttctttattttagaatataagtatttctactatttaaatttcatatacaatataagcatttccaggtactacttcagaattcagatacaccgaaagctaagtattttcagtcacttaggtgattaggaagggggctaagcaattcacaaaatcaaccaatgagacaactgagagggaatatttatcctttagcttactatttactaaataaactaaaaatatgtgtcctttgcagtaagtttaataatactactaccttcaataattgaaacatcatctaccaactcatattacatcaacaatacctaatccatccatctcccctcacatagtctattgaaagccagtcctgtggttggctacaaatctagtccgcttttcttttctcttctctcctctcttcttcacataagtacaaatttaatgtgccaacttttacatcccgctttcgtcactctgtccaatgcataaaaattcatgcattttcaaccaatcaaatgcttgggaggataatctaaataatttaatattttaccactactttaatggaaaggaaatcttcttacttaacctttgtaagatttgctaaacaacctaaaaatactcatattttaggacgtagggagtactattctctcttttttttaatgtatgatgtcgttgatttttgacatgatgtttgaccattcttattattaaaaaaattatgtaaatgtcatttattttgttatgatttttttgtcaccaaagaaatcttaacttatacttttacatatttacattaaaacttttaatatagtcaaacgttatacgaaaaatcaatggtggcatacataaaaaaaatagcactaactatcaatagaaaaaaagatagtgaaattatttaatagtaccagagtatgaacaggatatcgtgagatttatctttaaaagaaaaaaaaagaataccgtcagatgaccttttccgcgtgttgtgtctgtttgttgaagatgaattctaatagctcaagtggacgtccacccgtttattgcatgtcaactagatggttacgaaaaattttcaaaaaaattgacaacatagatcaatatgtaatatatcactccacaaacatgcaagttcaaattcaacttctataagtagtaacgaaaataacaaacaaaactcaaattactatatgtatatttataattaaatttgttatttttgttacaac

SEQ ID NO: 62729 - DNA, 95766 bp, Oryza sativa
tcctgcaccccttccagcattggatatcataacagggatataccacaatgaaatagtgccggccatagcagcgatcttaggatcctggccaagaaaaattaggagtggagtggtgaagaggtatatcgggaggaggaggactgcacaacacaagagaactatccatgaacgttgtagatagatgcccaacatgtggtattgcttggcgccatatgattgcccacacaatgtttccaatgcacttgccatgcctagctgcagtttacaacaatgtgcatttaaggtgagcaatttataatgtgtttttatgcatatatagaagataagattacatctagaaattaattgttagtaaaagtctaaaatataaagaggtcatcattacttgtagtaaggtatcttttgataccaaagtctgtgattgagagcattgatagggagaaagcactgcttatggaaatagtcagatatgatcaactccaaaaacaattcctggctgcttggcataaggtttgcagactaagttaaaggagaagaggaggccattaacttgacaatccaaaattaggcaccgctcatgaaacacttgaacaaattttataacaataaggacttgccttaggtaaaactgatttagaataagtattatgtctacctagtgcctaatttaactatcccaaaagagtccttctggtggaatgatgtttgtaaaacaagcatccactttagaggaattcctagatgtatcttacataagggaactgcctgcaccttctaggaagatatgtggtctcactagccacctccatgcaatgtatatctaaggctatattcctttgcttctaataaggaggcctctgtcaaagtgtttgtatctactgatctggatgataattttaatctgccatcatctcggaaaacatatgatgaggtttctcgatagtcaaacaaactcctaaacttggaattggatcacactgctgatcagtggaagtatatatggggaaacatgaactatgcctttcagaaattcttctatctgatctttaattacatccgtctagcctccacattttatttggttatggaagagtaagtgcacttcaaaagttaaagtttttggattgctacttcttatgaatagattgaacacacgatatatgcgagatcataaaaaattgctccaccaaagtatgacctagtatgtgtgttatgtaatcaaggggtcattgaaacaatgcaacatttgtttcacacgtccattttcatcttcatgttgagcttcaattggatttagttggaataccgtgatgggaacttaaattatgatggctaaggctaaaaaccaatatgtgggttacagcttcatcgataaattcttaacttctgtctagtgtatttggaagataagaaataacttcatcttgagcagaaacctcccaccttttcttccgggagatatctgtttaagactgagctcctccttttaatatttggactaaatgaggagataaagatcaataaaatatattactgtagggcctccctccctgctgtgcttccttaaaaaatatctagatatataaaaacttggcagtctgctattgttccagagctagctaacacagatatcttacgagcttatttgtacttgaagtcatgaagagcacacaagtatataactaatgcataaagacaatgcaatgattaagagggggtggctgaactaagagtccgcttcaaacattaagggatgctttgaattagtcggatggcccctttctaaacaaaaaatacataggtctcacataatttagttcttacagtacgaattgtgtcttttttaaaaaagaaaatttttttatgtgcctctgaatattttggatcccttccgtgacattaaatgttgcctcatctctctgacatgtctgatatttttttccccatcaatacactttccattactttgaccgttagatttttttttctaacatgactatatgcccacactatccatttctcatagactcgcacttatgtacactttaaaatataaatctcaacttgaaaaaaatacagtaaaaatcaaatcgagcaaagtttgagagttatttgatggaaaatttggaaaacaaagtttaaattagtttaaacacaaaatgtaattaaatagtattaagtgtagtgggtagagaggatagttacgaggatgccgccgctgaagcgcatgaggacggtggagacgagagcgtatccggcgagctcggtggcgccgatgtggccgatgaaggcttggctgatgacggtgacgccgaaggtggagaagcgcgcgcagatggaaggacccgccaccacccacagcttcttgctctccaccaacacccgcggccccaacgacccaacctcctcttcatcttcttcttgcttgtcgttgttgctgccttcgccatgagcgtgcttaggctccagcagaggagccgtcctgcagtcatcatgttcatcacccggcctctccatttctcctagcacagcttggcttagctagctgctgctaactttaattgtgcaggaatggagcgaattaattaatgggaataattgcacttgaggggaagaggagctatcagaattgatgaagggaagcaggttaggaaggctctcagctaccgttttaaaggagattgatcaggtagctgggttgatggctggacttggaccagagagttgagtgagcaagtacctgattgtccctgtggctgctacataaggtgggtaggtagtgagggcaaggtgggaaagtagtagtaacactgactcgttaatcatcgatttaggaatcagcattccagacaaaaggaaggaccaataatatagcgagtatgaaattaattaacagtgactgtcgtcatatatactacagaactatcatccatccaggaatctggggttgtgtgtagtgttaaatggctcaatgcaagtggattgtgttatgtacgtatacacaccagggttcgacttaccgccggtaaccgcgcggttaccgtggttaccgggcttaccgcgggggtacggtaatataaataccgcggtaacctccttaaatttaaataaatttaaaaaataatttgaatttttgataaattttgcacggttttgtacggtttttcacggttaccgcggttaccgcgcggtaaccgtgcttactgccggggcgcggtaactctggccccggcgatttgggaaaccccattacacacaaacggcggagcttgcaagcggcgtacagagccagtaattaacttacactataaagccttaagaagttatatatatatatatatatatatatatatatatatatattaagcacatataccatatagtgacacaaattaaacatttatagtatgatagataataaataaagcaatttgtaggttgcaatataataatttattctctataaataataaacgataatataattacaactaaaaaggccatagtagaaataaagtggtataaataccttataaataattgaaactataattcaacaatgaattgaaatcgatagaggcacttctgtgagactgtgacctacgtaccttcaggatccaggaaacacagccgcacaggcagggctgcaggcaccggcagcttggctgatggcgtctcgctccgtcgctcggcgcgtaaggaactagggcattcgcgacttggggttcggcgacgagacgagtagacgacgaagcgacgcgcgctcggcgctccccggcctgggcgctgcgctatgatgtgggctgccgcctgggcccccttccggcctgggcccaggcggttgcacaaccggcctaggcccagggcaggcagcggctacgtacgtcatgtcgccggcccggtctgttcacggcagctatagttgccggacgtacgtgtcacgtgtggctgaccggcatccccgcttggcgcttgcatcctcaactcgtcgtggccaccaaaaccaaatgtaggacttcgttcatttgatgtcaaaaaaaaaaacttactaaaatttaagcaacttgtcaaaattttggcaggatttcttatatgctctagttaccaaaatttagcagtaaactaaatgtagctattttttttttgataactttaccaaaatttagtaaagttgaaaataacatcaaagtgaacaaactgtagagttcctcgtaaatccaacgataccacccaatatgcatctaagaactgggaaatgcatcttgacaaaaaggagatctcgctgcaaggacggcgttacatcattacatgtatgatcaggttaggttgtttatgccctgcagttcaggtaatacccacacaagaattgggtttgaaagtaacactagaaaagaaaagaacaaaataaggggaaggccggccgggggatcaaataacaattgattctttttttctttttttcctttttacatgcgcggtggtgcgtgcgcgtcacaccgccctttgaattttggttatcaaatctgcattctttttgttgtaggacttggtgatttaattaaatcttgaatatgcatgcatggagctgtaatgtataggtctcaccataatctctagagaaaatcccttatatacccctacaattttagctaatcccttctatatctctgaattttgtttacctccttgtatgcatccaaaatttgattttgatcccttctatacctctcccgtcagttgaccgtctaatttctataaaatgacaattttacccttttgatgaacatagaaatttataaattacattattgaaaatgtaaaagcttgctgtatgagactattatagttgtgtgtttattgtgcgatacattatctatgacaaaatttatttttagataatgaaataaaaaatatgtatttattttatttttaaaaaagtcataaaaaattaggagcatccatataaagataggactaccaatgctcacgatatatttttatgaatactccgataaaaaaaatccattgtcctattgaaatttcaaataaaaaattctatttattaaatttgttttattttcaaattttatgtcaaaatttcttgcactaattattttgtctcattagtttcgtaaaatgcacatattgtgcactcaaacaaaattttcaattgcttttcaagcatatattcaaacctaaatcctcaagggcataaaagacatttgcaaccaaacttaatagtgaaataaaggaaaatataacgggaagggcatggaagggatcaaattgaaatttcaggggtagagaagggatcaaataaatttcaaggatatgaaagggtttgagtgagtttttaaggctatacagggaatttactctaatctctgtggagtgcgacacgccatcttctttcgtcaagcaaccaatcgtcctaccgaattggctcatcatctatcacgccttccattcctcgtcaaatcctattaaattaatgcttagattttttttaagaaaatcctattaaatcatcattatcatcaattaattaattaattaatcaatgtgccattaactaagaacgtttaattgttaatatgtctgtccgggacgggagatgatctcacttgattttttacattttaactctttttaaaaacttattttataaatagacacttaaacaaaagacaacttcgacattgggcaaccgcgggcgcaactatgacgtccaaatctgtattagtcccactctatactctgagtaggccttccatgcccttcacatagcactctatttatacctttgttctcgtttctaaaagcattaacctggaggtactatatatgcttgaaatgaactgggtatataagttgacccaaatctatctacactctccatgtggagctcttccaccaaacgaacacttgggtctaaaccggaacaagaagagtcacggaccgaaacagactaaatgggctggattttacactctcactccctcatgggttgatgccctagcaactcaccgctacccaacagccaaatttccaggatatcccctcggtgctacggcattgtgcctatgcgtcgtgtccccctccacgggctaacacacacgcacacttgtgtaacacgggttgaagttctaatattacatgtaacactcgagagacaaaatcaacaatagtccactctacccgctaaatggacccacattcacattacacccaacttacacttttcatcatcacttttatgtaaaaatgttaaccaggaggtactatggttatatacacttccaatagatgttgattaaatgtgctagtatcaatttatgatttaggtgtatatatatcatgtgtctgagctataatatgcatgtttaattgcaaggtagttattgtcgacgtttgatgtcgcgattccggtatttgcatagtatggggatcgttggtactaggatatacgcgagactgaggtaaaagagatggggacgaggatttttatacaggtttggacccctgaattgtcaggtaataaccctatatcctgttggtcgaagccggttgttgctcttattcatcataatcacaccagtacaatatttggggtagcctatctaactgttgtcgacatggcggtctgaaggtctgactcgtagtcgacaacagggtagctttcctcctcgagttcgcatccggcgagatcagagacaacgctatatctctcctgatggtatctgtaggcaccataggggactagccatgcctatctctaaagtcgatatccggcgtcttgtcttggcgtatgttggcttgtatgttgtggtttctgttgttttgtgtatgttgattcttccctctcctcctaggggccttgtatttatacccataggtgtccccttgtccaagtagaactagggaaaccaatatggatacaatccgagtagtccttatcgtttctatgtagaactctggtcatccttccttatgcggaactcctcctatatctgaaggttgtttccgtataagacatggtatgtggtgggtcctgccgagatttagtcaactactattaggtatgtggtatccataaccctgacagttatatgcatttgttttttaaaaaaaaaatcttgcatatgctaattatgtttgtttgattaatgatgtaggagtatacatttttattacttgcttaaagtgcttgttttggttgaagggtagctatatttttaatttgttcctttttgtgaatcttggagatgtcaattgtgtttggttcactattcagtagtatttaatttttgatatgtgtttaagcactaaagtgactatttccttgtagcatagacatatccatttgtttgtttgtgtgaattccataattgttgattgtgctcaattcacaacttagtaggatttattttggtgatgcgtttcagccccaacatggatgtttgattccatactgaaatcttgttatggattgttgaacaattctaatgaaatcgattctcttttgtttttgtatatgttggaataaatataccaacttgatccaatatctcttgatattgaataatttctacccaacctaaaaaatgtggtgtattaattaattacacaaaaaagtgggatatacatttcaaaaatagatgtgtgagattatgttgtggtttatgcatattcttgagtgtgagtgcctcgcttagatttgttggtagccttatacactacgattgttctcaagagtaaggaattgaggttcttcgttttgatatgtagctcatgatttgcaccgcatcgtctgaatttcatgatcaacaaaaacatcttgattttaccttgtttagtgattaggtatgttctaatagcatttcttaaacaacatggcccaccttcgaagggtttgactattagttttattaatcatgaaagggatgaatttcattaatcagaggaaggtttttcacctttgttggtttctacatatctagtgtttttagtcatgtatcatataagatctatattttgcatcattgaggctatgatgccaggactactttattggttttagataagttttatactttggcacaatgtagaaaattccatcatcattcaaccagttactttagagtcaacctactagaatggtttccctggctaatcaaattagtaatacatggattgtggagctgacactttggaatttcgagggattacttttttttttgcattggtggaaataattcgttacagataactccattcagtgtggtcaatttttagtcttcacttatgataaacgatcacaattcttagtgacagtgttcgagccatcaggcattgacaagatgtcaacccactctactcacccttcaaaaaagatgatcattagaactaaaagtgatgaaagggaatgcaactatcacatcagaaaaaatggctcccgccattaaggagaataatggaaccgtaggaaagagaactagaaatgtagattgtcttgtgccttgtggaatatagggttccataaagaagttgtttgaggctaatgttttgaaaagtgataagagaaaatgtgcaggtccttctgttggtaagtctaaggcaacgtcaacaagccatagcaataccaaagatataatattcctctatttctgaaaatgttatatacactaatgtatttattttggcatagcttctcacatttgtttcattcatatagcatgtttaattgcattcttcatttgttccatgcatcaccataagttaggaggccatatgcagtgtcaaagcagtttttaatgtttgacgtggacttttggatatatatttgaccattcacgttattaaaaaacaatgcatagttatcatttattttatgtgatttgcttttatcattataaatacttgaagcatgacttacatttttgcatatgtgcacaaattgttttgaataaaacgaatggtcaatcatatgtccaaaagtcagtggggcgtcaagcattaaaaaccgaattgagtaattgcaaagagacctatatctagtctcttggcttgaggttaagttagtttatttctttcccttatgactgattacgaaagtcatttttgtacgtagttcatacatgttaagagtcctaagtattcacatgatcccccatcaagcttacttttgcacattatagattcctcaagctacatgtcagatgaagatatttgttttagcaagttgacaaagacaccagtactgatttgctttatgtctactaaggtgactccacgtggtaaattttaagttatcccctaaacgcagggttaataaatcacttttgtcgataatttaatgtggttacacttttcagacatttctaaggttctaagacatctatgagtaataccacaaaggcatgtaactgaagtagaaaaccatgctcttcaaagggcaaaagaatttaaaacctaataatcctttttaccgtgtaaataatgatatgttggatttttcatggtaatgttactttcatgtgttcattctcatcccgtattgaactttttttctatgtgcatgaggtattatctaaaaaaatgtggatgacaggattgatcttaacttgcataacggtactgcaactatagtttgagagttttggatgagatctaatttgaatatcccatcttgatgtttgatttttatgtatgtttattgtgaatgtgactgtaccaattgaaaaatcctacaactatataaatcaccaatttgtgatagcacattgtttttatgtcagaaacacaattttgtgtgatagcaaataacttgcaagattttcttggtgatgctagaagaattaacttccagcttctgcattatgaggcacatgtagccttacataactaagtttggtatatctaagtggccgtttggtcttatcgaccaatgattcattgaaattatatattagcgaaaatttaaacagatttttttaataatactatggccctaaagttaaacttctcaaactctttttaatctgctacagattgatatctaaatttaggacttactaggagatattggagacatatggccggtcaacatctccaaggtgatgggacgacagatggtggtgttggaatgagatggcgctgaccacgaccagtttgcgaggagggaggtgactacctcggtggggctatacaggtcccaccacacgtgtcgctgcggggtggggcacaccatctccttcgtcaagcaccccaccgtacccccgaacgggcccagcccacagcacgccttcctcgtctcatcaaatcctatcattatcattaatcaccatcattcattcattaattactgattaattaattatcattaatgactgcttagtaataacgagtcattgatttctgtatcaacgtttaagagtacaacaagagaagccagctataaacacatacttccttcctccgtactcgtaaaagaagtcgtttaggacaatgtttaagtcaaaccttgggaatataaatcataaataactctcaagttgttgagttcgaaaatgtaaaaaatatatgaatagatttgtcttgaaaaatactttcatagaagtatacgtatatcacttttcaataaatatttttatagaaacaagaagtcaaagttatgttttggaaaccgtgtcgttgtccaaaacgacttcctttacgagtatggagggagtattgagaagataaaagagtagagactagagagtagaagcagcaggctacagatttatagccagctatagcacagacttcaagacacaatgtatgtatcacatgtgggaccatgtattaatacggtagtatatgtttatagttaactattttatgaattagctattatagatgatttggagttaggccctgtttagtttccaaaaactttttcccaaaaacatcacatcgaatctttggacatatatatggagcattaaatatagataaaaagaaaaactatttgcacagtttgcatgtaaatcgcgagacgaatcttttgagcctaattagaccatgattaaccataagtgctacagtaacccacatgtactaataacggattaattaggctcaaaagatttgtctcgcggtttccatgcgagttatgaaattagttttttcattcgtgtccgaaaactcctcccaatatccggtcaaacgtccgatgtgacacctaaaaaatttttgtttctccaactaaacaggctcttagtagttggctatactattattaaacttgctccaatcttgtttaccgaatctggcaggatgggtgatgatgtccatgatccccttgtagatgtcgcagaagacgatgtcggcgccgggcagccgcggccgcagcgccgccagccgcgccgccaccctcgcgctgtacccctggacgagctcgttcgcctcctccacgcagctccggccatccacgacgtgcagcccctcccacatcacccgcggcgcgcaccccagcggcgccacccccatcaccgccgtcctcctcgccccggcctcgtacagctcctcgacggcgcgggcgacgcggtcggcgaggaggcgggcgaggccgcggcggccgtgcttgggcgccgacgcgtcggcctccgacccgcgggagagcacgcgcgcgtacgcgtcggtgccgaaggacaggatgaacaccgcgcgcgccgccgccgcgtccgcgtcctgcggcgtcggggcctccagccgcagcagctgcagcgtctcggtggccagccgcagctgctgccccacggcgcccaagcggaagatcgcgccgcgcccgccatcctcgccggcgaagttgacgcccctggccacctccgccgccgtgccgttgagcgtcgagatgaggggcggcggcgggaggcccatcttggcggctgcatcagaaatgattcgaattagagcaattcgtgttcgtggggctcacagttcatcagttgaggaggagctaggtggttggttaccgaggagatcggggaggaggcggtgggcggaggggaagagacaggtgccggaggaggaggtgagggagaggttgatggggagtgtggtggcggcgcagctggcggtggagtcgccgaggacgaagagggcggtggccggcagcgaggccggggcggaggcgacgatgcggagcagcagcagaagcaacagggggaggagcgccatgcctcgggcgttgtggcgccaaccaaacaaacacctcgtcaacttcaaagaggaatcgattgccgatttggagggtatgaattgaatttactaatatattaagggttaaagtgtaattatttcatctcatgacatatttcgaagaggccccctgtaacaaccaaaattactggtctcggtggaatcgcagcggcctgcagatctctcttctccgactcaatcattcgccctgcgctgcacaaggtgagaggaaggaagggaaaaccaattggatctctcaattaatcggggtgtgggagcaagccgcttcaacgcaattacgcaacgccggaggtagtcaggtagttgcgatgccttcctgttcttaatttcgccgttgttttcccctttactgaaatttctttaaactgtcccgaattgttcgatgcattcgcggggaacgaaaattttatgttcttgttcgtagtttcttgggtcaacggctccgtcggctgcagtttgggatttcaatttgggcgccatttatgggtagatttcggtgacatctgatgatagctgttaggtttgtcagcagtcaaccaattggcctgcccgcgagtttgtgcaaattcctttcgtccttttgtttgggcataaatttgatgaatgcccttgccctacattgcttgtagttatgtggaacacgccgagcagaacaatttcatggtcttagtgtactctgatacaagtaatgttttcttcagtttggtgggagatgtcaaactttgtttgctaccactagctatggctgcttggttttgtacctgtatttcatgttgacctagagcatgttttgcttcaccgtgttgtttttttggagttgtaatccacaaatttttgttggtgtcactatctattggttggttggtttcaatataaatttttcaataatctctttggcgttccaatttttcctacataacaggcatgattcatgcaatacactgactgaaaaaataatatggcttcaaaagccattaaaaggaagccttacactgctgatattgatagaagcgaaaaacagatggagacgatcataccagattctgtaagagaacctcttctaggaaacagaactcatgaaagcaaatccgaggttagtgaaatttctccaaatcatatgaatccaggttattaaccgcattttagttcttcatgcgccttaccccttttctcgtactttttttttagagacatgagcctaatatgcagccaaatttatgggatggaaaaggacaagagcgccttggttggatgcatattatatcgacttttattgctcaatctgtaagaaagataggtacctatcatgaatatgattccagagaagtggattttttagtgtcttactgccctctcgaatgtacacagcagaatgcttaaacttgaccttttagaacatttactatctgaaaaatcttctttttttttccaggaaatgcgctctctcagtttggaccattgctagcaaagttctttagtaggtcttgtgcttcccatggttcacatgatgaacaggcagttctacttgatctcagtccactacaggtataatcagtgctggcacatgcagatctcctatttccatttaaaataccatatgattgatgggttaagtttcccatcaaaagcatgaattcttatgagtatcagatgtgacatgttaatttcatgtaaatattttgagatatttcaaaccttttactgaagtatgaaggaaaatatcttttcttcctcagtagtttaagcatttgaatgagttgtttcaagcatactctcgacatctttgatgctcaattcatctttcatttattttttatccttttttacaataataaaagttcttgtttgcttttgtgattattcatggacaaaaatgttggtatatccatgaacaatatcatggtaacatccatgaaacttgttatttcttccacaacactcatttagtagttgaattgcatgctttaaaaattcaaatgaattcttgacttggtttattaattccaacccttctgttctacaggagcaatgatggcatctttatgttattcttgactgtttcaagtttttacatttaggaacttttttacatgatactacggttttgacagttccatgtttactttataggaagagagactgaggttcttgagacaaagattaaatgtgccatttgacagttcctctgtcaagcatcaggttccgcttctgtacctaactacctataggcctttggtattcttgttctattgttctcaccaatgggacaccaattttcttgctcagaagaaatgataaactgaacaattcatatactaacattcatgatagtaaaatatttcattttttctatgacaggatgctctgaaagaactttggagattagcttatcccagccgacaacttcctcctctgaaatcagatctatggaaggagatgggctggcagaattctgatccagcaactgattttaggttcgtttcgctaatccctagtaatgattttaggatatatatatataagctgtcatgcatttatcaacaccgcttgaacctcgacaactaatcttttgaagtatctaatgattgcagagcaggggggttcatgtccttggaaaatttaatatattttgctagaaattacccagtatgtttctattaatcatgaacatttactccgcattagtctgctgttattgggtgattcgattaggtacaatgctcaatgtctgctttaacatgcaggattcctttcacagtttattacacaaggcggatggtaagagatctgaatgggaatatccctttgcagtagctggcgtgaacatatcttatatgttagtgcaaatgttggatctgcaatcaggtgaaatttgcagtaacaccttatctttgggcccaatttacctcctttgctcttgacttcgaaactctcttttttttttcagctctatgcagagctacagcttatctctttcacttcttttgtaggaaaaatgggcacaaaagtcagttctcaatttgttcaactacttagagaagacgagatggcttttgataaccttttctgtatggcctttcagatgcttgacgctcagtggctcacaagacaagctagttatatggaattcaatgtgtgttctctgtagaacatctggtctcttctattggcttctcattctaccaccttattcagttgtcttcatttccatttttcaggaggttctaaagtccatgcgtattcagttagaacaagaacttactatcggaagcatttcttgtgttcaggagatgccatcatttaggttgctaaaaaggtagccatgtttgttgtttacagaaaggagtgtatcttacttgtcagtaggatcttgtgcatactaccgattctttcattggttgtacaacatgacacactgtaagattatttatcatagaataataaacccagtatatatctggtactttggtaagtgttcaatgttttctggggtaacaatttaagtatttctctaatgaaaattacctgcaacaggtttgcttcttgaaacatgtgaaaaatgtaagtaaagtaaatatcttttattaacattcctgatgtttggaatatcaataaaagatgcagcatttatgcattcatgcctcaaccaagatgtatagtatagtttattctgaaagttagatagatttacatattgtgatttctgtataacatatgctccattaccttataaaactgtgaactacccagagttttcttgtgggaatacctatagtactacccaagcattcaagattctgagtaatcagaattaactagctcaatctagggtaagggagaaaattctctccctagttaatcaatcagccttgggggtattacaagaaaaggaacacagacacttgtctcatgccaagttgaatgcctttgggtttctaggagactaggaccatagggagaagcatatgaatcttccccacctgaacagaacgcctacagaagctttgcttctttgtggcagtgccattagacagaaaaatataccccaagataaaaacctgaaaacttccctgtatatctcaagattttcaacacccagaaacacgcacacagagagaatcagttgcacacactgatcattttttgagggcaggagatattgtttgcttgaggagatattcgctccctatctgaaattgaaatgtccttgtctaaaaagtctgaaatgtccttgtctaaaaaatctgaaatgtccttctccaacatattgcattcctcaaacaaattgtattctgccatacctgagttatccatgctgttgccgccttcagttatactggagcacccttcaaataggtactccatgccgccttcgaatgcctcatcattgaaccattcactgaaattcatcgagttgctgaagtaagccccaggcattgtatccaattcataatccaagcaagggctccagaggctttcttcaatgccatcaacaattggaaggggttcattcatgcattcggcgctgtcatcggctgcaagtggctcattgttgtcacttgatgtatttgcttcactggaactgagctcttggactgcattctcacttcggtcatcatcttgaggctcttcatgtaatgctggcaccacctgtggctcttgttgcagttgtgccaataactgtggttcctgttgcagctgtgccagtaactgtggctggtccaggtagcagctgatgtcgaagttggttaccgcattggcacctcggtattcgattgcagcaagatcataggccttggctgcctcctcttgagtatctgtaaaaagaggtacgtttgttgaaatgagaacaaattttctggtgagacactgaatctttggggcaacttagtactactaggagtcatgaatacttctagtaacattggcattacagaattgatcaggtcatgctgtatagatttaagactttagaaaatgaatgcattggatcttaatactgagagatgctgaattgcatcccatattcacattttttttcactttctagtttgacatgtgctggacaccatctgagatctgatatgacttttcccacattgctggttgctagaactgtgctggcaaccttctgtttactagtaatcggtgaacactgttcactctcccttttttctttctttatttgtgatgaaagtagtgatgaatccatctgtgtggttctggatcttgaatcttgatctagtttggcacagggggggtaatagcctagtagggcattctccatgcacgtgaagtgatcacttgcaactggctgctgactcactcagctagctctagtggaaagagccggcagtgatgaacaattgaagatccctatgcaccatctggtttttactactggcattgcagcaccactcacgtgcttgtcacatgcatttccaagtcatgtaccatataatgtatctatgtatactaggattttgtctagtaattaggacatggtggtgatcaagacatggggcttgtttttatgctatttctagggcaagttgggcagtcttctggggattgcatacaggatggtatcttggtctcatggtctttgatcttgacagcaggaaaagattttctgatttttttaagtaaaagaaaaagaagtttcaacactatgcttccatatcagtgatatcaccagctcacttaatttatagtaaaatggagagtttgtggttcaagaacatacaaggagaataatatatactactttctctgttctaaaatataagcatttttagaatagtcctaaatcaacatttttaactttaactattaataatgaaaaattaaaaagagcaatcacgtaagaataatgttactagattatagagtaaatttaataaaactataggtattttgcataatttatcacaaaactacatattaaaaagcttgtctcacaaaactacagatttagtgtctccgtttatcacaaaactacaggtagtttgtacaatctatcacaaaactacgatttaagaactttcacaaaactatagatttagtgtattcgtttatcacaaaactacacatttagtgtcttcatttatcacaaaactacagatttagtgtctccattatcacaaaactacaagttttaacaacgctaaaacttgtagttttgtgataatgaagccattaaacttgtagttttgtgataaatgaagatactaaatctgtagttttgtgaaataagtacttaaatctttagttttgtgatatattgcgcaaagtacctgtagttttgtgaaaaacgaagccactgaatctgtagttttgtaaaacaagttcttaaatctgtagttttgtgatagatcgtgcaaaatatctgcagttttatgaaatttactcaaactagtatcataatatgtaactctttcatttaagataacttgtttttataaatattattggtcaaagtagcatcccgaaaattatattgaaatctaaaactgtctctattttgagacagaggaagtactacctagtaagtaatcctcaagaaaagcaaggggtcaaatctacatcgaagggaaacaagaaaaacacgccatttaatttcgcagatgggttgatcaaccatcataaaatttggtaaaagttaggtggccggcttacagcaggcaaattctccaacaaacaagagcggcttgtaaatgctagtaatcagcatttgattaagttaagtgggctccaagaaagaaagaagagcaaagagcatgaaagattggatgaaagaatacgtaccgaaagtacccaggtagaggtacttgttccccaggacccgccctatccgtgcctcccaccgcccattgtggtgatgcctgaacaaaaccagacaaaaaaaaagttcagaaatgaattactaacagacagctactagctctgaacaaaatggaaacagcaagttggtagcactggcaccacaatacagtaactgatgttggaagcagatttcatcaagaaagagagaagcttaaaacttttgcagttctgacttttcctagatgcatgcatgacattgcacgaaactgacacaagaaagagaccatggggcatccatgcagagcatacacggctggcaaatgacgttgccagctgatgaatgccaccctagctagcaatactatgctgactcatcattcagggagagagagagagagagattaattagagttaattaatcagtagtcctacctggcaacgcctctgtacttggagacacccctggagaaaccgctgctccggcggcggagggaggccaggtactcctccctcgacacaccctccatctccgacctctccttctcatattcctccagctgcaataattcacattatcttcagtaataattcagattacacaagtcgcaattgtctagtggtaagttggcaaacttactgggaaattgagcactgtctcaggaccccagtacttaagagctgcaaggtcatatgcacgagcagctgcttcctcactatcataagcccctaaacaccattaaacattgcactaatgttcagaaacagatcaaacaccaacacaataagtagttatgtaacaactagttgctatatgcctatattcttagggataaactgttttcatattgagacaaaccaaggatgtgacagatcaaacaaacaaaatgtgagattatacaagaacaggaagcaacatgcagcatgaatctgacaaaacagggtgtatagacaactagtttgtgggacttacccaaatagactattgagaggagcatcaagcagcagcagcagatcaaggtcacatgcgcatcacaagggcaaggtcccccaaagataacagcaaaaaagaaaggagataaaaaaagcttaatcagaatgtcagccttaaaaaattcgctccactttatagtaataagctttgtactaatggccgatgtatcaagatccttggcagtatacagaagtacaccaaggaccttgtatgtttcactttttctttcattatagtacattatactgtaaaaatactcaatttcactttctttacagcattttcagataaaattcatgttaaaaatcctaaaaaaaattaggcaactaatgcatgttgcgatcaatgtaccttgcctccctttcttcttgttctgaagtgaagtggagcaattcttgtcccacagatgggcctcaaatctgccagtccaccgatgcctgtttatagacacatgcatgcagcaaatgattccaccgtatattgaatttattaatgattgataaataagcagcattcaagcattagtgtttgctttacaggaggaagaaaaactgaaggagttgaccaccccagcagtaaatgtagatcaaccaactccctacttcccagctaataataattgactcactccaaggggaggagcagcaagaaaaaagattaaaaatgggaattatgagatcaagaaatggatccgatcgatcatgctcgccaacctccaaaagatgaggcatgaaaaggggagcagactcgccacccacaaaacgataaaataactgatgatctctgacatgcaagtgaaaatattcaggaacagattggaaagaagcggctggtaattttgggagcctgaaaggatggaaatgatgcggaattttgggctggaaatcagccattgattaactagcggcaatgcaggatgaattcgcgactgaaatcgagaggggatcagaaagaacagcagaattgggatcagagggatggaagcaactgaacatgcagggacgcatacctggtgactcccctgtagatagaactcctcttgccgccgccgccgccattggaagaaggatcagccacctccttgctctccttcttgggcctcttggccttgccggtgctcttctccgtcctcggcctcgccctcctcttgcagggcatcgacatgggcgaagaggaatcctcggaggaagaggaggaaggagacgacggcgaggatgatgcagatggagaagatgatgcaggatcaggagacgatctcttcgccatgatctctcgcgttggtgcaggtgcaggtgaggaggaggaggagaggcagcgaagtggagcccctgaagttttgtaatttatagcggagggggggaacgaaaggaagtgcagcgcagagatgggttttttgggttgctaatcaccatcatcagcattaactgaagatgacacctctgttttttttgtatttttgtgcgtcagggcctcaagctggccaccatacgagtcaattttgatacacttattcattattttttttcatttcagatatttcctctgtttttatacattattattgatgtaagtgcgcattccgtttgtgcacaagtagtggtcgtattcagatttctttctctttctttatttttgcagatttcggtatacgtgcagacgctcatatacatacgtgtatactcaccttctataaatgcatatgctatctctatgaacacctttgaagattaggcaaggatattggcgtttctgaatagacataattttcaaaggaagcacaccggtaataatatctttgagatttgcgaagatacaggacaattttacatagcatagcagatgacgcactggcaaattaactcaagataacaccttgttttttgtatttttgcgcgtcagggctctgctggacaccgaagattagcaatcaatttcgttgcacttattttaattggtttctttttgagagatttcctctgttttaattatattattaacgagtctccaccaaaaccctggtatatcaaacaggcacaacattgagaacatttcttatgagccttgaaatttggtggggattgttagaataattgggttaggcccaacttataatattaaatctcaaaggcccataataagtgttgaggataataataccacctcaggatttaagcgagaaatatctcaacctaaatagggagttattggaggctccctgttgaccagttgaggtgggggtcggaatgccacacgcgcgcacgcgcgcgcgccgggccgggccgtgggcgagggcgagggcgtggctggcttttgcagccactaacccacgttcccacgattccctccgcaacagcgcttccacgttctttctcctgatagataaggaggccgcgagtccgatccgatatcatcgcttctttcccggtgttagtttctccttctccgcgcctgagttgctctcgcttcctcgcttctgatctcttacgcgcacgagagattggaaggagcagtgcctccgaaaccacaccttcgcctgagatctgcaccgggtaggcgggtgatcaggtttttggggagtgcctcccgcacgactgctcatcaccatgtctggagttgccaccgccactgctggcggaggtggtacgccgccgacaggagctcgatccggagctggtgcgccaggaggtgccgtgaacgacaacaacaacggaggcaattctgcctcaccatccagcggagggagtgcctcccgtacgactgctcatcgccatgtctggagttgccaccgccactgctggcggaggtggtacgccgccgacaggagctggatccggagctggtgcgccaggaggtgccgtgaacgacaacaacaacggaggcaattctgcctcaccatccagcggagggccattctcagggtataatcttctcctcctgctactattgttagcgctatcgctatactatgtgcgctatgttcttgttcctgttctacatgatgcctctagcatgttatcgcgttactgttatgttcctgttcctgacattcatgatgtgcatagtatgctactggttatgtgaagatcaccctacactgcttatgccatgatcattgctttaactttttggattaaaatatgccgattaatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagctgtacgtcatggagcagttctatgactacaagatggtcgatgaccattctgtagtggaacaagctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaggcaagggaaaggcaaagggagactgctttgtgtgtggcaagtctgggcattgggccaaggactgtcctgagcgcaaagataggaagtctgccaacatggtcattagcgaggggggaggaacatcggggtacggtaaaatgttacctacagttctctctgtttatcattcacctgattggtgggtggacactggtgctaatattcatatatgtgctgacatttctctgttttcttcttatcaggtcgggagaggttcctccttgttgatgggaaacgggtcgcttgcggctgttcatggtgttggtacggtcgatctgaagtttacttcgggaaagaccgtgcagctgaagaacgtgcagcatgtccctttaataaagaagaatctagttagcggctctctattgtgtagagaaggttttagacttgtgtttgagtccaataaatgtgtcgtatctaaatatgggacttttgttggaaaatgttatgacagcggaggcttgttccgcttttctttgaatgacatgtgtaataatcataatgctgtgaaccatattagcgagaatgatgagtctaatgtgtggcattcgcgactctgtcatgtgaatttcggttgtatgacgcgcttagctaacatgagtttaattccaaaattcactttggtaaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttttgactgcgtgtcatgtcctgaataaaattccaatgaagcataaggaagtaacaccattcgaggaataggaaaggaagaaataaaatctctcatacctacgaacatggggctgtttggccaaggtaaatgtacctatagccaaaaagcggaaacttggacaaaaactgttgattgtgtgtttcttggttatgctatccacagtgtgggttatagattcttaatagtaaactctggagtacccgacatgcatgctggtacaattcttgagtccagagatgctacattctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatattcatctcctgacgctgactactggaaggaagcagtacgcagtgaaatggactcgattatgtctaatggtacttgggaagtggttgagcgtccatatgggtgcaagcccgtaggatgcaaatgggttttcaagaaaaagcttaggcctgatggtacaatcgaaaagtacaaggcaaggcttgtggccaagggttatacccaaaagaaaggcgaggacttcttcgacacatactcaccagttgctcgcttgaccacgattcgagtactacttgctctggcagcctctcatggtcttctcgtccatcagatggacgttaagacagctttcctaaacggagagctggaggaggagatctatatagatcaaccagacgggtatgtactagaaggtcaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagagttttgaaatgaaggatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcagctgagatactctcaaatcattggttcattgatgtacttggctagcgtaacgaggcctgacatctcatttgctgtaagcaagctgagccggtttgtcacaaatccgggagatgatcattggcaagctttggaaagagtaatgcgctatctaaagggcactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaactaacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggggtgatagcattggactatgtccaaacggctagaaatctggcatatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaactattgtgtgactgagagaagagacccttgaaaagggctcatttttatgatgtgcttctcttctttcctgcatggtaggatggcttatgtcttaatgtgatccgagtggcttttccaagtagagatgttgacctgcagaacatctcagaaggaacacacctatatgagttcaactgctagtcacagtctatgaggtttgggcgatctctagatactcatgaaaggcctggagtttgacttatatgctccaaacagaggggatgcgaacggcagcccagtaccagtcaaggttctgagtgaaacctgatcacacaaaactcacaattcaaggcatagtccattgttcagttgtggtctaatgtagctcatttcctaggtggaagttcaacttaacagtctccaccaaaaccctggtatatcaaacaggcacaacattgagaacatttcttatgagccttgaaatttggtggggattgttagaataattgggctaggcccaacttataatattaaatctcaaaggtccataataagtgttgaggataataataccacctcaggatttaagcgagaaatatcttaacctaaatagggagttattggaggttccctgttgaccagttgaggtgggggtcggaatgccacacgcgcgcgcgccgggccaggccgtgggcgtgggcgtgggcgtggcgtggctggctggcggcgtgcatgcgtcacgtcgctatgcttttgcagccactaacccacgttcccacgattccctccacaacagcgcgtccacgttctttctcgtgatagataaggaggccgcgagtccgatccggtttcatcgcttctttcccggtgttagtttctccttctccgcgcctgagttgctcttgcttcctcgcttctgatctcttgcgcgcacgagagattggaaggagcagtgcctccgaaaccacaccttcgcctgagatctgcaccgggtaggcgggtgatcaggtttttggggagtgcctcccgcacgactgctcatcgccatgtctggagttgccaccgccactgctggcggaggtggtacgccgctgacaggagctcgatccggagctggtgcgccaggaggtgccgtgaacgacaacaacaacggaggcaattctgcctcaccatccagcggagggccattctcagggtataatcttctcctcatgctactgttgttagcgctatcgctatactatgtgcgctatgtgcgcgctatgttcttgttcctgttctacatgatgcctctagcatgttatcgcgttactgttatgttcctgttcctgacattcatgatgcgcataatatgctactggttatgttaagatcaccctacactgcttatgccatgatcattgctttaactttttggattaaaatatgccgattaatgactatatttccaacatggtacacacctgagattctttctggaaggacacaatttccacggagactacaccgagtcactggcaatatttgccgatgttgaactgccttttgcccaagctacacttcatttttacatagcagggtacactaggaagtaaacaagctcataaatgactgcaaattaaacgttactggagatgaaattttttgtctatattgttactgcaagagctttcacctctgattcagatcagttacagacttgcagtgagttgattctacagaaagaggacaagcaacttttaaactagaaatggacggacggacgcctctttgccagggtccttagactgaagaattgaaatgaaggaaggtgcatagcatagcagctacacaaggagacgaatagcatcgggacgtgaaaaagaaacaaacacatgtaacatgtaacactgcaaaatcaaacaaattagcgccatgtgtccaaatggcagagctctgcagccatgcaaaatatgcaattcctcattcagaggaaagcatcctactagccccgcaaccacaacacctgtccccaacattcagagcaacctactgtgtctgtgtgcagtcagtcaattactgtacacaacaagcatctacagtagctaccaatgcagcaaccccctttcgatgaagaatcatcaaacaaacagttcatccttcaaccaggaaaaatattcagcagtcactaatgctgtagtactacgtacagatcatgtgaaacatatgtgttgtgttgcactgtggatgatggtttgatggctgaccgtgatgacctcaatatttgagtaaattagtcatcccaattaagctcccatacctgactgccaaattatttgttttgtagtagatcatactcaccaaaatggtttatcacgagtctgttttctgaccacatttttgtctagacagtctgctgcaagacggtagttgcccagataattaggccatgtttagtttctaaaaactttttcctaaaaccatccaatcgaatcttgacatatacatgtaatattaaatatagataaatttaaaaactaattgcacagttagggagaaaccgcgagacgaatctttggtgcctaattagtccatgattagccataagtgctacagtaacccacatttgctaatgattgattaattaggctcaaaatattcttctcacggtttctagataagttatgaaattagttttttcattcgtgtctaaaatcccttccgacatctgatcaaacgtccgatgtgacactcaaaaaaaaatttcttttcggcccaacctgactgactgtcgattagaccgactgacgtcttctgtcaccaccatgatgtccgtccagcttgttcacattcctcagcagacagacatgcaatcacaacaattaacactaggtttatgtaccatatagtggtccatgatgcagaaatattaatattctcaactctaaattctactacaaaaaaaaagagtgacatgttgcttgtagtacaggcagtacggtttggttgttaaccacgtttctcatctactttgcctgcatttgaggtgctagagtgaagataaatcctaggttgccagattattcaaatattcaatcaagataaaagaaattccaagcttttccatctaacatctccctcattagaccagaaacatgcttgcttgcaagctactccctccgtattttaatatatgacgccgttgactttttgacaaacgtttaaccttttgttttattcaaaaaatttatgtaattatattttattttattgtaacttgatttatcatcaaatgttttttaagcatgacataagtatttttatatttacataaaatttttgaataagacgagtggtcaaacgttgattaaaaagtcaacggcgtcatacattaaaatacggagggagtacctgacaatgcaaccgtccacggactgattgcatatcgtacaaaaatttctgtaacacaaaacagcactagtcaaacctgaagctttcatggaaccaaaccatctctagaatgagcttgcactccaatttgttataatatccaataaagcacacactctctcctggtattactgtagtaatgatcaaatttcaatgttcagaagaaacaccattaaatcatgaattggatttaaaacatgtgtccttccatgtaacatagtcctacagagacagctgccaacagcagtcgatgcaaacttctggttttcatttggtataacttagaaaggatgaaatgtgcaaagatattgcaaatagaaatggatattgtagaatcaaatgcgaactgtttcagagctgtccacaagaatagatataatatttctttataatactaacagattattcccaagtaacaaaacagcatgcagatcacatgagagcaatgcaatgacgaaaaaatcattagtagagataatcctatggatatatatacaatagagcactactaattgcacgttccatttccaccactgcgcactacttgatttttttttctttcaggatcttctgatgttacaaataattattcccaggttaaaaagaaaatagcatgcagatcacatgatatcagtcgatgaccaaaaaaatcacaattagtagatagaatcatatgaacatgtatacatctctagtagtactaattgcacgttgctaatatgaatatcagtcctcccaccatagcgcactagttgatgttttctcagtatcttctaatattacaaataaggagacccccaaaatttaccatgttcttaaatgtcacagtatccataattaagtctgcattcattttctgaaatacatagtcatcatcacaataatttgaccttatctctcttagatctttactgattccccttccaaaacttcttaaatattgttgaacgtcatcgccctcaacagtttttgttggttcatgagtgaaggagaaacaagaacttctgccttttggtgtgtcaaagccatcgagatcatcactggagctatttgtagttcttgaaacgggggtcatcatagtatgactataagtatggcctccagacacatcagatccagttaagctaactgagcactgggtttggttgtcagattcctgggagggcaaaaaatacttgttacagtgtgagaatgatcgttactatccacatcatatacctacttgtctttctactaaaatgctgctggcaaatcaacaagagtatgtaatatgattccatacaacacattaagtacaatgtagattgtagacaattcaggaatatttgagtggataacaataggaatatgaaaatagctacaagatgccaattaatggagagcaaagactgtactatttctgaaccacatagtaaaaaaatttaaatgtttaaaagaatgttgatggaggttgttgggtacttcggttgatattcctaaaaagtacttcatatctcaaaacctcagtgaagtgaaccagcattgatttgctaacctcattatgccaatgacgatcagttggatagtgggtttctgcaatgcttgatccacctttgtcaaaagatgtatttctgttcttttgtgggatgttcacaactgagtttatttgagggtcctccagtgatgagaaatcagtgctatccaatgtcgagatcgatacacattcctcaaaataattcattgcctcttcagccaaatgcttcgatactttcagtcgttctacactactctggtaccacaacatggaaacaaaggtcaattcaaatacaaagaccatctatatttatgagcaactgcacttatcgtatctttaaatttcagaaaactacaactttaatgataaaaccatctatatttactgtagcagcatactccctctgtcccataaagaagtaattcctagattcccaatgcaaaactaaagagatagataaatgaccaaaataccccttattaatagcatattagtattgatggttaggtaggtaaggagtattgaagaaataaactttttcgatttgtgaaccaagtgtgaatgagaaggtagaagttgatttattttgtgacaaagtttgaattccagaagttgatttattttgggacagaacgagtataacgtaaaagttgtagttttgtgataatttttcacgttattgttgcagcaaactgatacttttatcactaaagttacagttttcggaaatttactcttctttaaaactacccttaaaacaagcattgaaaaccaaattcatggtggataacagaatgaccatgtagaaatacacaataccatactttcttatacttataagtcaaaatttaaattttcagctttaaatttggagttgattttagggttttttttcattatagtttattttccagatttttcttttagatcgctagaaacacatatataaaacttttattcatgaattatattccgtttaccaatatgccgtttggccaaacgatggccccgtttacctatagccatggctctagccgatgtcgttgaaatgtgggatgggaccaagctgtcagtcactgtcactaaagacgcttctacctccgttctaaaataagtatagccgtgaaaatccgtgtctaacgtttgaccatccgtcttatttaaaaaatttataagaaaattaaaataagttagtcacacataaagtattattcatgttttatcatctaataacaataaaaatgttaatcataaaaaaaattcaaataagacgaacggtcaaacgtgagacataaacagtgtaaaactccacttattttaggacggagggactactactaaagagaatcccataaaaaatgttatacaaatttacaagctcaaaaaactaaattaaacaaaaaaaagtcaaaataattcatcgtgtcacattcacgtacaaaataaggcgctgaaaattttggtgagcagaaaattaaataactagaccaaaaaaggcaacatatggcacacaaaaagagaagagaactaaattagacaaaaatttagaagaaaattagaggaacacatagctaaattagaaaagaatttagaagagcacaaaattaaattagacaaaagaaaaggagaagagaactaaaatagacaaaaacttagaagaaaataagaggaacacatagctaaattagacaagaatttagaagagcacaaaattaaattagacaaaataaaaagaaagagaaataaaatagacaaaaatttagaagaaaattagaggaacacatagctaaattagactagaatttagaagagcacaaaattaaattagacaaaagaaaaggagaagagaactaaaatagacaaatttagagtggagatgcgggggatcgaaccccgtgcctctcgcatgcaaagcgagcgctctaccatttgagctacatcccctttgatgtttgaaatgaaactaagaaaatcattatgaatagatgtttacttgagcaacagcaaactgtttagtcgcattcggatattcatcaaaaattgctgttctcgttcagaataaagggaacattcaacaaaaatgtttctgctttaacgcaacacaaatggccaagtgaaagtgcatctcatgtttaggctgagtccatcaatcgtgtgtttctaggctcgtggatcaccaatagttctctaggctggccggagtattctagattcgaatttaaacatcaaatttaaatttttacagttgttttactacttcctccatttcacaatgtaagtcattctaacatttcttacattcatatttatgttaatgaatctagacatcaatatgaatatgaaaaatgttagaataacttacattgtgaaacggagggagtaatatattgtagctgcattttctttttttgtaattgtagccggtggtttcggaaaaaaataaccggttattggcaggtaaccatcattgatctgaactcaaatatttagtttgaaagtttgtccgataaaggtttggataaatgatgttcccaaacgccaaatacttattactccctccgtttcaggttctaggacgttttgactttagttaaagtcaaattgctttaagtttgaccaagtttgtagaaaaaaacaatactctctctatttctaaatatttgacgccattgacttttttaaatatgtttaaccgttcgtcttatttaaaaaatttaagtaattattaattcttttcatatcatttgattcattgttaaatatacttatatgtatgcatatagttttacatatttcacaaaaattttgaataaaacgaatggtcaaacatgtgctaaaaagttgacggtgtcaaatatttagaaacggagggagtaacattttcaatccaagaaaaaattattatgaaaatatattcaagtttagtattataaatattactatatttgtctataaacttagtcaaacttatttcaaatttgactttgaccaaagtcaaaacgtattataacctgaaacggagggagtaattattattaaaaaatagttattaccaaatggaaagtatacagatcatatgccatcacaggaagtcaaatcttgatcacacctaaacgcaatgaagtgtgaggttgggcctacacatgtgtccgtgctgggcttgaggtccagcaagcaacacgacggcccaaacaagtcgctgacacctcacgctgtggagtggatccactcaatctgggccacacaagccttatccgacggtagcccagagacccaagggggctcggagtctaaaactccgaaccccctttgtgttttgaggcgcagcggattagcttatctctggctgaatatcatcaaaatttgtatattttccaagactaaagtatctttgtttctagacatgaacacgaaaacaccatgtatgcattagttacaggaatcatgtaaaagaaacatatttgtttgatatttattccctgaaccttcctaaatgataggtgtttcatcatattccagtattccacttgtacaagattggcctatttctaaccacatgcgcatgatctgtgagactgagaccgtatgaacttactgtcggttgcttttctgcatataaattcagtacgtctcctgccgaatgtctagcgttttttcttctagcttgtcaagactctgatgacatatattgttcttatcagtcttcagcttgtctcaaaaacgattcttgccacaaaatgtgtatccatggtgcaaattgtgtaggtaatcataaagctccttgctgacctttagaacattccaattttaagttcagagaccgcagatggttctattcatttcagaaggcccttttgcagtcatacaatgagcatgtgacacaattagaaatgtagacaagttgatttccactcttctaatgtcccatgttccatatgccatctactatggaagtccaagaatgttagaatgattgacaggggctagaaccaacttggaagttaaacctgacaaatggctgatcaaatctgtggacttacgtggattgaagagaggagttggtagtggctgaactttgctagtcaaaaaacgaaaaaacaaaaaagatagtatttgaacatatttaaaacattaacaatagttgctacctcattgtcaaagtttgtggtacagttgcctgtgggaaactttgaaactatgaaaactgcaatgacataataataatagtcatgtactcaagctgtcttcagattcaggtatttggtatgcattgatgtttttttggaatatgaagaaatgcattatccatgtgattccatattgccatctacaatcacagtcaagtagaagcggccatgaacttcgcaatgattgaagagggagcaatgcaaaggctcagcacttcacttggcaattagtttatggtcaaacatgtttacttaggagacagatggtccatggccagcctcttccatgtggacaggcatttttatgtagtactggatgcatcatggcatttccacttggtatgattaaccttggtctgtcctgcactacaccgtcggctgatctttcctcctggtggcgctccgcgcggaaatcaatttctaaacaagaccgtaagacttttgatgctggagttatcttggtgacctggcttatatggaaggaacgcaatgctagaattttcgacaacaaggccattctggcggcgcacttatgtgcagcgatggaagatgagtggaccacttggggtgcagcagggctgctgtgtccactgcaagccggaagcaacctgatggcgagagagcaacattaagccggtggtggtagctccctgctctgtagtacagacgtgctttaatgtctggcaggcagcatcctctgtagcctgaatctgcagcttgcacctttgtaatttgtttcttgtgacttttttcccctatcttaataaacttcggctggcttccgccagcccggcgaaaaaaatgattaactagggcatcccattagtaagaattattcttaacatagtattcaacattgtttcagttttgcaaatatagacctacaattcgaatgtttcagacaaaatgtagattcaatactgaattggataattttattctgaaataagcattgagctgaatatatactatccaaaatcaaaattcaaagaggaaggaaggaaggaaggaattctgaatttctgatgtttttgttaggcttgcccgggtctaaaaacttgattctgaaactgtggacagtgctatctgtgtacgatatgtttgtagccgatcggccgtactctccacgacgaagttagctgctatgctagccgatctgaatctgaagcatgcatcattattgagattcttatacatcctgaatgtactcttgaaaaaaatgaatgtccgatctgctcacatgaccgaacgtattgtatttggttgtttgtatacggccggcctgactgcaactctgcaagagatgctattagtcaaatagaagcatctctcacatggtcggcactcacgcatatatccctagaaagaattatggatcatatgcttaatgtgaagcattttaatggattagatcatctgagacgctcaaggaaaaggagatttttcagtcaaagagaaacagcactattattagcttgtcaatttgaggtctgcaaaacaaaactgaggtctcagggtggcatgttccagacccacttgatgcatggctcctgtcttcttaacaaaatattccacagaagctaaaatttacagggaaatgtgtggcatgttctctgcatgttcccaagtagtggatgcagcgtgcctgcacattgcatctgcatgttactactacaaacaagctagtctgtgtaacacaagttacaagaacaatatatataagccagcattgctcccccttgatgcccaactgccatacacgcacacagtactgcaactaccaccacatcacagttgatcaacaaagcatcatcaccatgaagaagaaggctttgcaccgcatgttcgctgccatcttcttgctccatattctcctcgctgtaactgctgctgcatcaccaaagaccagcaccggcttgttgcgtgacggcaacaacaatgcagtagctgctgttgctgctaggagtagcaggagattgctgctgcagcaacagcagcccagggcagcggcgccgacggcggcaatggctaccaacaccttccgagtcaatggcgttcatcaggcgaacggcgagcccaaggtggagttcgacgccagcatgaagcacaaccccgggaccaacttcaatcccaggcacaattagaagcatccggcccggctaccttctgcttctttctggattctgctctacatttttagttagcaaaagttttgcagatgagttttatcaacttgtagatagttttaacccagctttctttagtacaattaagatcgtgtcgctagttttatcattagttccactacactgctagcttagtagcttgtagcttaatcagctggatgactcacgttctggccgttaggtaagctagcttaatcagttaatctgctgtatccttcaattcaccgagaagaagcaattggagaattaacagcaatttattgtccgtcgttcaaatcagtatgtgaatgatacttgtgggctcttttcggcttcctttttctccccatctgtttcacaggctaatgggctatttcctgtgaccatgctgcctagactggaacaagaatcaacagaaacagcagtctgtaactctgtattcctgatccacaattgctcaggatgcccatatcaaagactcaaagttgtgtgttcatatacctgaagcacccagcaaatatatgttccaactggcttacttttactttgttaagctaggagatttttttttttcaggatttctgaacaaacaataatcttgccacagaggacatggtgtacttgtattcacaatgcagggtacagacttcacctcccctgaattatccactctgagtctgagctaacaacgcagccacatcctcagaatgaatgaaggaaaggaaaacagcaaacttgcatagcaatcattttgaataaaaaattaagtaaacaaataaacttgaatatgacaaatatttgcagttcacaacttcaagtaaggatctatggatatatggcttctctagcaaactaacagagccacaggtaagttctaccattgaggagcccaaaaaagttctttcacttgggcacctctttaagtaacaaatgtaatgccgacatttgtttgcctcaggactaacaataagatctggctatgcaaacaaaagtaaagtctaactaacttcacataatcaagaagagttgaacaaactcctcagaccaaaaggaacagttgtacatcacataagccgcaagcctatcctacaaatcctcccaattcataagcattaatcctgcttcacgatgcaggactcgccaactatcagatcaatcctcagggattattgtttaatatacaaagttagcacaaggtgcttcctttatagcccaacaattgttgtagaatcatcattgccgttgggcagatggagattgctgaacctgcactggtgggaagaacccagcacctggtggttgaaaaaatccagtcgaggtcggcgattgctgtggtgcctgtggagactgctgctgctggggctggctctggttctgagattgtgtaggcagaggcagaggtggaggcacacttagtcttggaaaacctgctgacataatgttgggcaatgggggtggaggtggcgcagagccactcaccatcccaaaaggtcccattccaaacattcctccagtattttgaacaaattgtggcataagtggtaatggaggtggaggtggtggaaatgaaccagctgcttggtttgcttgggttggtggctgtgtgcctccaagagcagctgttgctccaatctgtggttgcacctgcggcagttgcccaaagaatgggggagcactcatgtcactagcatgaatggggttgtcaagcctaggcttcttattgctctcaaagcctggaggtcctgcagaaagatctccagaagtcgaaccactattccttgcttgttcagcagcaagggaagagaaaatggaggagagcaccttctcaggagctgacaaagatgcaagcttatctgccatagctgctgcagtttttttgggctcatcaccaacagcactggatgtggcaggaagtgaggttgctggatgcagtggttgaaactggggaaatatcggcattgctgctgaattctgcatcatggcagctgtttgtcctggtggaagtgtaaccatcagtggactagaactagatcctgcaccattgttcaaggcactaccaagtcgttgttttagttgcatggcatgttcagcctttgctcgagccacctgttaattaaatcagggttagccaaaaatcaatctaaataatttcttgagtagctgctaaaccaccccttcagtggcaggaaagatgctgtggttttaactgagatggtagatagcaatgttaacaaaagccagcggagatggatactacatagggaacagaaatatgtgattggaaatttctaacttaagatgcaatgacacatgtttgcaccatggagttagcaggttagctacatagaacctaggttacaattaataacaatgcatgcgcatgggtatatcactgcaggcatatctttatattagctcgtgcaagggccaccttaaccgtatagcttatgctgtagagatagtcagacctcccaatgtgctggacctaattctcttgaaacagataaagagagaaatgtcatatataagcaaacataagttggaattgagaagcagtctaacaagtaggaaatgacatgttgccttgttatccagagtaggcctcagggttgccatggtaacttttaagaggcaggtttgtgcttgaagcaggatactagatgagccagacatcatctgtgctgcccaagctgaccatggttagtctactacttccatcatagagctgaattgtacagcagattcagcaactatccagtttagaggcttctcttcgtgtcagagcatacaatgtgcatcttatgtgttctcatttttgcttttgtatttcctagctctactcatcctgaacatgtgtgatataaattcatgaatgaatgtcgttgacaaagcaaaactctggttgtgctcacatgccatggactcatggggtcttaggctaggcatcaagaatagagtctagctcaaagcaaatacaaaagcatatggatccatgaaaatgctcagcataattttgaccctaactttccattataattgagtaataacagacatggcataagaaatagaatgatctaacatgtgattctgcagtgaaagatgaagtaatatgcataaaaaaatatatcctacaagcaactgattgcgaagaagctctgactttgcttcctgttataaagaaagaaaaaacataaagctttatgactgtaatagtatgccgtcaaggtagaacatttggaagaaaatataaaaggtgctcaagacctgttcgccgagggcttttcttagtttattgattagggttattctagccatgttgacactttcaagttgctcaatgcactgcttaaggactgtttcctgcccttgaaggtcagaaatcaacgatgatccttgctgaatacctatgaaataaaaaaggagtaaggtgcgcatgttttgatcaagaatcgaagtgaaaggctgaaagcattatagtgtcaaagcatcatttcttcatatctggtctccaactttgtaaatacagaaagtcagggtacaggtttccgattagagtgaaatgcatggtcggtccttaaaattgagcagtggtgtcacttgggtccgtaaacttgaaaattgcgcgtttaggtccatgatcttggtttaatgaagcacaccaggtccaaaccttgtttgaccagggctgaccgacgatgtggcgccccacgtaggcaacaattttgcatccagcctcatccacagcacggagtggcggtaaaattgcatttagctcctgcgagggaggagggatttggggattttggggggtttcggggtggtactgtggctgaaaggggctaactacaattttaccaccacgctgtcctgcaaaaggggggcggatgcaaaattgttgcctatgtggagcgccacgtcggcagtcagcccccagtcaaatgaggttcagacctactgtggttcgttatcatggacgtaaatgtgcaattttcaagtttacggacctaagtaataccaacgctctagtttaaagacccgccatgtattttactctttcagatcattagagctaggagcatttttaataggaaactttgcactacagtattttttactctgtaactcattaaaatatttagtcaaatttgaagtcagcaattgtcaataatcatggcctacaggcctagtgtgcactataaaggactcaaggaactatcacaatgtaaaataattaagctgctggatgtgctccacagaataaggatatgtatgctagaccaccacctatgaaaacaaatgccagaaaattgattttcttccctttatatgccaatgcatgctacaatcacatcattatagtttttttaacataattataaaattatgtacagcaattttctttgtcaacatgctagatcatatttatgtatttgagatgtttgtttagtctagaatttacatggcagatcaacaaaaaaccggaaatactatgtaaattccttttttctcaagtcaagtacatgatggaactagaagtaaaatagcgctggaacaatcatgatgcaatacaggccaaggtatcagaatgcattaagtgccaatctttcgacggtacatatccataacataacagacctattgaagtgagaaaaatgctttaccttgagtacaagcatcatctacatctttatccatcctatccaaaacactaacagcattattgcatttgtttaaagctgtgtcttcatcaaaatgttgatcaagcactgactgatatgctgttacaatcttttctggcatcccgccaacagtaagtttctacatcaaaagacaaaacaacaaaaatatctctatcaaattcatgacaatatactgcatccatccttagcacaagaaaatattttttagcaggtcaagatctggcaacttactcttgttactgtaccagaatctttccgcgcagctttggaaactgaagaggggttagggcttggatttgagctattgacattgttacccattgtatgagtgctaccaccaagaatgtcatttttcagactttcaatacgggttccaaagaccttccgctcatcccaaatatctatctgtaattttaaaaataaagttttttttttactttttgggctatggccttgtgatagagaaaatgaagtaaatagacttttccaatgtaacggaattaagaataacttactaatcttccaactactttctttccatcttctcccccattgacataaaagtctttcaataatccaggaagaaccctccaaaattcattcacaaactcccctcccttgcgtttactattttgcaggatatcatttgacaggtacaggaatgatactttcttatccttatttgcactgttatactgcttctcccatgtatcaacaacctttctggctctctttcggtgaaaaatgcaccaatttgaaagtgctgcttaagaattaaggaataaaaaaggcatgctattgtaatctagatgctattgttaaaaatatgctgtgggaatttggtatcatgactgtgtaaatgatttttacggcattgacatcaaacacaggaaagcaagtggtaagactcgttcagaagatattacatagggattcgagttgctaatatgtaagcaaacggacatgacacaaccatcacataatcccccaccccctttgtagcgtgaatttatggatgcaaatggataaatgctatatatatccttcttcaaatgccaaaaatttgcaatttgcgacttgttttttttacaaccatagggaatctgttatttgtttaattgatgacagtatatgataagccctgacctaactgcttaactgatttagaaatgaagataaatggtcataaaagaatcgaaaaggttgtttattcatttgccagtactacctccgttcaagaatataagaaattttagggttggacacggttattaagaaagtaggtagaattaaatggaggaagattgtgattggatgagaagtggaactaggtgggaaaattgaatggatgattgtgattggttggaaagagaatgttagtgaagaagttgttatatttaatcattcctttgtaattttgtattttctccctctcttccttttgtaaatcttttcttattaattatttaatatagcgcagtaggagcccctcctgctgttccacgtcaaaaaaaaaaaagaagttgttgtattttgggacaaattctgaaggctagaaattgttatattttgggacggatggagtacaacattagtgcaaccaaatattaccacattgtatttcgaacatagattaatggataccatcgtaaaaagcagttccacaaagattgtacaagaagccatcaagagaccaaaaaaagtagaactagcatatcagtaccctgatagcagcaaccaaaaggaaacaaagtatgtgatatatgattgattctacccattagtttgtaaattgaacaggaaaacagctatattcaaatccacaagagaacactactacaatgtgatacaaacctaacgctccttatcattactccctctgtttcatattataagtcgtttgacttttttcttagttaaacttctttatatttgaccaaatttatagtaaaaatgagcaacattgaaaacacctaactagtttaattaaatttaacattgagtatattgagtatattttcataatttgttgttttgtattaaaaatgttagtatatttttttataaacttggtcaaatttaaagaagtttgactaagaaaaaaagtcaaatgacttataatatgaaatggagggagtattagtcaatttcaaaatataatcatcctcaaaagacatagaaaaacataatttttcacaacaaacaaaaaattattacacatcaaacagaagaatagaagatattactaattgtaacacaacagcttaacaaatcgtgccattatttgtcatttttcaaaagataatcatcctcaaaagacagtgaaaacttattttcccaagaaacaaaaacaaaaggaaagcatgtattgatagtaagaacacatcaagccaaaattgtaatataaatttgattgccaatagcccaatacaccgtaatgctgataagaactacaaatattttagcgaggttaatttatatatacagctataattgaaaataatataggaaaatatgcccaaaagaatgatccagaagctagagaaaaaatggccacactaagttatatttgtatcatcgtacacatcaataagtattgataagtaaaacattagatgcagtctaactctagcagcaataagcacagctaggaacaggtgaaggtgaatattaaccaaacaaacagtgcaagagccaatatatggaacgccaaggagataagctgtgtcagttgtactaatccacattgcaatttagggttctattcaacttgaacagtaaatcaatcaaaactaccagacagataatataagcaaccaaagtaagtactatcctaatagcactagcataccactacgctaatagcaccaaccaaaaggaaccaaagtatgtggcaatatgatcagttatgctcattaatttgcaaattgaacaggtaaaatattccattctaatgtacaagaaacctgtataagtactaagtagaccacctagaaaatattagtaaaatgtaacacaaagcctgaatgttccttatcatcatttttcggtttctagacacagtcatcctcaataggcattgaaaaacattgtatttctcaataaacaaaagatcattacatatcaaacagaaagatactactccatcaaaaaaaacgaattccaagctacgaacctggacacacaggtgtccaggttcgtaggtaggattggtcttttttttaggacagagggggtactattcacataatacctaacagttcatgccattacttgtcatttttgtaaagataatcatcctcaaaggatggtgaaaaacatattttcccaagaaacaaaaaagaatggaaagcatgtatacagtaagaatgcatcaaacagaaattattatacaaattttcattgctgatacaccataatgctgataagaaatccaaatcttgtagccatgcacatctatatacacttatacagctataactcaaaacagtatatcaaaatatgcccaaaagaatgatccggaagctacagaaacaattgccacactaagttatatccatatgcatcaatacataaaccacgagatgctgtctaacagtaataagcacagttaggaacataagaaggtgaatactaaccaaacaaacagcgcaagaaccaatatatggaacggcaaggagatatcctaggtcagttgtactaatccacattgcaatttagggttctattcatctggaacagtaaatcaatcaaaaccacgagacagataaggtacgagcgctaccaaatttgcaagcgcacaagaaataaacaaccggaagaaaggatactctggatcctagtcgccgtgttgttgagcttgttaagcttctcaacaaacgcctgctcgctgaacgagccagagccgccgccgccgccgccgatagtttccgcctttgcctccgccttggtgtccgccatcacgaaggcgaaggctccaccaccgaactcctccccctcgcgaacaagctaatcccccgaagaaacttgtacttcttggccggccaagatcgaaccaatcctaaatccccccctaaaaaaggcgagaaaatcaggaatttggaggcgagagattgaagcttggggaggttttgggagggagagtgacgcgtaccccggtggcgagctcgtcagcttgaattcgccgccggtgaacgacgggaagggggcggcgaggccggggtgggcggggaaggggaggacgagagggtttggtttttttttcccctttccgtgctgcgtgtgttcgctgcaacctgcaagcctcttgggttcaacaagcaagggtgagggtttttcacatcagaacatgagagggtgaaaaaaaactgaagataatgttattggattggaattttatcaaagatagctataaaaataaattaaatatataatactattggttttattcatgtgagatttgaaaacgtgtatacaaatatgctatacttttttctattaatatacatacgttaaaacgtgttatttgtttagcgtacaatgcgggctatattaaatatagccataacatttatcgcttgaattatacatatcgcttttggtgatatccttacacatttaatgttatgataagcctcgttcatttattttttccaaataatactcgctacatccctccgttccaaaatataaggtatttgggctggatcggacacattctaatactataaatctgaatttaagattcatagtcatagaatgtatcacatccaatcaaaatcctttatatgttgggacggagagaatatattttagcaacatattaggttgcactttagccctaatgcttatgtataatcacatccaatctctccctcagtaatgatgtaacttgcacgtaaataggagagatcgtcctcatgaggttgttgatgtgccacaaagagagtttgaatagtccaaagtgtaacaaaacaaaaaaaatagatgatccaaagtgaaaaaaaaatcagataaaagtgctccaaagtgaaacttcgataacataggggactaaagtgaaattcactcaataaaaccatgatcacataacatgtgcattaaaaaatatctttacactttttacaaatattataatcaaatgtattagtaaaatggacgatatactcgtagctagaatagtatgaaacattttaccccgaaacatggagggcatgaaaataaattgtaaaatttaggattttgtgttacagatggctcaagacctcacgttttatgaaatttactcattttataatttgaggtactttaaatataacatatttctactatgtttttaagatggatggtcaaccgttatgctaagtgtaatatcatcgtatattaagaggatgtacataaaaaattaaagggaaagaaaagggaaaccaatggtactacagtccatttaactccattcctcatttcccaagtacagaaaactacaatttggtaccaagcggatccgaagagataaactttttatctactactaccgttttataatataagtcattctagcattttccacattcatattcatgttaatgaatttagacatatatatctatctagatttattaatatcaatgtgaatataaaaaatgctagaatgacttacattgtgaaatggaggaagtagatagatacagaaaagaaaaaaaaagaaactaaatatactcgcttgtacattgaagcgctgctagatgttgctccgtagcgctcaatgtggggagcttcaccctgacgagtcgtgaagaagcagagaagattatggttggaacgccatctccatctccatctgcaccagttgctgtttcaaggcggtacagcttctggccagcggcgaagttgccaagcagctggtaggaggtcgcggagccatccatggtgaggcagagatcgtcggtgcacgccgcgagctccttttgtgtgcggtagatgaagttgagcgccgcggcgacctcctcctcgaagcgggagaaggggctcgtggtgtcgtcgtcgtcgtcgaggcgcagcttgcggagcttgcagaggccttccccgagctccatcatggcgccacggtggttctgtgtttgtgcacgatcatgtctaatcacgaattttacagaagtgtttactgattactatgcatagttaaatgtggaaataatgagacgatgaaaatatatatacttggttgaagaggtggtggaaggcgacggcgcactggaggatggcgtggagcagcgtccgggtgggctcctcggcggtgtaccagagctcctccaccacgtcgtggcacgcgtggaactcgccgccgttgaacagcgccaccgccgcgtcgaagctcccacctatgacttccgactcctcctcctcatctccttcttcatcggcatagttctcgtagaagtcgtagtcaccccgcgctgtgaggaggcggcggcggcagcggaggtcacgacgagaggaggatcggcgctgcgggtggtggagcggtggctgtgggcggagcaagaggccgcccgccggcaacagtatccgcggtgcggtgggcgtgcgctgctgcggcagtagccgggcggcgtgcagcgaagcggcggagcggcagggcgccagcgccggcgccataggaattcaacggagattgctctgcttttgtccggtgaacgaatcgcgcgcgtgtgatgtagtagcgtaggaggacgtgtggactcaaccagaggtgagccgttgagacactcgtgcatgcagaaccaatcaatggagtgagtcaaagtgtcaaacccacaaaaatatctaactacaggcccaataagcaacagcccatctggcctagccagttttcccagcgtttcgggtttggaataagtctattctaaaccctcctgtcgggcaatttaattgacgtccctaaaccacggaacccgaaatctttctccctaaactatacgaaaccatttgaatcaaatcctataacaatatggaggattgttttagcttatgtggcaccctagtcaaaaaaaaaaagtagaacccacatgcaagtggccttcaacctccacacatccctcaattccctatccgtccacctcttccctctcttcaccagagcgcactgccagggagagagggtgatggctggtgcacccgtccgtggaggcggcagcaacggtgggaaggaaattggcgatgagggccggcctttgatgggcgaccggtgggcagtcacgccgagcgtgaagcccttccttgcctcctccaacgccgacgaagagggagatggcgttgtggtgacaacaccaacgatggtggatctgcctcctcgcccacccatgtcttagcttccattttcccgcactatcagagctcgggccgtctccgccgctagagagatagaaagatagaggtaggagagacccttgcctcatgcaacattgctgaacaaggagatggcggcggcggtagcgacggcgacgagatgatggcggatccacctccctgcccacccacatcttgcttccgtctccctgtgctgcagggagctcagtcaaatgtacgcacgtgctaggggaagcgtgtacggtccactctcgctgcactcgatggcctcaacctcgatctccgccctcaatacccccacttcctcactgtgtgtacccctgggacattgagagcaccacgacacggtgagttcaagggaaaagtaagatgccacacaccatagtctgcttcactgtcaactctctgtctattggcctacctccaccaccaccgttaccatgaaaccaagagctatatcgctcgttgacctcctagatgatatcgtcgtcgacatcctcacccggttccccgaccacttatgcctgtgccgcgccatgtgcagatcctagcgcaccctcatctccaagttgtgctgataagtgggtctggatatttgccatataagcgaaaacaaaggaaaaaaaaggtctatactgttatgggatgtaagttatatagtttaggggtaaagatttatgggtatgggaataagggatgccaatcaacttgacgtaaagttaagggatggttggacttatttctttcgcgttttccttgggtttgacaatgggctacattgcaaatactcgggccgacccacccaacaagatctgccggtaatatacatgggcttaattctcaccaacagcgacgggtgggctcgatttcgtgggccttgtatttggcccgcacacaccaacctgtcctgtcctgccgtcctgcgccgctgcgctgccaatctcttcttctcttcccgcgtctccttcgcctcttcccgccaatcgccaaatttcccccatctcacctcgctccgtagccttctatcccaaaacttccttctgctcttgctaggctagggtttcttccttcctctacctctcatccacagattacgagatcgatccagcagcaggggcaagtcagtcgagtggagagcgatggcgccgctctcgtggcgccaccacacgctgttgcaggcgctgctctcccgcgggcccctctcggagcgcgacttccacgccctcttctccgccatctccggcggcaagaaccccggtatatgcttctgcctgctccgcttgctactctcatctttctcctgctgttcgccagcgcttgtctcattactcgtagcacaggtgttcgacgtaatgcccctttaggaattactatcatctcaaatggaaacaatcttagtttgtcccaatcttctctcagtttcagataatttctgcttcatttcaccattgacgcctggttttattacctaatattgttcacaaatcataaaaatactatgcgtgattttatataatttccggcctaaggggtgttaatattcccataattgaacaaaatggtttgcgaccattcatgttctgtatcactgcttgcagccactcatcggcatctgttcaatgatacactcctcaagatcaacaaggagctcgcatacttgcagtttgagttaagagcaggcataaaccagtatgatggtactgtgtattatggagtggtcaataacattgctgatgaagagtcaaagcttggatcaaagttttctgtgccacagattgcattctacaagggattggtatgcaatcactttgccttttttttggttaatccagctcaatctagtattcgctatattcatgtaattgtactggcagttggaagcaatagttcatgaagctggaaatgatgggagcataacaaatatcgatgctcttaacacacggattgagaaccaggtatctcgtactagtaatacccagtcactatgagagcttttgtttctgtttaagcaaatgttttatatttgtattgttgcaaacttttatggtagtgtgacgaattatttggtgttctgctcccaggttgtaattgcagacgcttcacagggcagtcaatcccgtctgcctacttccattaccaacttctcattgtcccaaaaggagaaaactcttaatgaactcatacaggatcgttggctgtcatacactcccacaggaaagattggtcttggcatacgatcatttcttgatctccgaagttggttacgtagtaatgatatcccatcatgtgaggtctgcaatgaagcttgcataaaggtgcagatatgtgattacgaattacgattctacatttgcatttatcttgttacccatggtcatatactccactaatgtcattccctgtatttctattacttatttaaaacaggcatcatcttgtcctaatgagggatgcaatgtaaggattcacgtgtactgtttgaagaagaaattttctcagagaaaggtagttacctatttttaattccactttacacatatgaacaggagtggctttctaaattgtttgtgtatgtaggcctcgagagcttgtggttgtggtactgaatggcctcggttggagggtgaagatgacggtgctgaggatgttaacgaacctgaggaagatcaggtcccatcagccaaccagcattcgaggactagacgcagaggagtcaaatctgaactggtggaagaaaatgaaagagcaggcccatcagcgaggatgacaaggaggagtttgagaagctctaaagcggaagcagttgaggctgctcaagaggtgccatctgcagcaggaccttcgcagtcaaccagggcatctaagagaagaaagaactaatgagattgatttgtgcttgctagtgatatatccaggttccttttgtcatgtacagacagtagcagtaggtaatccttttgaagtggcaggcaaaattgcaacttctagttggagaggaatatatagctttaggatgctcttgttactaactcttagaacgtattagaagcttaatgctttcatttggcaaagcaagcctgcttgtgacagcccagttaactgtttgaatagctctcttgcttggtgatgctagtttcatgcatgctgtttttatcctctatgttgcttgtttctttcggccccatcttttcggttatgcttatgcttatcagccaaaaattgaattttcaaccttaaatttggagttgattttggggtttttctcatcaaagtttatttttcagcatttgcttttagatcagaacacatatataaaagttttattcacaaattatttttcgtttgcaaatatgccgtttcgcttattggggacttttgtgtctcttattaaaagggacaatttaaagctcagcacagccagcattgtgtggttgctgactggtataaacactgaatggaaggttgcctaggagtcaggaggaaaacccaaaaatagagaaaaaaaacagagtggatccggcaaaaaagagaaaaaactgagtgaggttagtttcagggttgagaatatcctgaacaagggcagccaagtcacaagtatttttgtttatatcattatatgagtgtgaagatgaagatgatcctcacccagctgacttaactatagatgatggagaacagcttgttgagtcctggacttacttgcttgacgtattctacttgttcttttcatttttctctttttgagggcgtattctgcttgctgatgcagctatggtactctattcgcgaacataggcagcttgcatgaggtacggtccaactcggagaaaagaaagaaaaatagaagaagaaaagatggctgctattattttactagatgtgtgtttcttgcatgcatcattcaggtcctgcagatttaccatattactatatagctaaccaccccgctggaaattcctagtatgttgacatgcacacagctagttgcacgaacaaactgaagttgggcagtcgccatctagacaaaatcaggggatgactgagttcaggcgaaagcaaccatggcgacaattggtgaaaacacgtacgcgctgcaattagttattgaaacgttcaactcttgatttgattgatggccccagatgagctgagccttaagaactaagatacatactttgctaaactagtatatactccgttttaaattatttatgattctagcttttatcgtaagttaaatatttgtattttttgactattaattcttaaaacttcatgtggtttagcattttagaatcaacataagaaacactttcataatatagcatccgcatgttgttaaactatccgaattttaaaaaattgatggtcaaagatacaaatgtataatttaggataaaactaaaactacatgtaatttgaatcggatggagtatatttcttgcggtttgagtaagatcataccgtttaattagatagaagagaaaaggaagaaacacccaagagcctagtatatcctaaggcacaaagctacagctataaattactcgtcatgcagacctacatttccctaagtttcattctttcccgcttacccagcacacgttcatggacagccgctccgccactagcccactatactttgcatcctaattaatcctcttgtcataattaactaaaccaggtcacgacagctcaatatcataatcattatgctactgcctacttatacatgaccagggatcttcagaaagcgttcaaggatacgatttatttcctttgaaataatgtataccccttaaaaaaattttgaaaagagatgaatgacaacagctagaacataaccttggagtaggacaatcaaacaaagtttcagactgcttgctaacgtttggtgaataaaattataaaagagacgggggcagaaaactctcagcaacctcgttggacgatttcgtttttgtcgtcagcacaattgcactgcgtcaattaatggacaaatgaagaaagcgaaggtacacggacgactaggcaagttgatagcacaccagttaaaacgaaagctaacagcacaagcacacgacttgactgacttactattaactacaggcaaggtcaccgaccaacggcaactgaaacttacttacattgttcttttctgattaactacactggccatgttcgaatcaaattttatctcggttttcattagcatatttttcaaactattgagcggtacgtttcgtgcgaaaattttctatatagaaattactttagaatatcaaatacacctatttatcaagtttataataattaaaatttaattaatcatgtgctaatggctttctcgttttacccaacttcatcttcatcactgatgcaggggaggtgccattttggtagagcaagatcaaagatatgatcaaatttacgcttattttgtacaataataacagacacttatctgtaaccacaacttcatcagttacatctgaaactgagtaaatatccgattaattcattcttcattcgcacaaacagaaaacagagaaaaccatctgtatttcaccaattacatctgcaactgcaagtatgcaaaatgctacactggtggtaatccactaatcccctcatcaacagcttgaaatgcaccccaaaattggacactaattatgaaattaattcaattcacaggtataataagtactgtaatatctctctgttcaatgcacagctgttactagctatactaggctgtagccgttaatgtactacccatccaaccatcagcggcggcgccgccgccgccggcgatcaccaccaccaccagagcggccggaccttgaccatgcaccccctgttcgccggcgccgccgccagcttgttcaccgtcacctcgcacctcgccttcacgtccaccgtccacgtccggagcaccttcccgaacctcaacctcaccggcacgatcgcgtccacagccaggggcaccgcgccggcggcctgatccgcggcgagctgcttcctctgctcctccgtgaggctcacgcctcctccggccaacgccgtcgagaacaccgtcacgttcctcggcgcctggtggaacgcgggccacgggccggcggcgagccgctcgccggagtaggagacggtcacctccccgccgccgcggtagtcgatgccggtcttcttgttggcgccgttgtccgcgcgcacggcggcgtcgatctgcggagttaacgacgacacggcgagggcgtcgaggccgcggatggagagggaggcgacggagaaggacggcgcgagggggcggaagacgaggtagacgacgccgacgaaggcggcggcgaggaggagcaggaggaggaccccgcagaaggcgccgcagcacgcgtggcggagccggcggcggcgtgcgggccgcgccgcgagcttcttgtagcggcgcgcgcggtccggcggcgggacgcggaggacctggtccttggggatttggatgatgtacgtgcccggagacggcggcggcgcgccgcggaagctgggatgcagcggcgtggtctccgtggcggcggcggcgtcgtgtcccggcggaggggaggaggacggcggcggtggagcgggcatggggtggacgcggtcggccatggggggtggttgtgaggcaaggtgttcgacgaaatgaagagtgaccgagtggcgtggcgtgcgagtgggagtggtcgcttgcttgccggatatatatgctgcccgcgtagcgtagaacgcgtgagaagagaacaaacagacaaacacgcgggaaacggtcatctgacggtattctttttattttttttcttttataaagataaatctcacgatatcctgttcatactctggtactattaaataatttcactatctttttttctattgatagttagtactctttttttatgtatgccaccgttgctttttcgtataacgtttgactatattaaaagttttagtgtaaatatgtaaaattagaagttaagatttctttggtgacaaaacaaatcataacaaatatttacataatttttttaataataagaatggtcaaacgtcatgtcaaaaatcaacgacatcagacattaaaaaaagagagagaatagtactccctacgtcctaaaatatgagtatttttaggttgtttagaaaatcttataaaggttaagtaaaaagatttcctttccattaaagtagtggtaaaatattaaattatttagattctcctcccaagcatttgattggttgaaaatgcatgaatttttatgcattggtacatagtgacgtaagcgggatgtaaaagttgccacatcagatttgtacttacgtgaagaagggaggacagaagaaaaaagaaaagcggactagatttgtagccaactacacgactggcttcaataaactatgtgacggagatggatggattatgtattattgatgtaatatatattacaattatgtagtatatgagttggtagatgatgtttcaatttttgaagctaatagttgattatattattaaacttactgcaaaggacacatatttttagtttatttagtaaagagtaagctaaaggataaatattccctctcagttgtctcattggttgattttgtgaattgcttagccccccttcctaattacctaagtgactaaaaatacttagctttccgtgtatctgaattctgaagtagtacctggaaatgcttatattgtatatgaaatttaaatagtagaaatacttatattctaaaataaagaaagtatattgtggtacaaattttaaatactaaaaatgcttagggtccttttaatttggaggaaaaacataagaactttggaggatttcaaccatatagaaaaatttcctatgaatgcttttgaaacaaaatattaaatcatatcctatcatatccttttaaattcctatgaaatggataatctcttggaaatttttctttgagtctatctctctcatccaattcctgtatttttctagctgtccaatcaacggttatttctatgcttttcctgtgttttcgatcacttgctttgcacttgcattactattagaatccagactttttttctatttctccgtttattcatttatgagattcaaaggtggagtagtattattttaagacaaggtgctactttatttacttatgtcctgcaggagttggtgtgataatttgatcaaggaaatgaatagcgtgggttcgatgatgaatgtgaatgaaagagtcaaatattatgggggtttactacggaattaggtacaagctactccgtagattgtaatcatctgaaagagaacgttccgttctagcactgatttttctcaaggtgcctcatactgtacctaatttttatatgatcctgtctgaatgtgcttgttatcttgcacttctctgcgtaagatgagatgtttatctattctagtattctactatatccaacttaagatatccgcatattcgaggaagtaattatttttcttatatgcattgctagtctaaacaatcatgtgttgtacatgtgtgaaaactgaagctttttgtgtctgtgaagaatacttccatagtaatcaattatttcctactatgtaatatactagtagttcaaaactatccacatgtgtttgcacaaaactacattaaaaaaaactcgatcttggggaaagaaaaaatagtcccttgggggacggagattaaaactcccaaccccttggcatcctttgaattgaagcttaaaaaaaatggtccatgggttggagattaaaactcattgtaacatatgaatagtgcatactttctcaagtagtttaatgtttagcacaaacttcagccacactttaaaaattttggcaatctattttacaccagaataagtttatataatccaataagtttataatattatgagacaaatctacgtatatcattttgaaaactaagcatttgacaaattattgatgtctagatttttaaaaatgcaactaaatatggtcctaaatgtcaaacatttttaatcggaagggatacatactaatataatcgtattgaacagtgaaccacaactcttgcagtaccgaataatctctgtaaactctgttaaaaaaaaacttaatcctagttactagtgccttgaaggaacaacactttaacttgtgactgttgtttgctactgtacggagtataagttacagaattgtgagtacaccatccatatcttctggaacaagcttctcatctgcctcctcgcgcccaaaacatccatccaaccgatatctcccttttcggtcgatgatcatttgctccaatattaacgcatttctgagaatgtattttgctagctccacctggcctgtgttgccacaaaatccaaatatgcacaccatcttgagatgatagtgaggctgatccacgatgtcatccaaatccaaagggcacctgttcaagctacaatacatctgcaagaaatttatgtcatcattaacaaggagcaaagctaacacgtaataattagggaaaagaagatcaaagattcatgatcgaggaagagaaggagaaggatagcctgtatatcttgtcaaaacaaatgcgggggatggaattctgagattttgttagaaaaaagaagcttttgctctgtttggatacgaatatattcaatcaaggaaacacatggctaatcggtttccaaacatattatcaccttgattcatactatttggtatcttgtacagtgcataaatatggtgatgtgatgatcagggtaaacagtgatatcgatatagcaaaagcttctacagatgtcccaaataattatgattaaaatttacaaagtccactgtcaaatggaaaaaaatgcagttgccaactaatgctgaacaatactactttcgccgggccgaacaatattactttgccaaagctatgttcgatggtctgatgatcgttaaaaaggatcaatagtctgcagcgaatgttccagtttctgggacttatgagttcatggatcatgcatagggcacattggacaagcaggtaattcctaattagattgacagtactggcttagcaggttattctgattgggtttccaaaccaatgaaataacattaaataggaaaaaagaggtaatcggtcaatgagaatacaaaaggcgaactgtaactggctagggaagaaggcaataaaagtagtgaagtacaaattgtgaattctagaatgaaattggggattcaactgttcatccattgagttggccctaagggctaatatgttgagaagagtacaacgcaaaaagacagaaataccccttaacacatacacactaatacatatattcttaacacccccactcaaatgcaatgtgtatacaataacattgcatttggagtgaaaactaaacaagagaacacaaactaaatattagcctatctccaaagtcttgatgatatcgtcgaagtgtgccaattcttggatgatggagaagaaaagatgtatcccctcctcaatgaagtggaccttggagccttcacaaactgttcttcggccctcgataccttgaagccttcacgaaccgttcttcggctcttcattgattcagagatgttgttgatgatgatgacaatagaccttcacaaattgttcttcggtcctttgactgatgatgagacattgatgttgatgaaggcccttcacaaactgttcttcggaccttcactgattgatgatgatgatgagaagctccgatgtggagatgatgaagtgacaatgaaggccagctccgacggggagctgatgatgatgaggaccagctccgacagggagatgatccatagatgggtttctagctttctgctgctttgctcacgaaggactctcccgaagcctcatgcggctgggcgacaagcagacaaccacaacggccatgctgcccagcaatggagacgagcagcgatgacctcggtgcaaggacgcccggccaaaactggagccgttgcggacgacggcggcggcttgccgccggcagctaggacacgctccgcgacctgaagaatggtggggacgagcggcgtggataagcgacgcgacgggcgtggcagcgagagtggatggtggagaagcgggcgcggcgccgcaacggacggcggctgcgaccggcgaatgggaacgcggtgacgacgacgagccgcgggcttgctgcttggagacgaagacgacgactgactgatggacgaggatgaacgacgacaacgatggctcgccggcgatttggcagctagggtttggagagaggctctgataccatgtgaattctataatgaaattggggattaaactgttcatccattgagttggccctaagggctaatatgttgagaagagtacaacgcaaaaagacagaaataccccttaacacatacacactaatacatatattcttaacacaaatgatatagctacttacatccaaataaagatcctccaaaaatggagctgctacgaaaagataagccaactggagactgaatttctatcgaatgaacctctctcaaaagttatttccaaagttacacttcaattgagtgaacttgagaggcgattgtgtaaatccagacatctggagggtgaccaggccacacataggttcaaacaacaagatgtgaaacagaaaatcaaatagaattaaatgtatatagagagtacaagaataatcagacctgagttttgacattaacttcaacgtataacgtttcaacatgaggtaatacacttggaattccagttaatatattttggagggttttctcatcaaaaagtctgatggttgatgctttgatattggagcattcattgagcgttaccaatgccagggaaccgtcgtactcaaatgttgtgagattcggagcatgtaactccattctttgtaaatgacaaccctgaattgacaaacattgcagacggcataatggttccgacacatgtaaattatgcagctggttacatgattggatgcttaaccactctagaacatggcatttcgatattaactgctctaaatgttgcaacctaacattgtcaagagcaagcagtttaaggtttgcaaatccgcagaaatctagaggtggattcaaagtaacactgtcaagccgaagagcctcaaggtaagatccattatgtttgtcgaaaatatgacaaggaaagtcatagttgttttcatgtgatttccaatctggggagaagtcaagaatgataacccttgcctttgatgcaatagcaaacgcaacccagccattgacatggttagcatgctcatttgacaaaccaaacttaacagcaaacttatttaccattgttccacaatgtttttccagaatagcatcaacccttttaatgaacttgttagcacttgatattctacagttcagatcagagcttgttccttttctcttggcattatttccaaggactgttttaataccaaagtacagattaggatggaatgtccaagcctgtctccagtttgttgacacaacactcaaccgagcgacttcctttaatgttaattttgatattacccttagtacaatatcctgacaatgcattttgaacaagcatcagaatacagcctcctagtcctagcacaaaaggagttgagagtttcatgacttcatgtcatgatatgacatacctcgggaagagactgaaaattaagcagacatggtcttgtcctctgtaaattaagctgcccccgacttatcttctgaaaattatgttgtgttcttctcctcttactaatacgttgtccgcaaattatacaattccttttggctgttgtgctcttactcctgaaaccaacaatcagcatgctctgccagtatgcaatgatacttctttcagaagttttaagtagcacacagaattgacttcttgaaactttttttttagcaaaataacacatatgtcagagggtattttgcattattattagtagtaacagtacacaaataaatgaatataagcatataatgtgatggaattctgccatgtaaggatgcctttctttagattctctatttatttattttttgcgggggcctttgtttagattccatatcgtattaaaatcacaagcaaataaagaaaaaggtgcatgagttgggagtcaccttccatggattttcgaggagacaagaacgttgtcctccattgttggacgtggaggcagtggatcagggacaagagaaaccctgaatccctccaccgcaggtccgcagcccaatccaatcagcagactcctgatcccagcaaggtagccatgaagggggatggaatgatttatgattctgagacagggagaggctatttagggctggagccgctcgatcgcgaggcgcagcatcaaggagtcgaccggaggttagggatgaaggctcatcttttatgggccttaccggtagatggccgtacggcccatatacaggcccataaatcagcccatatcgattttgactgctagtagtagtatttatttgagaggatataagaatcgtattctttttcttcaatacgaatcggtttcggatttgttgccgcaaaaatcaaaataaaacccgggtggaggaggagggagaagatgaagcaaacgagagagatcgagcttgaggccgggtggaatcgcgaggggatgtcatggcgaagcggcgggcagagtccgagcttgagctggtggaggcggaagcggaagcggaggcggaggcggaggcggagaagaatgggaggcgagcagcaggtagtcaggacggggtgaatcgcgcgttcatcctcgagtgcagcaaacatagcgatggatcgatctacagcggcgacgatttttggcacagattttacaaggtcgccgatacccgagagagtaagttttaacttttaacttcttgcaaaccctagctttttcccctctccaccatgcatcacctaccatcctctcatctccttaattagttccttttcaattttaactttgcatcatctacaatcctctcatctgcccttaattagttccctttcaatttagcttcacttggtagcacctcagatcgatgctatttaattcatgctcttttaacttcaattttatactatattgctgtgtcacctaatttgttccccaggaggcgggcagcctcttgggtgcaatcaaagaagaggtcgcaatctggaaggaagcaggagtctttaaagaatagagatgcaatcccttttattttggttttgggagggcgctccggcatactccattcagtttcgacatcttcttgttggaattctaaacttgtaaatttgtacatcgtaaggaaatttggactgaggggtctttggtcagcacggcaaaataataataataataataaaatctaatttgttcttgtgtatgctcagtactatggaactgatgtcaaattaaaccctttttttcataacatatctgtctagcttgatgtcaaatttagacctttcataacataatctagttctaagtaacactagatattccttaagtactacttcaaaaaactcttaaaggcaccatctaggatatggtatatcttgctttgggtccatgatagtgtggagtttgctgttttaaaccttattcgtatctatttgtttctttcctgctcatttcaatattggggttaacaatctaacttctaatcatccactgatgtgtatggctgttcagctcgtatggaggcaatgatgctgtcaaacccaaccaattgccggccacacatgtgggcttgcaaggcgcacagtgtgcaattcatgatgcagatattctcgctcaagctatccaatatcactgctgctgttgatggcccagttcacttgtatggatactttgctgtccgggatcatttggacccgctacgcaactacatcttcaaccgcaccagggatgaccctttcatcatggggcaagacaatggcgttgattcggataattcattgataccaatgtcaggccccaagagaggcattggaaaccaagttcgtgtgctcatcgagttcgacatgaagatcaagaacggagagacacaagacgatgattttcagctcatcgatggtgccattatctgcagcgaattcgtgcttcccgatagagtgtttacgcaacggattgagggtgattgtggtgcggtcgacattagtcgagccctttttcacgaagcagtggaggccacaatacaagttagcatatcacaagtgcatgtcaatggcttgagcttatctttatattcttataccagtcgaatccctgaaaagattcggctctttgatggtgtcatttccaagccatgtgacctgaatagggtagttgctgtggtggagaatacacctttgtttttaatcttcagggctgttcatagggatggctcggattatgatatccctaaatactgtccattggtcttcaaggttgatcagggggatggctcgtatcgtgtctctgaatattgtccattcaaagctagaagacatggatatgacatgaaagagcttaaacttggtggcgcccgtgtactgttgaaggtgtcttggtcaactttgaagtgattttgaatattcctggggtatacataatctatgctaagcagaaatagcgatatttctgtgtattgactagtaggcaaatgtttgggccttattttgagtacatatttaagttttttatttgttgtagaagttcgacaggtgaaggatgccacactcttatctgttcttatttattgcatattaatgcagattaaatttggtattgctacctgaatttaccaaatgttttggatgcaactcttgtggaattctaatgtttaacttacacaatatactcttgcaagagtgccgaagagaaaagggatcatccattaatttgttccgtcattgtgtctgcgtgtgaaatagtgatgcttatgttaggtaatactgatctgcttctggggcgcgttttgttgggaaaattgaagatatgctactcccctggaatcattttcaggacgtcactccttcagcttgactttgctaaaatggattgtttgcatgataataaataatagatgaatcttcggtgtagcatcgcattgatgaataaaacttttttttgccatctgtttgtaatgatatttttttcctctttgtattttggtcggccaagtgtccgaacagtttggcatcttgtaactaaacaagttctactccttaatacaaagacgtgtgaacctttcgcatgttacctaaaacaaaaatgagtccaccaacaacattacaaaaatgagaccaccaacagcattacagcaagcagataatgagcatgagggggtgtagaaaagaaaaaaaaagaatttatgaaagcatcgcttgattactgaattattgccaggacaaccgttgaagaagcaaaccgcagaagctgcaactccagtccagcggtttactaacaggcaacagacatccaatcatcttatgtttactgaaatagtagtaaagtggtgagggattgccaatgccaatctgccagacaataaaaactgacagggacagagactggagttactaagtgttcagctcagtttactgaaccagctatctaagagattaagcaaggctaagtcagagaggaactgtgtaatgaatgagatagcgctatctaatcagtttactgtctgctgctgctgctgctgctaggccaagacgaggagggggttgtgtctccttgcttaatgagctccaagttgatcttttgggccaagttgagtctcatggctgcgacgctctcagcacttacttgatccatcaccgactcaaaccagcagggcgccgcttcttctgtccttggatgcttcttccaccaccggcagatggccagggcaactgccaacaggtagacgccgcaatcgtacccattgctctgctgcggtgtcgggcctgagatgggcggtccctgcggtggcgccgggagcagtggccggagcgcgtcggcgaggcgggttgccgccggcagattggcgccgtccatactgtcgtggtggacgaagcggccggtgatgttgtccagcacaagaagactccagtgtgacccatcgtcggccttgtccaacctctcgctgttgttcaccgggaataacaccatcctgcgagatgccagtaacagtgcctgggctgtatcagcgacagtctcaggctcatagtcttgcaagttcgccagcagagaagccacggatggcgacaccaggagaaggctctcatcacccaactcggttgtcatgtgcgccatcacaaagttaatcacgccatctaataggaagtttggggcagcaaggctcgcgacatcggagctgaacagagttgcgtcacggtgactcattacgctctttcctcttgtcctcgtcgtcgtcgtcgtcggagacttatgcagggattgtttcttcacagtgaggccgaggaactgcaactgatgttccactgtatcacattgctgctcctgcaaagtacaaaaccatgtattaacaacctagttagtttgataagtaatcaaccgacatggagattagtgaactttcctcagtattaatcaaagagacagagatggactgcaatacatacacataacaataacagtctgcctttcttcaaaaacaaaaacagtctgcaagcgatcaaaaaggacaagtattcacattactcgcattgcgcaaaagaagataaatccaaaattttggcctcttacaattcattaggcatgatgaatttgtagttaagtaaatacaagttacaaatactatggactgtaaatttggagtataagcacagtaagaaattatgaattaggagaaacatccatttctcctacaccattccatctctctaaacttccaatgaaagtgacagtgacctattcttgtgccctctctgtcaaacatgagcagaccttcaaaatgacaaagagcaaacaaaaacactaagagaaagcaatgcgttgacctctcaaatcctcagaaatctccaaaccgagaaaacattagtcaatgtgaacaaacattggatatatgagatgactaaagaagttgggaatgggggaagcaacagacaatgatacatttgcatgattgcacgcacaacgaattgcacacatgggagatttaagacctagtacaaatctaaatgtgatctagagtgtttacgcaacggattgagggtgattgtggtgcggtcgacattagtcgagcccttttccacgaagcagtggaggccacaatacaagttagcatatcacaagtgcatggcaatggcttcagcttatctttatattcctatattggtcaaattcctgaaaagattcggctctttgatggtgtcatttccaagccatgtgacctgaataggtttgtagttgctgtggtggagaatacacctttgtttttaatcttcaaggctgttcatagggatggctcggattatgatatccctgaatactgtccattggtcttcaaggttgatcagggagatggctcgtatcgtgtctctgaaaattgtccattcaaagctagaagacatggatatgacatgaaagagcttaagcttggtggcccccgtgtactgctgaaggtgtcttggtcaactttgaagtgattttgaaaataatgatattcctgtgtgttggctagttgtcaaatgtttgaccctatgttcagtacatatttaatttttttatttgtttaacagaataacagtcgaagaatgccacgctctcatctgtaagatatggttctataaacagatgaaaaaaaaatagatttattcatcaatgcgattctacaccaaagattcatgtattttttagtatcatgcaaacaatccattttagcaaagtcaagctaaaggagtgatttcctgaaaaaggttcctggggagtagcgtatcttcaattttcccaacaaaacacgcctcagatccagatcggtatacccaacataaacatcatgcatgtaatgtaatgtaatgaactatgaattttttttaactaaggaactgtgattttcttaacgaaaccacaaacaacaagcagataagcatgaggaggtaaatctatggaagcattacttgattacttaattactgactggataactgttgaaggagcaaactgcagaagctgcaactccagtccagcggtttaccatcaggggttgccaatgccagtctggcagacaagaaaaactatgccataggcagcgacagaaagatcgtcttgactaactggatatcacaccgcaactgcaactggtgtttcatatcaatatcatctactctcatagctaacctattagcgcaaaaccgaaaccaaataagcataaacaaaagagaagaaacaagcagaaaccatatggacatccattgttccttggatatttctgacattacggacttcctgagaaaagttttttgaagaaaaacagcatgattgctgcacattttgtattaagaagaggaaaagttaaatccagacgccatagagcaagttggaacaaaggggggcaagaaacctgttcagagagctaatactggactatctatgctttacagatctctctgagaaattggctgtttggccttgttttaggcccttgtctcatcattcagtgacctgtagcatcaataacctgcacttgaatctcagaactatctgcagtctgtggatctcctgattttaacagttcatttggcagttctgaataatcttcgtttcctgccagtaatgcttcacttgatttctcttcaattgactcattacgacatgttgcgttagaagtagaagataccagtgcttcatcattgagctgtgcaaatcgtggatccgaatcttcaactgaactcccgtcaatgaaatgtgtcccagtcccagaatctggagataatggttcactcaattcatcttcaagtttaactgtcaagggttgactgatactggactttgagatggattgcactagtacttcctccatacgacacttaaacaatgagttaaattcatcaatggagtctgcttcaacaatatgtgcctcaaaattatttaccttgtaaggggaacacgatgttaattgctcaatacctgcatgacatcaacttcagttgagttatcatttccagtaggaaaattgcaatacataacttagggttaaaaaacagttttacctgcatgtactgtatccttagcttcgaaagtgctttgtctaggcttctggaaaggagatgaactgatatcatcactgaaatcagcattttggttactgctaaccattccagaatttacttctaatacacccacctctgaaattgccatgcctaatattttgatttcttcgcctatatgtgcttccagtgaaccaaataacgtgctgttgttcctttcttgcttggcatcaccgtctgactgactattatgggatttatgggcatcattttcacttatttcatctttctccagtttgaagctattgtgatgcaggctagtagagtgcctaacatataagtttccatgctttctatgccgtcttgctgaaaagtacgaaagaggagtccaagtttcttgcaatggactatcatgggccatattttggttgactgcaagatcaaatagatttttccgtggaaggagacaagacggtgctgaatcaggaacatgtggtaactcgattatttcatctgagccatttgaagaatcaaatgggttctgccttccagtggaaatggagggaacctgcacacggaagcgtgatgcctcctccattttctgtactgcatcagctgcttgcaagtccattaacctcttgtcaagttcaaatttcagaatgttctttgctctttgcagatccatcataccctccagcttgctattattgtccatatccaagtaatttagatcaataacatccttccagttagcaaaatcatctattttcccttccaattgattttcatctgtgctagcatcctcctcctcaagatcatcttcatcatcatccgaagaagtattcaagttgtctctggagaccaatgaagggtggccagtttgcaagtctattaatgggtgcaactcttcaagcattggaataatgtcagtcattgatgcatcaggagaactctcagtaagatcagattcagaatcagaacaagcatcctgtggctcctgtctcataacaggttcccaacatgaactcataaactcacctaactgatattgatattgtactttattgttatcactttcaggattgatgcttccaagttcttgcagctcatcattcttcttgctgttctccccaacgtcttcagtttccacagttacaccactgtaggcaaaacttgaaggcgccacacaaggaacagtatcagtttccactgatgtgataccttttccttcacggtgggtatcctgcaaatcataatcagaagttccatccttcgtatgtatttcctcatttagagcagtatcaactgtcatgtaggtgccatttttctcttcccagtgagtgtcatgtatattaccctcaaaatttctttccctgacatatacttcattactggtagttgttttatccaagtgctcctcgacagcaacagtctcaaccttgtcaatcgaacagtcagtaatggaaatcttggatttaaaggacaaagtttgttgattctctccaagaacaagaacagcaggttcaccataactcaaaagtgctccaagcagaagtgcagttaacaggaagactggagatgaagacagcaagaagttgaatagagaagggcaaagcctgtgtagaaacagcaacaaaacgccagcagctagtactatagggtaatcacaagcaaattgatatccaattctgacagatgaatacattagtctcttgatatgcaacacaatgtcatttgcaccaaaagccatatatatcttcttgaattttaccctcagataaaacgttggcctggaaataggaaagagagaagcaattcatcactataacattatggtgaatattcaaacaagtaaagatttatacttgaacaatagcggccgtacagctcttagcctccatggcagctgtaattgttgtactagtttgaacctcttcccaatcttaataaacttcagccgcgtatcttacgccagcccggcgaaaaaaaaaaagatttatacttgaaacacaagtttaataatgtgcaatacaatcaaactgctcaaataaggtgacattccagcttccttagttagagatctatagaaattgcatgttcaaaaaaaaaaatcatctgcaatggtttaacattcaacaggtaggtggaaaagcaccatctctttaaatgttcagtcagttatcacaatgaagatctctgaattcaacagtatttttgggctataattgtatactatcaacccataaaagagaggaaagtaacaaagaaataaacaaaataatctaatcagaccaaaatcaaagcgaatttacagatcatttagaaaaagattggacgatcagattcacacaagaagctaaattaggagccacctatgaccacacaagaggctaatagtggagcttagcacaagaccagattagcagtagaacgcaaaaatgcacagaatgccaagctcacctgtagcgacaacaccgagaagccaaagccctcagtagcctgaagcaagtgttggtagaagagtggaaaagggaagggggcaataggaaggcaacctcagcaacaagaagcaatggaagaccaaataaaggagataggaagctgcagtgctgtgcttgcgccctttttttctaggattctttgctttggagtaccgccatgagagagaagttttgtagggaaagtggagagcaatcttggtatctttagctgtcactctcacttttaagtttcacctcattcgttgcacacagtcttcactccctctagaatctggctattttaccagacctgtcaaagctattactgtgcctgaaacaagttagatgtcagtatttccccatcggtggaaatgcttggatagcagtcactgaaatcgtagaagctccctctgtacccgtagaagctcatccatcttgttttcagcttccaagctgaatttacaggcgcaagcttagctcttcctttgaacatgttctcataagcacgggacaagtacaatgatagcacataatgtgctcaacttttttctgtggggagaaagcctgtatggatcaatgcatgcgactgctataattttcttaaaaaaagcacaagtgaatagtgataaagaaagaaaaagggacaacacaactcagctcattttagtgatcagctgtacaataaagaaagcacgtttatggaccacaaaagttgtaagtaaacaatttgtcgtacatctgtactatgtgggttcactttgtggactccaaacattgacacaccttatgcaggtcaaagaaacagattttacctccatatgtaacagtctcatttgcgcattttgccagtgttactgaacccaatcttgctgccatggaaacacctgcgaaattgtgaccaaaacctgtaaattcggcagtgaattcatgcgatttcagtcgggtggcactaggagaatctgacgagccaaagcatcatgtcaaaaaaaaaaaactgaaccaaagcagcagcacatggcggagcgagggactcactgagtcactggagccaccgaattttggaactttaccggaactgaatctagtgccctcctcagtgtcctaatttcctcaataaatcccacgagcaactcaagtgcggaacgcctattgtcaaatctatggtacattggaaccgagaggcggaggaagaggaggagaaagaagagtctttacctgatgcgcggcaggggcactccaatggaagcaaccagcagaggggcggaaatctcgggtcgaggagaggggagaatcgagatgaaacttctccttgacctcctcgcattacgtttccgttgaatccatccacgtgcggcgtccacctccgtggctccgcccgcaccgtcttcgccgccggagttgcgccggccgccggagttgagagcgaaggcggcggcgccgccgctcgcttgttgggtagccagtttgggtcgggcccacagcatatgacccgtttcgcaaagttggcccgtttaaacattcagattaaggcccaaaagcccataaatatgggtcgggctgcccagattttgaaggcccaaaaaaagaagtgatacgaaggagtgtctctaatctgtgccgcatattcttaatcggacgtctcacggagatcctaaggagttcggagttttcttctccgaacccctctgtttatcaattccatcatgtttgatcgccgccacaagacgtctccgctttgagaggatttcacaggcacccgaggattctgaattctgatttctatcgtgctacttgcgaactatatatatccgcgctctgccttctgaattcgatgttctggatcttgtttcttgcaggtcaggtggcagtgacagtttattacagacatatccattgatattcagaaatattcagactctggaagaaatttggagtctcggaccatgaaagtcacttggaacggctgcaacttgtagtgcccgattagcttatggtcagacacaatttgccggtgctgtgtgtgcttcatgagctagactaagcaggtgtgtggaaattgaaagtggactactcctgttacgcagtggatcagtaagcctaacaaggacaatcaactagacttcttatgtatggtctctctcatctcatctgctattcagttggggggaccaattcattcatagcttcagtaccaatgtgattcagaacttgctctgtatcctgacagaaacacaaacagcaagggatggaacaagtacagtcacacactactgttcataacagaaacaggtagagtgattgcattacgttttggcaaagcaacgcgaaaacggaatgcatcttgaagcaaattgtccacgtaatgctagctgctaattaatgatcatgcatgtgtgccatcttgaatcatggagaagtgaaagagacatccgaaccaatcgatcaaaacaggcaggaaccggccatttgactcacgtattagttgactctcttcacttgagacagtagcgtgttgtatggtgagctcaggaagctgacggcctaacaaagacatttttttacttgacttcaccagttgatacacgtacgtacgtggctccgtttttgcttcagatttcagcaggtgcagcactgcagtgcagaccatttgtcctcgcacttcctcgcactacacgttcgagatgtagtatactactaccaactgttgaatttcctctctgaatactgtatgctagactagagtcaggttcttccataattttgatcaatgattccagccagtattccaagttgcctgaacctcaattttgattagcattacatcatcatcattctagacagtcaagacagtactgatgtagcagaaagaacttttaaagtttcagaaaatgcatgcctccagtcaaattttcagaaaaagaaggatcaatctagacagacaagacagaaagaactctttaggctctgttcgttatgaggagataggggagattgattatcgttttccacgtgcacgcttttcaaactactaaacggtgcgttttttgcaaaaaatttctataggaaagttgctttaaaaatcatattaatccatttttgaaatttaaaatagttaatactcaattaatcatgagttaatgactcacctcgttttgcgtatctccccaatctcctcaatccccttctcctcaaacacaccttaatcagctgactgatgtagcactagagcgtcatcaccattctaaaggtcggcaccatgaaattttctctggttttgactgtttgactccaaaagcaaaaggggctcattgatcgatcgcgttcttaatttccttgtccattggattactgaagaaacggcaacatatatgatcgaccaaacacccgtctgacatgtataacagtgaaagtccagccacaatctcttgcatgcatttggagcatgccactgtttcagcacaaccgaatgattcagaacatacactagctgtggcatatttgctactagtaagactatgctatcgaaattaaattatagtgtttgcaacaactctgcccaaggaagtggccaggaagaacacaacttgaaattaagctagcgattacaaatcgataaatccaagcagaattaaagaaaaaaggatgaaggagaagaacgctgtaattaacggtaatgcatgacttaagcagtccaaaacgatttgaggatactactcacatgtgtgcgtgacttgacgatgtaggagtagtattgtccaacagcacgagctattcaaaactcaaaagaggagtcaagcaagccgcaaagccaacagcctgcaagtacctgacattgacctggtgatgaaaagtctcagcttacacccaaccattttcacatttgccaacaacataaacaacgcaaagaaatgagcttgctaaaccttcctttgttggtttctgtacaagaaaaatgatggattaatgttacataatttgatttcgaaatattgctgaaactgaaagcgtccatttcattctttttctgcgcttactctgattcatgccaggtcaagatttaattaggttaattgcatgtatgagatgtactagttagtactggccgttatatataaacacggtcaaaattaacctaattaattaaacagttgaattgggaaaatatatataatgtaatgaatcaatgtttgaattgaacgaaatatcatatcaccatgtactctgtacgtagtttagaacaggggcacgcgattctgatctgacgacacatcaaaactatgggcacgagcgtgcgttagtcagttagttagcgttgagaaaattagttgaaatctctagcactagcttcttagcttgcatgcacgcgagatcacacctagtttaattggtcaattttgattcgcaaattctgtacgtctacgtgtacgtacgtacgtaagcacatgttcttaatttgtttgtattgtcgttcaatggtacatgtgtattctccaatcaaattgacctcatatatgcacattgtacgcagttgatgatccgtccatattgtactatctgaggagcgattagatcgtgtttgaaattcctgaaacgattagtataggactagctaggatttcagttcattaataattagtaattattaagttaggtacaaataagcatgtacgtagtactatatttgtaggcaactaaggacacatatcatcgatcactctctcttttcactcgttaattagctggtgatatcagagctgaatgcaatcatatcgttgttgtcatgttgtggattagtccaacaacataccaaactcttgtaatatgatcacttgtggttgaagcaaaattaaatcacgtttcaacacctaatgaggcaaccaaaagattgttttgcttcagaaacaaataatttgatgccaaatccccatctatatatgaatttcatttttaaaagtttgtctttctacgagtaatatatatattgattcttaaacttgggtggagttgtcacttaggtcaactaaaattaaaatttcaaaattgcacgtttaaatgcatcagcttggtttaatgaaccacaacaagtccaaacctcgtttgacgggaactcactgttgacatggcgctccacgcaaacaacaattttgcattcgctctcctccgtgtcatagcgtggccccctccacatatagtactaccccaaagcaccccaaaccctctaaatctctacctccatcaccttctccccgatggttagagttttgacggcgagggtaatgtcgcccacccacttgccactctcccttgcaaccttcgcttcgggggagaatgggagggatttggggggattccgtgtaggggtctaaaagcaaaattaccgtcacgccatgacatggaggagggtggatgcaaaattattgcctacatggagtgctacatcatcgatcaacttggttcaaacggggtttggattgttgtggttcattaaaccaagatggtggaattgaacatacaatttttatgtttaggcacctctgctcaattttaaatactggccatgtatctctcttttcctaaataaggttaaaccctaataattttaaggaaaagtaaggttatatatactttttttttcaaaactcttacaaaggaagatctcaaccatctgatctagccgattggtagttaataaaagtcaaaatgaagtcacaatttgccacgtagtttttataaagagtttgcaagtttttttttttacatgtatcattttcatgtaagaaagagtaaagacagatgagtttttttttcatgataatcatttttttctctctaattactattattttctaaatctatttgcatatgaaactttgatgacataatttatcattatatttatattaatttattgaacactgatattggtatccaaaccatacctaaaagattcatttcttaagaagaaaaatatcaaggggttatttctaaatttatttgaaaaataaataaaaataacaaaaaaagttgtccatatataggccaccccctcgtctcccctgaagtgtccgtccatccccagtcaagttcgccgcgcgcaacactcgcagcagagcatccacccatcgtcgatgctcaccgccgccatgcacatgctcgactcctccacctcctcctccccttggcttcctcccgacctcatgcctcccccgccgccgccgccgcccgccgccgccactctccaccaccacttccgcgccgccgccgccgcccccggccgccgccgcatcgccaagcgccgaccgcgcccgtcgcggcgccttcccaccacctacatcagcgccgacccggcaaacttccgccgcatggtgcaccaggtcaccggcgccgacgacctccctccccctcctccatcgctctctctacagcagacgacggagctcctcctcccggccgtgcacgccgctccagcgggctcgcccggcgctgcaggcgcgctgatgcttcccacgctcgacacctcggcgttcctgctcggccgccgcgcggagccggcggccgcggcgccgccgtgcgacgagtcggtggcgttggtaagaggaggagcgggtaattacggcagcaacaacaatagcattagcagcagtagcagcagcggcaactgtggtggtggcttccccaccttggactcatgggatctcctgtaaatctagatcatatattgtcgatttctatcgatttctgattcttcatggctgtaattaactaagacgagatcaatgaacaggttggagcatctatctacctgattctctgttcgtgtccttgttaattttaagcttatgcctcgtatacacatggatgattttttttatcagtagtgttattttattgatcttacttaatttagagttccttttcttttaattattaagtgcgactgttaagttcgttttgatcttccttctgctgattccagcatcactgcatcagcctcaaggttcttaatttatgcaggatttttgttcttgtgaaactcttttgctttgtttgattagttggctcttgcttttctattgattttgagtctttgatgaatcctccttccaacagtagagctgctccagcaccatctcactgaacatgtggtttctgatcatttggtgaacaaaatgtaacaaaagatgtttttttatattagtacattttagagaggtgcttagtgcattaattcagctttagctatataattaattaattaatgcaccaaaccactgtggggggcagtagcatgtaaatgctgcttagacagtaagatacgttaggatgaagctaacagttcaattggagcagagcagggttgagaatcagtacttggaaaagattgattgtgagatacaacaataataatatcgtaatcatcgagccaggtttttttagaaaaataaagtattgcaatcatatatgcacacgcatactaagactgagtttagatccaaaagtttttcttcaaacttctaacttttttatcacatcaaaacttttttacatggctgtgtttagtttctgaaatcggggagaagtttggggaaagttggtagtttggaaaaaaaattttgagagtttatgtgtaggaaagttttggatgtgatggaaagttgaaagtttaggggaagtttggtgtgaactaaacaggaccatacataaattttcaacttttctgtcacatcgttcaaatttcaaccaaactttcaattttgacgtgaactaaacacaacttaaggttcagcggaagagtaactttttttaaaaaaacctaaggcggaactttgttccacttttatatttagaagaagataattgacccagtttataaaaaaaatcggacccgaaaactacacaactgtcacggttaattacagaaaaaccagctaaaaaccaccgttacacaactaactttacattgatctaccagtaacatcgttagtagaagtgatattaacataattgtactattaataattgatgtgatagtataaatagatataattcattgtaaagagtactataaaacaccgcagggcggaaaatgaaaggaaaaaaaaagaaacaaattgggtgtggaatcaacatgcatgcttaatgggaagaaaaaacaaatatgaagtgtatttgttaaacacatatgtaggcttgatctagagctgagctgtttggtgcttacaagtaactacctctagattgcccctaaaatacaatgcaaaaagggaagttgacaaggaaaggactatatcaacggagaggaagaatcagaggcacgagctgttgactactgagtctgcgtgtgatttctttctcctcaatttgcagtgtacgtgtgctgtgccatcaacaagtgtggctctggctagcacttagcagcccctggtcctgatgagatgatggtcaggcagtcggtccaaaccgccaaaagtctgggtccgttcctggacgatgttaacacataggagtacaatacaaaccaacggctgtcctaattacttatcgatgtcgtttaccgtactactaataacttactaataatagtagaattagcatattttttttaaaattaacaaggaggagaattcatggtccagcactccagcatgccgctgttagtcaaaattcgcggctcctcttatgggttcgtagttcatattttcgtacgtactaccccttcccaaaatatgtgtaaatatgtgtagccatgagtaaccgtgcctaacgtttcatcatccgtcttatttaaaatatttttaaaaaaaatcacacataaaataatatttatgttttatcatctaataaaaattttaggacgaatggagtatatggctacgcagtgagagcgacaaagggatggatgttggccgccggccggccacgcaggaggggacaccaccattgcacttgcaacgatcgatgcaattgactgcttggtttgcctcctctccggtctccgctgccgtcctcatcaatcacttctcatttgtttgtttggacccagcatcccttacctctacactgcatgtgattcctcacagcccacctgacctgacctccctcccggccccaatgcttacaccatcattgcgtcatgctcatgtcataaatgaacatttttacacatcgctgcaacatcttcagaaaacggaaggcaatactgtgttgttcatgctaaacacatcactgtcggctcagctggatcaacagcgacccttgcttacacaacggagacaggaaggatgcaagcccaagcgaaaacaggcaccgactgtgtttgccgcagacagataagcagggtcagctggcgcacagcaccactgatcacgccgcgttggcaggatgaaacagtacaccactgcttcagataatgacagtttgaacctactcacttgacctctacatataacaatgtacaagatctcaacaccatgcgtttgcaggctcaggcatgccatcacggtgatatggttacttactttgccgccttcagtacagcaataccagtaaggaacacgccctagatatttcactaccaaagaatttctacacctcaactgttaggggcacaaaagagagttatgctcgccgggcatggaggtggagctcatactttagtaaactgcagctgggaaacagaggcaggctaaactgatggcgaagagtttgaagacggcgatggaactggaaaccagtgttttgatgcttgaaatgccaatggagataccctccctttttccaaaaaaaaaaaaaaaaaaaaaaaaaaaaaaaaaactgcagctgcgacaagccactacgtacacttctccatgtcgccaactataaatccgaatctgcctaaacctagaacgaatgcaaagagcaaaaattagtactgataaatgataaatctaatcaatgagtgagtgagaaatgctggaacatttaaacacaacaagaaaatcagattctaatccaggctgggggtttattgatttattttgctactagctatgtagaattacaagaaagaacagtctcatttgactttatccatttcttttgcctccagagacactactggttgttcctcatgagtaacaaaagaacaaacggcacctttagcaccaatcaacatcattttaaattgcaaaaggtacaaaaaggtggtttgtgtggctttggggaagtcaagctacaacaattccataacaagtccacatggttgttttcaggggtggcagcaaataagtccgggaataagagacactggcaaagagttattgtgcaaggttacaagaacaagtcaaagtgtctcacatggctggtgaaattgaaaacaacaggaaataaaagtatgctcagagatgttcataatgcctacaactacgtgtaatgaaatgtagttgatatcacctatatataaataaggaaataagttatatatatgcactatcaccaacgtacccttgttggaaaagttattatatcagacacccgcctcaacaaattaatatgagagcctgaagtaaggatatcatataacatatccatatatatataccatcccagattacctatttcacagtaacttctttgtgagctttaaatgatagaatcacgttccacgcaagggctacaaaattagcagcaagaacctggaaaaattagcagtatactaggtgagaacaacattcagtcatgctaaagcagacagaaagaagcaaattcagctccagagtacagtattgcactctaaaatatttcatgaaatgaaaatgtgaaagatttcaaagacctgaaatttttgtgggacaaagtaaaaattcaagaactgaaaaggtatccacaattgccaatttgcaatcactgatgataaccactcctgtaaaattacaactgaaaattagctagcagtaaatgagtgcacacacatattatcagggagatgagagaatcaatcagaagaggttcatgtcacctgcttgagctttggaactacaagagaaggctttccctccaaggtgacgagtaaactcataaacactccaatgaaaatgggagagaaaatgaactgaaaggaggagataaaaaaatatcaaaaaataaatacataaatgcataaaagagctagaacagaacaagcagcaacactctctctttgggggcagaagggaaaggaaaaggatatgcatatacctgatcaagtaagaggcgagcaattgcacctgacgcaccattgatcatcactaatttactcaagtacaagtacctgcatgtggcaacaagtaatgaaacaaacagcactgggcagagaacacatgctatcctctataaacattggttgttcagcataaataagattaccagacatgcaatgttggccccaccaggacgagtcccaaaaatgtgaatacaaacgttctcttcaaatctagctttggcactttatcaattgcgagctggagcagtaccaaacaatggcaacagtaaatatctcgtaagaaaccttaacaagataccacaataacaagaacaggtgaaatatcaaatattttgcccaatccatggatgcaacccagttggaatagacattgttttttaataatggaataggacactgttgctggagtaaagtccgttgaggaatcaaataatatgagttacagattagcataggctaaagaccgacacagttgagtaaagacaatatattcagattatggttgacacaggattggataaaaagatatggacctgaaatttgataagaccgtaacagcctagccagttaagagtttcacatcatgtcatatttagaaaacaaggaaactaaaagagtgcagctagggcagaaaagaaccataactcagtaaattgatttccaagtggtattagcaatggataacatttcaatgttgttttgaaggaaaattggtatgatttgaccatttgatgctaatgcccatctaagcacgcctggctatgtgctattgcagagtaataggaagccctctacaacaagagagggagactactggttcattgttcgtcaaccaattaagtagtactaagtaggctgcaatgtatggatgtgaaaatgcggcaaatagaaaacaactgcaagtcacctggcagatgaggtctccggtcagggttaggacggcagaggtaacagccttagtggtgatgggatgcttatcaagagccagcaggtacctgcaaatcatggcgcatttcagtaattttgcatttagataagagtattgcaaaaagcgaggcacaagaccatgtcagtgcttggccgcaggaggcaccgggaatcaggaagaggcggaattggatttaccaagccagcaggagacgccaatccatttctccttttgctccaccaccaccacctcctcctccggcggcgactccggcggcggaggcggaatcgcagcaggaggcggcatggagcttcgagaggcggacgcccttgcgcgggtggacgacggcggttgtcgccgggagcgaggcggggcggggagggagggcgaggcggcgggagtggaggagcggcggcgcggtgggcctcggagtcggaggggtggagcggtgcacgaggaggagcgggagggtggaggccatcgccatgggtggtgcttgcactgatgctgcaactgcaatggtgtgaggaggagcttgggttttgggtcgcactggactagggttctactagtagttgcaattttggggagaaaatgatgaggtagacgaagatgctagcaatggatgatgggctttgcatatttgggctctcggcttccttgttgggctcttggcccacctacatttatctatctatctattatattatattattaaaacagctttaaaagaggcaccacgtttgctgtgggggataaaaattctcacattaatcggagaaaaaggaaaaaaaagaaaaggagagtccaagtagaaatacaatataaaaatagatgaaattcggaattaaaaataattaatattgaaagaagtttccatataagtacccaatacgagaataatcaaaattcgaaataaaaataaaataaaatccaaaattagaaaagaaaaggataatccaggtaggaatataattttaaaatagctgaaattcggaattaaaaataagaaatattaaaagaagagtctatataagaacacaatacgagattaatcaaaattcagaataaaaataaagtaaaatctaaaattagaaaagaaaatgagagttcaagtagaaatacaatttaaaaatagctgaaattcgaaattaaaaataagcaatattgaaagaagtttccatacaagaacccaatacgagattaatcaaaattcaaaataaaaataaaataaatctaaaattagaaaaataaaatgatagtccaagtaggaatacaattttaagatagctgaaattcggaattaaaaataaaaaatattaaaagaagagtccatataagaatccaatacgtaatcaaaattcggagtaaaaataaaaataaagtccgaaattagaaaaaaaaaagaagagttcaagtaggaatacaatttaaaattagctacaattcggaattgaaaataagcaatattgaaagaagaattcatataagaatccaatacgagattaattaaaattcagaataaaaaataaaataatattcaaaattagagaaaattaaaagagagttcaagtaggaataaaattttgaaacaactgaaattaaaaataaaaaataaaaatattaaaagaacacgatacggtattaattaaaatttggaaaaaaattctgaaattataaaaagaaaaataagatttcaattaggaatataatttataaataactcatttgggataaaaataacgactattgagagaaaagaccatctaaaacacatgaccaaataaattaagtaacatgcttataaaggagtagagtggtggcggttgatacgatatataaaaactgttaataaaacaccaaatagaatcctaatgacaattaaaaggagggacgacaggcaggccgtcaaacaaacaagcaggcagttgccgggacttctataaagttaaaaaaaaccattgataatcaacgacaataaaaagaagaaggagcgagcggggtgtatagagtatagttgcagagccgccgatggttgacgggtcttctagaaaataaaaaatgaatttcaacgatagttatgttcgatttttagaatcacaatgacaataaagagtaggcggcaaacgggtcatagaggagcatagtgatattgtttgacgggacttctaaaaattataaaaaatggaacccaacaagacaataaactctaaaaactataaggtctaatttttaaaggttcggaacttctaaaaagtaaaaaaaaccaatgataatcatgttcaattttaaaatctcaatggcaataaagaagggagggagcgggcgagccgtaaaggagtacaatggcaaagccgctaacggtttggcgagacttcttgaaaagtaggaagtaaaaatgaacccaaacgataattatgttcgaattttaaatctcaatgacaataaagagaagagacggtggacgggccgtagaggagtataatggcaacgtttgacgagacatctagaaattataaaaacgaaacccaacgtgactataaactttaaaaactataagatctaatttttaaaggttacaagaagaatgaatagaaatagcggtagatcaagcaagtaaataaagaaggagatgacataaggggtagtagctggtgtgacttttaaaaactactccatccgtttcaaaatgtttgacaccgttgattttttagaacgtgtttgaccattcgtcttattcaaaaaatttaagtaattatttattattttcatatcatttgattcattgttaaatatacttttatatacacatatagttttacatatttcataaatttttttaataagacgaacggttaaacatttgctaaaaagttaatggtgtcaaatattttaaaacggatggagtatataattagaaacatatagatgataaggtttggtctttcgaaatcttaagaaaatgaggtagctatttaataaattttaagtaaaatcatagtaaaaaatatatgttttgtttaggtgctagtttaggtctaacctaactgtgcccatctcgccggcgccgcctccattcttctcatcctctccactgcggcgcggcggcgcggcctcttagcgccatttcctcctccacttggaagcagcagaagcggaagcccgtcgcccgcctggctcgagctcaaggccatggagtagtaagtaccaatcccttgctgtccattgctacctacctgtattttagtttgcccctgtatttctgtctctgtacatgtctgattgattgattagcgaagattttcatgtgttctgtcccagtgatgagcagtttagtaatctgagcacttgattcagttcagttggtgctccctccactgcaatatgctgtgaggttgaaggaaccgatcgatcgataattccatgtgcactgttgagaataggcattctgagggacagacatgattcagtttagtttgcttcttcgtattttagattagtgttttaatcttccttttcatttcagtgtgattcttggtgttaaatacttttgctggtggaatggagttggagcctcagtccaggctttggttttccctgatcagatccagtcctaattgcttgtttgtttatcagttatgatcagtcacttgctctgacgattcggagggaggatgaatagcggatcacaaaacgagatgattgattcatgtgagatccaagcacccatcttgagctgtattttctttagagttcttgacggtctggaatcctaatgtgttctctttccatggaaaatttttgggcatttcagtttcagagcggcaaggagccaaggatgcagcagcactagggtcctagtccaaattgtcagctgggggatcaatggcaatggcggagacggtgaggctgcccgaacagcagcgtcgcaggcctctcaccattgccagcctccctgaagaaattatgtcggagattctgctcctgctgccgccaaaatccatcctccagtgccgtgccgtctgcaaggcctggcgggacgtcacctccgaccgcgccttcctcctcacccaccaccgccgccagcctccacagcgcctcctcaccttcatccgcgacgtgggcagtcaccacgatgacctggatatcctggactactgtgttgaagccgttgacttccgcacacaccagttccagtctctggcccggttcactggccaagattacgactgctcactcgaagacagcccattcaccgtccacgcttcttgcgatggtctcctgctcatgtcctacaacaactatttgcatctctgcaaccccactacacgtcaatggctttgggtctcccccccggcgcttcaacatgacaaggtcgtggggctctatgcacatggacatccttccgaataccgagtattgtactatcgagaatttggtttgggacgtacattctacatcaccactgttggctccaggaaggagaggcgcatttggccacattcatcatcagaatccctgagaaagtggttgacaaaagggacagaggatactgaattcaacaagcctttcctgtttcatggaaacctgcactggttgccacagtcaggtcgacaaaacaagatagtggtgttcgatacactggatgaggcgtttcggtggttgcatgtacctttcaagatgcacaatgtgtcctcattactcgagattgagggtagccttgccatgtcaaacagccatattggatcatcaaaggtggatctttggcttctgcaagattataagcatatggtatgggtccacaagtatcgaattgaattgccagtgatagagattcgccgtttagtagaagatgatgtttggtttcttcatattgtttcccaagagggtgatgtcttggttgatggatcttattggcagtttcactacgacatgaagggtaatttgctggagaaatttcaatgtagtggccgcatgctgaacattactccacatattctccaagaaagtctcgttccacacgaagtgttccaaattctagataatgaaagtagacatgcaccacatttcttcagggggttgtagagcatactttctgtactgtgaggctatttcacacttttgggcgtctattcattggatactgcaattttagcgatggaacttaattttgtagtgaatggtcaatgatctgttgttgcaaagggcagcattcactctgatcagtatttctgtacctccacatgttcatctttaacatcgagggtatcatttcagtactgtacgtgggaaatttaaatgcctgagactgttttttcctggtttgtggaagtctgagactgaacagttgattatgctcgttgtttatttcaacatcgcaagatggttacttccttcgtttcacaatgtaagccattctagcatttctcacattcatattgatgttaataaatctaaatagatatatatgtctagattcattaacatcagtatgaaagtgaaaaatactaaaatgacttgcattgtgaaacggagggagtactttttattggcttcttgcaacttaattttgccactctggtattgaaaggtcattgtctacttgtgttggtgatgcgtatgtctgatgagatccttagtgccatttattttgagtttgttgtgtcttgctggaattgttgggttacattccctgtttgaacagtgactctggaattgttgggttacattccctgtttgaacagtgactctggaattgttgggttacattcccagtttcaacagtgactagtcatgaactggatatcctagtcggtaaggaggtcttatagtgactcaacttgaatttatgactgcaccttcactgggctgctggaatttcctcaacctttgtgcttgttgcaggaaccgaattaccagattgatgttatctacggagtgatggaatccaagtatccaacaggaacaggtcctattaccatcaggacccagaattataacatgcataataaacacgaaacaggagaggaggcagtatagtcaagcagtataattatattcttgagattgattaattatcggcaactagctggcttaattacttgcactcatccaagtccatacaaaagatatacagtaccatttcagctttttagcccatcattcgcttcaactcaaccggcaactgggcttaatttacggcccaaagactggtccaatcaaaagtgaactatgacgaatgggaataagtatatttttcatccctcatctcttgcccctggtcgaatcgcctccttcaatagcaaaaccgggtataatgactccctcatctttgaaaaccggtgcaaatcgactcttttggtggtttcagaagcggttttatcctacgtgacacttgtgggacccacatatcggtgaaaaaataaaaaaataaacaaccccacatgtcagtcatcctaatctcaaccttttttttttctcaccactctctctttcgtgttctctctctcttgtcggtggagaagaagctcgactactacagcggagaggggcgcccgccgcaacagcaggagggggggaggaggggcgcgacacagagcaagcagtttccgaggaggaggacgcgaaaccgcgtgagcacatggcaggggagggaccgatgggtgggaggacgcggtcgccaccgcaacgtccttctctgctccttggctcgtctccacggcgtcattccgtgcggggaggagctccaatgtgatgggttgctggtgctgtggggacgacagggtggagtctatttgtgcatagagtctatttcaagaagaagaaccggaggaggaagaggtagaagcatgagagggccgacttgttccacgacgttatcgcgcccacgctgcagccgatcacgcacgtggagaggacctgggcggctacggcgtgtgcggagaagagaacaccaaccggctgcgcgtgagggaaggagccgcctgccgtggcgcgcgtagacaaaggagctcgccgaccactactccgccggcaaatagagaacgggagaggtgaggaaaaaaaggatgagatgttttttttttcattttgctcttactgatatgtgggtcccataagagccacgtaggataaaaccgcttgcaaaaccattgaaggagtttatttgcaccggttttcaaagataagggagatgttatacccggctttacgattaagggagacgattcaacaaagggtaagagatgagggaggcaaaataggcttattccatgacgaatgcttctctccccgtagcagcccaggtgcacatgggcccagcaaccgcagccgcggaggcagcactcgcccgccgcgccgccgacccgctgcccgcgctccgccgccgcgacgcgctcccgctcccggcgcgcctcttcgcgcagctccacgctctcgtcctcaccgccggcctcgcgcgccattcccccaacttctccctcctcctccgcctcgcctcccctctcctccccgtctcccaccgcctccgcctcctcctctcctccccgctcccgcccaccaccttcctcgccaactccctcctcctcgcctcctcctcctcccgctgcctcccctccgcgctctccctctacgccctcctcttcctctcctcctcgccgccgctcctccgccccaacgccttcacctacccgccgctgttccgcgccgcgcctccggccctcgccctcgcgctcgccacccattcggtcaaattcctcggcgcccatgctgcctcctgcgaccgcgtcctcggtgccgcgctgctcggcgtcttcgcgcgctgcggcaggatcgcctcatgccgccgggtgttcgaccggatcgcgcaccccgacctgccggcctggaacgcgctgctctccgcctacgcgcgtcttcgtgccagggacgtggcctgcgccacctctgcggcggatgcaatcctcgagctgtttgtgcggatgctatccttagccattgaacccaacgagatcacgctcgtcgccgtcatcggcgcgtgcggcgagcttggcgctgtcagccacggggtgtgggcgcacacctatgccgtgaagcgccggctcgccgtcaactgcatcgtggccacggcgcttgtggagatgtatgccgggtgcgggaggctggacctggccgagcaggtctttgcagccgcttcggacagggacacgcgctgctacaatgcgatgctccatggcttggcagtccatggccatggccgtgctgccctctccctgttggacagaatgcacggtgcgggcgtgccggtggatggcgtcactgtgctatccgtgatgtgtgcttgtgcccatgctggattggtggatgaaggtctggactacttcgacagaatggagatcgaattcgggattgagccaaggattgagcattacggatgcatgattgacatgctgagccgggctggtcgacttaacaatgccgagaagctgatccacgaaatgctcatcgtgccaaatgccgcgatatacaggtctctgatccgggcctgtggcattcatggcaagctggagctcggtgagaagatgatcgcagaattgatgcgacttgaaccggatgacagtggaaaccatgtcctgatttcaaacttctatgcgagaacgaaccgatgggaggatgccaagaaggcgaggaaggagatgaagtccatgggcattgacaagaaccctggatcaagccttgtagacatcaatggagttctccatgagttcttggtgggtgacaagacacaccctgcctcaaaggagatatacaccatggttgaggagatagaaaccaggttaatcgagtgcggacgccggtcgagcacctcgtctgcgttgtttgatgtcgaggaggaggacaaggcggatacactgtcctaccacagcgagaggctcgccattgcctttgctctgatcgcttccaatccaggagctcccattaggatcatcaagaatctccgggtgtgtgccgattgccatgagagcgcaaagcttgtatctcgggtgtatggtagagagattgtcatgagggaccgtacccggttccatcacttcagagacggggtgtgttcttgtggagatttctggtaaatactcgttgtgttgtattgtacattatacagtgtaatgtgctgtagatttctctcataattctgtggtaatgggatgtgctgtactggtctcacacatttgctcgagatcacaggctgtgtttagttccacgctaaaattgaaagtttgaagaaattagaacgatgtgacagaaaagttggaagtttgaagaaaaaagttggaatctaaatagggccacagttcattcggttgtagtttgcatggttcaatatcagtttttttttacaatcattttattgatgacggatcaagtgttacatggcaagtggtcaaagaactgaaatgaaattccgaaacttggccgtcgtagttcaatatcagttgtcagaattcaaacagttgtagtttgttataacttgcgcaattcgtgcatatgtggctagatagttcatatgaaaaagaattatttcggggcatatgtggtctattctttctctagatagttcgtatgaaaaggaaggaaaaagtataaattacccctcctccccccccccccccgaactatgacggtcgtccgaattaccccccgaaccacaaaaccggacattcttcaccatcaactatgcaaacggggcgaattacccccctcgacccaatccgcggtggttttagtctcgtggcgtacgcgtggcagtccagtcagcattttatttattaaaaaaatatgggacccacctgtcatactcctattacactattcctttctctctcttctctcactctcaacatctctctctcactcttcccctctctctctcctctcactgtgaactatgcaagcggcgggcggaggaggcgaggcgaggcgaggcgtggcggcggcggcggccaggtgagcgcggcggcgggcggacgcagagctagtggccgtgccaccggcggtgatgggtggacgcggaggcggactaggcggccggcggcggaggcgaggcgcccgggcggctggtggcggaggcggcggacctggcggccggtggcggaggataaggcggacctggcggccggcggcggaggcgccctagcggagctcgctcgaacggtcgatgacggaggcggaggcggaggcggagcatgcgtc

SEQ ID NO: 62730 - DNA, 28034 bp, Oryza sativa
ggccaccgccaccgggtggtccaggtgcggaggtcgtcgtaccacaacgtggtgcgcgtgtcggagctggagcgcacgctggacctgacgcgggtgcagacctacgtcatcaaccgcgacagggtcgtcttcctcaacgagcgcccgcaggcgccgcgcaacggccggtgcgccgccgccgccgccgtggcgtgcgccgcctgcgaggcgtgcggccgcggcctcctcgacgtcgccttccgcttctgctccctcggctgcaaggtcagagctccggccgccggccgccggccacgctcctttccttttccggccgtctccgccaccgtctttgccgtttttgggcctcgtccgaggagacgcgtctcgtatcatcagtgggttttgcgcttcatctggaccgttggattgggaaccaacggcccagatagatctagacgtgaggaagaaatgggaacgtccgtatgctgggccggtcagtcttgcatgggcctactcagcccaattaggaaattagcagctctctctttttttttttgggaaaaattcaaatctcccttttcaatttacttccacgcagtatgctccctatatagagcatcaccaacagtctatacctatctgattcccaaaattgattttaaaggaatttagttcaaaaaacagctccaacagatctcttactctcctacgagtttgttttggagttcccttttcccgatttctcgctccgtttatatacaggcgcgcggtctcgtgaaagtcgctcccaatctcacactcccgcctctctcctaccgttccagcgtgtgagagatagcgatctttctgcacgtggaaaaaaacagaattttctgttcgtagtttcagaagggtccacttttaagttttttcacttcctatttttattttaggaaacccaaaaataattttttggggagattatagataatctgttggtgatgttctaaacaattctctttaagttttctcacctctgtctagtttacgttgattcttcgtcatgtttagagatttctcacatcctgtgaatcttgagcatggtgagcgaagtttctcaatgtcttccttaaaaaaaagtttctcaatgtcttctcttattgggaatgggatttaatatacctttttcatatattatgtgatcgattgtcatttgtcgtgttttatcgtcacacaagctgtttaatttaaacatgcatgaaaaagtggaaggtggagggagaccgagggacacacacctttggtggcaaagaacaacttaacataccacaatggtcaatgaaagcccacggagtgtggagaaagtgttgatggaggttgaaagagaaaaatgaacttgtagggagtatttaattttgtacaaaattaaattgtaggggtgtaggggtatttagattttcctctctcttttttccatttttcattcaggcatactcaacaaaaccatgaagctagtgctaatcaattcaacacaccatcgaactcatatctttctctactctctagtgaaagagatttcttccatcaaatgaaagcatctccaacattgaaactcgaatttccatatacttttctgattatcaacacaccatcgaagttgcgtttagccgtcgtagtagtttcctagctgaagtttttgttttgctttttttttgtccttcccctacataggcatacctggccgattgtattgtataagaaaaactcttttttcttctattgacgtgcaattcatttatgcgttcatgaaaaaagattattaattctgatcacttctgattaactaactgaatcaccactctaatccatactactgaataatcttatctatctcctgttgatgtcagctgaaatgcatggaatcggatcctaccctgacattcaccatcgatcccaacaacatcccagagccacagatttcagggccacaggaagacgaggaagaagacgacgacgaagaagacgagccgttctacccaaccaaggcgaacgctgctcagagcaaggccgcgggcggcggcggctgccggccgccgccgccgccgtccgcgtcgtcgtcgcgacctaggagaggaggacgccgggtggctagaggcgacaaggaagaggatcaggaggccgccgccaacatcctcgccttcgccgccgccgcggcgcggtcggtgccggccgcctccgccgccgaccccaacagctaccggcggcgcgctaggaagggcgcgcaccgcgcgccggagcggtcgccgttcttctgatgacgatggcggtggcggaggagatgctcgccgtcgtcgtcgtcgtcgtcgtcgttgcatgctggtggtggtggtagctgcatgcgaggtctgaatcacccgatttttattttaattttttttacagagaatgggaacttggttggttaaattttctgtggtgaaattcgcttgcatgcatgtatgctagctacattttgattaatggtgggtaagaatctagacattttgatgacatttatcctcgagaatttgaatttcccgtgtgactgtgctatgttatgtatatcttagagcggaattgtatttgttgcacaactctgtttttgtctctacattaaaagtacatgtgttccatattcatttgtagaaaccaaaaacactaaaccgttttggttgaagggggaatagtgttagtattttttttccccaaaatttgctaaatctattatgtagtaatataatggatagatacgatgatgtgatagttctgtctcgtggggataattcaaaatacttcttttttttaagataacggctctaggtatgttgtgcagtgtagtcaaatttcttgatttcctatatgcatataattttttttctgcttgattgcatgctatagacctatagtattagttgggcaaaagaaagaatctattcttcctaattaagcagctagctacaagccaccatctaccttttgtttcctaagaaaaaacaacacaagattgtgccttttattaaatactccctctggttctataataattgacgttttggataaggttgaggttaaacttttataactttgaccatcaataactttaaaaatatctaatttaaagaaactagaaaaacatatatagatttgtctttcaaaacactataataaaagtaaacatgcatttatttattgtatatattactagcaaaaatgcccgtgcgttgcaacgggtaaaattttttattgataatatatgtttttcatgcataatcatgtcaatgacaatgtttctattttaatgagcggctttttttataaacattgtttttttttcttgcgcgattttctcaatccatttttcagaaatggcgcatttctttataacaaatttttcctagcatgttttatttttgcttattttactgacaaagaaaaccatatttttctcccttttatgcttttcttttctcgtatgtttttttgcctattttctcgcacgttttttttcttgttattttcgaatgttcttttttacttttttttccaatacagtagaatgtatgacgaaataaagccatgtagtagatggcaaaaaattgatggatcctatccgactcaagtgtctatcaatttagcttttttctaacagttttttcagagcgatttattttttagtagacggtgtttttttcgcgcggttttttaaaaccaaacttttagaaatggcacgttttttctagcagttttttttcctcgcatgttgtttttaaaatatttttaccgatgatggaaataatttttctcgcgcatttttttattgaagatggaagacctttttagcgtgttttttacgctttttttctgacttttgcctcacgggttttttgaaccgtttttattttctcattcattttttctttttaaatagttcgattagattagagatagagaagagatatatactggttagaactcggattttgtttcaccctttccatttttttcttgtgtgtattttttattttatacgaaccatttttttcgccactttcttaggaaatcggacgaactttttttagatgttttttcatttttttttcgtttttaaaggaattgtatctagctttttttcaccactttttttttttgccttttctatgaatcaattttttttccattcggatctacagtttttttcgccacttaggggaaaaatacttttattcttgttgtttttctttattttctttttttaaggctttcctttttcttttttctttttttttgagaaacacagtacgtacgcaggcgctcacaacgtgcgcacactcacccctatgaacgcacacacgcacaccctaccgctatgagcacatctgaaagactgagcctttttctttttatgcacctttctgcctttgttatctctcttttattatttttttaataaaaatgacctcaagtaccttattgcaagatattagggactcaaatgtaaatataaaaattacagggactcaaatgcaaaaagtacaaacccaaaaattaaaatcatataaaaatggaatgatctcgacttgtaggtttcatttttgcaaacagatcttcaatccggcacatcaattttttcaccaatctagagtcgaactttttttttggtttatgagagggaatcggatataggagtcggactttttattttatttttttcgctaatcagcccaaacgaaaacggatgggagtttgtttcctatttttgtggaatcggacaaatttttttcttttaccgcgtcgatggaatttttttttgatcggataacttttggttttttttcccttttttctgatcggacttctggtttttttggttttttttgccctttttttttggatcggacttccttttttttgtccctttttttatggataactttggttttttttttgccttttttctggatcggacttctttttttcgcactttttttttgcccggtttttttatcggataaacctggttttttccatccgttttttttgttttttttcgcccttattttctggaccggacttcttttttttgtccggtttatttatcggacaaacctggttttttctgcccggttttcacccggtttttttgacggacgatggaggtacctcttattttttaagtagtagagataatagaaaaataaggtcaaagatatatcttgtagagcgtgtcattgtccaaagcgttaattaaaatgaaaccgaagggagtagagcagaagaaaagccaccttctacttagatacacactcttctatttgaaaatatacacaagcatttctagttatgtacctgtattttataacggagagaatagtagggcttgcttcatgccgaagaatttattgaattctagacgatgacacaattgatttggacagtgctaccaaattccctgggaggcacgtccgcacgtacgcatgcagtagcatatgcccacttgcccaggctgaaatatacaccagattaattatcagtatttgttcgctgtcacagtttgcaacacggaatattaggcgcataatattttattaggcaaaacgtttgattaagattgctgtaactatggtaaacacctttgattaagaggatgtttggttgatgcctaaccttgatataactaagtttagactagctgtggcatggtggaataagcgtggtttagaaataatttgtcacaagtacggtatgcttagctctaaatttgagaacatgacgtgtggattccaaagttaagaaagtgtggtataatatatacaattgcggcagcgaaacaaatacatgcctaaaaaattgtggcatggctaaagtttggcgtggcaaagtgtggcaaccaactaaacaacccctaagattgttgtaactatggtaaaccactcctcaatagttctgctttgtagtgatattttttccattaagaagtcaagcagttaagtttgtccctagataagctcggtaagtagcacttgtttgaccatgtttacttacttgaatatatagaaaggcagctatttcagtcagcaacgaaaaagatacgcatgatgttgcagcattactcgatcggtctccatcactaactgatatgatcatgactggatgaccggccaagtaatcaggttattaattaattacagtagctgtttaggttctgatcagccagctgaaactaaaaggtcaatttcctgcatgcatgatcggtaatcagtactgtacactatagtggattagtccaaaaggccggcgctctggatagaacttagtttgatcttttccaagataggagtaattctagctaaaagaaaaagatcttttccaggatgtgatttgtctgtagaactgtataacaagctgcatgcgaatgtactgtgtcggaggggcgacggcaacgaattgaaagctaggattacgaggaagtaggtacgaggaagaaacccaaaaaaaaaaaaaaatcgcgaacacggaacccagaataatctttcgtgtaggagcgttatttagagcttacccctccgtaaaaaaaaaagataaaatcatacctacaatcctacacacatgtgtgtccaagttcgatcgtaggtatgaatttgttttttttttacggagcagtagcttggataattcttttctccacgaacaagattcggattatattgtaggggattggaagaattagtttcgtgctaaagttggaacacccttgagtgacaacaagcacgctcaaggaaggtacatatggttctcttgacatttaaaacttcgagtctcttgataaatctattgagatatgaaattaagagaatggtatccttttcagagtatatatcttcctattatggaagattttaaggaggtacaactactctaaaaagatctaattccttttagcaattaagaccgtgaaacagaattagaactacctgacttgtactccctccgtttcaggttataaaacgttttgactttgatcaaagtcaaattgctttaagtataattaaatttatagaaaaaagtagtaacattttcaacccaagacaaatttactataaaaatatatttaattattgatttgatgaaactaatttagtattataaatattattatatttggctataaatttagtcaaatttgaaacaatttgactttaaccaaagttaaaatatcttataacctgaaatggagagagtaatactgaaactaactaataaactaatagcttactcttaagaaaaaagctaatagtagttactctttcgtttaaaaatatagcaacctaataagacatacgtcttatgtcccaaataaatcaatcctatgaataaacatgaacacgcgatttattttgatagtacaaaggaagtatccatatatatgtaggtcagtgcagaaggttctaatgttgaaaacctaatttctaatttcgtccgggcttttcaaaattagcgaacggacgaggcaagaacgcggcagcgaacgcgacacggtagaacaagttccgagttccgacgcgacgcgccgttggcgcaggaaaagtccggtcaccccaccccactctctcgcttgggccgcccgcaacagcaaaccagcctagcgcccgcgctgacgcccgcagggctgcatcgccagtcgccacgcgggacggacagagtcactgccaggtgggcccccagtagaggcggggagcggccccgcgagctactggcaggtgggccccgccgttacttcactagaaggcgggttcgcattctgtgggaggggagcgtccgagcgtgtggtcgccgctgctgctgctgccgtcttcgtatgtttttttttttttttagccgcggaatcgtcagagctcaggcgctcacaccgtcacacctgacctgacacaaacgagtccacggcttttgtgttgacttgtctcacgtttttttgccttctggtcccttcacaagtgccattttgtggagccagacaccaaacaagaaggtcaaactgctggtgcttttctttcctcaattgcttctagaagcagtggggctgtcccgtacggctcagatatggctgccaagcaacgcgcatctgcgatatcgaatcagtgaaaattgtctacagtaatatagctacagtagtcgtggctgataggtagaaccggacccatatgttagcggcttctaccgcagctgcagtactgcataggatccatgtccgtatcgaacacatgatagtagtagctgtgacactgtagctaatacaggcagtcgagcagccgtgtagtagtgttggagtacattaactaatagcaagttaagaagatgttcatcttgttatcaaaattaatcctaccaagttttggtttctatccaaatttgacaaggtaacaatctaacattgataaattaatttatctccattaccaaattctggtaattttagaatcttcctctcacgcaaatttggcaatgataacaaaccaaacttaatttacacctttcaaccttaacaaatattaacaatgccaaaattcagcattaccaaaatttaaatttggtgcggttgatttagacatcaaagtgaagaaccctaagtgtatagtgctctatattaatagttacgtactttttccatctcaaaataactttttttagtctcgtttgtttaaaacaaggtaaaagaaaaaaaatcacatgtaaagtatattgaagataatctgatttgcagataagggtagatatgagataaatgtgaacatatttttaagaaaagttagagttcaaaaaacgaagttattttagagagtatggactagtaatccatcactaatcactcttaaaaaatatcgtctcgttccatgagcagggctattagtctcataacttacatctacatcatccagtcgactaaccacaatacttgaccaaaaaagtaaagaaaattattttctccataatttcccaagaatcaaggggcttaaacgaaacaaactcatcactttccccatttcgcactctatatatacaccatccatccattttcagtctacgcatccaacctccgaactagcaatagaaaattccaacattttcgccaacattaattcccatgggattgaagctttcttgcatcagccggcgacgcggctcgccggtgccggcgccggccagggtcatcgccgccgacggctcgctcaaggagctccatgcggccgcctctcccgccgtcgccgacgtgctccgcggcgagggcgagtccttcttcgtgtgcaactccgacacgctctacttcaacgagcagccgccggcgatggcgccgggggaggcgctccggccggggcagatatacttcgtgctcccggcggcgatgctcgggcagccgctgtccaccgccgacatggccgcgctggcggtgcgcgcgagcgccgcgctcgctgccgtcaaggcgccgcgccgccgaggggctcgccgcggcggcgacaggaagatgaagacggtgcgcgtcacgccgctgcgggacgagggcctcgacggcggcgacgtcctgctccacgagaagctcaacgagcggactctgggtgagttcccggcgtcgtggagcccgccgaagagcggcggcgagaagctcgccgcggcggcgcggtcgcggttgaagcgcgtgctgagcatcatccaagaggatgcataaatattcaattttttccacttcttttttggggaaacaattttttttcagaagctcgaagcccaatacatgcttaaagctttaattaatacttgctctgtttcagaatgtttcagaatgtttgacaccgttagactttttattacgtgtttgaccattcgtcttattaaaaaaatttaagtaattatttattcttttcatatcatttgattcattgttaaatatattttcatgtacatatatagttttacatattttacaaattattttgaataagacaaacggtcaaacatgtgctaaaaagtcaacggtgtcaaacattttgaaacggatggagtatgtttaattagtagatttagaaagaaaagaatactggggaaaaagattcatggatgaatcaccctcttgtatatacgacttcaatctgtagttgcaaaactacaaaaatgtaaaaaaaaagttgatctttgtacaatttttcctgatgtacatttcccagactctgattttctgctggttacatagaaagatggagaattaaggaattaattcaggctgtgtagaacagaagctacatggtgccagttagtgtcattttcctcgcgatcacagtcgaactttgtattatcctgacatcatttgcaataattgtgaaataagtgaaccccttgataatcgaaatgttcttaccaaatttccagtctgccttttactccaatccactccactcgttagacaattcccaacccagaaactattaattagttttcatatttgccatatcatatagatattatacatagaaactatatatatataatggatggtttcttaaaataaaattctcatccaatcatctcccttctctcttcttttatccacatattctcttgttttcattctttatacttgtgtagagatggtttcttgcataagaaatggtttcttcacctctttatctctctcattaaaatattatggggcggagggagtaactacctgttctaaaatatacgcaagcatttctagttatatgtttggacaagtgtattttgaaactgagagaatattatggcttgcttcatgccgaagaattgattgaattctagacgatgacaattgatttggacagtgctaccaaattccccacttgtcaggctgaaatatacactagattaattatcagtatgttttcgttgtcacagtatgcagcacggaatattaggcgtatcatattttattaggcaaacgtttgattaagattgctgtaactatggtaaacaaatttgattaagatttttgtaactatggtaaaccattcctcaatactcctactttgtagggacaatttttccattaagaagtcaagcagttaatttgtccctagataagctcgggaagtagcacttgtttgactgtgtacttgaatagaaaggcagctatttcagtcagcgacgaaaaagatacgcaggatgttgcagcattactcgatcggtctccatcactaactgatatgatcatgactgatcgaccggccggccaagtaatcaggttattgattagtactacagtactatactcactcacaacaaggtcaatttcctgcatgatcggtaatcagtactgtacactatagtggattagtccaaaaggccggcgctctggatagaacttagtttgatcttttccaagataggagtaattctagctaaaagaaaaagatattttacaagatgtgatttgtctgtagaactgtataacaagctgcatccgaatgtgtgtcggaggggcgaaggcaacgagttgaaagctactccctccgtcaaaaaccaacctctgagaagatatgatccctcctaatacaatgaatatggataaaaggcagattcgttgtactggaaggagatctctcctatgttggcttttttttggacggagggaataggaatataggcgatggagacgtaagtaggtacaatgaagaaacctataaaataaaataaaatttcgcgaatatgaaacctagaataatctttcatgtaagagcagtagagcacttaaatagagcttagtttcgatagttcttttctccacgaacatgattcggattatattgaagggtttggaagaattagtttcacggtaaagttggaacacccttaagtgacaacaagcaagttcaaagaatgtctgttcctcttacgtatgttgaaaaatctgaacctcttgataatgatctattgagatgtggaattgatagattgccaatccttcagaacatatacagtgtcctattatgaaatattttaaggaggtacaactacccaaaatatctaattcccttgagcaattaagattgtgaaacaaaagcagaactaccatacttctaatactcaaattaaatactaactactagtagtaatagctagcttgctcttagaaaaaaaacagttattactcattcattccaaaatataacaaggacgtacatatatggggtcagtggagaaagtacccaattttgaacatctaatttcgtcccaagtttgaacatctaattttgaacggacgaggcaggcaggaacgaacaacgaagtagcgagcgcacgcgctgtacggacgggaaggcagagaggatcgcgtcgctgacaggtgggccccagtagggaggcggcgaacaactgacaggtgggcctcgcgcgccgtgccgaatccccccacacaccactgggttcggattcgcattctgtgggaggggagcgtgtggccgctgctgctgggcgctgccgtcttcaggtttgttgccccgcggaatcgtccgtcagcgctcacacctgacgccactcgatcggtggcggtttctgttgacctgtatcccctttttttttttttgcctactggtcccttcacaagtgacattttttttttttgcctgctggtgctggactggaccggatgtgctttttctcaattgcttctggagtagaaccagttgggcagttccgtaggactagtgctcagttcttttttttaaaaaaaataaattacacagtacaacaacgcagttgggaactaatctctcacttgcaaaacaacgtaactcacgtatatgattaattaaatacggagtattatctattttatttttaaaaatagattaatatggtttttaaagcaactttcgtatatatattttttaaaaaaaattatttagcggtttgaaaaatgtgtgaaaaagagtaagctgaagttggaaaagtgaacaaactaacccagcctcatatggatgcctagcaacaagcatctacagggtcgaacacattactagctatgataccgtgacaggcagacgaaccaccctgtagaaggatcaacatcctttgccgtcactgcaccgtgcctttgtcactgacatgtgggtccgatgtgtcgtcgggcccatacgtcagtgataaaggcacggtgcagtcgactgcaaaggatctcaatgccctgtggtagtgtatagtactatatagtttgtttctattctttaccggcgttatcttttgatgatgaaagtatatactccctcagtacctaaatatttgacgttgttgatttttttaaacatatttgaccatttgttttattcaaaaacttttatgaaatatgtaaaattatatgtatacataaaaatatatttaacaatgaatcaaatgatagaaaaagaattaataattacttttttttaataagacaaatgatcaaacatgtttaaaacagtcaacagcgtcaaacatttagggacggagggagtataactatagtatactccttccatcgcaggataacatttttactcttgtgtgttttaaacaagataaaattttaaaaagaatcaaagtgcttatcattaataagaaagtagtactggtaaagcaagtatataaggtgcccggccgtaaagtatattgaaggtaatctgatttgtggatcgataataagtagaagataaatgtgaatttattttgggagaaaaagtagagttaaaataaagttattttagagagtatggactagtaatccatcactaatcactatatcattgggctagtttaggttgatgctaattttttctgctactaaaatttttggtaacttcaatagtgtcaaatgcatgtttggttttgataccaaattttatctataatagttcaaattcagtagttctatctatttagggtaaaaattgtttcaatccaaacaagctcatcttgttccgtgagcgggtctatctattagagcatccgacaaatatagcagatatcttaatttaatttatactggtttccaagttgtaattaagaattattcatatcaacactcatgatagtagcatactcccttcgtctcataatataaagaattttgagtttttgcttgcattgtttgatcactcgtcttattcaaaaaattttggaattattatttatttttttgtgacttactttattatccaaagtaatttaagcacaacttttcgttttttatatttgcacaagttttttgaataagacgaggggtcaaacaatgcaaacaaaaactcaaaatcccttatattatgggacggagggagtaacttattatattcagttatctcataaccttacttacatctgcatcattcagtctactaaccacaatacttgaccaaaaaggcaaaaagtaagaaattatgttttttttaaaaaaagtaagaaacttattttgttcatataatttcccaagaggaaaggggcttaaacgaaacaaactcatcacttcccccatttcgcactctatatatacaccatccattttcagtctacgcatccaacctccaaaccagcaatagaaaattccaacattttcgccaagatttcatgggattgaagctttcctgcatcagctgccggcgacgctcgtcgtcgcaccagccggcgccggcgccggccagggtcatcaccgccgacggctcactcaaggagctggccgtctcttccgccgtcgccgacgtgctccgcggcgagggcgagggccggtccttcttcgtgtgcaactccgacgcgctctacttcaacgagcagccgccggcgctggcgccgggggaggcgctccggccggggcagatttacttcgttctcccggcggcgatgctcgggcagccgctatccaccgccgacatggccgcgctggcggtgcgcgcgagcgccgcgctcgcggccgcggccgccaaggcgccgcgacgccgaggggttcgccgcggcggcggcgacaggaagaggaagacggtgcgcgtcacgccgctgcgggacgagcggctcgacggcggcgacgtcctgctccacgagaagctcaacgagcggacgctgggtgagttcccggcgtcgtggagcccgccgaagagcggcggcgagaagctcgccgcggcggcgcgttcgcggctgaagcgcgtgctgagcatcatccaagaggacgccgagtgaagatagatgaagattcagctttttgtcccccttctttttaggggaaacaattttttcgtattttttttcagaagcttagagcttaacacaagtttaaagctttaattaatttgttcaatactagactagatttagaagggaaaaaaatacccggggagaagagatccatgcatgatcaccccttgtaaatactacttcaatctgtagatacaatcatacaaacctacaagaatatataaaagttgattttgtatttttatgtacatttcccagctgctatagattgcagttaatggaaactttcaatctcctgacgcactgcaataatcgtgcaatcagtaaaacactgacgatcgaaatgctgctactaacttttcagtctacccaataagaaactcaaacttcaattccactgcaaaaaggggattaaacagggtaattaacacctactgacatgcttagcatattaatcctccaatcctatgcatattaacacctacggtcatctctcagttgcttctagtttgggatgcggtgcttcctacctagctcttatcgggcgttgaggatcgtttcgtttggtgttggacgagtgatcagtgttacttggcgcgctcagcataacaggcattcttctttggctagcactcatttgcctgtgccaacctgctctggcacgcgaaaggccatgccaaatgcaaattctttcttcggtttgcatatcagcagcgttgctggacagctgatctttttcaaaagcgtggtattgatagccactatgtctgtcccttttgcgctcaggagtttgagacggcgaaccacattctcctcgactgtgtgttcccttgacagacctaacaccatgttttgtcacctgagggctggactgccctcctctccggtggcaatttgcttaaggactggtggtcgtctggtaggacttgcttacctaagcatcttcgcgcatgcttcgactccctagtcctactgatctcttggcagctgtggaagtaacgaaactctagggttttcgactcggccctttcctcggtttctgtgtttatagagtctatccactcggaaggttgtctgtggttttccgcaggcattacagcttttgagggtttgctaggagtgtagtgtggctccgtcctacctctcgtttgtttggagtagcctttgtttcgcaatagttttttcctttccttttaccttttggtttttttctttcttcacccccaacataggcctgtgtggccaattgcgttgtgtaacaaaaactctttttattctaacatattgatgtataactattttgcgcgttcgaaaaaaaaatcctccaatccagcccttaaaatcctaaaccaaatatagcctaaggtactaggaaaaatgtaagcaatttactcatgttgcagttataaattaactggctcggactcatttacaatgggcaaattgaacaggtttttattttctttttgcaataattttgcaatttagtcatttacacacacaattttcatgatttactgcataatatgatactatgatcatgcagtaaataatgaccttaaatattatcaaatgtagtagatactccaaccatcaagatttaaatccaggtacacataatattaagcacacccggttatgctattaataggaatttagcgaggtcatgaatttgacattagcttctgtctctttgcgcaagtgttagaatacgtttttgcagatgtgggtgaaaataacacagtattttaccaggttaccacctcatgagaatctccagtataacgataggtccatcagtttgataaggacagtttggtctcaactcccttttaattttattatccttgcattttttacattctccagggaagaaaaatgcactagaagattatattctactccttttcagatgccgtatgcatcggtgctctctatttcccgacgagataagtaaaagaatcggtcaaaatattcaccagaaagagagtttcttggaaatttcaagccactctggtcttgctaagggaagtgccaatctcgggtagtaattaacgacccctaagtacggtaatcaacacaaaaagattaatttattgtactgatctccaaggagcgatgctaattgagatgatgccagaaacgtcaaaattagaagcagataggaagaagtcatggtcagtgaaagcattaacaaatgacgaattaatttggcaatcagtggccgttttatccactgatcagtcaaagttcgtcagttagctatgcccccagatcgtgttgcaatcaactgttttggtgattattgtatgaaatccttgctttacttgatgactaacgatgcatgcatgcgacgactgaaagactgatggcgtcaatgattagatcagagctttgcactgatgaaggcttcatctcggcctgcctcatgtggctaactaatggctatacacctactttaatcttctgtgttaagcaatttcttgattgattatgacaactaccagctgcaattatgtgtcctaattccaaatgtgcatcgaggtaggtcgacgacatggatgatcctgtggagaaaaatagtggcactgatcagcttctgaaccttaactaattcagtttgtctcctcttttgtcctctgtagattgcatgattaaaactaagcaggtagcaaatgagtgaaaatagagagacggacaaaaggagagtatgaaagcttggattggtggtgtttggttggtgatcttctcaacttatcagcatttttctgcacccaacactctgaaataggaaatggttgcatgactgaccactgacattttttttaatataagaaggtagagcctatctaatagtcatttcattgaaagaaatgataagttataaagtttcatgaataaggggaaaatgattaaaggaagaggaaaggataaagagaaaaggagatagacttaccactgactcgggagaatactggaaaaattcagcatcaagtgtgggaataaacaagcatacgcgcttgtgtacctgcaatcagagactcgtaattagagccagctgcaaatatattttaaggagataaatcaggagagagaaaagtagcgggctacagatttgtagctagctgtagcacggactccaagtcgcagtatgtctatgacaggtgggactatatattaatagtgtggtatgtaactattatataaatgagctattagattggctctagatgaattggagctagtagttagctatactattgaacttgctcttagccaattggtcagtgtgtcatgtagttaattaatctagattaagatgtagcttgttcataattaagatgagagatactctaaaatcaagtgttctcaggtacaaagagtaggaccatcagactgaccaaaacttgtgaagacatgcctgcatcaattagcaaaagttctttaaaaatttcagttaggactgatgctgtctgaaaatctgtatacacacgaaagattagaagattaatctgtatgcacacatcatggatacgtacgcgtgatccgtcgacttacctgtcgaagcaaacgtgatagtcttgcttcttgaattgaaaagcatgattttacacaaagttgattatacaagttgatcagatacaagttgattagataagccatgggagtagtagttaagcactgttggtatggaaatggaattagcatgctctaagtcactttgcccaagttgcccaacaaccaacggggtgtgaaatgagaagtgacccattgttgaaatgaatccaaatgttagacaatgcaaaaggtgttataagatacaggattttcttcttgtttttttccctttgatttcagggaagacgaatgcacatgcacacacattataacgtaaataggccacacgcctatggacataagtatgatttctaaactatgtttaaagagacagaggctgctgtaaatccttcattttattaaatttatactaaaaatgtaccaacacgtataatatgaaaccataacggacgaagtcatacagacatgaattcacaatcaaatttattttctcaagataaaatgattttctaattgcatgggttgtcattaatgagtccaaattaataaatgcctaggtatggggtatggctatttcctctgcattaagtcatctcctttcctttttttttctttcaaaggcgtaaaattaaaactatcagcatattagttctctgccctacgaaattattagtactgccaaaatcagggtaaactatggcactactaaagaattggtaaggtaaagttatctaatgtatgtttggattgtgaccaatataaagccaaatttaatattgtggtgaataaacttctagaatgaaccaaataaaatatgggcactacgaattggttgacctcaaccaaaactagcacatttagtattaaagttataaaaaaattggtaacgcacatttaccatgtctatacgcctatagacatatagaggtttagccacaccaattcttactagaaaaagtgatttagctacaataaggttttttaatccagatgtgtcaattaataaagaaaaaaatatcctcaatgaaaattcatcagtgccctatcagtcccggcaaatccttaattaattaattatgcatcatctattttgttttgaataatggaaagacacccggtccaaccctttgcttttgccactctataaatacatcttcttcatccttaatccacctgcaaaataaaaaattcagactcaactctccttaatctcatcaaaaacacacacaaaagcacacgaaaatttcaatgggatcgaagctttcgtgcatctaccggccggagagtgacatcgtcgtcgagtcggaagctccggcgccgccgccgccgccggcgagggtgatcgcggccgacggctcgctgagggagctgccggcctctccctgcgtcgcggtggtctccgacgtgctcggcggcggcgacgacgcggcgtccttcttcgtgtgcaactccgacgcgctctacttcgacgaccgcccgccggcgctgtcccccggcgagccgctccggccgggggagctctacttcgtgctgcccagggcgatgctcggccggccgctgtccagcgccgacatgggcaggctcgccgtccgcgcgagcctggcgctcgtcggcgagaggccacagcggcggcggcgacaccggcaaggcggcggcaagaagcagaagaagaaggtgcacgtcatgccggcgcaagcgcaaagcagagacgacggcgacggcgacgtcgacggcgtgttcaacgagaagctgaacgagcagacgctcggcgtgttcgccgtgttcctgagtccggcgagaggcgccgcgccggcggcggcggcggcggcgaggtctccgctgaagagggcgttgagcttagtagaagaggaggcatagtagtgaggcagtaggaagtagtagtaggaatccgtttcttgttttgcgcaaagtagaatgaaccagtatatcatcctcaagtttggttgtactcacaaacaaaaaaaaaagagaggaagaaacaggacgaattttgaagtaaactaggccttgtttagttccaaactttttctttaaactttcaatttttctatcacattaaaactttactacacacataaatttttaacttttccatcacatcgtttcaatttcaaccaaacttctaattttgacgtgaactaaacagacccaaagatgaatgaattccttagctcaaaggaaatcctctctccgtttgcatatacttgacactgaagtacgattcatctcgaatcactcatgatttttaggggatcataagtcctcaaaatgatgatatattatcaagcatgttgcatcttaggcttgttccatacttggcttgcatcataggcttgttcaaacctttctcctgcgcacataaaacaacaaaacatgataactcattagcacataattaattaattattagctaaaaaagttaaacaatgaattaatatgatttttcaaagcaattttcctctatatttttatttttattaaaagaagtagagtttttcagtttaggaaggcgcatgtgcgtgaaaaatagtacggagtagtagattagaagttagaaaagcttagctgaaaacacacccttaaccgtgaaagtttctcctatagtagtctaaccatttaaggactattaaggctcaacgttaaaatgacgaaagtcaacattgcaacgcaaatgtaaacggaagcggtttggaacaaactttgtaaggccttgtagtttgatgaaacccatatcccggcccatctcgggagtattatttgggaagagattaagctaagtaagcatgtggttcaatcaacaataaccagagttagttagctgaatcttggtgggggaatcatttagtctaacccgctaaatcaccctatcaagtgttcttttcccctgattgtgctatcttaaaatgcattgctttcgattatacaacatcacggagatattaaaaaaaaaacaaattcaacccacacgctgaggtataaaggaatcaaattcagcagatgaacaataatggtactattcatatctagatttgtctttctcttttttcccaatgcatagtcactatactatacattatcattttttaaaatatttgtataagtatttatattaaacttttaaaaaaacaaaatatacacgagtgaaaattccctcaagagatttgaatccattccgtaaattcaaacgaaagaatcaaagaagtactagtactagtctcaaaaataatctaatcctaactacagatctggatatatgcgtatgcaggttcgtagatagggcgtgtgcaggttcgtagataggatttgtttttagacggagtagtaggtcggcttgtaaattgtaagccttgtttggtataaaagcccacgcactggcccatctctagagaacagggatgagcaattcgatggtataggcaatcatatttgtccccaaatttgcgaaaacttatacagaatcagtcaaaaccacctataatgactcaaaacttatacaattcgatcgtactccttctcagtcaagcatgtcaagttgtcgctgctgctcgaggacagtttttattcgcaccatcaattgcaacacaaatactattttcagctacaaattcaaaactcaatttgaaaaattccgatcttttcgcatcgatttgaatcgaatttgccaccgatttggttcgttttgctacctcccaatcagcgacgacccggagttgccgtgatccgaggggttccagtccaccgtggagccgtacaccgccgcgagcgagacgaacacctcgtccatggccggccgcgcggcgggctgcctcgccacgcaccgcgccgccagcgacgccacggccatggccaggtcgagcgggtagtcgccgccaagccgcgggtccatgaacgcgcgcacgttgctccccgcgtcctcgccgccgccgtcgacgagcgcctccgccgcggactcccacagcagcagcgcctcgccgttctcgccgtcgccggaggacgccgcctccttgccggagaggagctcgaggaggacgacgccgaaggcgaacacgtcgagcttgggcgtgatgaggccgtgctcgaggtactccggggagaggtagccctgggtgcccacgacgtggcgcgtcagctgcgcggcggcggcggcggcgccgtcgcccgcggggagcgcgcgggctagcccgaagctggacatcttgccgtggaggtcggcgtcgaggaggatgttgctgctcttgatgttcttgtgcacacatggcgggttggtgtagtggtggaggtagttgagcccgtcggcgacgtcgaacgccacctgcacgcgctgcctccaccccaggacgccggtggcggcgtcgccgccgtggagccagtcgctgagcgcgccgttctcggcgtactcgaagacgaggtaggtgtcgccgcggtggacgcagaggccggagaggcggatcaggctgcagtggttcacgcgcttcaggatgccgacctcgccgctcacgtcgccggaaacacgcttcaccgccgccgcatcgccgttgaacacgccgcggtacacggcggtgccgggcaccctccgctcctccgagaaccccgccgtggccttctccagctccgagtacttgtacaccgttagcgactccaacgcctcgcgcacttcgctcgccatcagcgacctcgccgcggacagcgacgacatcgaggttgccgtcgtcgtctgcttccccgatgccagggcgccgtactccgccgaagaggacacgtcgccgaccaccttccccggacgaacactttcttccccaacgccgcgtcgccgccggagacagaagaacagcaagccaaagacacccgccaacgcaagaacgccgcaaccgacgcctaccccaacggcgactcccttcccgctgcccgacccaccaggcggcggctgcgcccgcggcggcgcgggcgcggggggcggcggcgcctgggccggcggcgcgagcatgtccggcgtgggcgcgttcttgagcgggaccagcagcgtggtgaaggggtatatgatggagctctcggtgagcgtgttggcgtcgagcacctcctgcgcgtcgacgcggaaccgcgcggcgatggcggagacggtgtcgccccaggtgacgaggtaggtgaccatgtgcttgacgcccgcggcggcctgcggcggcgaggggcaggcgcagcggagcgggacggtgaggttgtcgccggcgacgaggccgcggctgtcgtggaggggattctgcgcgatgagagcctggcacgtcgagaggccctggtaggtgaggttggcgatgatgaagtaggtctcgacgccggtgtcgcggatggtgtgggaggcgttgtgctggtagtagccgcccggggagcagccgcacggcacgggcgcgagcacgaggcggtcggcggcgacgggggcgaccgggtcgacggcgttggagtcggcgacggcggcggcggcgacgttgaggaggtaggagatggagacagcggaggcgtagaggggcggggaggagcggaacaccaggtacgcgtcgcagggcgccgcggcggcggcggaggcggaggtggcgttgcaggtgtagccgagggtggagctcgcgttggtggcgtagcaggcgttctgctggttcgcctcgtactcctgctgcgccctcgccgcgacggcgaggaggagggcgacgacgacgagcgagagcccggcgccgccgcggcggattcggcgtggagtttccgccatcggcgaggtcgggggcggattggtctccgtctccgtctccggcgaggccttgtaattaagtggttgttggctgctgtcctccgctggtttagctggagacaagttgggtcaacggtgacgagtcaaactagtggcacatttttctatgtggggatgcagcgacggatctttgataaacttttcataaattttaccacgcggagtactcctattagtcatgaaatcgatgagtacttgcctaaacgtgtcgcatccggtacgtcgtgagctagtaataaccggcatagttttagaagttgatttaaaggattttttttgtctttctttttaattctcatttaggtaagaataaaagtacataaatgataaatcatacccccactatcacaaaatgtaactatatttttagatagtgctaaattagacattttaaaattaactattaataacaaaaaaaatataaaaaagattgatcaggtaaaaagtatctttatccttatccttacacaaggatggttcatcaaagtagtatctcgaaaatcgtgtaaaagttttaaaaggccatattttaggacataggaattgtatatttcaaattattttctgttttttaaattacgcgtcgtcaggtcattattagccgagtagtaaaacttgtttggaaataaacccgtggaactttatcactgtgggttccatttgtcactgcaacttcgcaaagcaacacaagaccaaatgggcgagcccatagtacatgggaaatggtcaaagaaccgaagggctagcgagtagtacgggggaaatggtcaacacaaagaccgtcccgttatcagtgggacacgcagcaacacggggatgatgggtttccacaggccactccagtccagtcacgtcgtgtgtgtttagttcacgctaaaattaaaggtttgattaaaattgaaacgatgtgatagaaaagttcgaagtttatgtgtgtagaaaagttttagtgtgatagaaaagttaaaagttgaaagaggaaatttggaactaaactcggtcatcgcccattttttccgagcgaattcaggttgcttcacgggacgcgcaagcgcaaccgcggaccatgctggattcgttcctttgtctgactgttagacttaaatgaagatggttgctaatattctctctatcctgaaatataataaattttaaagagatatgatacgtactataaatctaaacacattttagtaatatgaatttaaacacataccataaatctagacacatcctaatagtatgtatatgtcacattcctctaaaatttcttgggtgtgttttgctgcactccttgagctgcggtgcagctatctttcacagtaatgtgtgtcagcgtaacagttgtatggctgcattgcaatgactacaatcgtgcacccgaacgggacccttatattttgaaagatgaagtatgttagtccgaggacaattcgtccacgttttagtcatcacgtcgggtggaacattatgggccagcatatttgcaaactaaaaataatttatggataaaatttttatgtatgtgttcttagcgagctaaaagcaaaaactgaaaaataaacttcgatgaaaaaaccctcaaaatcaactctaattttaaaattaaaaatttaaattttagcagataagtataagtataagcgaaaagataagtaatagattagtgaagttcctttcagtcacagcaaatatgttagtgaagtgctaatcggtcaaccaagcactcgagcatactttggggctggtctagctcacgaacgttcgagatgagcggatttcacgaacggttttcatggcataacaatctcttcctgcctaattacgtgattagtatttgtttcttctgttaataaccaaatccatgccgccactatttgtacttacgagatttgtttgattggattatatttttttcgggaaaatatccggtgtggcatgatcatcattttttatttatattaagattaaagtgtacgggcagcccttaaacttataagggtgtatcatttaggtccctaaactttcaaaatgtatatccaaatcccagaacttgttatagtgtgtcatatgggtcctaaatcgccagaaccacttcaggatcctatgcggcgttgatgtggcatgccacacggacatgacgtgggattattttgactgacaaataggatccatttaatttttttattttttcttttttcttctcttttttccctttattatctttttctttgtgaccttgagcagaagaaaggaaaaaaagaagaataagaagaaaacgaaaaagaaaaagaaaaagaaagaagaaaaaaaaagaaaagaacacgtcacatccatgtggcatgccatatcagcgccacatagtatcctagaggggatgtgtcgatttgggacctagatgatacactttgacaagttctgggacctggatatacattttgagagtttagagatttatatgacacaactctacaagattaaggatcgccaatgcactttactcttatattaaagttaatacactaaattatctaataattgcaaatataaattctatagaaagtttatatacataaagtctacatagaaacttttttatatataaaatttatatattgaaagtttttatatataaagtctacataaaaattttatatatgcaaagtctatatattgggcttcatatatataaagttcatatatgtagaaagtcccaaaaaaattcatattaaaaagttccgttaataaaactagaaagagactaacaaaaaaacaaatatgaaaaaaaagtgaaagaaacaaaaaaatgttgatacgtatataggaggatcacgtgaaaagagaaaaacggaaaattgggaacagaacaatacagcttcctcgcgcatcctctactcctcgtggcgcgtcctctagtcctcttcgtccatatccattcacaagattcctgctgagcgaatgttcgctcactagtctttccgtacttatttgtgtccattcatttatctctgtttctgataaagttattggagatgtcgccatcgtcaaagtatacgaaattgatccgtggtgacctggtgggtaatcgggttttggcggttcataaataactactcgaattttattcaaagtttgcagaattttgccaaaatttaccaatgcgtatccaattgataacacagaaaactgagcggttaacatctgttttgcgaacttgtgtcagctactcacatgaccaggtgaccatcggtcctattcttttcaaattaagataaatattttttctcgattttcattaacatatttttcaaactgttaggcagtatatttagtgcgaaaatgtttttcaaacaatttttgaagtttaaaataaataaaactaaattaaatcacgcgttaacggttt

SEQ ID NO: 62731 - DNA, 8556 bp, Oryza sativa
ttttagattttgtttggcataattaagctcctatctttattatactttgaaaataaattagttatgataatatgttttttgtgctgaactatctttcgactaactagcaatcaatttaatacaaattgttgtcgcgtctgaaagggagagtggatcataacaattaacataatgtcgtgacagtgcatacggaggatcaatctatcccctccttaattaaaaaaaacatggatgaacagaagaatatacaaactgcttgttgaactatgatataagttgtcacttcaaatgtgtacatatatcggattctcttagaagataaggaaatgtcattttcatccatcttttacattgtcaatcactttgtttttttctccggtcagtccatgcattcgagcatgtgttccgcgcgtgtacgcttgcgtgggtggattggttcatgaaactaaccggcaggattaagaatttaagattgcccaattgacatgttggttattataattattaacccaagttgcttgtatttcttcttcttcctcctccaaaattcttcctaatttatttgtttcaaaggtatcgggtcagacttcgaaaccaattaacagaagggattatgagatagttgtgcatgcattcattatccatgtaattcgtccattctcaaatagatgatgttttagtatacatataatcgaatgtcgaaatcctaacccatcattagtaaatggaaaaaaatatacaacgattatttgatgtgtgaaatagaattagagaatttattatcaaaaaactttaacgtagctgtatttttttaaaatatttctatgggttatatgaatgtgtgagacagtattattgatatcttgaatgttttatgaaaaaagaaagaagatgttgtaagaacaatctgggttaatggaaaaagtcagagaagaagaaagtggtggtggtttcagattacagttgaatgagatgctgtcggccaggtcggctacaacaaacaggcaaagccaaataaccttgtaacacaaaatgaaaacaagaagatacaaaaggtcagggagaacatatcttgaccttcttggggtcactacaaagatgatgctaattaaagtcaactctacaataataaacaggaacaatatatggtctctgcatttcacatggatgcatgctaaattgtgtctaattgtttaattattggattggaaaacccatgttatgattctgaaggaattgccttgttttccatggattttctgtgttctgataagttattccaattcagtgtatatataacgatcacgtacgagtcgatttcagaaaacagcaaatgcaataacgacattattgacctatgtataagagctctaaaaaagatgtcctaaataaaattgaccaataggagccaatctgaattgaagtgatcgatgtcgattaattaaccgtgggaatttccttcacaagcacggaaaattcagttttgtcctaattagggtcaagtcttggatcctgaaaaatgaaaagaacttgaccattacaaaagcaactgtttccaaccacaaatggagtctcttgtaataaagcgacggcttaatttgttcttttagaaattagaatcttctactcggtcgatctaagaaaatgaatatatatttcctgcatgctccttgaaaccgtgacaggaaaatgtaattttaagttaattactgacaaaattattgaacataattaatttcaaaatgttctgaaattttcggttctcttttcccatcatgccgtttctcatcagctagcgagcgtgggttttggagttgggaaacggcccacgggccagcgacgatcaggcatcagctctatgggcctcagttcggtccaaaattaggcctgtttttcaacttttttttttcggactgctagaaatttcaacaataggttgtccaaatgcggccttccagtgtaactaagggcttgttcatacccaattttggtattgacacctttggccattgtcaactttttaggctgagttagtttgtcctacgcataacttattagcacatgattaataaaatattagctagtttttttaaaaacaatagattagtatgattttttaaagcaactttcgtattttttttaaaaaaagatcgtttagttatttaaaaagcatgtacgcgcaaaacgaggaagatgagttgagaaatgtaacaacaaacacaaccttagcagtcggttgagcaatagtaattcccagctcttccccaaaaaaaaaaaacacaaccttagcaaagtttgatagtgttcgtatgaaaggaaattatctgaactaacaaaatttggaaaggtaataatgctaagagtagcttagtttgctacctaatcaaacattggtactgctaaattttgagagttaaaaatccgcgacaaaatgaactgccaaacaaaataataaatagctaatttcgatgcaattaaaataaatcagaatattttcgatgccacaaaattgtaactggaaacttttatatttctacaaaaagtataaactactcctttgcttgtcttttggcttattacccgtagccagaatttaaatttaaatatttaattttcaaactgattttgataattattttatcatggtttatttttacaatcatatgactataaaaaatttatcaataaattattaccagttttgatcgataaatgatagattaaaccatttgtttcctcatataaaaaacacagtttaggacatactcaatagtagagcctagtatgatctcttaaattatttagagataatatctttacaatataatagttgagacgacgaaaactcaaattttgtttattgttgttctttcttgttttttctcaccctcatgtaatcatgttttctttctgtaagtgctaagaatcaatattgtgctgttgttaactatatcaacgatattttgtttattttttttcacaaatatttctaattagcaaggttaatagcttatgatttaatacgggttgtacacttgtacatggccttacatgtgccatattttggccaacaaccaacgttggattgctagagctatcaactcttcttgccatgtctgaaactacaaaacccatttatcctatcttactataaagttatcccccactaactccttaagcttaacatgcaaagatgccacatcatcatctactaatccactaattaacaagatgtcacatcatcatccactaacaatcatcacatttaaacatcatgcaaacatgctatatatttatagtttttataatttaagagcttttcaaatacaaacatgttaaattatcattcaacacaattcacataatgtttcaatgtatatttttattatgttttatgatatcctatatacttatatagttcatcctcacttagttagtgcttaaatgattaatctatggtccaaattatctttctccttttttcctctaattaagtcatatcacatcaattatttttagcctttagatgattaatttacggtccaaactatctccctacttttcttctttcataaagtcataccaccttactttttacgtttgaataaccattctacatactatttaaatttaaattatcataaaccacattaatttacttaatctgatgttatctagttattttacacgttattttttttgttatcatattaaattcccgcagcaatgcgcggggtttcacctagttattactatgggcatatttggtgcagctccagatatagcaacatctctcttggatcttaagcctaaccaaacaatttcagtttcatctaaattggagtggagctggctagagcgctctcacaaaatgaactaggctaaataatctgcaaataaaacttttatatacgtgttcttaacgatctaaaaagcaaggttgaaaaataaacttcgatgagaaaacctcaaaatcaactccaaatttaacgttgaaaattcaaaatttggctaataagcataagcataagtgaaaagatgaaactgctaaaagggtggagctagatttatactgccccacaactttatactagacccaattcatgaagttaaatttagaatttaaagctctaacaaacgagtcgtttggttctataccaaacaaaattcccactataatggaaaacaattttaatataatctaataaataaaagaaaagaaaagaaaaatcacccgctcccctgcgatcccttctcgccatttccgcggcgccaccgcactccgccactctccccctcctctcctcctcctcccagatctcctcctcctcctcctcctcgccgccggcgatggccgacgaccccctcgacccgccgccggagccgcagccgcagacgctgccggcggtagcagccgcgtccccgtccccgtcccccccgccgctccttctccgcccccgccgcgaggccttcgagcacggcctcctccccatccccaagctcatcttccccgagggcacgctcgcgcacaccctcgcccaggtcaaggacaagctcgcctccgccgcggatggaggaggccgcgtggccgcggcggcgctcgcggaggcgctgcagatcccgcacgagcaggcggcgctcgcgctcgccacgctcgccgcggtgctccccgcggacgaccccgcgctggactccggcggcgggggcagggccgacctccgcgacgtgctgctcttcctctacatccagtcgtacaagcgcctcgtgccccgcgcgcacaaggactcgcccgccgtcaccgacgtctggccctccacctccgccttcgacggctacctctccgcgctctccccgatccaggtcagggatctaggcctcccccccgttgctttataattagaatttgggtgctcccatgattcctctgcagcagagaacaccttggatgtgtgattgcttagccttaatcatgtgcccaattgagcttagaacatcgccgtcgatttaaacaaggcggctgttgtgccaccttatatccttcatgttgcagctgatgctgccgtttatctgctgtcacaacaaaaattgatatgtgatgtaactcactcgagctataagaaatgctccacagtaaaaagtcgtgcagctctagatatatagtgcaaaggaagatcctagctgctgatacttattggatgctatggatggtaccgtatgctggggtcacttcttgacttcaatttaaggttatcttttttattggtggccgtcagaaatgaatggttggttgcatcaaattacgtatgatggttggacttgtatgctaacagtaaactcagaagcacacagactttgccataattgagcgaccagtcattgttgtgaccattttgttatagattcagtcaattgtatgtttgcttaattctttcgatttgatctggaaccatgcaaacctggtaatttcactataggcacaatattttacttccactcttttagctcaaatttcaaaatttggagactatggtgcattcaaatatgacttacaaaattcccagctgctaaacctctgtttcgtctatcagcaatatttttaaactgaaatcctatgccctgtgccttttctggtttgggtggtaacagtggctacagagggttagtattcatgcctttttgtataaagtttttgtaaaatcaagatttctcctacttattcaatttctcgtatttaaagcttttacgctaccaacctcagttacatgttaaaattgttctaggtgttacatttagggtcaatcccaatttcccttccccaaaccaacagatcaagcaaaagacataaaaacaccttctgttccttttgctaatatgagtcgtatggtacctccttcacttactctttatatttatattatttcgcagcttgtacgcagtaatagccgtcgattcatgccttctcaagctgatgaggaaattcaccagctatcttatctgcaaaagcatatggccaatattcttactctgttggccgattctgttgagggcgaaggtgatgattctctggtacgcagccttttctttcttttaagtttgccgagcttgttgctatttgtgatatccacttgattactcttctgtttgacaatttgtatcttgttttcttagtagagtgaagctttatgtgggaaaagagtgacagaataatgcatagcatgttctgataatggagtttatttgtttttctatatctcaaaacactagaatcgacccgtaaaagtacatctccgtgttggatgcctggaactccagggccgtgatcctgtaaaattatatgcaaacctacctctcagacaagtatacctctaaatatattgtgatgtatgagtatgcttttggtcaattaggtgttaacttcactcagaaggtgccctgcaaaaaaagaaaaaaaacgaagaccacccatcagtagatgttttgagatagcagattcttttttaaaaactaatatatagacaagcaaatataaaggtagcatatatttgacccagttagatatatctggcccaagtaagaactcatctttttgttaaatttaggatacatgtcacattgtcaccttacatttgagggcattttctgaaggcaattgcctttgtgcgtcctatttaggtttttattccttaggattctttgtggttgggctttggtagaccattacacttcagaatgtaaaataactgtatttcacaatttttgtgcaggtattgaccatggagacatttgaacaccttggatttctactgaagttctcagaaggaacacccttaagccaggcagccactttttttgcaaattctgatcctgacatgcctgctgcccctgtacctgctgcccaggttcatgattggatctcacagaatatatctgcttcactggaattctctaccgagaagtccatatcaaaggaagttagccagcaggttacttccgatatagacgtcacaatggctgatgccaatgctagtaatgcaaggaacagcacaccgactggtacaaatcctgcatactacagaaacacaacatttgtggaaggcttctccaaaacttctgttgtcaagcacgcgtctgatgtcaaaggacattcagtgaaggtatggatcatagctgcttaccataaactatttttggatgctgaaaagactacaaagatatgtcacttttcacatttctacatgtttgcattgtccactaaatcccccgggggggggggggggttaatgttgataaaaagaaccatttatgcgaatctagtttaaaacagtttcaagtgttttcatatgcttacatatcttgaatgtaataatttattctagtgctactcttagtacaataaagaatatgttttaatctctggatttccagtggagtattagtttgaaagggaaaaacattgttagccacatctgggtgattaaggagatgatggcttaaactggcattatttgggccaggatatgtaaaatgttaaaaccgaagcgaaaaatttagatagctatattttgggacgcggggaaataggctgctaagtagaattgggatgagaaaacaaatatgacaactgttctcatgatgaaaattttttgcagactccagcttctagctgtttgtgtcagtattatgttttactctatttcaagaaattcccacttctgtgttgtattgtgacgtagctgctttgtgtatttaattttgtgatcatggaggtgggactccacatttttggttttcttaacaaacagcttttgtaggttttaaattgccatgagtctgttatctacatattggcaccattgaagtacgcaactgtgtatggatgttctgatgctactgttgttcttggtgctattggtaaggtatggatgccaatcggtatatctttacaccctcctttcccattgttgcagaatattgattaatatattcctcatatttttctaagcaatttaaagagaaaaacccttgtatacacatcagttgccaccagactattttagctgcaccggatctgtttgagacttcaattgtgtatgccttggtatcacctgaatggtacatgagtgctgagtattttgtccaaatagaagaggaggtgatgataataataacaatagacagtgaaagatgtcacacattgttgtgtgaaccaaaaactgacatgctagttgctactcttttacagtcttttcctggaaaattcctatcaaatagatttaatcatgcgttgagttggactgttaaacataatataagataggctgtacattaacaaagaataaagggccccaagtggaaaataagaaacacttttttattgtcacttcaaatttgctgttattacctctgttctgctaaagtgctaagtacatttgacaattatactttatatgttttgtgttgtcaggttgttaaggtggagcattgtgaaagagttcatattattgcagctgctaaatggatttgtattgctaactgtcgtgagtgcatattctacct

SEQ ID NO: 62732 - DNA, 33488 bp, Oryza sativa
atctagcccaggtacaatgttgaagagggaatctgaactcttttgcgcggattgggtaaggttgttggtgatcaccgttcctgggaggtcaaatggttctatctgcacagaggtccccttcaaggttgcaccctgggtgtcaagctgccctgctgagtcctgagggtgtactctgaatgttgcgtggatggcggtatcagtgccatcgaccgtcggccgttcttgcattgtgagagagccattcgcgctcgagaggacgaaggtcttcccactggattcttgtgtgaaggtcaccagctgtgagttgtaggatgaagggactggagatatccagtctgaaattgcgctggtgttgccggcttctgcattccaatcaccagttgacaggccagctagaacaaatggcccgaataggattgcttgaagagatgcatattctggccgatcatctgatgtcacagcatagcagttaacattgagatgaatattctgactaaaataaatcacaatagttggtgtatgtcacatcgtcacagtttcatattcactattagcttatgattttttatgttaattgataattttcggttgaaatgtcaaacaattgtatgtgaactaagcaaaacacattgatgcatacttgaaaatagaagaaatttcctaaaagttgagttttgaccttttattgcttcagtccttagtgtaatagggaactgtagtgataaatgatcatctgaacacattgatgcatacttgaaaacagaagaaatttcctaaaagttgagttttgaccttttattgcttcagtccttagtgtaatagggaactgtagtgataaatgatcatctgagttccactgtttggagattgaaaggaaagaccctgcccacaaaacaataaagtaagaacttgtctaaaacatgatcaaggacgattgaaatggatatatttttttgttcatgcactcaaaagattgtacctggagacattaatcctaaatcgttgtcatttagagttgcttttgcgccattggcagatgtccatgatggtattctcacattcaatgtggcagactgaccatttgtctgcataagtagaatagaggaagctaactgctgcttctttcatctgattttcatgtaacatacattaaaagaaattacctttgcagaagtggagagtgaaacttgaagaaacatgtccaaagagctgattggctttagttgttgattaacagtaagcccagctgctttccagttataagcacttggtatgtactgaatgatgtttagcaccggtctatctcctttctcctcgaagtaaatggaatcgccaagtttcgaaaaggattctatccctgtaaatgaaatagaagatccataaagaaacaggccacctgataaattgcctttcaattcaaattttcacaacttcgaatgaaaacacaagcaaagtaatactaaaatcacggtattaatttgacaaactgttaccgcaatattttcatgtaaaagcagcagtgttaaataagcagaactcagaagcattttatttacctgtcccataacaacaccagaaggagtcatactttgttccccaaccatgataggaaaccgctttagaccgtccaggggcctgaggtagcatgtaaatcatcaccccgggatcagtccctctttggatgcttaaaacaccatttatcagtgccctttcataatagtctgcatatgataattcctttgtccatctgaataggttgcgagaaacctgcagtagattgcattgaacccattgagagagagagagagagagagattgaatgttcaggagagtggtttgatattgtgaaccttgagcatgttgtaggttgtgcaagattcctcattctcagtactcagagtatcagctaaacgctttggattggtcctgaataattatatagaagtagatagtcatacatcaaagagaaatatactattgactatgaattcagaatctagagtaaaattaccaaaattcaccagcagatgtgcccccagtagcatagctatgagaagaattgatggtatccatgaaaaacgttgcaatttgctgtttcatgagaattatgattacaatcagcttttctctcaaatgatgttagtgaaaagaattagaaagaaaaacagatagtataactccagtaaaaaacagcataaaaaaactccagtaaaaaaccaacacatggctttgacatacagctgacaaaaaaagggactgcatatggataactacagagctaataggtaatgaaaggtataatactgcccaaaaactatagtttacctagagaaagcatgggttagcaagaaatatactattttccccggattatgctatcacacttccaggcccatatctggaaatttaccaatatcagcaggaaatatgcataatctgtaagcagaataaagctatccttttcctttcagccaagcagccaatatgaccactaaaaaaaagtaaccaatatgataatctaaactattagcattgtacattcatatccatatccctggacagataattcatcttcatgtatgcatatggagtaaatatccagaaagaaaggtttgtgttcttttaccttgtaaagaagatcaccagtaacttcatatctcatctgtgcaccaataacaactggaatgtgtgtattggaatggaagcctgaaatactgtcggcctgaattgaagcacactcaagatttatcagtcagagacattactgcaataggaatactactattcttgtatcctctggaatcagacacccaagccaaaagttctaaacttcattttaggtagtgtctttgctatagtgggaaaaatataatgacaaaatgaacagtagaattgaaataatagatccatttggcacgcaaacatgtagttatattgattttcaaactgccaagtgccaactcaaaactggatattaggtaatccataatttttgacagttagtaaaacaggtaaattgctatatgacaaacaaggttgaagttgaatgtaagttggtctgagtcattcaccataaattgacacatgttcatagatgatacagaatataagaacaaaagcaggtaagaaaataaatcagcagacctgaactgcaagcaacccaagaaaacatggcttatcaaaaagatgggccagagtcagatgcttctgatcattctgcacatgcaagaaaactagaaaagttagcaactccactagagaaaattgcattaatcaaggcagtattcctatctcataacaaaccgacaatcaccgttatcgtgtagagctgatagagcacatcattcatcccaccactctcctcattgagtgaagcccaatgcctctcaatactgtatttctgtatgacattcttcacacggtcactgaagtaattggccatcccgaccaccaaatcaagggccttagaattcccggccaccgtatactgatcaagaagaccttgcataatctgcaaaccaagaattgcactcatgtagcaagacaatgatataatatagtgatcaagcaacactaggaactgaaattcccccatataccttgtgaattgtatagtaaggagcccaaacagccttgatggactcaaccctgtcgaagaactccgaggggaaggccgacaagtaccccgatcccatcttcttctggcaatcatggagcgcgtcgacgaccgatgacatcttcgccaggagagtgtcattgtgtgtgctcgcccacatcttggcagtagcactcaggtagtgtcctgcaaagaacaggcagcaaagcaaagccaccgcaaattcagaccaattgcgcgatttcgctgtgcaagtgatgccgagaaatggcggtggcgcaccgacgaagtgtccccggagctcgacgccggggccctcccacccgccgtagggcgccccggacgccggaaggccggcctgcgtgcggaagctccacacgaggcggtcgacgtcgaggaggagcaggtactccaggttggtctgctgggcctgccagtacacggtgcccggctgcagccgcacgtcgtgcagcgacgcctccgccaggagcgcgccgccgctcgcggcgatggcgccggcgccggagccggagccccggaggttgcggtagagcatgagccagtcgaacgcgtcgcgccgcggggaagagacggggctcgcgaggagcctccgcggcatgagagacatccaggtggactcgtcggtgggggtgaggtggcggtcgccgtcgtggtcgtcgccgtggccgtggccgtgggggaggaggagatcgagcacccgcgccgcctcgacctcgccgtccggccgctgctccgccgccgcggccgcgcgctccgtgtgcgacgccgtcagccccgggaacccgttcgtgcagtccttccccgcgacgccatcgacggcggcggccaagaacaccaccaccaccaccacgaccccaaccgccgccgccgccattcccgccaagaaccactccctcctcactaatcaagactcaagaacaccaccacactaccagacgcatcaaatcaatggaatcctccaagaattccacctccatttatgcccccaatgattgggcgatctcaaccaagaattgcacggaaagcaagccgcaacaactgaatttcaagaacacgaagccctccttatcccctcggacagatcactccctccgagtccgatgactagtcaccactaaccactgagccagtgattcttggggagaagaggagtagaaatcggcgcccttttcgtgggcggataagcggaaagggggcaagaaatacgcatcaatcatcgggtaggatgagagcgacggcttgtgggatttcttgcacccaaagagcagcaacgacaaggagcgacatgaaagccaagccaccattgatgcatccatccatccattcgagatccaacaaatccatttccggccatccccgtgacactagcagtgagcgccgcttgcttgcacgccggagctaccgctcgtcgtcggattacgacgccggcattgtccctgtcaaaatcgcagcaacggaagctggccgcggcgaggggcgtgtgcacttcacacaggcatttttctccaaattttttcttcgaacttccaacttttccatcacatcaaaactttcctacacacataaacttccaacttttctattacatcgttccaatttcaacaaaacttccaattttgacgtaaactaaacacaccctcagtcgtcgctgatcattttggttgtgtttcccaacaaacctccgtcccataaaaaatcagcctaatactagatgtgatatattctaatactatgaatctatatattcatctgattcattgtagtgttctagatttctttttttatggagggagtacaatttgtagagtaccattaatttacaatatagatttaaaaatatgtattataaaataatagatttaacaccatttaaggtagttttcatgtttgaaatatatatttcattttataaaattgaagctaaatttatagttttgtgatacacatatttcaatatgtacgtagttttacaataatttgatcaaatgtagttttataaaatttactcattaggagtcattaggaggttgtcacaaataatcccaaatcatgcaaaagccaccgaaaaccttagtttaaggtaatcttttatcatgtatccaagctaatatacataattgctaccagaatgaatattttccatttaatgaaattctcagttttgacttttttaaatccctagtgaaggatcaattatggcttagatatagtgaaattggcgaatttaaaactttaactacttgctaaacaaatgtactctaccatggatataaataaatatataaatatactttttataaaatatgttattcatcatttgctattggaaatattcaacttttgattttatacgtggttgtatgttagaattcaattattttaaatattaaaaagttctaaggatgctttataaaatctactgttagagtaggtggggcagtaaatttactgacactaccattagtttttttaagaaatatatagaaatgaggttcacatccgctactgtaatgacactacaattacatagaaatgtgataagcggaagcaagtctcatgtttggaccaatatagtactttgtaaaaaaacggattcgtcacaagtgagcctacaataacacaagcagcaactagtaataagaagctaaccacaaaattgtagagagaaggggacagggagaaggctagcagccaataagaagcttggcagtggcgagaggcggggagaagggtgcatgtgtcgaggacgatgcgaccacaatgtggtgcaagtggagttgacctcgaagacgatgcggcggaaccgcacgtgcgcctctacggacgagaggcggagctcggggacacctgaacacatcggcttttgagcagctcgacagggggtgactatgagcttgggggataggagcttggacagcgtgatgaggtagaagcctcatcactcacgcgtgcaggtgaagacgacattgcagttgtggttgggacccgcgccgcaccccccctgcgtgcgcaagtccatgatgtgagcgctcccggccgtcgagcttttcctcgccgaccgacacccttctccccacccattggcggatgcccaggaggtttgggttgagatgggaggaggggagtgaagtggaagaagattgccggttaacttgtggggtccacgtgggactcagccaccacatcaacaaaaccgaaaagcaatactaccttgggatcaaaagtgatccgatccggttttacaggattagaggtttcatggccttttaaactcaacaagaagttagggaaccttagatgaacttttttgggagatgaaaaattccagcctcatgggcctgtgcatatgacccataggcaggcgacgacctccgcctccccaatccgtcccggccgtctcctcgcccgccggccgccgccgatctccatcctgccagctgaggtggcgccggcgtcctcctgctcccgccgcattcgctcaccggtgagcatcctaatccatcccatccggcctcggcctcggcctcggatttcgcctcctcgcccgccgcttccgccgcgagcagaggtggcgcccggcgtcctcctgcttccaccgcatcgtcgctcgccggtgagcatccttccctacccacacctcatcagctattctgcgttaagcgttatccctggttcaaccgaaacagggttagatctgcctctgctcagttccacctactttcaacttgttaattttgatttttgtttttagcggatgtaatttggttactgaatatcatccacaaacccttagaatagttgcattagaaagaaaaatgtaagctcatataatttgtacttatccaaactcagtaactcacataaaaatttcttaagaagagtagtcacacacaatatctttttatcaaggtatattcttataagaagttttcaacaagatttgcttgaaaatttgagtctaatttagcaggcagaactaagagagcatggtggcgatggcgcggtggccgtggagggtgctgctgccgctgcttctccttcactcctcccccgtcttcttcgtcttcgctcaaggtactgcgacccccgtcttctctctcttgtggggcggcgcttcctcttcgccccaccacccccaaatggcaaatattggaagtgaatcatccatcatacagataagatgaacgcgagactcgtcatctcattcgaccacctcagtgctctgcatccatctgcgataccattggatcgtttctaacacaagatatttggatctagagccagccttggatcctattaactgctccatcatgggttcatctcatgaaatttaacggaaccactccatcctaaattttctattcagcatattaatttcatggatcagcaatgtcctaagtttcttttcattccaatcagcactacgtctacacaaaatggatgtttcctttatgcttcctggtagactaagtatcctttttcccctcattttttcagaaggccaagataatgatccctctactttgttcaaacgagccttagaaatgatgaacctaaggaaatatgatggatcacttggtctgctaaatgctgtgctggaggttgaaccaaatcactcagaagcttacaggcagcgtgcatctgtgcttcgtcacaagtgcaggtaaaaaaaagttgtatccgttactttagattataatccattcatgtttgattcacatctgttcctcagttcaaagttactgaccagaaaaataattacttgccaccgccagatagctaaactcccattttctcttgtcctaaaaatgtctaaactttattattaaaaaaacatccatatctgaaagactccattaaagaaccgttaagcatatgtgcctacttataacattgtcagttttacacgtatgtgtcacctttccgtatcccttactcgtttcaatgtgttttttctgaagtctaggtacaaggaagcggagggtgactatagcaaatacctggagctaaaacctgggagttcttcagtggaaaaggaattatctcaactgcttcaggctcaaaatgcattagagtctgcttatggccagtttgagtctcatgacttctcaaaagtcctggattacatcaacaaaattgtgcttgttttttctccagactgcttaaaggtatatttcagaggatagtaggaaccatggacagataaatatttcatctaattttgtctcagtaagctgcagtactaaaaatggatttttcaggcgaagcttctcaaggctaaagcattgctagcacttaaagactactcaactgttatctcagaaacaggatttattctgaaggaagatgaagataacctggatgccttgttgcttcgtggccgagcatattactaccttgctgatcatgatgttgcatccaggtaaagcgtgtctggtattttaggtttggacaagtgcatgcttgtttgtgcctgcacacacaaatgcagtactagataaatgtgctagctttaaatatttgtacagtgatgacaatattaattgtttaggcactaccagaaaggccttcgtctagaccctgaacattcagaactgaagaaagcatattttgggttgaaaaatcttgtgaagaagactaagagtgtgagtatgatttctttgtatcaacaaattaggggcttactgcatcatagtaataggatcaaatggtgtgcatgcaggctgaagataatgctgccaagggtaagctacgtgtgtctgctgaggactacaaggcatccctagcaatggatccagatcatacttcttacaatgtacatctttatcttgggctatgtaaggttctggttaaactcggaagaggcaaggaggctataagtagctgtacagaagcactcaacatagatggagaacttgttgatgcattaacacaggtgacattacttgcttggcatgcacagaaatacacatttttctaatttagagtggaaaccaaagttcttattattcaatgttgaaacttccgtgaaaaaaagaagggaatttcagtctgattgccctgcaattaatgttgaatcttggactccttccgcactctgatgccacattattgagcaagctgcgagcatgcagacatgcagtcgcattagcctgtccttctaattctgtattttaaaccacaagacttgggaaatctgcaactgctattcagaaaccacaaaaaatgtaattcagtatgcacaaataatgtgttttgactttatgagtgaataagtgatgcaaaaaaaaatagtaatgtatatttgtttggtaaactaagttatgcaccagacaatgcaattgaattagttgttatagccagatctcgctagtctcttacttcatctgcttgttgtatgttaccttctactggttgcagagaggtgaagctaagcttcttacagaagactgggaaggagcggttcaggatctaaaagaggctgcccagaaatctccccaggcaagttttatgtggacctatctcctttttcccctaccctcctaggcaaatgttagggataagtgtgctcatatatcagcatatcttctttttttgtcctttgaaaacacacatattgctatttgagttcccatcaaataatctgcttatgtggctacgcagtgtgctgatctcatttccttttagatttgggaacacaatatttttagtgtaattgtgctgcaatcaaattatcgtgaaacatagttccaaatggatgaaacatctagttttagtcaattggatagacaatatgcagaaacaattatttgttttttacggtagtcatctgatgatacttttacttccccatgatgtatttctatttggtgcccttctgccagcaatctttgttatccgctttttgcagcgtgggttcgtaggttgcatatgtttctctagcacctatgcatgcagtggatgagttgataaaactagatttgcacattactattgttagtactactaataataaagtgggccaccgaagaggaactttatgccaatgtatttatgaataagcaacaggatctcaggattttaaactagtggaaaaggtgagggcggtcagaatttcgaacatgggtgagccccgcttgacggctgccccttacagcacagttctcaaataatattgatagttacataaattgcttctcagctatattacaaataggaagttaacttgttgcttccctgtttctttaacctcaggaattgaatccaaaggtcatgtgcttttaatggaatgctttattagatttatctatcaaacagacttggtctctgccctttttctgtatttttttggtacaaatgtaacagtggtttgcactgttcatgctcaggacatgggaatccgagaagcactaatgagagctgaaaagcagcttaagttaagcaaaagaaaagattggtataagatccttggcatttcaaagacggcatcagctgcagagattaagcgtgcctacaagaagttggcactgcagtggcatccagataaaaatgtagataagcgagaagaagcagaaaacatgtttcgagaaattgctgcagcttatgaggtataaataaacaaaattgaactgtactaagtatttaatgttctatgagatgacattttctattaatatggttaatttaaaatactctcatgcattccaagtttctagccctggtgttgtactatgaataagaactagctgaagtgcatttcatccacaaaatatatcatgctagacactgcatgtgtccgagacaaaaagtgtcccaataacataaattctggtcacccatatttagctataggcatgcttgtttcgaatcagatcgacatgctgcagatgccacgcgtgtcttttaacaatgcgcaatcggcaatttgcaggttcttggggacgaagataaacgtgtaagatacgaccgaggagaggatcttgatgagatgaatatgggaggaggaggaggtggtggtttcaatccttttgggggaggtggccagcaatacacattccattacgatggtggattccatggaggaggaggattccccgggggcggctttcctggaggctttcagttcaactttggatagaaagtttactgcctgtggagttggtgtttgtatgtttgtttgtttgttttaggaacgctgataagcttaacaacaggtattgattgtaggcagtcaagccgatcgatcgagatgagcatcgtatacaagtgttgttttaagcaccatcaaattttcctcaagttgtatccttccttgggattttctgacgcatatgatccaattgaaataaacttagccttacagtggagctagctgtttcactttcactagccaaggatttgcgccgaaaccataaaaaccgaaggtccattccatgtattgtgatcggagtcggcacgtaacagaaaaactaaccaaaaaaaataacttaaatcctctgaagaaacatttgaaccactcgctggatcgtctagccatcagtcaaccatgagcgtgatgtccaacaatctccatgttaactgtaacatctgactatctatatatctacatgttgtactgtaacatgtgactatctatctacaccgatcaatctgatgatcgcttactttctctattttatattgtactagcaaaatacccgtgcttcgctacggtgtattaaaactaaaaatatttgattttaaccgaagttattttcacactgctttggtacttttgctcgctagaaaaagtctcaaatgatagaaagaaatatagttccgaggaaagggagataaaaaaacaaagccggtttgatttccacctttatacggtgcgagtcaacatggactctgaagatatgggtagatctacggggtggctcagcagcacggtcgaccagcgaataagcgagcaaactcagaccaatcgacggccgatcgatgaccgtagcacggtaggtagcagccgcatctggccgtccgcttcccttccgcgacaacaatgaccgtgactctacgctattattatttcaatatttcttatttttaattctagccttcgtcaaatttctacttcacaaaattaaacttcttttcttcggctgagggacctagaacagactttttcccagcctagctggtacttttcttcggccgagggacctagaatagactttttcccggcctgccggtcagcccacggcatattatgcgcacgtgcgggcactccctcctccccaagccgcaacctggacctgggctggggaagctgcccagcacgcgcctctacttgggccggtttcgatccagccagtgccggccgttcgatcttagggtttctatcgaatagccggccgccgacgtcggagggacaaaagcccatccctcccagccgtcggcgaaaacccaagcctctcgccagaactggagcggacggcgaaaagcagcggcgccggtgcatgcctcctcgccggtgcgcacactcgcccaagggtgagggcgccacctttgagcagccctgccccggcgccgtccccgtcgtctctctctcatcttccgcgcggcgtcatcgacggccggaggcggtggacttcccttgcgcgtcggcaacgaccggcggcgggtgggctacccgcgcacgtgggtgacgaccggcggtggcgaaggacttcccgcgtggcgtcggcgacggctggcgttgaggttttccgttcgtcattttttaatttttggagcttttcttcagggatccaagaccccctttttcctacagacaaaaaatcaccggatggatgaaacagattgtgatgaaaggaaaattatgaatattttaattagttaagataagattacagccggtgtttttttttgtttttttccagatttttttttgtgtcgtacgaatcggactttttgagcctgtttttttttccgccgttctcttctttttacggtgcgttttctttttttttttctgcctggtttttttcgctctttataaattacggacgatggaaacattttagattttttaagtagtataagtagaagtagattagcaaatatacccatgcgttgcaacgggttaactaaaatttaaagatttgcattggttttaggagtttgaggggacaaataaagggagctaaagcgaacttattccgtgtggagcgtacacgcggcctatgtggtggcccaatagtgtggtcggcctgggaacaatttggggacaacttgagggatctaaagtgaaattttttcacgcggagcgtacatgcggcccaatagtgtgggcggcctgggagtggcacccgacccgacgtgggagaagcagtagccgtccgatctgatggacggtcctgattgatcccaatctatataaaaactcataagtctaaaccctaatcctaaaatcatttccattctccccctctctctcagccgctactcccctcccctcccgtcccccaccagcgccgccgctccctctccccctcaccggtggcgccgctccatctccccctcttcctcctgtctcgccggcgcggcgacagggaaggcaccctgccggttcccctcggccactccatcccccttcctccacaacgacggggagaggatccaccgctcctgccggttcccctcggtcactctctcccccttcctccacggcgatgggaaggggatccaccgctcctatcggttcctctcggtcaccccctctcccttcctccacgacgacggggatcagcgacggggaggggaaccaccgcctcggccactccctccccccttcctccacctgctccactggcggcgctctccctactggcgtggagccagcggccctccgccccttctcgcctccctctcgcgccagatccagcggtggcggcgtcggtggctccctccgccccctctcgcctccctcccacggcagatctagcggcggtggcaatctgctcgaccacatcgccgtcgtggcactcatcagcacctccgcggtggccatgtccgaggcgcgcctcacgtccacgctcaactcgctggcatcggtggttggcatcgccatcatcgccttcgtgctggccgcggggttttccacttcgacaccagcaacctcgcgtcgcccttcttcccctcggtgctgcgggcgtgttctgtgcggcctaatccgtactcccgtcgccgtcaaggtcgccgaggggaggggaggggaggttgccattgttgtccatgaggtcgaggtcaccgttgtcgccgaggagaaatataggaaaaagtgaagaaagtgctacgaaatagaagaattcgcagtcacgatggtatattgtagaaggcgtgcggattaggtggtaaaacatataaggcatgcgtattggatggtatattatctaaattctccattatatatatatatatatatatatatatatatatatatatatatagtggaatgacaaatggccctacacatatttattttaattctaatgccacataagcgccacatcacagccacgtggaacaaagaccgggtcaatatagccatgtaggcgccacgtcagcggaactgtcttccaaaaccaccgaagaagtcaaattgcactagtttcaacagttgagggtcgagatatccggtattatggtttggggatacgaattagattcagcctccagttaaggaagccaaagtgaacttattccttgggaaaatgaaaaaaaaaagaactcagcccaagttggtttgcagcccggcccaaagcaaaaccaaaccagaccttcctcctttccgtgggccgcaggtgggccccaccttatcccctcgcgcctcgtgcctcgtgccccgctccgctctactcactgaagagcgggccccacctgccccgcctcagagcagcatccggatccggatctggaaacccgcttcccaaatccggcgcccgtacgcccgcccgccactaccgccgcggtgcccaccgcttcgcttctctcccctcctctccaatggcggaacccccaatcacagcccactcctcctcctcctcccgccgcgtccccaccgcaggcgactcccccaccctctgaccccacctcccgcctccccgccgccccgcgaccgccgcggatcgatcgaggggattcttgccacctgggatctctcctcccctcccctcccccgattcttggtctcgcgcgtctgtctgcccccccgtggtggattcttgtctggctcccggcaaaaggaacggcgtctcgccgcgggccgcggattcgaccaggtgcggtgctggaaccggcgccccgtgtgtcccagatgttaattctttttgtttttattgttctatatacagtggttgatttctgaaccgatccgttgttcgcttggttgggggaggacagagagtttgtttgcggagatagttttcgaattgcgtggtgaaatataaaatttagactagtttggcttatcttggcacctccgcacctgcattgcgccgttgagatgtaacgttgttgatgagctcaattggtcgggttgtttttttttccccagatctggatggttaggttcttcacctggctaacaagaaagatgttgcttttagctgccctggaattgttggtactttctgcgggtgcatctatctgatgaaattgagctgcattgttctggggagtgtttgcttctgctcattgcctcatagggcacacaatgacaccaaggagttatagaattaccgtctcctggaaatccttagtttaccatcctgttatgattttgctcaaatttagccatcttatcattggttatgcgtcgtggaattccaagttgtactgtcctattttacttttgtcaaatgtagttatccatcatatgttatgcacaacatatgctcaaagaagcatttttactggctaggttagcttaacacatgctgatcagtatttttcctttacagttcaatgcacctcaaccctcaacttgttgactagcttctgtgctaaactttgtgttgcaggcatctcagtgtccacggctgtaatttataaccaagcctaagaaacttacattattctagcattcattggatatggtatcggtgaatcttgggctagtacattatgtactggaccacatatatggtaccgtccttcatcgcaccaaattaggaacgccatttttctcgaaaggatggggaggcaccaaacttgatttgttagagaagatggtgaaacagttattccctgaagcacgttgccagaactggccaccaactgccgtgcaacccatgtggaaaacggtttgggagacaaagagttcttgtctgcgagagggtgttttcaggactacatgcgatccacggctaattgaagcattgcctcctgagagtcacaatgcaagagttgcttttcttacacctaagtcagtttcacctgagaagatggcctgtgtgattcatctggcaggtacaacagtttaatcctatttatttgttctatactttgatgtaccatgcatctacatgtttttttctatataagagactattttcaagcctttagatattgatgtttgtacactagctgaatgttgtttatttcatcccatcggacagaaataaaagttgactagatttgatgtttcaactttccatattgagtgatctgctttctggttctaaatattatatttcatatcatgccatgttattaactgatgagttgcaaaaatgttctttgtccagctgttgaaatttgatctgggcttctaatacaatgggtcaagttaaacttttatctaatattacaggcactggtgatcactcgtttgagagaagacttcgacttggtggacctcttttgaaggacaacattgcaactatggttcttgagaggtgaggcttgtatagaatgccagaatggttgtcttacgccacctttgataccaaagcttttttcctaacccgcaagatctgatttctcaaatgaattccagcccttattatggacaacggcgaccaagcatgcagcatgggtcaaagcttcagtgtgtgagtgacttgctactattaggaaaagctactattgatgaagctcgcagccttctgtactggttgcagaatgaggctggttatggcaagatgggcatatgcgggctcagcatgggtatgtaattctaaagttttcatctataattgaataatgtgaatgctttaagtcttaagcaacctgcagcatcccatttatcaaactcacccccattttcgtggcaacttcgtttcaagattcctttacaagtattgatgtgatacatttttccctaagactggtaactgagatgatttttctcaaggaaatatcttttatttcacctcaagtactttggccccttctattaatttctctcttgcggaagcgctcctttttctatttatttggattgcttattgacacggaaaaaaatgctatatgatagataatgaggttaactctggcatggctttttttgggaaaaaactttatcttgacagtagttaagtaccatctacatatgaaaattgctgttatttcttacaagcgtctcatgctaattacataggtggtgtacatgctgcaatggttggatccttgcacccaacaccaattgctacgctgccatttcttgctccgcattctgctgtggtgcctttctgtgacgggctctacaggcatgccacagcttgggatgcattgaggaaagatgcagcaacattggcccaagacgtaacttctttgacagaagacatggcccagaaatcaggaatcactattgagcaagtaagagagaggttgcgatcagtgctgtctttgactgacgtcactcgatttccagtgccaaagaacccacaggctgtcatttttgttggtgcaacggttagtgtcaatgttctatcatcatttctcaaacatgatttacccttcctgtgtcttatatatttcagcctagcacgtaaatttcttgataagagtaactcattatcaccttccagtactagtgcattctggtttcctactattactcatatcttatttttgcattcattcaaaatagatttattgcctgcgtcatttgcagcaacacatcatcttagttgctcctttccaataattacccacgcctctctgtagtactgttgtcatctgcttaattctgtactttcagatatcaatatgcttttttcgttatcatataatatttaatggagcttggtctgaagcaaatgttctctttattttcaggatgacggctacatccccaaacattcgataatggagctccaaaaggcatggccaggttcagaggtccggtgggtaaccggagggcacgtatcgtcgtttttcctccacaacgacgcgtttcgcaaggccattgttgatgctcttgatagactataacagcagaggaaactcatctttgtgatggcatttcttggtgtgcttgttgtgaaactcataggcatgccacatgacaagatcacatttttatgagtgggggagcctagaaataccacattctgtctgtaactcaatatatgtgttttcccaaagattgggaagatgcatgagtgtaacattgacattcgttacctgttaactaagccccccattgttaatctgtcccaaatttcacctactactaaccttgcaactgaagtaatttgcagttgagacaagaaaggaagaagatgacagtgcggcatacctaaactctctagtctctattctgtgtctgaagtctgaactctgaagcaaagtcagtcaaaccatatgccacaagacaaaaacattacagtgtcatcatcaatctcagcacttattttcatactgactagtaattatcatcagcagctactagtatacagcttagtttctgtttcttatacattatatgcacaattacagcatgctgctaccctcctaatttaaaaatgaaatcatctgatcttgtcaaagaagcaaattaaggcctgatcgattgatcatctctctatgcactgtagtattctgaaacttttgaaactaatctgttcctgtctgtctgtctgtatgtaaaactgcagtggtgtagcagtgtagatgctgggccattggatctccagggccagtggatggatgtggtctaatttctagggttgatggatggcggaggcggaggaggggcgggttggtcggggtggcgcgggcgcgagagccagagggaggtgagggcgcggaggcggtgggagtggtcggcgatggcgaggaagcaccgcgccgactgcctcgccgtcagtatctgcggcagcttgtacagcgtctgcagcctcagcgcgtccgcctggatcatacgcatgtacgtcatcagttcatcagtcagtagagtactcgtgcattatatttaaagttgtataagagcctcgtcggttggcctaataataaatccaagcaaaagcagaagctaaaatttaaatttttaaacttgattttaagatattttcactgtgatttcattttagtgcttttaaatcgctgcgaacaaatatataaaagtttgggtgaatacccaatatgatccttgaactttcgcttaaggatcaatttagtccctgtcatttcgtattgtccaaacaagtaccttaagttcattgtgtgattcaatatagtcctttaaccctctaaatatgccatgtgtacatgtcacatcatctatgcatgcaaattcaatatttaaatgtcctttacacccttatgttttcataggaaataaaggaaaactattgagaaaacacacaaaaaaaaagcttttgaccattggcaaaaatatgtagcattgatagataaaaaaaattaacatttttctttgttttatgattgcttcttcttgtttttcttttctttatttgatagaaaattgaaggttaaaatggacatttaaatgttatcttacatgcacgaatgacgtggcatgtccacgtggtgttttaagtggctctaaggactatattaagccgcatgataatttttagggtcttggttggacattataaaacatgaaggactaattcgactcatgaacaaaaattgaaggactgaactggctattcaccctaaaagttttaactataaattattttttattccctaataagccgttttggtttattagagagtatgagcaaccaatgaggttctaacaagtattttattttgttaggacaaaagtttgagcaacaatcatcctattagtgtgaatttttataacacaaaatgaatgttattagatccatattaaaagagtcactcgccattatgtttctttatcatacaaatagtatatatatacggagttattcaagtaattactatttccatcctaaaataaaatataaatattggatagaacacatcttaataatacaaatttgaacaaatgtttgactagtttcgtagtgatagaatatgcccttttcagttctagtttgttatattttaagacggtggtcgttgtattagttaaacttgtgtggtaacgaaactaaatgccttttgcaagtttagttaattagagatctagctgttaataagaaaaagattatccaatttcaggttttatttcaatcactgtaattaattaattattaaccaattgcctggctctagctagctaggtgctagctaagtatgggctcttgttgaagggaacagaacaaattaaaatgcccagctagccaataccattgatcattagtggatagggtttcttagttataggattaaaaggagacagtacaacagctatagctagctggctagataatcaattagcctaagcagccacacagttttgtacaatccaccacttaatccagagccaactaaccaacctaatgcagccatcaactgaattaaaaacaaaaatcaactacaattagcaagccgatcgaatcacgtgtggtaactacttagctccctccctttcaaaatatatggcactgttgatttttcgttcaaattcgtcttattaaaaaattagtataaatatataaaagtataagtaaagattatattttatttgaaataaaacaagtcataatattttttttgaatatgactaattgtcaaacgatgtaaaaaagttaacggcgttatacatttttgaatggatggagtaattaacaacgtacctgcctgacgaaggcttcgagggaggagagattggagatggcaagggagaggtgagccatggcgacgtcggagtatgcggtggcaccggtgccgggagggaagagcaggagtgagtccgaggagacggcatcggagagggcgtggtgggtggcgtggaggtcgcggtcaagtgcctcctccctctccctcgccgactgctgcacaccgtacacacccgccgcctgttgctccgtcaatggctccgcgtgccgcgccatcatctagtagcaacataatcattttatttcaattagttttcgacaataataatgaagaatatttatagttatgtaatcatattatatataggttcgcaagataatcaaatataactattcgagttcatgtagtatcacttaataatattatattagtatgatagagtcgtggatgcatgactatgactatgagtattaatactcacaaatattgctatgagtgtattaattagtatagagatcagaagttatacttactttatataaaaataatatcatatcggtaatgggacgacacgtaaaaataatatcttagaaataccatattgatgatggaacacgcaaagaaaattagagtacctaattaacaagggtatatctaattactaactagttagctactttttatgagatatatatgatagtactactataatataatgtagctagctagctttttatgagatttgcaagtattagatagtagctaggactctgtccatctagaagaattagcttgctaaagtatgtatacacatcctctctacatgcattattggtaaattagccatccccatctacatcgttgatcactcttatctaacttgcctccttcaccaactctccgttgtacattactgcacactactttcttccaacacagaaaataacaaccacatattagtagccatcaaagacttccaagagcctaactgttccatcaactgggacctctcacctacttaaatcaatattttaagatagatagctagctaacccatcatacatctttctttctagttggagtacctaatatatgtgtctggactctggtgtactatggaatactgtctaacaagcttctttccaattactttttttattttttgcaattatgcatgaatggaaatctatgtatgtatagggctactacacacactactaaaacttaaatatatactccatatatatatatatatatatatatatatatatatatatatatatatacttatacatttagagcactaacagatccataaatattgcacgtatatatagggtatttcaggtattttattaaatatatgtaaagctattaattgtactccctccggttttaaattaattgaagttttggacaggatctcacatacttagaaatggttagttagggtgcatattcatgttttatccatattaaatacattaggatggcacatctaacaagcacatcctcttaacctagtggctggctgctagtcccaaagcatctttttactgtcttgtgccggagttgatgcatgcatgcagccatacatgggtaaatcagtttaaattaatcacatggaagctaaaacgccaagttttatcatccaaaaggtctaagctccaaacgtcaactaatttgaaaccggagggagtacatgtttagggcgtgtttggttgcctgcatccatgtatagtgagcagcgtgtttggttgtgcactggctgatataagcaaatattatatgtatatgcatgcatgcacgaggacgaacgaagtaaccgaaggcacgcatggaatgatggaagaaacgtgctgcaaacaaacatgcatgtatatgttgctgtgcatctcggaggaagaatgatgacattttttagtcaaaatatactaaaaacgtacgtaacaaaaaagaaaaaaaatatcgggaggagcaggtagctagttagctagctatatactccctccgtttcgaaatgtttggcgccgttgactttttagcatatgtttgaccgttcgtcttattcaaaaaatttaagtaattattaattcttttcatatcatttaattcattgttaaatatatttttatgtaggcatataattttacatattttacaaaagtttttgaataagacgaatgatcaaacatatgctaaaaagtcaacggtgtcaaacattttgaaacggagggagtagtaggttaattggtgaactcaagcttatggaaacctgagctcatgcaatatatgagtaatatacagttatgtcgatctagttaattaatactccatctgaaacagatgcagtatattaacctagtatactagctagctaatatactgctacttctgtcgctctagtatattaaacagatctggttgtaagacgttttgattttggtcaaagtcaaactacttcaaatttaactaagtttatgcataaatatagtaatatatataatatcaatttagtttcattaaatcaataattgaatatatttttcataataaatttgtgttgagttaaaaatattattttttttctacaaacttagtcaaacttgaagctagcatgtattttcttggttcaccttcctctgtctctcggtccatattctacatacccatattggaacatagacaatgggttttatttttttatttttaacgtaaaccgaattttatcatattaacatatttaatttgtatatagtgatgaatgacaccatatagtctatatatgttgctattttctttaaaaattattaccatatattttgatgccatcctccccttcattagctattacattgtataaacccatctctctttatttttaagtttttatgtattatatatgtagagcgcggcatgcgcagctagccaaatacgtactccaacatgtccaataactaaacgcgtttcacaaaattatctgactatatcatgtctatcatatattgtagacgcccttaaaccctaaaaatccaatataatctagctagtatctcaaaatctaaagggtgcctatactacaacacatcttttataatttacctctgctttcagaaggatgacgtgctaatttatccagttaaaaatgaagaaatcctaactcatcaatatatgcaaaaaaaaagtatattgcaattcaaaacatcgagattatgggtctgttcagattatagccaaaataaaccttaccaagttttggcaatgctaaaattttggtaagatggcaatattgccaaaattttggcaggattttttatgtattgatcaaatttggcaacacactaaacgtggatatttttttagcaactttgcgaaaaaaatggtatggttgaaaatgacatcaaaatgaaaggccctatattagtggattatttgttatgaaaactctttcatatagttatactccctctatcacataatacaagggattttgccctttctaattgtctcacaaagatttttgtgtactactgtcagtcacatccatcaacttcaattcaaatttctacctattttgaccctcaactatcccctcacccaaaccaaatctcatttaataggggtattttagtcttctctcgctattcttaatcttataaaaagggaatagtcccttatatatatattattatgggacagagggagtatttataataattttcataaacattaatttgatttgaaaaggtaatgataaatcatatcaacatctaaaacgtcaagtaaaaatatcactgccagttcagatccgtttgggtgggtaaaaccatggtgaactggcattagtactatctctctatatatatcaccattggtttacactaaaccgtcagtgataagtcatcagtgatgatattttgtggtagtgaatccttaatatataatatataaagccggctttaaataattatctataaattgattatataagatattcaattaattatgtgctaaccttgatgagctcggatgggcggaagccaccaatccagaggaagcagcgctcggcggcgggcagccacgtcccggagacgaggtggaagacgtcggcgctggccacggcggccttgagctccaccagcacgccgtggtgcgccaccgccgcgtccaccagctgccgtagctgcgcctccgccgccgccgccgccacgccgccgtgctgcggctgctcctccaccgccgcccgcatgtgagccatcatcctctcgtggctctccacccaccgcgcgtactcgccgtcgaaccacgccgcctctgcatgatgacgatgacgatgacgacgacgatgatgattagtctcccttacacattataatatgttcttttttttctcttaatcctttaagtctagattcactaacattcatatgaatttgaagttttgaacacatatataaaatacatacgtggatctatgtataaatctatttaaaacccaacgtaaataatgtgaaacagaggaagcattcattaaaaattttagttgtttccattatgtattttaaaaattaagagttgtgtgtttttgcacatggacatctgcattcattcctgacatatttgatctaatgatgaattaattaacgagtaaacaaattaattagagaatttgttggtgattatgtggttttgagtattatatggatttaattataataattaattagggttggtttgatcgtatgcatgcatatatgattatatatacctgggctttgtcctccaatgccggcagaaaaagctccaccacccaaaattgcaccctatgttgatacgtgcgttagacatgcatcatgaaacaaatcaatcaattaattagtttactgaaaacatcgtatagttcaggagcatttgcatgtatatatgctgtacctgagttcttgatctttgcaccaactcctgttccagctgggacagtctgatcctgcttgtctccagattttgaatgtaagcctatatacacattgatccatatacgagacacaatttaaaaaaaaaagcatagttaattaagtgtcatgagaaacgtaattttcagatagacgtagccagtaatgttgcacatctatattccattttaggtggtaagtaattctccgtacccccacactcacatgcatgcaaactcatttgtttaattttgactttattttatatccgacatgacacatgttagttattttaattttgacttaaatttggagtaagaacgtcgtaactgcacaagtctatactcctgtgctgtcgtaaagtagggtgaaatggcagtgcggttaattaaacaacaggtaattaattaatctcgatttacagctaccctaccagccaggtagagcaagagtaattaactataattaactgcaacttaattaattaacaaattaccttcttccttagcctgcttttcctggctgcctccctgttctgtgcaagcctccgcagcgtcttggcgtccggcgtcttggggccctcgtgctccgacgccgccgccgacgatgcgccgccgtgatgcttcccgccgccgccgccgccttctttctgatcggccgatcgagacgaccacacacacacacaaactcatgcgtgagcttgagccactcagaatgtcgtagatcagctgaagacgaagatgatgagatcatcggagctaattaagttaccttgacgacggcagccttgccgtccttcccggaggccgacggctgatcggccggattattcagcctcgacggctggccgccggccgccgccgccgccggcggccgcttggaagagccggcggcgatggcgagggcgttattggacggcgccgagttgatagccgccatggatgatgatcccttgggagaaggctcgccggcgtgcattggctgtgaagggaagatgttgagggtttctgcatccatgtagagatcagtaaagtagcaattcagaataatactgagaaacatatgtccaaaaatatatgcatgttgatgaactaaattgtccaaattaactatatgtaatgcatggcattaattaatatattaacacatatatcaaatggtgtaacagcatgtcaacatgcatgtggttgtaagttctgttgtttcacacttatggtcctaatgtaaattaaaagtatgaaaaagtgaacaaaagggagagaatatatatgtgtgtgttcatgtttgatgtcctagatatgtaaatagctagctagctagcagtagtatatatacatatatatgcaaatcgttgttgcaaatgtctctggatgattaaggttaaaaatgcatatatctagcttgctttagcattacatatatgtgtatatacgataatcatcctagcaagaacgacacacatctccaggtgtttgttatacgtcactctctcctccccatctagagaaaattttgggaaaatgacatgtcagtgagtaaagctttgaggcgatcaaatagaaggaaaaaagaagatggatcaccatcgctgcctgctcatcgatctctatagatagctaatactccatatctgtcgtcgaaaaattcgataatgaccatatatattcacttgtcaaaatcgaggtagctagatgagatgcttgccggcctgcttgctatatatctgatgaaattaattaattaatatgaccaaagaaagattattctccctctgcatccttgtcgatcacatcttttttcggagaagaatataatgcataatttgtgaaaagtctgaagatttggtgacagtaataagtgcatatatatatgtggcttacgaggttgttcttgaattgctgctgatgcttgatcctggctgttgaggtagaggaagatgtgatccaattctgccatgtcgtatcctcccccaggatcctttctgctgcacttgcacaaattaatacaaatggagaaatcatcacaaaattatattatcatctgatctgacagtagctatagctgtagtagttgctaaattattctgcatattttaaggttttggtaagagaagctaagcttcctgctccaagaaaggggataaaataaaaaaaggaatttttggaatatacgttgtttgctaaacaaatccagtattagaaaatgtaaaaatccttagaagatatcaaaattaaggaaatgaatgaaaagcctcggcaccagctagtagaattagttgcacccatcgctttattaaatttggagcaaacaataagtacacccacttcgaataccactcttcaaattaattaagagatgcttaaatatacaccaaataaaacccttaataaccaggataaagttacttatcttgcgcaaacatgcaccattagtaatcaacccattcatgcatcatacaaattaaaacatgaaaaacaattctgtaatcttgaaagttcaaaaaagcactccataatctcgaaagaaaagtaaaagagacaacaaattaaactgccaagaaagacagcatcaagagagagagagagagagagagagagagagagagagagagagagagaattgtggagttaattaaagctccagttctgatgataagacaaaaaaggggatcaagaagctaaacattgagcaaggtgcttcaaatttgttctgataaaacaagatcgaattagggaggaaaaaaaaaggcacaagtcgtataggagttagggtttttacatgatgttgttgccatggatggaggaggaggtcgcagaagcttgcatcatcatcccggccgtgactgagcaagaagccgcctgctgatcatgtggctgcagctgctgctgccatggcctatcccccatgcaaacacactgatccccagtagcaaataaactatctctttcttctccttgatgatgatcacctcagctagcaattaaatcgatcctatcaccaaatcagctcctcaagtacttcacatctgatctcatcacctctagactcgatcgatatgatatcgattgattttgcgaggaatttatcggtagacgacgcgtgtcgatcgatcgcgccgcaatccctcctcctcttcttcttcttcctccaagctaggtagacatagcttctaattctccttagcttcttctgaccggaagctagctagctataggtagcaaaagtattaggacttgtagtagctagcttagttgaggtggagtgcttgtacaagaaatataaggggagtggttacaaggccatggaaaaagctaggcaataattagactttttttataaaggtcgaatacgatatgtgattggatcggggttgatcggtctctgcgactggttttggagcgcggttttatattgatttttgttaattaattggtgtttgatctttacgtgtttcatcattggtccaagtcaatttgaagaaaaaaaaagaaggttatctagtgcttgtattgttgttgggtattttgggttcagaagaaattaagtattatcactgtttcttcttgttaattaattttgctcaacttgttgtgttttggcaggatttaggttgggaattaattgggtcctgcaagaaaacaaagtatggtttggactagccgctaatatatactagtatatattttttaagcaaattaattaaggcatatgctttgcctttgtgtatattgatagagcaggggagatgcaaatatatatatatagttgattatcaattggattgtgtaaacatatatttatgttgctgtatatatagcacatactattacaaattaaaagtacacggtatgaacatatataatttcaaattccctaccgtgtacttttgtaatggttcgatggcaataatagttaagaaacatcagtgtcttaatccaaccacaatgtccacccttttcaggagccaatagccactcaaaagagaaaacaattaaaggatgtgttattacaagataaacataattaatagggtttcctcccttggatacaaaagaagggggccctggagacaccacagttggttgatccttccaaaatgtcaattaattagtaagacacatgattaaattccagatacccatgaagcactatgtccggtctgttgtatatatgttcagcatccaaatatgcaaaatttgggtttgattcttctctggccagcaacagacctggcatgcattgttggctacacctttctcttccaatgagcacattattatacaggtaaaggtcaaagctaaaatacatgccaatgagttgacctctaatgatgcattgcatttagctactatctagcattagtacacatgatcgacccttgtatatatgcatgcatgcaatccaatttcagtatataatatattcttataccaaacctaaacaactaattaaattaagagaagatagcaactaatacttgatgaaaccagccaacaaaagcaccttatttctcttgtttaatttgtttcatatagcgtgcatatatatatttttatatctctgttactgccagttcaattaatctcgttctgctctgcatgtgtgtatatatatctcccttaggattatttaataagaaactcatatatatatatgaatatatcacacacacaattaaccagaaatattaggttgccagaacacacacaattggtatatataaattaagagatacacaggtaagtacattagtgtattaattaggatccgtgattaattatatataatctgtacacttactttgttaaaaaataattatgtctatagtatatattaattatctgtccgtacgtgcaggagtatatggttcaaactgtactgcctgcttgtgtcgtcagatatggacgactcctttgcgtttgcatacatcatacaatgctgaatgcctgaatgcaacactagataaactgtgcgtgtacacgtacgtacatgtacatacactatacgtacctaatacacgtacttagacgccggtagctgacgtgtcaattcatctcttatgtgggctccacagaattgatggcaatggcgtcgtacgattttcttgtacagcttatctatagctgaggatcgatggacctctcgatggtgatgaattgagtgatcatcaatggaggctttcaatccgagtttgaagctgatctctactattataaaaattaaagatgtttttttattagtactttagtacgtcatccgtatatgagttggtttttaaattcgttcgtttttggaaatacatgtacttatttgagtcgacttttaagttagttcacttttgcaaatacaaaagcagtcatataagaaatctcttttaaaaaaaactggcatatatactaactcgaaacgattagactcctaaccatagctcataatttttaaaaagaaaatacatccaaatgaaattgccacagtgaatttcaccttatctaaaccatatagtagtaataaggttagaatagacttcactagttgcaacgcacgaacaatttttctagtgaagataaaaattaaattgatgtatgtaaaacaagaaaaatcattaacacatgattgattaagttttaattattataaacttgacaaatggatatatttgatattttaaaacaacttttgtatagaaagtttttacgcgaaacacaccgtttagtagtttgaaaagcgtactaaaggaaaccgaggtaaaatatcttaatcttagaaaagaaatggatcgcacgtgatgtcatgctgacgtattggttttctcgtccacggctgtcatgtcatgtcatttacttttgcttagtcgccggccattatatttataaatcacctgccgatcgagagatcacttaatttgcctgcctagctaatcacataacctaactaaacgactccacccaacccatggagacgtgtgcatttgtgcaacattgcacaatcaacctacccttgagttggatagatagatatattaaattacaaatgatactatatctttttgtcatgtgtgatattaaattttgttaagagtattttgctgaaaaagttcttgagtgttactcggtttgtacgaatgtaaatatgggaaaatcagaagaagttttccttttgtacaagttgtaaaaagaacacatagaaaaaatttgatcaaacctcttgaaaaattctttcgaatagaagtgtgcgtgttcatttctatttctctatcttttctatttctatatgttgaaattcctccaaaccgaataaatcctactgtctacgatattatagttttaggccttctttggaatgaataattttctaagaattttcttatgaattaaactaattcctgtaaagattttataagaaaatcctacattccgagcagccagcccttatttttagattttgtttggcataattaagctcctatctttattatactttgaaaataaattagttatgataatatgttttttgtgctgaactatctttcgactaactagcaatcaatttaatacaaattgttgtcgcgtctgaaagggagagtggatcataacaattaacataatgtcgtgacagtgcatacggaggatcaatctatcccctccttaattaaaaaaaacaggagggctgcagga

SEQ ID NO: 62733 - DNA, 49827 bp, Oryza sativa
aacataaaaaatcataagctaatagtgaatatgaaactgtgacgatgtgacatacaccaactattgtgatttattttagtcagaatattcatctcaatgttaactgctatgctgtgacatcagatgatcggccagaatatgcatctcttcaagcaatcctattcgggccatttgttctagctggcctgtcaactggtgattggaatgcagaagccggcaacaccagcgcaatttcagactggatatctccagtcccttcatcctacaactcacagctggtgaccttcacacaagaatccagtgggaagaccttcgtcctctcgagcgcgaatggctctctcacaatgcaagaacggccgacggtcgatggcactgataccgccatccacgcaacattcagagtacaccctcaggactcagcagggcagcttgacacccagggtgcaaccttgaaggggacctctgtgcagatagaaccatttgacctcccaggaacggtgatcaccaacaaccttacccaatccgcgcaaaagagttcagattccctcttcaacattgtacctgggctagatggaaacccaaactcggtctccctcgagctcgggaccaaaccgggatgcttcctggtgataggcgtggattactccgtgggtacaaagattcaggtcagttgcaagagttctcttccaagcatcaacgggattttcgagcaggccgcgagctttgtgcaggctgctccattgaggcagtaccatcctatcagcttcattgcaaagggggtgaagaggaacttcctgcttgaaccattgtacagcctgagagacgaattctacacggtttacttcaaccttggggcttgaaccttgaaagaggttactcattagtagaaagaatcaagaattcagaataatggttgtccttactatactgtaatttagaatatgcagccaaagaggaaacgttttgtttcttctgaaattgtaggataatttttactgagttcagtgcaatgttgtgcaattatgagttttttttctgtggcattttcgtatcttggtaattgaaaatgctgctgaaagcctgaaatacagccattctgcaacatatatgatgcagtagatgctacttcctctgtttcatattctaagtcattttagatttgtcctaactcaaacatttctaagtttaaccgagtttatagaaaaaattacaacactaaattagttccactaaatttattattgaatatgtttttatagtatatttttaattttgtgttgaaaatattgctatattttttttataaatttgatcaaacttgaaaaggtttaacttaggataaatttataatataaaacagaggaagtatcatttatctccattgttctggcttttgtccggtaaacacaagagggaaaaaaatcatctgttcttatcaggattgcgtgatatacactataatggcattagtataacaatataagatcagagcaggtaacagcagtttaagtctcataaaatacatctccagcgactgagaggacgacaaactggagattctatccaattcaataaactactgaggaatctcagctgatcagagctcaccattagtgcctgcattgtttaatgcatttcggcttaacacccggcaaaggagttgatcaatgtacccatcatgcctaaagaaacccacccaaccacaatggcacaaatcaagggggaaaagaagtcatcctctgcaaagaattttttggcacaacttggtttattctgcaatccatagtcatgccaatccatagtcatgccaatcaagtgatataacaaaatgtaagcatctgtgaaattatccacctaaggatttcaattggataatataaggggggcagaatttggtagcagatgtcagaatctgtgaaattatcaatcgaatcagaactgcagctgccttgcaccaggaaattaatcgaacaaaatggttatcttcgtgacaacaatatgtatgctggttcagatcacaagttaatagatgtttgaactttaaggcagattattaactacatcccagattactgaaacagaacagcttcacatgctgaactttcagtgttacatgttgcagatctaatcccaactattctcagtagcattaaagaatgaccatttggggatagagtaataacctgagaactaacttgtcatttgtcacaatttcctctcagatccgattttcaatctagagtagacccagccaaccaagcacaatccggcaaacttctttgaacatacatgaatttgaatgcgcaccagataaaggtgcatacataaataatctttaaggaaaaatgaataatggacatgttggcaatatgatggaccattgctgataactattactgattgaaatgtagcaagcatgggacatagtacatcacagagctagctaaatgagacaccacaatactgaccgaaaaccaccaagaataaagattacacaacatacccaacacgcaaaccacttgacttgactgagaggatgaattctttcggctgccaggatgcagtgtgcatcacaaagttgaacaatttaagaaatgtagcagccgacaagaagaagtgtgaggatagagcagcaaaggtggatgttgaaatcttgtaggttgcaatccattccacgcccctagccgccttagatcttgtcgagcttctcagccttcaccactgggttggccttggcgatggcatccctagccgcagtccggtagtcgaactggcattcatgcttgtcggagtagcggtgcaacgcacagtacatgttaccgcaccggcagttgaatcccgtcagcccaaccctcttcctacaggtagcgcaccggttcggcccttccttgaccttggggactacagcaacctcctcgctggtgcccgcgacatcggtaggctgcacaacgagcgtcttcgcctcgacctgagccaccgccaccgccgtgctaccactggcagcaacaatatgctccttcccaccgtcacaaccattgacaatgctatcgatggaggaggcagcaagcttggcctgctcctccttcatgatcatctccttgtggcacttggagcacatgttcatggtcgccgcgctgccaaagaagccgcagttattgatgcaaaggattgggccctcgggctgctggcagccagcctccttgtgttccatcgcaactgtgatctgttcatcaaacaaacaatgcaaaactcaataccgaaatgcgtataagaaacaaatttaaaatttaacatacggataaatcaactagtgtccaattaaatcgggcggtaagataatccaagaagcacctagttgctacaattttcctatcgaaatttccatataattgtgacttttaaaataacctataacccactgcggcgagcttacactttatgaaacaagatcctaatttctatgaggcgcaacgaaatcgccatcacaaaagtggattcctcatcttatcaaccaaacgcgcctatccatttcgacgaaatcaaattcaaacaccgtaaatctgctgtaacacgttttacccactcacatttaccccgagtaatgattaatcgcccacggttctacaacaaatcaaccccaaaaaaagatcaggaaactcacgcgaatctaatcatttcaacctgaaagatcacatagcctaatacacaaccgaaaaaaaaaatcaaacataaacgctttcccctcgagcccaataaccaataaccaaccacatcaaataccaaatcaaacaacgaccccccacatcagatccccgcaccaacccaaaaccgatcccccctccccaacaccagcaccacgcggatcgatcgatcgaatcgaatcgaccccaagaaaaaaacaaaaaaaagaaaaagaagcccacagatcaaacgggtcacccacaaactcaaggggggggggtggaatcaggcagggggagcaagagggcaaaccctaaccctggtcgcggcggcggcggaggccgaggcggcggtggcggaggaggcgtgcggggattggaatcgcgagctcggtgcgcgtggtggcgtctcctctctctctctctctctctctctcactctctctcttcaggggaaggtgggggtggggggagagagagacactgataaaaaagaaagcccccgatggcgacggggaaattaccggtttgcccctcgcctcgacgtgtatttacgccacgtggtggggttgtgggccgttggatcgtggttggacggatgggaatcggagggagggtgtggggttttgcggttgggtccctgggagatgtggggttataaaaagtaggggctttttctttcttgctggggaagaagatggaggagagggagagcgtgtcccttttccttctctttattgttggtgtgatacttgtgtttaattattaaatcctttcttattatagtgctggaatttagtttttttctattgcagtaatactgtgaaataatatgaaccggtataaaataaaaagataacgtgttcatatgataatcgtataaattgttgctaacttttgtagatgaaaagaacaacatgttcataaccattccctataaaatcatattgccttataaatgaaacatataggttgtcctagatataaaacaatttttgcctgcttgacactcttgtgttcatgaaaattatttttttaatacacaaaagagttgcgcacctatgtattaagaacaataaaatttataagcggagccaaataaaaagaagaagagagccacatgtggagtagatgaaaaactagaggaccataaacctattctcatggtaagcaagagacgacctattgtgacatagcactctaccttattgcgtcatgtatataccttatcatgtacaaaacaataaaaataaagaatatggtcagaccaacttgcttttaactatggatgattggtagtattgatataggggtaagaatacatttttaggatttagttcaatcataagggtttggattaagtcgttgatttcgtaccagctaattaggtatgctaggtataaacatttggcatagcatacatgcacttagtaatataggtgctcaatgaaaagagaaaattgacatttagccatcgtcaggatggggtttcgccagaatgccactcccaaaagtggtttcgttaaaatgccatcctcaaacaggggcaacatgttgtaatgccattttatccatttcttctcaatttaatgatttttgtagtgttttttcttgctgagatgactaaaataccctttatcctatctcatctctctcttcttcctctccgttgcatatacacagcacggctcgatggcgtggctgtggacggggacgacgccagctaagctggggacggggacggggaaggggacgacgccggcgtgggtggggaaggctgcccccaacctccggcgcgtgcgccagccaccgcgatcgaagacggcgacggcggcgagcctgacctggacctccatggtaccaacgcccccgcccttgagcggcgcggcgtcgtcgggacccacgtatgcgccatccacctcgaggcggaaggcgagcgtggtgatgttccgcggcggctgcgcgaagggcgggagcgtggcgacggcgatgggggaggacggggcgagggagacggaggcgagcggggagaagcgatgggggaggacggggcgagggagacggaggcgagcggggagaagtaggtgacagtgagcttggagtttgggttgtcggcgaggagggaggcgtcgatccgtccccagccgcgccggtgccagggcagggatccatctcctccacgcaagtcaactaaatggtcacaggggcaattttgtcacaccacggtggaaatcatttgcaaatcagctaatttggtcgaaatggcaaagtagcaatgtggcgtcgttcgaaaatggcattataacgaagccacaatccggagtggcattctggcgaaaccccatcctgacgatggctaaatgtcaattttctccaatgaaaagggatcatctgacttaactgttgtgtaattgagccactgacacatggaaagagactcacatgtcagcatatgtactttctccttgtctttttcttaaccaacgcttgtaagatcttgtattgtactccctccgtcccataatataagtgattttgagtttttacttatacggtttgaccactcgtcttattaaaaaaaattggaatcattatttacttttttgtgacttactttattatccaaaatactttacacataacttttcgttttttatatttgcataaattatttgaataagacgagtggtcaaacactacaagcaaaaactcaaaatcccttatattatgggacggagagagtagtattcatcaaaacgttagatacccgggtgaactaatatatgttggtatgagtcatttcagcatactcctgtgagaagcagcaaatggacaattacatgtatgagagtatctgataaattttatgatccttgcatatatagaacctgaaatatgcaccatttattccattctattttgcaaagaagaatgtgtaaacggtatcagagctcgaaaattttcacgcatagggctaaactaatgaagagctattttttcacgaataatatagcatttttttaaaaaatataataagaattacggagcgatttcagcctaaacaaataagagctatttttttcacaaattatatagcatttttttaaaaatataataaggattacggagctaggtatagggtttcaaccctagttgctccatgtttgttttccgccccagtgcgcagataattgttacctagctctacatattttgtttaaatagcatagagtatagagcagatgatggacacaagtcgtctgcagtactgcaggctgacatgtgggcccacagccctcgggcccacatgtcagcctgaagtaccgcacatgctctgcaggggatctcaattgagcagatgatattgatctcttaggtctaaatttcataagtaaactatttataaggtattgtttgagttgttgataaaacctaactaacaagctttaatacgtagagaaaaagaagattcctacaacattgtactccctccgtccctaatataaggattttaactttttgcctgtactgtttgaccattcgtcttatttaaaaaaatttagaattattatttattttatttgtgacttactttattatccaaagtattttaagtataacttttcgtttttatatttgcacaattttttttaaataagacgagtggttgaacagtgcacacaaaatatcaaaatcccttatattatgggatggagggagtactgtcttaaccaaattcctcatgttatttcccatcttcgtctactgtggaggagctctaactcattactcatccgttataattatcattttctttaggacaaaactcggtttagtatgtaacatttgatatactacccggtcgaaccgtaccaagctttcttgtaacatatatgatggtgttggagatctctagccaatcttatgccacatcgcatatatttcttttaactatgtatgtgccctaaataaacttagacatttattcgagccctagttttaaagacaaattctatctacccaaattgtaccgattctacctagcacacatgctaaaggaattttgcaaaattatgtatgctcgtgtggctgatctctcctctctactacacatccattgtataaaaacgagatttgaagggagagatacccctctaaacttttttttgtaaaatgaattgataaacatgtcaaaaattaaacacgagattttaaaatggaaaccacacgctctttacaactgcaccgtgaagtgatctctcacctccggtgtacaagcattttccatcgaaccctccatccccatggcgggtggttcattcgacgagacgccgccaacgccaaatcccggcgcgaaccaaaaagcgcgggaaaaatttccccgcacccgcgccatctccacctataaagatctcgccgccgcagccgccttctcctctacactactagtcctcttcaccccgccgcttccaccagatgggccgcaagaggagggctagggtttcccgcgacggcgacggcgaggaggaggaggagcccgcgccggtcgccgcagagagcaagagcctctacgaggtaaatccccaactccaaaccctaggtctatggcttacgaggtgttacccgtacgggtagcggttgattttgcggcggggtggtgttggtctgatcgaatcgtgtgctggatgcctggatcgatgtttttttgttctttttcttttttttccgggattcgagggtgaggagcgcatctgattgttcgatgcgatagcgggatagctttcgttttcttgtttatccggtgtcgcgtcaggttccgcccgttggggaatttcgtggttcgctgcgcggattgatcgtgtgttagtactagtgtacaagtataacccatatttgcataccagattacctcgaattgaagcaactgtgtgtaccatttcaatgtgcaaaaacaattgggcaagattatgctactgatgaacccaaagtacgaagtgcgtacttatgcaataggaaaaacattttgtatcccaaacatggaggcagttgcttgaaggctcacatttcacttgtgaagccttatgactgatatgggagagtgcttattggtttggccttaactttcagctctagttttgggcttcgcagtagtagtacctctccaaggattttatagtgacttaatcttctttaaatcttgctggccttcctgccaattgctctttgatggtatggcattcttgcctttgagctatacctgttcctcttaagtattactgccacagaatttatgaaggtcaactgatgtttaaatctaatttttatcatgttctggaatctggagtaaatgtcaaacaatcaaacagttacgtggctgggtgtgatagggcctctaactctctactatgcacatacattgaggacatagttcaatccttgctagcttgtctcgttaaaaatttatattgtcaaataaaaagggtttctcatatcatctgatcaatcagaaaacaccaatgactgggtaaagtgtgcaagagccaagaggtacaagaggttgtgattggcggttgatctcaagctataccactattagttttaaaagcaagtacaatagcattaccttacttgcataacttaattcaataaaccttatatatgtcccagctgttcagacatcagtattttttttttgtcttgatctgtgctgaaaaattgtaattaattggcgcacactactagactgtttagcgcgttttaaaaaaattctagactgaaggaaatgttgctgaaacctaagcttaatgaagtgccaaagaagagctgaaagagttcatggaaattcatgtaattgactttaaaaaggccacaaatcataagattgcaaccagaaacagtggctcctataggctgagctagctgcaagcctgcaacttaagagccccatcggttggcctaataagccaaagcaaaagccaaaatttgaattttcgaacttgattttaagatattttcaatgtagtttcttttagtgttggattttaagttgctatgaacaaatatataaaagttttacctataaattaatttttatatggcttattagagaatatgggcaaccaatgagacttattgtgctgctacctccctagcagtgacccctagcaaagggcattgctggcttcctgcagcagttgtctgtggtgcaggtgcagctagctcagtggaatcggcctaaattatttatttttaagcgaagctgtagaaaggaacctaaagtacatatgcaatcagaaacaattgttatgcttcagttttgtctttctttataacacaagtaactcatttgatgtttcctttcttcattctgaagatcttaggggttgagaggacagcttcacagcaggaaataaagaaggcttatcacaagttggccttacgtcttcatccagacaagaatcctggagatgaggtaggatcttgtttccaaattttttccatggattaagtgccatttgtctcaattgagctgttatgtgatgtcaggaagccaaggagaaatttcagcagcttcagaaggtgatatctattcttggggatgaggagaaaagggcattatatgatgagactggaattgctgatgatgatgtgagcacctgattccaagtagtgtgatttccaacctttcactcccagtagattttctgaagttttgtcttttcctgtaggcactggttggagaagctgcagacaatcttcaagagtacttcagagctgtttacaaaaaggtatctttttggtccatatcaacaaaaaaacttgtgctatctgttcacctatacaatgatcggtgatgacctacacttctgcaggttactgaggctgatattgaagaatttgaagctaagtacagagggtcagattctgaaaaaaaggacttgaaggatctatatacaaaatttaaaggcaacatgaacaggtggcttacaaaatttagtgttgattaattttctatacagaaggcaatgaattgcaagtgaataattgggttccatttctattttaatttggtgcccttgtatgcaggcttttttgttcaatgatttgctcagatccaaagcttgattcccatcgctttaaagatataattgatgaggcaattgctgaaggtaaatgattatatgctgttgccatataattttatcatataatattgaatacctttttctattccttttctacaatgaagcgctggcaaagtgtttagcttatcatgctaactcaatctattccctgaaacttctctaatggttaaactcctttccatttccttcccttttgtaggtgagctgaagtcaacaaaagcatatgataaatgggccaagaagatctccgagattgaacctcccacaaacccattagagagaagagtgaagtaagctctcattctcttatctcccaagtaatccgccttccgagatgttgtctaccatcagttgctcactactgcatttgcctcaaacctcgtcacaggaagaacaagaagaagagcgaggagaacgatctgatcctcgcgatctcacagcgcagggcgcagcggaaggaccggttcgactcggtgctctcatccatcatgtccaaatgtgacccaaaggggagcagcagctcggagcccacggaagaggagtttgagcaagctcgtcagaggctcgagaaaaagcgttccaagaaccgcaaatgattcgccttgcagcctcccttgtggcttgtgcaattctgtttcatcgagtttgttaaccaggcctatctttgacagatcagattgtctgatattctgatccctagtatctatgtgagattggctgcttctgttgtggtgcaagttcaggctggaatctgaacttcctgctcttttgctgaaactggggccgatctttagcatcactgcatatgtgtataatcaaaatcttaaatgtttcctggatgtgaacttgtgatctagtttctgtataagttaatccagtagctgtcttgagtttttacgcctgtaaacgatataaacaagaatgcatcatcaacagggacgagaggcgggtttgcaatctcgttttggggttgaattgtgaggcacagcactattttcactaaattctgatgaaatttcaaacggaactattcataaaactgaatggtttgggaagctcgaataaaattcgcatgaacaatcttgataaaaactggttggtttttgcgaaattttctgtgatttcgagataggctagaaatcatatttttgagaagggggggggggggggtcgaatggtatttgaaaattttagggtttaaacagcaaaattcgattgaaatttggcaaacgccattagattagaacttcatcgagcaatcacctccactaatcaccaccacccctatcttggcaaacccactaatcaccacccccatttttggcgaagctccaccccgagcttcgctcatggccgctcgccccgccattaaaatcccccgcgcgcctcgcctcgcctcgcagctcaacgccaccaccgcgcgcctgcagcccgagaagccgtcgatcgacaacatcacccgtctcctcccccaccccgcagagcccagcacttcgccgccgccgcccgggatggagatgaagaagatcgcctgcgccgtgctgctcgccgtggcggcgtccgcctccgcggtcgaggcctccgagtccccggcgtccgcgccgggccccgggtccgccagcggcgccaccgccgtcgcggccgcgcccgccgccgccgccgccgtcgtgctctccttcctcgcctactgcctgcattgatgacgaggagagagagagtgagagagagggtgtctcacgtgggagaaggcggcgcggctggtttatttgtgtttttttttaaaaatatatgatctaattcgttggctaatttgattgtttttggtttatattttaaatctacgtgtttgtgaattgtggttgaatatatatatatatatatatatatatatatatatatatcatgttgcttaatttgttttctgacgttgtacctgctcaaatccacacttgtaagcttgtaaccgttattttatggcaatttaaatatagcatatgaattgatttgttcctttttaattgttttttttgtttaaaatacattcagatcgttatagatttatcgaaaacggtaaacatctttaacacaagtcgttttgtggcatggagaaccatctgccgctcaagcttatagaatggacgcaggagtaggtgggtggatggcatgattcatgtggctggctattgtattagcccaactacattgtttcagttagcttttatgaaactgataaataatattgatattactactccctccgagttgataatatttgtcgttttaaaaatatagtctaagaaacatatttgaccactattttctattataatatatatagaaatatcacaaatatataattttattgaagtacatttttaaaactaatatatacatatagttttcatatttctaagataaatattttataaattatttatagtcaaagatttgaaggtttgactttactctgcttcaaaatgataagtattaccagttcgaatggagtatagtacattgtttctccttaaaaaatctacatcatgttatccgcgtcacattactaaaatcataaagagatgtgacacttcataatactacgaatctagactaagagacggttcagattcgtaatactagaaaatatattcctccagaatcgcttatattatgggacggacgtaacatatagaagttgatttagaatattaaaactcaactaatcaatcacatggtaatgactttttcttttgtttttggtggcttaacttcatctcaaccaaatctaaattcgacctgctatatctgctcatccagttagatctcgaccgtcgaatctgcacgatccacgatatcaaattcgcgatatatatatttttttaaaaaatacaaaattccaagaacacaagttgccaatatgccctgacaaagacaacaaaaaaaagaacagaagaaaaaaaaaattaccaagacaaaattcccctatctattgactaacccaaacccaaagcacataagcatgtgattagcaaaagacgccgtactctctctctcatcaaactgctgacgtacgcacgccgtgagacgccgccgcagcaaaagcttcccttcccccatctccctctcctctcctctcctccccgcctccccccgcctcgataccctgcaagccctagctctctctcgccgccaatggagtcgcaggtgctggtggcgctcgccctctcgctcgtcggcggcctcagcacgtccatcggtatggccccgccccctcgcgcctcttcccctctcaacagtttcgtttcgggggtttggatgctgctctgcctgcggtcgggcgcggtttcctagggttccgcgggtggatttaaggccgttttgtgtagcttgcgggctcgctgcttgaaggaatcgccaagtggctgagcatctcgcaatctcgcgttcctgggaatttctgtgtttctggtgagtttcaggtgtcgatagcgaattctgtcttgctaccgctcgtataggtgacttccatgcgaattcagatgcatcctttattagcaaatcgaaaattagtgtttaggatttttgttaagaaagagagttcagaatccagtgagtatctcccttttgtaccattttggcttgtgagtgatgaatgttttgctatttaggcctctgaatatgaaaattaattgatcacaatgattcatcagatttttttgttttaaggtcagcaatggggtgttgtaatttgtaaataagtggcataactggacaggtttagtggcagggtgtggttttctcttatgtgtactatgtataacaggataagtaataaatgtcgttgcatggtcaaaaacttttaacccctagggttcaacattgtacttccttatgtttggttaacaatttgcgaccgtgaatgatctcaggacattgagcgatgagtactctcttttaaaactgtccctaatactatgtggagggtttccagcaaggcttctttgtgccattttcccactttagaagctccaattttctgtttttcaggtgcgctgtttgtgattttgaatccgacgcctaatcttaagatgcttgggcttctacaggtgataagctttgttctctatagtaatggagcaacttcactatcttttaagcaagttctggttttgctattggttcttggtagattgatctcttgctgttactgaatacagggttttgccgctggacttatgttgagcatttcctttctagatttggcacacaatgcattgaattctattggtttcttgaagggcaacctttgggtcagtcatgctttgcctatacttatagtatccatgccaatgtaatgccgatctatctcatacaataagcagcaaccattgttaactaataataatattttgcagttttttgctggagttcttttctttggtttggttgtcaagtttattccagagccaactgttgtgccaacagctgatgcaggcaagaagcaggttgaaataagcagccttaataatgttttcacaatcatattagtctgttttcaaataccaaggctgaacagaatttagttctctatgtttggtttgaggaaagcagactgacgatgatggttcgggtaaagatatgatgaaaaaacatcgtcggcaagtattattcagtgggatcattactgctgttggtaagaaaataagacttctgtatcactaagcatacaaccagacatgcattcctattgaacttacaccaggccattattcgaactgtttcttgatatatgttgtgtggctttgcttccttgttccttgagatactacaacaatctgatttgatacttattatgagcctgcaggaatcagcttgcataactttccggaggggatggcagtatttttgggatccatgaaggtattgcttttgtatattcatcattccaatatagtggcatcattcatctgttgaagggatctgtaacttgcatttttttcatctaatagaagttacttgggaccaaccacctttcaaagcctttactagctctggtctataacactatataacatagttttggtgttccaatagttactgtatttgagtagttggcttggcctagttgctagttgtatttaatatcattctgtgtcccaatagatatcatgttggatatttgttagcttgccctgaatgtgttttgttatgatgaaaaactgcagggccttcgtgtgggactgaacttggctattgctattgctttacacaatataccagaggtagataaatcaacttatcagcatttctggtccatgagaattcttaactacagtttgatgttgcatattgctaattaggataccctagcttgttgtatgtgcttgcagaaagatttgaatgccatctaaagtttgcctcttagaaaatatctggtatttcatttatcagtttaatatgaatcgccaacgttatggcaaactaaatcatgacaaggaaaaaaaaatctcaagtttggttaattatatatgcccttaagctgcaacatttatgacattttctagatctcaacaagtcaatgtagctgtatctgaatcattgttgagtgtggcaggatagagtcttggacaacttcttttaacttctacagaacttggttcatttactgtagtatttatctgaagccctaattagttgttttttttttcaccttctcagggggttgctgtagctctaccactctattttgctaccaacaggtacctattttacccatgtagagaggaactgaattaagttatatggttcacagtagccttcagaaatgagttcattaaagaatatatgttatggctttgagattttctatagacaaaagagtgtactagttactggtaaaaaaagagtgtactagttactggtaaaaaaagagtgtactagttgaagtcatgaattgaggataggtgtgtaagatttgagaactagtcattggcgaaccactcttatctgctagtactacattccacctgttgcacttggaggattacagagcattaataatttctaatggttttgctttagcgaaaaggcaaatgatgcttaaccttttcaatttgcaataatagcatgtttctgatagttctcttgtaattttgtaacactttcttctaccacagtaattatatcttgttccttttttcacatgtcaaagcaaatggcaagcatttaaagttgcaaccctctctggtttcgctgagccactaggagtgatcattgttggtatgctatgtcatatgcacttctctgtaatatttttcttctggtgtatatccattgagtgctgaaggctgatgcaaatgtgattgcttcagcttacttgtttccgagcagcttaaatcctgaagttcttgaaggcctacttggttcaggtcagtctgttaataaaaagaaaaactggtatcagtattctgcattttgttgacctcccatgtgcctttctgcagttggtggggttatggccttcctcactttgcatgaaatgttacctctagcatttgactatgctggtcaaaaacaggctgtcaaagcagtctttgttggcatggccttcatgtctgcaaggtttgttgatgtttcaaataaagtactcctaatatgtttcagatcatccattgtgactaatgtggatttgcattcagtaaagattttcctttatattttttgatgcacttctaccctggaatataagtaacttaatgctcgcaagtgctgaattgctaaaacatcattgtcataaactcatcatcaaaattaaaatatatcaaatgaatagactgattaacttattgaccttgacactgaacagctagtcaatcttataccgcagcataccgtcacattgccttggagcggtacatatgctattcttacacaactaatctctggtttttgcattgtcagcttgtatttcttggagatcagcctgccaaaggaagtgagcttgtagcacatgactatccatacaagcttgtcacactatcctctgaactgaagcggagaacttaggagagatgttaactttctgagcactgccaggcagggatgtggggatatatggttcgccatttatcaaacggaaacaaggatttgtgacttagattcgcgcgttggccatgtgtatgctatcacagctggtcattgtatttgaccattttacagtgaagatgaacagtctgggatgggtggcaaaacaccacccagaatcagaatgtaacctccgcttgttggggaggaataggacacaacttgaactagcagactgatcagatcagtcctttaacttgaccagtgtacattggttgaaggcactgtgagaaaaataaaaataaaaatgcttcgttttcactgtcaagaactgtctttggtttgaacctttggccagacatgagtgaattatatagttccagaaaccttgatggtaatatatcataatcctgattgttttagttttaacttttgactagtctaaaatatgtactatcagaagtagctatattttgggatagagggagtagtttgaaagtattaaactaatataagtatttctccatgctgttacatttccatacttttctaaaaataaatttacaaaattcggcggcatcttattgattacgaagataataaatgtcatttttcactctagggccacacaaaaagatttcccttgatcagcagcaattttctcagacctgttgaaccgccgacacgaacaatcacacaactgcatcaacagcaaccacattactgtgcaacccatgtatcatgtcgtgtaagaatttaaaaccaactgtactaacttttttttttgttaaccagggttagattgcccagggataaccagatgcacaggttagagttaaatcctaggtttttttttttttgctttaactcaccactcgtcgaatgaccactttttatctatcatgatatatatcaaccacaacatcaatatccaacaattcacatgtttattagatgctcttttaacttgaaatcaaaaaaggaaaaaaacagagaagaatatatattaaagaaacacatctagattaacccataacaatgtagtataacataaagcaagctagcttaaagttccagcaaacttatatatgctatgcgaattaagattattggaaaataagaaaatttcaagcaactgagacctaacaaaactatatataacaataacatttctcgtctagttcttataagatgcatatgctctagtcaagaaaatatgttgctttggacaggcctaacgatttggagtatttttagtatatccgtaaaacccgacaaaaatttgatactgtgagaaaaatatgtatttgatatgtttgtttttcatacacccgatctaaatattaaaaaagatattgacattcaaaattttaaaagttctagtgtgccttacacatccaaaacggtaaaatcaatgttttgattgttattgtgatgaacaattgacatgagattttatttgtattggttttgatatatggtgatttattggcgaagtgattttgtctctgtatgggaccagacagtaggcaccggtcaaactgtaggcatggtggcggtcaaaccggccaaccagacggtttgattgactagctcctgtttggagttggtttggagttgattttttgattaacaatgattgcttcttgcttatggcttccagatgatttctatacgtatgttatatatactgttgtgtgataatattgagtcaagttggaaaagaactaatgcttgaatatggtttcttatttattcatatgtaagtgtgtcttgagatctcaggagagtattgccgatgatggatagggagtcaacttgagagaagttttgtctagatgatcaggagatcttgtggggtactaatcctagaggacaatgcatgtggtgatgaagattttgtatgtcatacaagaggtgttgtatgcatatggaaagcatagttaattttgaatggagtccaagtttgaaaagtttgaagtttaaatttgtaaaggatattgagttggatacttgtacaggtgagtttccgaatggattaggactacttactcatgttggatttgtggcttttgtgcagtcatctcaggatataaatagagaattgtcatgagaaaagttagggtttaacctagatttgagtttagtcgaaagttgagagaggagcgtttttgttgcactttataaacacaattagaagcaataaagttgatctacattcaaagaatttttctgatttatgttctctctattatgatggtcaggccagtagaggaacgacagtcagaccacgacggtgtgaccgaaggcatcttggtggttggaccaatggcatcaagtcaagaggaaacaacaataggagatcaggcagacgatagggaggcggttagactggtcaccggtggcataccgtcggtcaaaccaacagtatcaggtggtcagaacgacgctcaacgggcagtttgaccggagcaacttcttcgggttttaggatattttcttattaaaaaaatttggatttttatgttcctaccattgacgtccctcgctggtaagcttggttgttgtgttcgattaaaaaatgttttatggcctagtggattattttgttagacatgaatcgtgataacggtacattctacaagtccctttttcacatctcctcagtaattttctagaaattatgcaaaaccaagaaccagctagtgttgttattttatttaacaagtgtcttgcgagttattaagtactattgaatatatacaagccataacaaatggaacgaattgttacagagaagcaaattcgaggtaatggaattcattgattaattccggcgtttacttacaaccaatattccaaagtttgcacgactagctaccgatgtctaccataagctaaataaaatttcgcaatgctattatttcttgtggatctaaaacttcaaaaaaagcatctcaactttaattagctaagtttgaattatttcacaatatgcaataatcactatagtcatagcaatgtcaaacatagttcgaattaataaatctaacctcagttcaaaacccatgcatttaccataagcacactgtatatatatagtgtttaattaatataattaagatctcacacccaaactgcaaattgcatgcaatacacatcaaatcaaatcaaaccaaacaaaaaaacaattaagagagtcctccacatatatatatgatcgatcacaaacaaattaattttctactaaaaaaataacctgaaactaaccaataatcagctaattaatttcgcactcacatatatataaattaaggtcatcgcagcacaccggcggcggcggcggcggcgcggccgtcgtcttcggcgccggcgccggcgccggcgtgggcgtgggcggcgccgaaggcccgtgcgtggtcgttgagggagcgcttgtgtcggaagtgggcgccgcaggcgcagcgccagaggcggccgcagttcttctcgtgggtgcgccagtcgccgcggacggcgaagcgcttggcgcagcggcggcaggcgaagtcgcgggcgccgtggcggcggcggtagtgcgtctgcagggtgcggaagtccttgagcggccgcgcccgcgggtggtcgatgtggttgcggcaccccgccgcgcagcagtagcacggcagccggagcatcgccgtcggctgcgccccgcgcagcgccgccgtcccgcctcgccggtactgcgacccgtgcccccacatgtgcatctgcactcaccacgcaacgcaatttttcattcttaattttcagccagctgcccattgttcatcttctcttaattgcatgcatttgttttttttttctctataggttgcgtccatcaattgaatgatcaatagatacacgaaatcaacctttatttttcgattaattacatgcaagatacgcacaccaccacacacactatgtgagatattctctcgttgtttgtatatcacttaaatagttatataaaaattaacaagaattgagaatatatattaatgtgtgacatatcactctacaaaaatgtagcttaaaattcaatttctacatgtcatacaaaaaatcaaattaaattatagctagttaacatatattctcagttaatttttttttacacgtacaagttaaattttaagttacatatttatgaagtgatatatcacatgttaatatatcatcttatttttttataactatttaagtgcaacgaggggacgtctctcgagtttaaaattcactctccactatgacaagcattaattacacaaacacaccacgacgtaagcaagagcatgcacattcactaagacacattataatgactaatgataaacttcatcgattgttgggagtttcataagatagctgatcataactcataaatatgctcaattgctagaaatttattggtatatctttttatgaccatatagatcaaatggggatcggagtaggaatttaaaacacacttgtcatatactccattatttaagtatatatgtgttttttgcacgtataaatacctggaggttgttgtatctgttgaaggtcttgcggcagacggggcaggagaactgggtggcgccggcgaggatctgcgccgccgtcgggatccagtactgcccgccgccgccaccgccgccgctcctccgcacgctctccacctccacacccacgccggccatggcgccgccgccgccatcatctccagcaactcctgtactagaagcactagccccatggttcgccatcgccggcgacggcgacgccgacgccgacgagacggccggtaggcctatgcgcaaggcaaccgtgacctcctcctcctcttcctcctgctgtttgttgcagctgcagcaaccgtaccggagcagctgatgacgatcatggccgccatggccatcatcatcttgctgctgctgctgctgctgaccactgctgctgatgcaagaagaggtagatgaaatgaggctgaggaaagggaattccttcatgagctcgggttgatgatgatggccatggcctctcgagatcaggttggtttgggcgtagtcctccatggatggatggatggatggatcaatgcgagctaaggtagtagctagggtgcatgaagaattttgcagatgatgtgatgctgcaggggatatagctagctggggacgacgatgacgaaggggtattgtggatatcgtttgatttttataagatgtgggttggattaatttcacgtacggcctccagaaaatggagcttgacattatttgtaggacgaatcgaacgatgtcacttttaataatctaaatggtgagaatatatatactttcgttcgttctaaaatataaagacgcaactgataccaagaaataattattatcacctttttatttggatcaccctaataaataaattatgtacacacctaataaagttagagataagggtggaggatttaaacaaaccaatttaaacgagggaagctagttaactatatgtatatgcatatatgcacgtcttgtattataaaacatagaaaaaaaatagttgtgtcctaatattttgaaatggattatagagtaatatttttcagatgtatgtaaacagctagtacgactattatatatcttcttcatttccttgtacgtcctgcatgcatggttgcgtatatatgtagtgacgacaatatgtacggttagcataaagttaaaatataaagaattacatttaatgtaaagatagtagacatgattctttgaaggtattacatatgctaccatttatatatatatatatatatatatatatatatatatatatatatatatatatatatatatataatattacctgtacaattacaaccatatgtaacaggattttattaaaaaaatatcattaacccgtcagtaccattaatttgtataaatattatcttttagtttatatatatatatatatttgttacttaaatgtgatctctctgggcccactagcccccacaatcctttttccttcttaaagaaaaaaataaagagttggtgataaggttgattgacgtgtaagcccttatactagaccccacattattctttatccccaaaaatgtatcgagttggtagtacaaataatggtagattcaccatttaccaccaccactaattaaggagtatagataaagaaaatagcacataacccctccgtgtttctatgacaccgattacaatccacaggaaactaagcattttaagcgacaatcatatgcttacgatggaattatcatagccattcaatatttggcaaatgaagtgattgagatgaaatatttttttccttatccttaatctttgttaaagaacatactcccttcttccatttatatgaaactttggttagtttaaatttttactaaccaatgtcatatataaatggaatgagggagtataaagaaatgctttatttaagaatggatggagtaattttttagggtaattaatacttttagaattaatttcttactatccaaaagttaagaatgaatatatagaaaacctaaattaagttcaacaattcaaaattggtataagccacagttcaaacttcagctaattaatcaatcatcacctacatatatacatgtgagaaaattcattttttatatatcttgaacagctcacatgcacatatctactttctctgacaaataattatctgccagaagtacagttttgtaaatcctaagctgtatatattcaccagtcaaaccatacaagccacacaacaaaatggacctgcagccagggcccactgtttttgcatagctagcagtatagctcaatgttcaactggacacggcttgattgattaattgaaaatgaaatgccaaatagtagcagcattcattgtcctgtgctgctttctccccagcttaattaattccccaattaattactgtaggggtcgtcgcaagctttgcaacccccaactgacagcacttagggttcaaggtatggatggaatagatcaatagtgagagccataaatttagatacagtaacagcacgtactaggtagcagagggacagatcgatgatcatcgatcctagtcaccgatcatgaatgtttcaagatgatcgagatcgtggtcaccaattgagagatgcatggttacatcttttagcttttgttttgaattgaatcaaggaaattaatatgtaggaattgcgaataaaaccttaacaacttctcaattacatgaaagtcccacacaccaatgtatatatatatattcgtcaggtttcctccttcgacacatgttcaaatgaactgtgaaaaatcttactccaatgccaaataatacacatgtggtacataaagtactcatatctctacgcgtctaccgcagcatcatcaggcatgattcactaaacctcaaattttggcacatgcaaaatacaaacctgtcttacaattaattattggttcgaccaaatccactcaattattggttcgaaaacgagattttagcaaaatataaaggttggaatgcatgaagtcttctaaaatctaaattattgtatgttggaattgaaccatttcacttcaaaattaaaaactactataagacctctttggaatttttcttttgcatgtattaaactagttctatgaaaatcttaaaaatttctacgttctaagccctaaatactaattaaataggaacttgattttttaaaaaataaactgaggcaacaacctcagggtagtttattaaaacacaattgggagtacacaaggcccctcatagaacattttgaaacatgtaaaaaaagtcctctaaagaaaagtaaaatgtgatcaggtccttcaactccttccaccgagctgatgttccattgttccatccagtgtctacggtgatggtgatgaaaccatggcagactgcaaagggcatagtcaagaagcaaacccaatcaaggcctccatgatggaggttgaagctttcatggccaaacaagaaaaccacaatcatcgctttgagatccaccaccaaagtccacagggaagagcgccaacccttgcaggtctgctcattggaaaattgaagaatggccggcgtaaccttttattgcttgtggatttgaaggactacatgttacagatgttgataaccaaagcatcggttctaagcctgacggttgctagctagacggcatcttccgagaccaagtctagcagatccatccatggcatgacaccgccaggacaaaggagacagaagtcgacatctcctttaatctttacaagaaaggtgggggagggggacaaaggatctgtaacataatttacccgactatgggacgagcttgagcactcccccggaccccccctccccccaatcctttcaccggcaaccaccggggacgaagaggagagggattccaacgagacaaagacaccgtcacctgtgggtccttctctaattgtgagagaacgtgtgttgggggaatgaagtccgtcttaaattaaacaagagttaggtaagggtaattcaaaaatcttccaactatgcctaatgttaatcttactttcgagttttgagggattttggatcgaatgaagggacatgacactttgaaaatttgcacaactatgctttagcaaaaaagcattttaaaaataccgataaataacttttatcaggtgtttggttcataccaaacctttggcaatcaggtttgcttaacatgtggccaggggtggatccactccaccacccgatgaccgggctggtcgggtggccgcacaatgaaatttaaatgttttaattttcaatttatagaagcaaaattttcattgcaaacacttgatacaatattttttccccatgctctaaaacttttttgatctaccactatatatgtggctaagagtttttttcagccaaacaaattatgacataccacaccgcaccttagctctaaaagttggtaaactaaagcatatatacaaccaaacagccccaagtgtttctagctcccgccactggaaaggcgctgtgactgaactgtgcatgcttgaccgatccgagagaaaacgtacgatggcaacacaagcgaattcacgatgatgataatgcagggaccagcagtacatgagccgctagcagctagctaagcactgtctccatcgcatcctccccctcgctaagtcctcaacgaatcacacacatttcgatcgaccacatgcacgcatgcacaagaattctagcatacagtactactacaatgtgtgtgcatgcattgtattccctccctcccataatacaagggattttgaagaatacaacacattcagtacttgtagtactttgaatctgaacacatgatcatagtactatgatatattacatactttgaatctgaacacatgatcatagtactatgatatattacatatatttaaaatctcttatattttactctctccgtccaaaaaaactcaacttctggagtttgaattttgtccaaaaaaaaaccaacttctaccattctacctactcccagcaagtaaaatgagaagttttattccttcaacattctttacctacatatcatcattactattttttttaataataagaggtattttggtcattttcactctccactaatgttacattgggatgctaggatttgattttataagggacagagggagtaagagtaaaaaagaggagggtttgattttatatggacagagggagtaagagtaagaaggaggagtagaccacaaatggtactacactgttatatcacatgatgcatgaacacacacgccacagctagcgtagtacacaaagatacccaggattgatagcgagagcttcgatctggatgagaggctgctttcccgtttccttttctaggaggctacgctgagctagataagctgcaatgctgcatcatatcacgctcacaccaagtactacaagatacccacacacaccggtggtggtggtacactactactggcttctagcttttgccttttgatatgccaatctatggaagatcatggttcgtgcactggtgatgtggagagggtgatgctttctgtccctgatggacagataagtgcaacagtggcttggaaaagctggtgttgtgatcatcttgattttgaattaatcatggaaaagttggtgttgtgaccttgttttgcattaatcatgtagtagtacaactttggcatcttgctattttttttctttcaattcgattttcttggatgccatctagctacctagctaggcaggcaaaatgaagtgtaattattgacattataaagtgttctgtaagaatgtggcttgggtttttcagtaatcatgaggcactcctagctagttagttcccatatttggtgcaataatccaattcttttagttggaaacatagcattacggtgtactaagatttgatttccctagttcctacgaattaacgaaggatactggagtgacctctgaaaaccgctgcaagaaggcaagagagaataccatgaatagacagcagctgagcagcagaagcatccatccatgttgtccccagatgcatccaggggagattaatctgcaggaaacctcatgatcacaaacgcgaaaatcgccgattgatcggtccactgaaaaactggagatgataagctcaggttggtctcctcccataatagactgattacacactgtcaatcgttggctgcatctggcttgtcagcttatatctgcaggccatatcatgcatgcatgaatcccagaaagattggtctcctgggtatttgattatcagcatgggacagcctgctgatggttgcctgtgcaatgatgactaacctgcagcatgcaggcaatgcattgcaagatgacttgtttgattaaaaaccaaactctatggcaggaaggtaggggtaaactgggaccaaatgaacaaattcagtagcaaactaatttaatcaggtgagtcatctgatctactagtgtgcagaaggacagctgggcgcctgggctactgcaagttctagagatggaaaaaataatgccgacagaatggtgtgcaggtgtaggtcttgaagaattgtcaatccattatatgctggacatatgcatgattacatgtatcgagatgctaatacactggtagcattttgcagtagcacatggatggcatgaagcagagtagcaataaccaagtcctgaacccaaaacagcacagatgtttctttgaaggcaaacaatcttttgaacttttatcaacattgtaagttgtagctgtaagaagaatgaaaattaccaaagacagcaagagagaaaattattttcttgaaattttcagctcgggaaattgtattgagtatatcttaagataaaaggataacttgtagctggaaaatgacaggatgagacactgattgtgcgtacctgctagcatgtccccattgcatggatggaagattccgtgagtgctcttcagtccagctttttattggtttgggaagctttcattcatcttgagatctgaggaaatccgatgcatgctgcaacttctcatgacacataatacaggcccatgcgtgcggacgtggctttggtcctggacagactcaaagtggcagcttttgtttggagcgaacttgcaatgtcatcagacagattatgatagcttttgtttaagctgaatagcagaggctcagatttctccagctaacattacaatacaaatggtgacattgatacaaatccaaaattttgtcctacgacaacgacaaaacttgtttaaattatcccagggaacttcacccaaccataagtcatgagtaattacctggtgggatcattttctcctcagtttcaagaacatctacatgagaagagggaggattgaaaaaaatgtacaaatatgttacaataagggaattgggacagacaaaatttgctttgcaaaaggctttcacatattgataccgcaaagaaatggaagtaatggtactatctcctaacagcagctaatcaaatgaaggatcacgccgacaaacacaatgatactctggttaatttctgtagccaaccccaaaatgaaatcgccttgcttgtttatcattgaaagcatactcaagacgcaaaggtcccagtggggagtccacacggacgccaacaccgtaaccgtaaccacttcctggcttcccacgagctccggctgggtcacctaaacaaccaataaccaaaggtggcctaaatgagatttgggtttagcataaaagagatgctatcactgtaaatatggaaccatgtcaaaattgtttcagggcactaaacctcattaataaatgcaaaagacattaactttcccaattataaggattgtttttattttcacacctatacaaggcttaacaaagtagagaacatctactgactactagtcgacaggactgtgctgctttaggaccaacaggtacacaagtggaccacaaaacttccgaacatgtaaaatgcgagcagaacatggcttaccaggaactttgggaccagaactaagatcactaccatagtcaccaaacaccacaccttccaatggcccaaactacacacagaaaaagcactgtaagtaatcaagatgatgaatagaagtttgaccatcatgcatcaggtcataatatgcacttgtcatcatgacagaacaattttcgtatagaaattaatatactcttcaccatacccgtctaaagcaaaggaaaaaaatattattagagtgatacaactcatgaaatatttggtatagatacaactatttgccattctgtgcatcacatagtgtcctcaccaagttaactatattcttaaatacatccagtccaacaaatataacttcatcttaagttgcaaaataattttaatctcaaatactactatttttagttttcttttatgtatgcatatccatgttatcaactaggtatttatgggggaaaacaagtagttgtgtatgtaagtatatattttactgtactgatgattcaggttaagccccttctactaaagacagaacattccataaaaagtgacaaagcctaccatgcggcaagagacttctccactaccaacagcatatgagcggccagaaccaacagcaccttcttcatatcctcttacactatttgtcccaccaattgcaaatgcttcatgaggcgaaaagtttccctctacatgacctccagaagcactacagcacatagaaagagtgatttatggaatgagtaatacaacctgggcaatttgctactggaaacctttagggcaaactcatatttatgttccaagatccatacatggcatatgatatgcactaaaacataccttagaagaagtcgagcagggccaatttcatagccctgcctcaaacgcgctgtcactctgttaaaactgagccactcaggaagaataggaagaccttgctcaatgttgaaaacgaactggaagcagtaagaacagtaggtgataagagattttgacaacaaaaattagaaaataagcagtggagtaggaaaaatgctaaccattgttgagctacgatctccagagtctgtgtagacactttcaagcttagctagtagtgtatcatcataagcatttccgctgcattgtcatgacaagaacatcagattccatatgttaacatgatttgacaattgaattcatggtagattgaacataaaattatttatggcgcaaagttaaggtaaatgaagcatcgagatccaagacctggcagttaattggctgttatagaaatctctgatgataggattgcctttgtcatcacgagcaccagcatgctgcatagagtgtcagtaatcagtagaatgaaggtccccaaagggacagatttatagcaggaaccaaatcaacaaacttagtcacttgcttcttacacggttacaccattactggcggtacaaactgtgctcatgtactacatctcttcttttttgcttgatgctttggatatggacatgtaccattattacttcttctaattatgtatttacaaacaatattaaaaacataactgcatgaaaggaattttcatgataaatctattggtgctatttttataattaataaatcataatattttagcatatattaatgatttaagatattgaggtttgacgacgtcatctatatttaagaacgggggtagagtatccttttttatcctttaacctaaggtagtattaatgtcacaagattgtctagtctgggtcttctctcatggccaataagtacggagaaagggctacttgattactatggcaaatctattctatgtgaaaagtaaaactcaaaaagcaaccagaattagccacatcatctgtcaaaaaatggccgttggattcacaaaatgacaaaatagcaaggaaaaatcctagccattgaaacgaggaatcttctagaagtggtaaaatacacagagaaggaagagtttgagccactcattgcctctcattgtaatctcatgttggcctcccaaacaggtctagggctggcttggcttggcaaatcaacccaaacggtccttagactagatgaccaattaaataattttagaagagggaaaaaatattctacatataacactgtaaatcagtcagcagcaatcaaaacaatatatagaaaagaaattaacatctaattattgatttaactgaatggtggaaaaattattgttaattacaataacggttaatagataggaaggttatagtcgcgcgaacatgcgacttcattcactagttgtacctgaaatattaatccaagtgtgccactccatttaggtctgaatggtcgactgtattcaatgccagcagtaactcgtccaattgtaatgggcccatggtcaggatggtccccaccatggataagtgttccgggagtcctagagttctggcaaagaaaataattataagaacataacgatgattgtcagccataagtaactatggagcgttgaagacggaattgtcttaatcataattacctgaaccatgatagttctggaggtcctcttattgtcaccatcaatccaaggatcagtatagtttaatcgaaatatagaatctatttgccccctctccagtgagagattcagcttcttgttcctcccaaaaacatttcgatgagaatatgcaaaactgtttattccagtgcgagacaagaattagatgtgcaactccagtttgaggacaacttctgtaaggatattaactgatacatttgaagcaatatctaattcttcacagctgataatccaggatgcttcctagaagtttaagaagtctggtttctaacaaacaacaatcccaacattgttgcatagaaaaaacagctatattctggtcttccagcagaaacaagatcatattggcatgtggtaagaacagtacgataaacaaaatcagaatagccgaaggcataaaaataaaaagagtggaagaatctaccaacctgccaataagcccagaaagtggtccatttgttatcctgcagaaaacacagcatgccatcatgataaaatagatgttaaaacaacatttggatgcaaatttgcatatattttgcatatggtctttgaggtacagtaagtttaacattatcagaaccttatggataaggaaattatttttatgaaagcaaagatttgatatttcattcaattaagttcgctcagcaagccttgtactcacccacttgaaatgccaccaccagcagaaaaaccacccgaaggtcgttcaacaagattcatgacaagatcaactttattagaatctgcagaagatcataagtaagaaaacatgtgctaataagtgcaaataccagctttccgaaacagactgaactaacaaattaacattacctccaactggctgtggaattatagtaacatcctccatgattcccatagtaaggattgtttcaacatcccttttcacttgtgctctattgtaagcctattttcatcatcacaagtttagacagataatacagtatcactcttatcagagaattagtctgtattttcattagcaaaatacttctgcttcagattgcatgactacccctttctttctttctttccttttttttgcagaatacagaatttgtgcaaaattatatgtataggcaaatattatacataaatgttcaaagaatttaatgagtacactctaacatcggtataaaaattaagttttgtaattatggcatttgcattgcaatttcagaagcacaccaaagcaatgcttcaatgcctagtgcacagttcagtatgaaatggaaatggttcttgaagtcatatctcatgaaaactcgtatgttctagatataactgatatgaatatttgtgaatatcatcaacagtgacatagtgcttttaaagtaggtatgaaatggaactagttcttaaaatcatatcacaagaaaacttctacattgagaacacaactgatgtgaaatttgtaaatatcattgtagtggaatagtgttcctaaagtaggtaaacacaaatggagaaaagtgatttcaatgatctgacctgacccttcttggtggtaaggtgacggagtattgtctctggttgcgtcttcccaacagttggttcaccactggtgatggagagaaatagaaagaggtggaagataagaaagatcagaatatcgcatagaaataaaacagtaacaagtgaagcgaatctcaataaatcaggctatggttctcacgttcttctatccagaaagcgaatattgatattattaacctcagcttcagaaacttgtagcctcagaattcctccagaaagaatctcagcatatgaaacctgataccaaatcaaggggctttattgatttatcagtagtaaacaaaataccttgtttttcttgttaaaactgtaaaagtctgatgtgttttgccctacaataatgaatgccagagctcaacttatcgataggttgctaacttcagcattaaccacacatcatatttctaatcctgttaggactaagaatttaacaaataacagaggattaccatggtgtatgcccacctatttgacatcagcaatatatatgcaaatagtgcaggttagacaatctggatagcaacaaatcgactgctgttgttgtatgcatctaaaagtttgtagttacaaagaatgtactgtaaatcaaatgggcaccagaagcctgattacagcaatgctcaaaccttttaaacaaaatgtgatatagaaccaaatagcatacaaaagtagaagatgagttttatattcactgatttgccacttaccaagccagttagaccacgttcctgataccatccattaacagacttgatcacttgatccaaatgtcttatattgattattttccctgcatagtgtaatatgaaaactcaagtaggtctcaaaagaaaatgcgacaagctagaaaaggtacattaggattacaaagaggaaatgaattgcgcattctttctccatagagaaatggtacaactatgagatttcgtaggatgtagaaaagcatttttgtctatagggtcaaaatgaaccaacaataagagctgcaaagcagcacattttaatccagtggagttctggaattcaatacccaaattcattctagacaaatgcatacgctatgtcaaagatataggatactgaccaccgctatactttgatggctctttacccagattttacaataggagaacaacgatttgcattgctttaagcttttgatatgatgtatgagtaaatgaaacaaatgtagctttttaccctgacaggcacatatcctcaattatgataatctataccacatttcacttcatccaccacagcaggctaccgagaatgaaggtggacaagttcttaccatggcgatcatgaaatgcgtcctctaggaacttagatggcagcatgttggcaccctcacagaccaacccatggaagtcctggttcggctccacctaaaccaagcccaaaatgtgcaataatcagttccaaggttagctgacgaagagaaaatggggaacgagcaaataataataataataataataataatcctgacctcaaagacgagacgaatgccgtcacgggtgtcgacggcgacgggcatgcaggagcggaagaggccgctctcgacgacgcggtgcacgtcctcctgcacctcccgcaccgtgagcgccgcgttggggcggcacgcccggagcgccgccgccgcggccgcctccagctcgggccgctccaggggctccccgtccttccccctcaccgccacctcgctgatcagcacccgctcctctccccctccaccccctccgccgtccttctgcctccgcggcagcgcgatgggcgccgccgccgcccccgcccccgtctcggccctcgccacgggtagcctgggcagcgacctggccacgtggcgcaccacgccatcgatggcgcggccgatgcgcgcgaacgggagcgccgcggagagcagcgtcggcgctggcgctggcgccggagccgcgtcggcgcaggggagcttcacaccggaggagacgaagcgcacgtctcggcgcgtccccatggcgtcggcggcggcgctgaaatcgagctagggtttagggtttccgcggcgacgaggagagggtttcccccgccatgggctatgctggaggaggaggaggcggcggcggaagagggagaagggaatggtggtgacgtcatccgcgttggcctctcgtcctcctctcggatgatgagggccgtcggatcgtctcgaatttcgttctgatggcggatacgtggatctgatccgttggatggtttcggggattacatccaacggcgagtattagaggtagagatgagaagtaccctctcacgctgtcacgccatgatccacgtggggaataaggtcattgtttagttcgtgaaaagaaaatttctgcgtgtcacatcagatgtttgagaagatatcgaaaagggtttttagacacgaatgaaaattttaattttataactcgcctggaaaccgcgagacgaatcttttgtgcctaattaatccgtcattagcagagtgggttactgtagcacttatgactaattaggtacaaaagactcgtctcgtgattttctccccaactgtgcaactagtttttttaatctatatttaatgctccatacatgtgtttaaagattcgatgtgatgtctttagaaaaaaaatttggggaaactaaaccaggcgttaatttgacactaaatcttattttcgtccttaaaccgaaaaaccaaatacaataggttcccaacttacaaaagcagtacaaacaaggtccctcggtagtattgtccccggtttttggctaacgtagcacatacgtggctaatttgactagtcttcgtcccacgtgggattgacgtggcgcttatgtggcaatttgatttggaaaataataaaattcgtgagcccacatatcagctacacaaaaaaaataaataaataatggtgagacctaggtgaatctcacatgtcattctcactcccctcctcttctctctcatctgtccccatcttctcttcatctctcttgaagacctaggtgtcgcacgactggaggacaagcgcggcggcggcaacggtggtcgtggaatcatcgggcagggacacagacgagggcctggcgatgtccgcgtcgaagagcgccagggtccaacgtgggtcacactctgcgcggaccaggcggtggaggtggtcggtggtgagggtcttgggccatcttgtcgacgagaggatggtcgatgacattgggtggcggcggcagaatgggcaagcctgcgagtacaagacatagtctgaactctgaagaccgagtctatgccacgtcatgtgcatgtaccgagtcaaattagtcacgtagacaccacgtaagctaaaaccaccatccaaaccatcgtgggatctatattgcaccggttttaacagttgagggatttgttgtatctggtattgcggttaaagggtgacaatcgaattcgctgtcaagttaagggatctaaagtgaacttattcctccacatcgccgtacgcttccgaaattgcaattttgcaaggtttcggcccaaaaaggaatgaaattctcaaatctcaactgaagcccaatacagatagaagttacggagaattttaggcccaaataatgggatgaagcccatattgtactatcgggattccttcagaatttgggtaccgctctaacttttttggttttgtttttcaggacatggaaaaaaaatcaactgcatttgatttttttaaaaaaattactgcgtttgaattttgaacccatagtggccagcatgatattagaacttgcacggtaccgtttttctttttcttcataaattaaccctttgtccatatcattccattgtccctttctgtctttcatgatgcatgctagcttttggggaaaaatattgaccgtcatagagtactgttttctttttcttcacaaattgcaaagattatacttttctgaaaggaatgcaaagattatacttgctctcaatcttcggtattggtatatagtattttcccaatgtagacattcgcacaaattacaagttaaaacatgtcaaattcaccgtggttgttacggcacgaacgacaaagagccacggcgaattcaaagcttgtgtttggactggtatgtgttgatttgacaaaaagtttttgaacgaatcgtgttggtttgacaataggaaaaatgactgcatgacatatcgacaacgatttgaagcatatttgcgtcaaaagctaggaaaaagtaggaaattcgtttgtgcaaccacagtatcatattctcatgtgaatggttttcctagaacccttcatttttgacacaaatcctcgtaaaattacacggtttgaaatgcctcgaacatggtacatgggaattggttttcctttcacaaaataagagaactttcagatgggatcagtcagggcatccacaatgtgagacactcctagagtgtcctcactaactgaggacactcgtagagaaacttggttcgcaatggagggtgcccctggatgaactccttaaaatctgaagcaacccggtgagggtactacatcccacagtgggtgtcctggcccaaggtagcccagtacaaaaatttcacccatacccctcatcagcccactagcccagcaacctcttcctctcctctttctagcattttctcgtctcctccgcccaccgtctcctcctcttccgatctctccctctctctctcttggtcgaacgaggcgcgaacggcggtggcgaacggcgagcgccgcgcgaggtggaagacggcgacgggcgtgtgcggtggccgacggcgatgggcgtgcggggtgtgaagcatctagacccccggtgttaattttggtaattaatgacaagcgctaattgtggactaaccgttgtctttgagctatacattttaagttaggtccacgtcatatgtgcgcatggatgattatcaatggattaacattgacggcgcaaagcaaagagaaagaagacggtaaaactagtgctttaatttagaattgatcgaggtgtagggcgatcaaaattgctagtttattttctagtttcgccgtactattaagaggggtaatgacctagcaaagagatgattgaattaccacattaggtcattgcattttcatttgtgctctatttttcatcacacgcacattcacttgcaaattcactgggttcggcctgaccagggggcggtcagaccggccacatagtggcggtctgaccggcgtgccctggccggtctgactggccccaagcaggcggtctgaccggcggcacttgtccggtcagaccggccctctggatgccgagatgatgctgctcgggatggccgatacagagccgatggagccgtagtcggtcagaccgagccgatggcggtctgactgagccgaggccggtctgaccgcccactcaactctggtctgaccggccaggccgatggggccctctgacagcacttcaacggctagttttctagccgttgcagagtagcacggtctgaccggccacatacctccggtcagaccagcaaagcacaaagttgggagatttcgcccccaacggctagttttggtgggtgggagtataaatactcccccaccagcagcaaggggactctcttggcacccaattcaattgcatacatcccttgcacctctctcacacccacttgagctttgtgttcatccatctagtgtgttagagggttgattagccaagagtcaagtgcattgcttccatttgtagagctagtgtggcacttgattgatcatctccacgccgggtcattgcttgttactcttggaggttgccgcctcctatacggcttgtggaggagttgccctgtgacctttccgagaagattgtagaggaagcccggcgccggtttgtgagtggtttggaattcaccaccttcggagtgaaggaagaactaccctagtgatcgaggcttgggtagtcctctccgtgggccagctcccgccttgcccaccccttgatgaagggggtgtgcggtggcttcgtggttgagcggtggagttgagctcgcctcaacggggagtaggaaaccggcgagtttccgaacctcggtgaaaaatctcgtctccttgtctcatttgatcgtcgcatttacatttgtgcaaatttacttttctagaaacaaactagatatcatatcaccctaggattgctaaacattgacataggagtgtgatttactttcttagagatatagttgagccacaatcaccctaggtttgcaaaacataacttagttgcttagttagagttgaccctcaccaagcctagcgacttaggttagttttgattaggtgtcatttagttttaaatcgcctattcaccacactctagtcgacatctcgatcctacaagttgtatcagagcttggtctctcttgattgggcttcaccgcctagagagaagatgtcgaacgaggtgaaccatgtagggaaggctcccatgtttaatggcacaaactattccacttggaaaattaaaatgtctactcacctcaaagctatgagcttccatatttggagtattgttgatgtaggttttgctatcaccggcaagcccttgacggagattgatcaccgcaacctccaactcaatgcccaagccatgaatgctttgttcaactctttgagccaagaggagtttgatagagtgagcaaccttgagaccgcatatgagatttggaacaagttggcggagatccatgagggcacgagtgagtataaggatgccaagcttcatttcctcaagatccaatatgagacattctccatgttgcctcatgagagtgtgaatgacatgtatggaaggctcaatgtcattgtgaatgatctcaaggggcttgggacaaactacaccgatcttgaggttgcccaaaagatgcttagggctctaccggagaagtatgagacccttgtcaccatgctcatcaactccgacatgtcaatgatgacacccgcaagcctcttggggaagatcaacaccaatgacatgtacaagttgaagaagaaggagatggaggaagcctcaccttccaagaagtgcattgctctccaagccgaagttgaagataagggcaagggcaaggtgaatgaagccaatgaggacttggaggaagagattgcccttcttgctagaaggttcaatgatctcttgggaaggagaaaggagagaggaaggggctccaactccaataggagaagaaatagaagacccaacaagactctctccaacttgaggtgctttgagtgtggtgagaagggacactttgcttccaagtgcccttccaaggatgatgatggagacaagtcatgcaagaagaagagtggaggctacaagctcatgaagaagctcaagaaggaaggcaagaagattgaggccttcatcggggaatgggactcaaatgaggagagctccgcctcatccgggtccgaggaagaaggtggtgatgatgcaagctccaaaaagaagaagatggccgttgttgccatcaaggaggctctatcactcttcgctccactttgtctcatggcaaagggctcctctaaggtaacatctcttagtgataatgagagtgatgatgattgtgatgatgtttcctatgatgagcttgtgagtatgtttgaggagctccatgcttatagtgagaaggagattgtcaagttcaaggccctaaagaaggatcatgcttctttggaggtcttgtatgaggagctaaagacttctcatgagagactcaccatttctcatgagaagcttaaggaagctcatgacaacctcctttccactactcaacatggagctctcattgatgttggcatatcttgtgatttgcttgatgatagtgctacttgccatattgctcatgttgcatcatctagcatttctatctcttgtgatgatcttgtggatatgtctagctctagctcttgtatttctatctgtgatgcctcacttgttgttgagaacaatgagcttaaggagcaagtggctaagctcaacaagagcttggagaggtgcttcaagggtaagaacactcttgacaagattttgagtgagcaacggtgcatccttaacaaggagggacttggattcattccaaagaagggtaagaaaccttctaaccgtgccactcgttttgtcaagagcaatggtaagtattgctccaagtgtcgtgaggttgggcatttggtgaatgattgccccggtggtaagcctcctaagacatgcatgtttgattctcattatatgattaggaaggctcatgatggtagcattgttgctagatatgtgggttcccctatactcggtggtaaaaagaatgccatttgggtgcccaaagctttggtctctaaccttcaaggacccaaacaagtttgggtacctaaaagagcttgatcttcttttgtaggtgaactaccacaccggtgggagccattgggtgcttgatagtggatgcactcaacacatgactggtgatagggctatgttcaccacatttgaagtaggagggaatgaacaagagaaagtgacatttggagacaatagcaaaggaaaggtaattaggttaggtaaaattgctatctccaatgatttgtcaattgacaatgtctctctttgtaaatctctaaattttaatttgctttcggttgctcaaatttgtgatcttggcttgtcatgtgctttcttcccgcaagaagttattgtttctagccttcttgacaagtcttgtgtgttcaaaggttttagatatggaaatctttatttggttgatttcaattctagtgaagcaaatttgaaaacttgtttagttgcaaaaacttctttgggttgcctttggcatagaaggctagcccatgttggcatgaatcaattgagcaaactttcaaaacgtgatctagttgtgggcttgaaagatgtgaagtttgagaaagataagctttgtagtgcttgtcaagtcggcaagcaagttgctactaagagtatcatgtccacatctagaccattggagctcgtgcatatggatttgtttggcccaacaacctataagagcattggtggtaataatcattgtcttgtgattgttgatgattattctcgctatacttgggtgttctttttgtatgataagtctattgttgccgagcttttcaaaaagtttgcaaaaagggcccaaaatgaatttagttgcactcttgtgaaaattagaagtgacaatggttccgagtttaagaataccaatatcgaggactattgtgatgatcttggcattaaacacgaactttccgctacctactcacctcaacaaaatggtgtagtggagaggaaaaatcgtacattgattgagatggcaaggactatgcttgatgaatatggtgtttccgattcttttggggcggaagccataaacaccgcttgccatgcaaccaataggctttatttgcatattctcttgaaaaagactttctatgagctaattgttggaaggaagccaaatgttgcctattttcaagtttttggttgcaagtgttatatttaccgaaagggtgttagactaaccaaatttgaaagtcggtgtgatgaagggtttcttctaggttatgcctcaaatagcaaggcataccgggtctacaacaagaacaaaggtattgtggaagaaaccgccgatgttcaatttgatgagactaatggctcccaagaggggcacgagaatttggatgatgtaggtgatgaaggcttgatgagaaccatgaagaatatgtcaattggagatgtcaagcctattgaagtggaagacaagccatccacctccactcaagatgagccatctacttccgctatgccaagtcaagctcaagttgaagtggaggaggagaaggtacaagatccacctatgccaccaaggatacacaccgctctttccaaggatcacccaattgaccaagtgttgggtgacattagtaagggtgttcaaactcgatctcgtgtcgcttcgatttgtgaacattactcgtttgtttcttgtcttgagccaaaacatgtagatgaagctctttgtgatccggattggatgaatgctatgcatgaagagctcaacaactttgcaagaaacaaggtgtggactttggttgaaagacctagagaccacaatgtcatagggacaaagtgggtatttaggaacaaacaagatgagaacgggttggtggtgagaaacaaggcaaggttggtggcacaaggtttcacaaaagttgaaggtttggactttggtgaaacttttgcccccgtggcaagacttgaggctattcgcatccttcttgcatttgcatcatgctttgatataaaactatttcaaatggatgtgaaaagtgcttttctaaatggtgaaattgctgaacttgtctttgttgaacaacctcccggttttgaagattctaaatatcctaaccatgtttacaaactctcaaaagctctttatggtttaaaacaagctcctagggcttggtatgaaagattgagatattttcttttgtcaaaggatttcaaaattggaaaagttgacaccaccctttttacaaaaatcattgatgatgatttctttgtgtgccaaatttatgttgatgacatcatattcggttctactaatgaggtattttgcaagaaatttggtgatatgatgtcgagggaatttgagatgtccatgattggagagttgagcttcttccttggacttcaaatcaagcaactcaaggatgggacgttcgtgagccaaaccaagtacatcaaggatctactcaagaggtttggcttggaggatgcgaagcccatcaagacacctatggcaaccaacgggcatctcgaccttgatgagggaggtaaaccggtagatttaaagctttatcgttctatgattggtagcttgctttaccttaccgcatctaggccggatatcatgtttagtgtttgcacgtgtgcacggtttcaagccgctcctaaggagtgtcacttagtggccgtgaaaaggattctaagatatttaaagtattcctctactattggcttgtggtacccaaaaggtgctaaatttaagcttgctggctattccgattcggattatgccggttgcaaagtggatagaaagagcacatccggtagttgccaaatgcttggtagatcccttgtgtcatggtcatccaagaaacaaaactccgtagccctctccaccgccgaggcggaatatgtttcggcaggtagttgttgtgcccaattgctttggatgaaacaaaccttgttggactatggcatatctttcaccaaaacctcactcctatgtgacaatgatagtgccataaagatagccaataacccagtctaacattctagaaccaagcatattgacatacgccatcacttcttaagagatcatgttgccaagtgtgacatagtcattagccacataagaaccgaggatcaactagccgacatttttaccaagcctcttgatgaaacccgcttttgcaagttgaggaatgagttaaatgtcatagacttctctaatatggcttgagatggtgcaccatggttgcttcttttgcatattgtatatttgctcctatttgttcttatgctttggatttattgtcatttggttcttcattgcgaaaatggagcatgtcacattaaggaggagtcttgcactcttgcatgtgttccacttccttttatatgtgagcaaatcaactaaaagtgctagtagtgttttcaaaatgaccaagtcaacataagtcaaaacttctgcaaaatcgatgcattttgaaaactatctcttggaaaatgttttaaaaggttccctatatgttttccaagcctcacattgcaagaaaaatgatttttgaatgaaaatgccattttggccctcttttgaagaaactagattcttagttttggataaaatgagatttatccccaaaatgagattgagaaggaatttgaggaaagtttcaaaacaaagttggtagaggagaagttttgaaatgtttttggtgttcaaacctatttcaaaaaccaaatcattcaaaagttatttgaaaatcaaattcgcccaaaaacccctatagaccataaaaggtcacctcctagcgctcaagtgagttttgttgcaaatcttcataattttcaaatgttatgaatggttggcaatattttaactcacacatttcaaaattgctccaaaaatcaatttttttattgaattttattgtgtgggggtagccgaactgtgcaagggctatgcacagtcggctgggggccaggcggtctgaccggtgctatatgcacggtctgatcggcctgatggcggcggtctgaccggccacttgggcccggtctgaccggccgcacccttgaggtctgaccggccgataatagccggtctgaccggccagggatagtgggcccaggaatctttctttttcttctctcttcttcccctacctgactccatctcctcccattcagctttcttcttccccaactcgaaaaaacacctcctctctcttttcccaaaccctagtcacctccctctaccaaattccctcggtctgaccgtggatttctctccggttacaccgtaagtgattctcctccgcttcctctctctattccatggattggtttgtgtttttgttgaagtttttgatccatggcatggaaccctaggtgaagcacgaggtgttcttcgatttgcaccaatagtgggtagtttcttggtgtgattcaactccttcaaccggtaaatcactctccctcttgcgcattatctcaaatcggtctatttcaatctctagggttttgggtagtttcccccattattccaatcttgatgaaataggccataccctttgatgttcaagttccaaacttgtgcaatattgttctagcaatattttagactcatttgtgtgattgttggaaggatttggttgtgctcctgtcagtggcggtctgatcggcaggcggtctgaccggcaccaaagcggcggtctgaccggcctagggcaggcggtctgaccggctaggggccgtcggtttgactgacttgacgccggcggtctgacagtccctggcccccggtctgaccgcccctgacaggcagcacccccattccttcctcttcactatgtggcttctaaaattgttgcttatccatcctttgctccttgtttttcagctatgcctccccgcactcgccatggtcgtcgtgagcccatgcccaatcccgtcaatgagaatgaggaatcaagcggagatgagtatgttcaaagtgatgatgacaatatggaaaatgttgagggtgatgagatggaagtaagtgatgatggtgatgacaatgggagtggcaatggtgaagatgatgaggcaagtgatgatgggagtcctctcgattccaccatccaatttgtgtttaatttgaggaatgctcaacaatacactatcctccgtcatcatgatcaattccggaggcctaacgattgtaatgatccaagatttcatacccagttccaaaagtccgtgtatgaacaagtgtatgccaacaaagccttcgccgaacacaagtggatttcttggaggcacattggtgagacaccggagtttgaagatttgcaagagatgttctggaccgttgggattgatagaattgtcaccatgaagcaatcttttgatgaagatctcatccggcaattctatgccaccgtatgggtgtccggcgattgtgatgcaatgaagtggatgtcggggacccttcaatgctctatcaaccgccgtgaattcaaggagctcttgcacattcgcttcaacaatggggatgaccttcatgatgagcacacccacaaccccttccccattgatcacttttctcagatttatgaagacgggggaaggcacacatatggaaaggtggcgggttagagggctctcccaagtgtgatcaaccacatagtaagggccaccatcctcccaagatgcggcaacaatgatgacatacgcggagttgcttggcatgtcattgatgccattttggatggtcgtcggtttgatgttatcaaccttatgatgaaggagattgccatctcaaaggggactattggacaaggaatctattatgctccctacataatgaggttgattcaaagcaagttgggacaaattggtcacaatttaaaagaacataaggagtacaagcctcgtctccaactctcctcccctaaagctcctcgtgtgcgccaaccaacatttgatcaaggtgcaagctcaagtgcagccccccctcctcctcatgggtctgatccaagtgcttttttccatccacaatatgcctactttggaatgcaacccaatgaattcttcaacccggtccttggggctattaataccctaagtgaaagcattcaacgcttatccaccgggcatgaagcattgcatgaagatgttcgtggcttgcgcaccgatgttggcaacttgaatacttcggtgggaagattgcatactagggtgggtgtattggattcttgagtccaaaccttggagagtacccaagcttttggctatcatcgtcgccgtgatgcttctcatccttccacttcggcgcgtcctccttctcctccgcaagagtgaagacctttttggtgcttgatgccaaaagggggagaaaagtgtgttttatgttttgtgggttgggactagtagtagtgaggttagtcacctcatatttaataggttaaggaggtttggactatattttgtatgggtatgggctattactctatattgtgtgttctttgtcgttttgttaaactctctatgtcatttggacccttcatggtcttgtaatagcctacatttatttgtgagcactttatgtggtcttgatgtgaacttgtgctatgatggatggttggtgtgacattgatatacttgtgaccatcttatgcattcggttgattcatatgtgaagttcacattataatttgcatatgtgttgtgctatgttgaattgtgaaattgaaatgtgcattggctccatatttgctatttgtgttggttatccatatgttaagggggagcttttgcttgccaatgcaatatatgtcc

SEQ ID NO: 62734 - DNA, 3579 bp, Oryza sativa
caatgtagtccgacgcctccgccaggagcgccgggaacgccagcttccggcacccgggcactagccgccccagcaccttcgccttgctcgccagcggcggccgcgagcgcggcgccggacgcgcggcgggcggcgggggcggcgcgccgaggcgcacgcggcggagcgcgcacgcgcgcgcgcgggaggcgaggatggcgcggctccaccgcgaccgccctcgcgccgccacggcgagggcgcggtcggccgcgtggcgcacctcgcgcgacgacgcgggtgatggtctgccgctggcggcgcggaccaggcgcagcgcgtcgagcagcttggaggagtagctctcctgctcccgcctcgtccgccacctggctgccggcgaggcggcgggatcgagcttgcggtcgtgtggcgccgtggaggtcggcgaggacgccatgggcgacgcggggttgtgtaggtgagggagacggcaaggcgagctacgagagaagagaagagggagggaggagtttgtagagtagaggccgagggtgggtgatgcaggccaacgactcaaatttaaaggggaacaggattaacaccacgattactgcttaatcacccttgtgatttccgtgccctaatctctcactctctgtctttatataaagtcttttgcatggttgacactagtagcattctccttgggataggatcaataaagtaatttaattgaagtggccaatctgctccatgtgcatacatatgtacatgggtgttctttcttatttgaatagaaattgtatgtggttaaaagatttttattatctatttgtcctctttggacatgtgttaaaaggactgtattcgtgattaatgtacataatatatttttctcctatataataaaaaaaatctactactaacttcatatttttaatgtatgacgccattgattttttatccaacgtttgattattcgtcttatttaaaaaaatttatacaattatcatttattttattgtgactcgatttatcatcaaatgttctttaagcatgatataaataccttcatatttgcataaaaattttaaataaaacgaatgatcaaatgtttgtcttaaaaaaatcaacggtgtcatacattaaaatacggagggagtactgggcaatataaagtactccagtacattggcagtgttggcacatacgagtaggtgattggtgatgatatatccagcgcgacaatggcgatgcaagcatgattaggaggaggagaacctgagcctctactctatgcagaggagagggaggggctcctcatctgatgagcagagcaacaccatggccatgccactatgtcacaggaacgaagctagtagctgactactctgaatgtcacaggtaagaagaagagtagtagtacaacctctgtatgactgtattatgtattatgtaggcatatgctgcatatgcaattcacatttttggtccgcacaattagcacaaatcatgtaagttaagctaagccaccacctacttccacatggaaccatcattatttccaccaatcttcttctctacctagtactccacatggagcacttagcatgggttacaatatcgcgtgattattgctcgtggttgattctcagtttttctcagttacctaaccgcaatgcttttggtagcggtaaactctaaaaaaaagatagagaaaaccctgatactacatctgtttttaaatatatgatgatgtgtgatgtttatcatctgtcttattaagataatataatattatttatattgttgcgatttattttattattaaatgtgctttacacatgacgtacattacatatttgcaatccatgtctaaataaaacgaattgttaaacatcatatttaaaaggtaaagtgtcaatttgtcatataggagtgtttagaaattgagggaatagcttaccttccttccttcctcctcttcttgatctcttcataaaaattcaggtttcacaagtaaagtgtttgcataagggataggattgctcaccgatttcatccttggcggctgcagaggacttgtgaaaggtcaaatgtgacctaaaattggaccttctctttaattggtgagggagtaaacaaacaccacgtatcctgaattcatgatacgaactggctagtacaacgcaaggcctggtccataccatactaatcaactaccatgttgaaatgatgctttaatttgcactacaattcaggcacgtttgagttgaaagcttctcattacaggctaatttggtggtagtaggaggttgcttctttgccttgacagcctttgcaatgagtactctatgctagtattaactaattaacctatagctagtctataattaagccaccacaagataagcatcaagcgccgacgcacgaagcaggaacaaggacacgtgagtcgtttgactgttgttgatatgatcagcggcggtgcacagtttgtcacctgaagatcgatgaaaaatgaataaaaacagcgacacgaaaacacacagctagcagcacagaggcttgcccgcctttgaaattcaccaagagaagaagatgcatgcagcagcaggcagcatagtatgataagactatatgcatgcatgcatggctccatccactgtccactgctgcctgccttgctgagcctgaggctgagctgcagtgcaggttcaggatgccaaagcaaagcaggctactgatgcgtcctcttgttaacaacactaacaatcaagtgtgtgtgtgtagtatgttaagctgcctttgtggatgccagcgatgcgacgccaggtgaacactgtacctacgggcatttacacatgtttcagagcttcaggcttgttgaggcctcacaaccttcaaattccacagaatctagcctgccagtgccatatcccatgccatacaccctctcgaatttactgcattatcctactagtattatctactcctatatatcctctaatgtaatgtatcctagctacctactactgatcgagtaattaatctaatctgctcaacagggcagagattctagttaactataaatctgctccgtgaggccttatatatccagacgcaagaatcacaggacaaagctatgcaagaatcacagggacgaagctaagcaacacaagatctgattaattatcgtttcgacaatgcagagggccggccatgtggatatcagccagcagagacacttcgattgatcgcttcccatcccataaataaataaataatactgatccattagacacgctgacgcttgacagcctcaccacgcacgttctccagtccagcgcatgaatcactcatcatacaacatctcccagcctcaacgctcagagatgatgattcatagagtatatggtagcatgggtgaactgaagaaagcctgtaacaataatttgcattttgtaaacagagtttttaaagtgctcgctattcaggcacatgccttggccttgttcattcagcataaacatatatggatcctgatcctggccatgacaccatgaccatcttgcttgcacttggttatggctgtca

SEQ ID NO: 62735 - DNA, 3280 bp, Oryza sativa
gcccaagaccaagtacctccactgggtgtcggcgctggtgttcttggagaagccggcgaggacgcggtgcttgaggtcggaaatgtcgaagcagcagaggaagcgggaggcggcggaggcagcgtcggagcggtcacgggcaggcgagagcaggtcggtgcgggaggcggaggagcaagaggaggaggaggaggaggaagaggaggtatcatcggcggagcagggcttggtgcagctggggatgtagtcgcggagcatgtcggcgacggcgcggtagcggcggagcgcgaggagagagcgcgcccggagctcgagagcggcctccatgcgcggcgacatctctagcaccgcttccactagtccaagcgccgccgtagccgctgagtgctcgccaccttccccatccagcggcgcggcggcggcggcggcgagagcagcccgagcctcggcgaggtagtctccgatgatctgctgcacaatgcacagcaccaacaaatcagttgctgaagccaaagccaaattgggagcaaaaccgcccaaattgccatcttttttggtggcacataacacattggatgaagaattaaagagggggcaagaaacaacctttcggtgtccgcggagccaattccttctcctgtccggcgaggacaccgccattggtggcaagaaacagaagcagcagtaaggccttggcaatctactggagtactcctatgtatggtatggagtatatatacttaggaaatgtagatggattgggaatgagaatggagagcaagaaattaaagaaatgccagctccctctgtcccttaacgaaccaaccaaactactccatctccatgagtcccatgaccatgagaggagaagagaagagaagagaagagaagagaatggaagggatcgagtagtatagtatagctggatatggatgatcccaagctggacaagaagaagatgcccgtgctgtgcactcctcctccttggcacgcacacgcaggccaccctaccctagtattggtggtctcctagtgcgtagggtgccatggcctatgcatccacctcggctaaaagctttttaaagagaaagaaagagaaagaaaccattggcacatcaccctgccagcaaagcaattcctgccttttcttctctcctcttctcttcttttttttttcttttctttttccctgctggcttttctgatcttcttcatcttctccatgtgattaggacactctgctcattcattcacattcgcatctcatgataaccttttactactcctgcacaccacctagagtaccacagtaattgtcgtggataaactcacggcacactactcctactcctacctacttacacttataatggcatgtgtagtacagtagtaaactggaagaattatacagtaggattacagtacatggagtaacaatttttaattaattaccttgcatatatgataatgctgttagaggcagtaatgaaatggaatgcagagagaagaaagagcagcagcagcaaagcatacttaaatttcatttcaattcattgaagccttgtcacatgtagaggcctgcctgactgtcagcatcatatcatgcatggcatggcctttccagcacaccaactactctgctgtccacccatgttactccagtggtattgctatgttacacttcccttcccccttttcatttcatcactgcaaaactactcatctttcaaactttaaaatacagactactcccctactaccagtacgccaacagtaatcaaagcaaccattacctacccactacctctacatagtgtaccgaattcatcttattactgctagactaggggattaactcacaagccctaaatggattatactacaactgatttacctctagaagaacacatgttagcatgtactatgagcaactaacaatgagtgggcccagctgtcagactgtgtccatggagagtgctaatgaggtggagccagctgcaggctgttggagcagtcgcctgttaatcaataattaagaaaaagggtaccactactccaggctggttgccaatgccatacagtagcattttatttggtgactaccatcggatgcctgattgcatatatatattgcccatgcatatgtcttcgcatacggtcaaacggatggatggaggggatcattggatcaatccatccctgttttcagactagactttcagggtttttcaggtggctggactggattggaccctaaggtcaggtcaaccttgttgacacctcaccatttccatcactccagtaccctgtagatacaagtgtactggagtacagtacatgtttgtgactacagtatatagatactcttgctcaattatttagtccagtagaaacttgggtatgtggggaagtggaatccaagggtatgtatgctttacttcacccaccctttacattaccacttgactacacatttattaaatattttctaatcagttctagtacagtttttacctcttaaactgtgagaaagtatatatctcttcaaggataggtgaaaaactcttcctacaaatattgacgttctctttttgaacctattttttttaaaaaaaaattgacatggtctaaatacaactttggctataaatttatatcacactatatttgtcaaacctgataaaagcttgcattaccagagtattttcttgaggcacattatgttcatatatcaaatcaaaatatttaaaaagatcttggtgttcaaagttttaataaagttatggctaagggcattttcactttcctaccattttcaaccttacaagttttggcgttagcatattttggtatagtcaaaaactaaacataacgttaccatttaccctaccaaatattggtaattctagaagtttcctctcactaaatctctctcaatggtaaggtttcataccaaacacaaccaacactatcaaattttggtaacttcaaaagtgctaaattttgacattaccaaattttggtaaggttgattttggtaacaaagtaatgaacaagcagccctaagaaattttctgcatgatgttatgttgttgtgatcagaaggagtatttaattactgtttgtttccatttttccgaagctagcattattgattgcagcagttgattgtcatatgatcatctttttttttcgggggaaatagggagatatattactcaaaagaatccacatcgaggagatgtgaaattatcatccttgcatatacgagcgatatgag

SEQ ID NO: 62736 - DNA, 5970 bp, Oryza sativa
ttttagaaaagtcatttacctgagcaagtgtaccaacttcgttaaggcgctgcagcaactccttccctttaagatcatcaatgcttttatctgaatctgagctggtcacaatatttgggtcagtaccttcttcatccttcacaagaaatgctccagcatatgggatggatcttttgcggttttctactaaggcttgcaacagcttttggtcctgaggggtttataaaaaacaggaaaaacacatcattaagaagggaaatgaataggtagcatgatacggaaaagtgaaattgatttaaccaatggcaaatttctcagcgccgacatacctttacatagatcggcatataaaatccaggaaagagtggacgatgtgggagaggcagtgctatgacctatttgaaaaagtaagcataataaagtaagagaaggatacaactagcagaaccatgttatgaaaaatatgaactgttaaataaataacaaataatctgaagggagacgtttagatctaaaaaatgatggaaagacagcaaagccctcccttgataacagagaaagagagagcatgatacccttctagacttattggtagaaaacccattttcaagacatggcatgagttcaaatagctactcaaaagactacaatcaaattataattattttgatccttcatcacacctcaaatgaattgctcactttagtcctaaatagattgtgcatttcatttggcaccaatgcaagttcttgagctattcaaatttgtcatcgaaatatcatatgtactccattatacagtttggaggcactttttctcaatgtttcctagtatatcctcatgagtatcactccaagtaacaaataagctctccttcccaatcgcctcccacttcataacggcagaataattatttcatggtgttccttcgttcttgtgcccattaatatgtgataattagatggaatatttattcaattgaacaacacttttcagaggggtgcaagctttcataatgcattaccaagcatcgcaccagtgacttttctcaaattagaaaacagtactgaactaaactacagttcaggacaacatgttaatccctcagtgagcaatcagcattttcctctttctttcccctaataaatagaaaggcaccatgtttgagcactcaaaaggaaggagaaaccatgctgaggtactgaactctttgtgcagctcattcaaggcaatcacactaacctagttgatccaaaccaaagaaactctaccttagcattacaaaataatgagctaactttgagaccaaagtgtttccatgctcagattgagccatggacttacgatatccaatcaagggagtggccttccatgcttactctttggaaccaaattacacattctccaattacttaggacacaaatgcatcgggttgctattggctactgcaagcaactaaacaaacggttatgatccaaacgagtagagcgcgcaccgagaggcagtcctcagggcggaggacggtgggcacgatggcggaagacgccttgccgtccgcctccccttccgcagcaaccgcatcctcggccttagcttccgccgccgccgcctcggagtcgctcccggcggagttggagcagaagcgcgccctcctcccgagcgtcgagacccggccgcctcggagcgcccccaaaaccctgagcagcggcgacctgacctcctcaaccgccgccacggccggcgcggcagcgaaccgcgaggggaagacggcggcggcggccgccgcggcgcgcagcatgagggggtcgagcgattctagctagggtttgggcgaggggagggggcgggggcgggggatgtggcggcgcggcgcgcgccctgtgaaagggaagctcgatttcgttggtttggggaggaagaaaggaatggaagcaccgaacgaaacccttctaaaaccccctctcttttacccatttttcattactattctataacaaatttttattaaactgaaagcgaaaaactatctttggcatttttttattctacaacaacattagctgaattgactagaggaagattcagctaatgtataacacatctaacatgttatacatggctaattaagtagtttagtgctttaaccatgaataaactatatgggtctttttatcacgtacttacctccgtcctataaaaacatacctactgcgagatgtgatacatccttattagatttatttttttatagaatgaaggaataacatactcacacacataaacaccatttccacccctacatacactcacacacacgtttagaatgattaaaaatctatagcctcatgtaagtgcgcatcatatttgtattatttttctctaccgtattaagtgtagttcgattccaatattattaattgtgaaaccaatcactattatttcattagcacgtttttcaaactattaaatgattttttttctaaaactttccatatccatgttgtttcaaaaattaaaataaatctatttttaagtttataattattaatatttaattaattatatgtactaatgagttttcatgtttcgtatgcgttggaaatctgtatataacctgagaaaaagaactcggtctaaatataaactttgatatataaaagacccttttcgaggagaaatatccgaagggttatcgctggtcttgtgtcaagtgccagtcactcagttcatccacagcaaagcgcacaggcatagcagcctccttcccctcttcttcttcttcagtagtggagtacatgctacctctgcttcagcagcacatgggaatcacccatgccaactccatcaccaccgagccttctccttctccccgcccgccgcttcttcgcctcttgccccagcctcgccgccggcgtcatgctcatgccaaacacatcgccctcttgaccaactgcaagtgcgcctccgccgcttccgcttccgtggaggaagacgacgtagcaggtggtaggtgcctcttttggccggggaaacatcttttggtttaggattcttctctctagagattggagattaattaatcaataataagttaattcattcaccagtcgtagtcccctgacctaaccccttcatatttgggagataatactcgtattcaatcccaccattttttctgcctgaattggggaacgactgtgttttgctttgttactttactatatattactacaagccttaaatttgtactcgatgcatcaatctgcagggttgggatatcgtcatcctccaaagcaaatacaagaaatccttgatgttccacccaatcccagttaccttatttcccctcgcagagatcggatcatgttcctacagcgcacagccatgcctccattatctgagcttacgaaaccagaaattgtactttccggcatacgcattgatcctgggtctaacatgaggagcagaatgtaagtaacacaccattaccattcaatcatagcaggagggttgacacctcatattcttgtgttcaatgatttacttatttgtaggtcgttttataccggcattattatccatgacctgatggatagtggaactttgggtccagcaaaagaggtccatggatatgctgatggtgcaaagattaattttgtgacatggttatttcccaaacatgtttaaatttaacttttaatgtgcaaccaaatcatatcacactgttttctattcatatttcctctttcggcaattttggaatttcaggtcacctgatggtcagcacatggcatttactgtgcgctacgaagataaggtgattggctgatgctttggactatgaaattggacaacatctttagtggttatcgatccttttgtttcactgttgtattttagtaggtggacaacagcgtcaacttgtcactatgggttgccaatgcagaatctggagaggctcggccactctgcatatcagaagacataagattgaatgctatttttgagctgtgagtgtctgcatctttccgatggagcatctttctactcctttccttcctaagtcatcagattttatcatgtttttctttacagatttgtatgggtgaatgattctaccgtattggtctgcactattccttcgtcacgtggttgtccaccaaagaagccattggttccttttggtcctaggatccgctctaatgagcataaaaatgtagttcagatgagagccacaaaagaaatgttgaaagatttgcatgaagaagaattgtttgattactatgcaacatcacagttaatactgctctcactggatgggacagtgaagccaattgccccacctgcgatatatactgctcttgatccttcaccagatgagaagtatctgatgctcacttctgtccaccggccatattcttctactgtctcgtataaaaggttcccaaagaaggttgagctgtggacagttgatggtacatttatccgtgaagtttgtgatctgcccctagctgaagatattccaatcacatctggtagtgtccgtaaggggaagcgtttaatcagttggaggcctgacatgccttcaacattgtattggtgagtaacaattccttagaagcttctgttgaaaaaaatatattgttgttctaataataatagtaatatttttccaatcctgatgatagtaggtaagctcaaaattgtagaatttataatgccaatgcactgcttctgctttgatgagatttgcaaaggtgaccgtgttattgtcttctcttgataggtagtgcagctagttgcttgcgtacgaaacaactagttgacagataatgaccctaggcatgctattagttattcttttgactgactttttaccatgtaatcacaatccattttaacttgactatcaacttttctgaaagatcaacttaatgcaagatttggtgacatagtatgtcaaaggtaacctcaaattagttagaaaaggtgaatggagatctgtcagaactcagaaacaatcatcatactaacagtagtccctacttagttcgtaataccacatgtccaatcaccatgctaacaatagttctcagatctgactgcgacccagttctattttcgtatgtgatgttttgaaagggtggaggcacaagatggaggagatgcaaatgttgaagtctcaccacgcgatatagtatatatggagcttgcagatcctttaaatggcgagaaacctcaagtcttgcttaaacttgaccttcggtataggtattaaattactactggcctaacattttctcctcatggtgttacagagtgaatatgcttttacagaaaggcaaattatgatgagtacatttggtttagcttggagataaatttggatttcgacttcaaagatgtaatcaatgatttttcaggctaataatctgtgtttttgcatttaaaatacacaaatatactttgtccaactgcttgccaaatcactcaaaatttactattttgatgaaacctgcagaaggatctcttggtgcaatggatcacaggcactggtttatgagcattggtacaggacacgcagaacaagaacatgggttatctctcctgactgcaaagatgttagcccacgggtattatttgaaagatcttcagaagatgcctattcaaatcctggttctccaatgatgtgcagaacccctgcaggcacctttgtcattgcaaaaattaagacaaactatgaaggaacctacatcttgttgaagggaaaaggtgccacaccaaaaggaagcatcccttttcttgatcttttgaatatgtatgcttacaactatctctaccaaacatttctgttgcacctcccatgcctgctctgttatgactctttgaatccatgaacataatgtaggcataactttttttctttacagaaatacgggagtgaaagagcggatatgggagagtagcaa

SEQ ID NO: 62737 - DNA, 4323 bp, Oryza sativa
gagggggggctgagctgcggaggcatcggaatggcggcggcagcgctgcctcgcctcctcctcgccgcggtggtgctgtgcgccgcgttcgcctccgtaccagggttcaccaacccctccgatggtgagtctactcaaccccaatctgtagcgatcgagtagttagcgtttgatgcctctactccgagctcgcgtgcgtacttgctcacacttcgtattagtgttcgtgttgcttctggtcttagccacatcaatggatgtgattgtgtaccacagcaagtgtgtgcttgctagtgtgcccgtgccatagttacctttgttcagttcctgcgtgtcacgccgtattcatgtctgtgtatgacttcgctgccttatgtttaattttccatggcagctttctgggtggacatttgagggcggtgacccctgtggtggccgcggtgaacaacggccatggcatggagtcctttgaagggattcatcattcatccattgtcgctttgtaattcttcagctattcgactgtgttgcaatgccggacggaacgcgcgacggcggcgtagcccggacgacgaggaggaggacggcgacaccagcgaggaagaagagatggaccagatcgagatggcgcagctcgaggggaacatcaggcggcccgcacgagggggacggggaggccggcgagatcgcgcagccccgagcccgcgcgccgcctgggggaatctcgcgccaccctgggagccgccgtcgccggccgcgcgcaccctacgagagcatagatcgagaggaaggaaggagaaacagagaaagagaaaggggagagagagaaggtgacgtgtacacctgatatgtgggccccacgtaggtcccacgctgacttagccgccacgtcggacaaaaccgagattaaaaccaccgaaggacctcttgtaaccggttttgattagttaagagacgccggatatctgattttgcggattgaggatgtttttgtaacttgatgacaagttgagagaccttcggtgtacttttttccctttaaacctccctgttataaaggcggtcatgtaaattcattggcataaaaaaaacctagaattgtaaatctaggacagtgaaactataaatagactatacgggatatgtaatagggatccaatattacttaattaactaatatactttataatcctatttttcataaaactcgagtgagcctacctttcagcaaaagtgttcatcatacgacaacacctactattggtaatttgaagatgcgcagacaatacttgatcgatattggtaatatccttggtaatgtacttgatctgtaagtatagttactctatggctggtttagtttgttgccaaaattaatcttatcaaaatttgatattactatagtttgacacatatgggcattgccaaaatttgaaagtattggatgtgtttggtttaccaccttttcaaattctttttttatgagaagaaacttttagaaatactaaattttagtatggtgacaatggaaaagtatgtttagttattacattaccaaaatttggtaaaaccaagaggtttcttttgcaacaaaggatttttaaggaattttagaggaattcatgtcctatgaaaaattttcctacgtgattatttggatcacaagaatagctataacaaatcctatgaaatttctttggattggctcaaaacataggaattttagagaattctaacattagcttcaacctcttagcaaaaatccttcatctctcaactctcatcttgtgttttttctacattttttgcaaatagctattcctataattttcttgtgtttttccaatccatagaatttgagatgttaggacatttaatcctgtattttttttcgggcattttaatcctgtattgtttttttcgggagtacattcgaaacagctgaaagaggtagtccgagtgtgcagtgatataaataaataaatgcagcagccagcgaggcgtgatgtggtgtgctgcaaaacgtaaagtaagcggcgtatgtcgtgtcctgttgccgtataggagtatgtacatgcacgtgtgcgtaccatatgctcgtatgtacggctccatatcatatacgtacattatgctgtcctgcatgcctgcctataggatcagagagagtatctcagtaatttatcagtatatataaggcaactggggccctgcagttgcatagagtagccatgtaccactaccgtgcagcagcctgaagatatgtatgtactcctctatcaccgtgtttagttccaaactttttttttcaaactttcaacttttctatcacatcaaaactttcttacacacataaacttttaactttttcgtcacatcgttccaatttcaaccaaacttctaattttagcgtgaactaaacacaccctatatatatatgggtggtcactccactcagcactgctcattgggaatcctatgcaactttttactcatcgtcaggttcctcctccgttgtttccttcctattcctatacccaacaatcgattgccctgttagtattactgactgtgaacaatccatcgaaataatgaataaaaacacaagctacccgcacctttttcacacatttagtaatagctcattgtcagtaatattatgtaatatggactggagaacatgatacatttgcatgactgcagacacatgatagtgatactagtaaaaagctactagctgctactactatcagctcacagccaactctgcattcattcagatgcctgccttcatcatacagtcactcttatgaattatgatctagaggcatatatatagctgccctgttgttacaaaaaaatgcaaagcatcgaacacttactgctactcttatgcgggtccggaagaaactccgtttctttgttcttctcaccgcatgaatgaataattttcatctctctctctctgtgtgtccccaacccaatacatactgccgctactttagcataggatccaatgagatatcatgtctcggccgtgtgcaaccctctttatttttgggtgcatgacatttctgagtgagatagtacattcgctgcatacatatccatggctctaaaataaatgcaagtgtacactaaaaactatttctcgatatcaaacaggagatctatgtgcctttgcctttcaagtaagaagaaaaacagagagaaataaacgacagacaatagctagctaaccaaacctttacaaacttgcttctcaaatttgttgctgtatatatgtctgacgtagacatggattaaattccattatccaaaaaaaaacccttaccaattcattttttttaaccaaagatcgatccagctttataacaaaaactagagagaatgtcaattcaaatttaaccatgacaaaaaaaacctataagcccactgggtggatcgatattttgaattgcatatccatttccgccttactgtacatgtcctactcctagttaaaacgacaatgcgcatatttaagttagtgcagagagcaggaattaatcttcttttacctctttatatattaaaaaattgcattccctatcttgggagcgtatcctatacacacaggccctcgcgtgtacacaccgtgtacaccaactaaaaaatatcacaaaaaattataggaaaattcatacatatactttcaatagtattacatctacgtgcaaagtcgcatcttcaaattcattctacatagagaataacaaaaaagataaaattttaacaaaattgcaaccttaaaactgtcagattttttgtttttttttgttacggctaaaatataatgaatttgacgttaagattttaaccctaggtgtaatacaattgaaagtatgtgtatgatttttttctagattttttggtgacattttttagttggtgtgcacatgtgtacacgtgaggatctgtgtgcataggatatgttgccccctatcctagcatcattggtgcacgtaactatataaatagtcatgaaaaatcgtagagttcaaaggttagaaataattctaaagattggatccattttaacaaccacatggccacttaagtacaagagattgaaaagcagagaaaagtaaaggaaaaaattaaaaaaaagtaaagtatatatctttattatcgttgtttttcccttctttcgtccgatggtgacattgttgcggtcgatgatggatctggaatttgcatatattgttgttttttcagttgtgtgcaagtcaaactgtctgtagggacacgtagcaatataatcttgattccattacagttagg

SEQ ID NO: 62738 - DNA, 13637 bp, Oryza sativa
cttttcaccgcaacatcaaatcttttctcactttacttgcactatgataggtagcaaaaaaagttttgcatagtactattactaaataaaatactccctccatccctaaatgtttgacgccgttgacttttttaaatatgtttgactattcgtcttattcaaaaaaatttaagtaattattaattcttttcctatcatttgattcattgttaaatataattttatgtatatatatagttttacatatttcataaaattttttgaattaaacgaacggttaaacatatttaaagaagtcaactgcgtcaaacatttaggggacgagggcgtagctgacattgcatcgtattgctgaccactcttttgaagtgtagggtggttgtggtcattctattggttagacatgcatgctaaagggttaataccactttaatagtcttgtcggcaacaagagagattctcatgtcatcatagtgtcattacgttataattgttactgtgtgttaatatctctaacagcatagcgtttatatatagttgtgctgcacatactgaatatattcacaataattttcctacagtacatactgtatttctatcaacctccacaggattctctgctttttctagtcgagcaatgctccctaacatgtttcggtagcaactagtactagcaaacaagtagatcttttttttaatgaaaatacctagtaacaatacaagtatccgagttgctggattttgtttttcaccagcaaatgaaagaagatcgatcatgcagacaaatagtatataggtggtgatgtataagcaaccattcatcactaacaaaatattaatggcacacctcgaagggtgaagagagtaggagtacgcggcaacggactctatattgcaagaaaaagtgcatgccctactgttgtatctacactggtgacaccatatccctagctagctagctagctgtatctgttcccgatggatgacgacactatggattcataacaaagttgctcatgttatccctacaatcgtggtggcaatggcacacaaagaaagttgcttatggcagtccttcagattcttacatgaacatggcagtttgccactttacaaatcatggatataattagttaacaagtgatgaggcatgaaatatgcctgtatgggtggcaacagtcaccgataatgtgggcctaccttttgtaagctcacattacagtcattgttacgtgaaacatatagacaaaaattgactatattataatatattatattggtcagttcccttagcagttgcgtgggattcacgcatttgtgtgacgtattgtttttataaagaaaacaagatggtgccagtaatagccataagctgcccaatatgctcattcagttgtttatatgtaaaataaagatgtgtacttggttgcgtgatctattatacggtgcacgggagtcgggaggtgccaataagtggcgtaagctatgaccaatatgctcatccaattgtttcgtaaaataaagatatatgtacctagttgcgtgagaagattagattactgttgtctattatatagtgcacgagaatgcacgcaagtatctaacaaagcaaaagagaacgaactttgaaggatttgcatcatggctcctttggattgaagtattctcataagaattttttaaggattcaaatccttaggaatttttcctaaattgctgtttgaaacataggattaaaagttgataaattcctttggattgctttccaatagttcaattccagatgaaattttctcatgagctcaaacctcttttttttttgtctttgagaagtacaacacgccttctctcttcatctctcttttctctttctagaaagctatcaaattcatctgatattttcctatgagacgtccaaacacatcatcttttaaattcctgcattttgaattcatgtagaattcatcaatgcataacatttcagtcatgtgtttttttctattccgatacttttaaaatcccacgtttcaataggactctcacacgggaagtttttcatatacggccctttggaacaaaggatttaaccatatcaaattcctttaggtcaatccatcagaattttagaggaaaataagcatgatgtttgacattatgttttgttcttcctatgaccgaaagttcctatgttttttctctgtgtcaccaaatgatagttttggaattttcatgtgggaatttaatagacatgacgccctagtcacatggaagacacgtgagtcggtaacatagagagtttgagttgggccaactacaaaactttgtctgttttgaacttttgagtttaatttattgctattttatgttacaatagattttttgaaaaaaaaataatgttagcaattttccatgcagcaataatggatttttgaagctccaaaatagatgactatatatgccgattagtgataaacaagggattgggtaacatttcagtgtcaatatataaggaatttgtctaatgtcatactaagatactagctaatcaccggccgtacgtgatttgctactatggatgaatatgacttattatgtatgctgttattattaatttgtaacaaactaactgcaaaactcatccatgtagatgtctttgcatgattaacatgtattttagatattgcttagcataaaaccacattatattacgtagaaaggctattttacaatatgaaagtacatcgaggaacagttgattagagagaatctaaaatattttctattaatatagtaggtatgaagaagttggactaaggcaatagatgcacgaaccaaatttgaaaatatactttgttttttcatattttacatttatatacatgtctgagattaacttgcaaaaatatacctagtccgcggaacggttgtgcgggatcgagggcaaaccgcaggctggggatgcgggagcggaacccgagccggtcacgcggaaccgggatgtgcgaccgaatcggtaccgcagtaccgatgcgcgggagcgatggcgtcctcagccgcgcggcggtaccgtagaacggcggcgtgggaccgcgccgaccctatggtccactgtgttattcccccaattttttccaactcatctccttctttttccgcgcacgcttttcaaagtgctaaacggtgtattttttacaaaaaaagtttctatatgaaagatgcttaaaaaatcatattgatccatttttgaaaaaaaaatctaataattgattaatcacgtgctaatggactgctccgttttccgtacggagatgtgttcgctgtttgggaaatgacgcatggtcccgcgcatccattatgcgggagcgcgccagctccaggcatcgcccaaaaaaacccaaaaaaaccacgttgctgctaacccgtcttgcgggaccggcgcggtagcacttccctggcctgcgggaccggctcggtcccgcatcccggatccgtggtaccggcttggtttcgctcccacatccccattctgcgggtcgtcctcgctcccgcgcattcgttctgcggattgggtatatttttacaaattaatctcatgcatgtatataatcacaaaatatgaaaaaaaagtatattttcaaatttttttcatagatgcacacgtacaaaaaatcgattgtttttaatagaaaaacacgtcgacacattattagcaaatctgtttatgtattatgaggaggtaagttatatctcttcgagggtggcagaagtgttccgtaagggataaattgaaatgatccacattttcatatgtctaggctgttacacagttaattatttttcccaaaaacttatggttcatggttagggtgtgtctagttcacgtcaaaattgaaattttggttgaaattgatacgatatgacggaaaagttgaaagtttatgtgtgtaggaaagttttgatgtgatgaaaaaattcgaagtttgaagaaaaagtttggaactaaactaggccgaaatagactgcatatggacctactatgtgggacctaaaatttggatagttaataaagaaagcatgtatctgcaaaatttaagtggtgtgtttgtgaacatcagaacatgtaatattcgtcctgcctaattaaactgcataaaacaaaggcattgcaccattccctttagactttgaactagtattgtaatttcttaatttcaccaagtaaagaaggacatgtggacggaaaagaaacgagtatgaattgaaataaatattaactaggatatatagtacttacgtcatcatgtatgaaatacgtacattacattatatacacaggcatcataattagcgttggatagttgtcattgcattacctacgaccaccggcctgtagctgaaattttggggtccctttcagagataatcctctcaattgtcaatggcatatataataaatactagactcgtcagatttttttgttgtgaaactagctcgccgtgtttaagttctagacttcacacggatactcgtatttttagctaattattcttaaaatggtagacgatgtatctgtccacaatgaggcgcgcgtggtaaatctcaaaatatgtcggcccaatcttccggaggtagggataggatgtacgtgtatgttcataaggtgcgcgtgttgtgagtacctacgtttgtaccgtgttttttttaaaaagaaaaatcctctctctcttttgtttggtgttggttagtctatttttgaaaaccaacataatataaaaaggatggagagagtacatcgcaatcgtaagtacgggaacttttaccctacatatataatatatatactctatgtaagctgttcttttctacttaacaaattaataaatcggaatgttaattaactagttaggaaaaaaattaattgatttcgtcatctattgagataagatatatatgatattgtacaagatagaatactacttataacaattaaaatcactaggactggggcgggtggcatctcgatcaacttgggataggatggtagatactactacatctgtttcaaaatatttgacaccgttgactttttagcacgtgtttgatcgttcgtcttattaaaaatatttattaaatatgtaaaactatatgtgtacatgaaagtatatttaacaatgaatcaaatgatacgaaaagaataaataattacttaaaatttttgaataagataaatggtcaaacacgtacttaaaaagtcaacggtgtcaaatattttgaaacggatagagtatattttattagtattatatacactagatgtgtattaattttaatgcgctaacgtggcccgaagaatagttttaagctaacaatacatattaattaagtagtactacatgaataggctcactgacgaacaaagctgggatcaggtgttttttttgtgagatgtcaacaaatattatatctgtcttcttgatgtatcgatttcgatgcaatgatgtcaatggacaaaaaaaaaagaaaaagagagattaagaaagtgaaggtaggtattgcattgtttaaggcacaggtacatgtacgcgtgcgagcgtgtggcttgtgcgtgcacggacgtaggtgacgcgtggccagctcgatcgatctatctacgatgcaacatagtatatacggaaatgctcaacgccgggtgaccggcgcggaaggagacggatcgggcactccctcttccctaacgcacggtgtctctttctgatctcaacatatatcttcaccatatattccattgcaacaaatcacttatatattttggaaaccctctattaagaaatttggtttatttttttattccaaaaaaaatgtttcatctagtgcactcacaatatttcactatggatagatctaatgttgcagtgaactgaaatattctattgcaacaaatcaccaatatattttggaaatcctctattaagggaattcgttttattttttattccaccaaaaatatttcacctagcgtactcacaaagttttactatgtatatatctaatgttgcagtgaactgaaacattctttcgctatttgctgaaacattgtttttatataaggtgaaacaacacctgatttaaatgaatgaaacattttcgatccacttagttgaaacaattccgatatacctggtggaacatcgtgcaacatttaaaaataattcaataataagctaaaaaaaaatttcgtcggaatatatccatttgtggtcttattttgaagatttaattgcaacgaatttaaaggtgcaatcggatcatgatttggataagtaatttaagagaaaagttagtttaaaatagttttgcacgtaaatcgagcgctgacgttatgctgacatcaacgcccgattttaacctcctctcattgggcgccgagccagagtcgcttccacatatatatagcctcttctactctcaaaaaggctgcatgttagttagagtatacaaataaaatcttggaatcgtaatggaaacattgatatttgatatgtggaatcaacattagtagatttatcttttttttcgaatggtcatgctgttgccgacgttttatataaagaagaaggtgcctcatttcaaggagaaaacgagaccaaaccttccaatacactgttaattaggaaaaattgggcgaaaaccacaacactctaacctaagctaccaacaccatgaaaaaagaaaaaatagcaaagcccaaaacagccatcgataaagagcttgttgtaagcgacacaaaggcttcgacttcatgaggcaagtgctatcgttgccgagcttgtcgcctagcgacacaacagtttcgactccacagttatcacatcatcgttgccaaaggcatcgtagaaaacaagcaagacaccgactgtccactttaaacatcagcccaagccacttgagcactactacttgtacacagctaacaccaacctttctcgacaactgcaacgtgttatcgttgccaagcttcatcgcaccccaataaagcagctccaacatcagtagatttatcaataaagaaataatgtggctgataggatagcatggatatattcggctgcagcagcccactacttatacgttgtgacactgttggtgtttggtaactacagcgtagggtatcgaaaagtcctaataatatcatgcttttatacttttaatattttctaaatataaagttaaagagaaatatagttaaatatgtgcattatatatatattgaagacaatatctatatatatgtttgccccaacaaattaaagtcaaccgaaccatatcatatagtatatcgtaatgcgctagctatctattggctgtcgtatctagctctagcctcctcatttgcatacgttgtgtagtaattaatttgtctactctactaatatataatctgcaaatacccactattttaacttaaaataatataataacaaaaagtccaagtagtgatcggtgaagtgatcaagactaactgatagattgatagatagataggtgtagatagataacttttattattttttaaattttaaattttaaaaataaatctttgtaaaattcatttttaaaatatgaacctttttgttatgccagcttatttggcgtgacaaaataacacattacgtcacctgcagcggcaatgatagttttgtcctaccatgccagctatattggtgtggttacgctagctagttacacatgactaaataacgttgtcacgtcatttagacccacgtgataatattgtttcgtcacgccttcttgattggtttggtcaaaaagatactgatttaaaaataagttttgaaaagatatgtttttaaaattaaaaactaaaataattttttttaaaaaaaatcgtaggtactccgtagatagatagatgctatatctcaaaacaaaaagttagatataggggcagcttagagataggtacccgctgacacgtgggccacccatccaaaccgtcctatgctataaataatggcgcccccgcggctcaccattgcactccaatccaaaagtataatcaagcaaagcagctcgatcgagtgttcgactgatcaccagttggagctaatcgatcgagagagagagtatgacggtggaagtggaggcggtgaccatggcgaaggaggagcagccggaggaggaggaggtgatcgagaagttggttgagaagatcaccgggctggcggcggccatcggcaagctgccgtcgctgagcccgtcgccggaggtgaacgcgctgttcacggagctggtgatgacctgcatcccgcccagcagcgtggacgtggagcagctgggggcggaggcgcaggacatgcgcggccgcctcatccgcctctgcgccgacgccgagggccacctcgaggcgcactactccgacgtcctcgccgcccacgacaacccgctcgaccacctcgccctcttcccctacttcaacaactacatccagctcgcccagctcgagtacgccctcctcgcccgccacctccccgccgccccgccgccctcccgcctcgccttcctcggctccggcccgctcccgctcagctccctcgtcctcgccggccgccacctccccggcgacttcttcacaactacgacatctgcgccgacgccaaccgccgcgccagccgcctcgtccgcgccgaccgcgacctgtccgcgcgcatggccttccacacctccgacgtggcccacgtcaccaccgacctcgccgcctacgacgtcgtgttcctggcggcgctggtgggtatggccgccgaggagaaggcgcgcatggtggagcacctcgggaagcacatggcgcccggcgccgccctggtggtgcggagcgcgcacggcgcccggggattcctgtaccccgtggtggacccggaggagatccgccgcggcggcttcgacgtgctcgccgtgcaccacccggagggcgaggtgatcaactccgtcatcatcgcgcgcaagccgcccgtggcggcgccggcgttggagggaggagacgcgcacgcgcacggccatggcgccgtggtgagccgtccatgccagcgctgcgagatggaggcgagggcgcaccagaagatggaggacatgtccgccatggagaagctgccctcctcgtaggcaggcatcgatgactgcttccatcgcttgctacctcaccagctcacctgataaatcacctcagttactatcgattaatcatttaccatgcattaattaagaagaaaacatatataccataattatctaccagtaaaacaaatctaatagtagtatttaataatctcgttggtaattaactgcagtcatgcatgaatgcatgccatattgcgtcgctatctttttttcccatgatgagactgatgagagagagagagaatatatgtcgctattgagtgttactgcttgattactgtactagtagcttattacaatcaaccattgtctctgttgcgtatttatgagtgtaagtggttaattttctgttgcagcataattaagttacctgtatataatctgatgtgtacgtacgcatactgtctcgatcgatctccggggcttaaaaaggagatcgattaattgatcgaggagcaattataattatgatgcagtcatgtttatagttaatttgcatgtgatcatgaattccatcgtaacgatccgctacttcttaaaaaaacaaagtactctctccgttccaaaatccaagacactgtagacattgtagaactatttttcagatattttataatacaagacatgcatgcatatattcaattgactagcatattctcttcattaaattattatttttgaatccttcactctcatgatctatctattggatatttatatgcaatgatgcatacattgtaccatttcttaaagtgatctaaacgaggggacaataatatactccctccgtccataaatataagaaattttagttggatatgatgtattctattacaacgaatctagatatgaagattgttcagattcgttgtactaggatgtgtcacatccaattaaaatcccttatatttagagacgaaaggagtatggttttttgtcattagattaagggtggttaattatatcttatagtagtatttttgaatgaagagagtaaaaaaaacataaggatgagaatatataggcttattttccattagaatttaggggaaatggaggttacttcatatgaatctggacatcctatttctcatgtttaaatggcttcgtagaaaagaaatttctaagaatttaaatcctccacaaatcctacgaattttctttcatgcaaaggaaccatataaattaagcagccagatactagtcgacaagcctaaatgattggagcagcatccaccaggccaaaatgatttgatttgatcgctcgaaatgtgtgcctgtaactgctagggttactcgatacatgcctttccattaatatctccgttctaaaataaattaacctaggagaaaataaaacctatcccagtacaacgaatctaaacatggacagtcatttgtcgagattgtgtcctagaaaatgtcacatcctctcctaggtaacttttttttgggggagggggagggaatggagggagacaaaaggggtcgaatccattggttttgggctgtcagatgaatcagaacacacagtagtactccctccgtttcacaatgtaagttattctagcattttccacattcatattgatgttaatgaatctatatagatatatatgtctagattcattaacattaatatgaatgtaggaaatgttagaatgacttacattgtgaagtggagggagtacaaatttttcagttctcgacctaatgagcacttccgggaagtcagggttggtgcgttaaagtgttacagtttgactgcctttaatattgatcggatctcattcgtatcccttaactataaaatcaaatatatcgaacccatcagctattaagattgtgtaaaatgactttttcagcaattttaatagaggtattagctggcttggcagttcaatcaatagaaaaattaagaacaaacatagatcccacgtgtaagtgacaagaaaaaaaaactgtaaaacccacatgtcaacttataccgcagccttctctttcccactcagcatgcggggtggctgtcaagcttccttgattgctaaagatagctcccagctccaaggcagccacccatactccctgcagtggcccctcccgggtttgcccgcctcttagtgaagccacagagcaaagtgattttggcagcctctccctccgcaatcccaactcccctcttcccccaaaaacctacctcgtcagaaaccttagagaaaacccacaacttatgagatggcctatgacaagagcaagccgttaattcatttctggtttacacgacttctaacctgttgcgtcttggggttggaggggggagggaggggcgaggggagcgctcgcatgtcactgctatgcaaaagagggatgagggatgagaggagccttctagctaggggaggaagggccgaagagggaagaggaaggaggaggaggatataataagaataataggaggaataagagagggagagagaggatgacatataggcgccatgtcatgactgacatgtgggttacacggattatttcaatcttgttttaaaaaaagtgcaatgatatgtgggtctaatttttatttatttatcttgctgattgtaattccacataagtgctatgtagtataaagaccaggtcaatatttcacatgggcaccacatcagtgaaaaccaccattaaattactcttgaagtgagaaatgcccaggggtctttcggctagctccacaaggtggtgggctagacaacctgggttcaaagcctcacccctcctaattatttgatattaggtccttccctaatattctagttttttttaattactctcgaagttattttttaaccagttttaataattggaggagttgttgtatcaggtttgtgcatttgaaggatattaatcaaatccacggtatactagacggagcccaagtggacttttttctgaagagttcacctgacttcggttgggtcgtatgtagcccatctgtatggatcggccttttttcggggttggagtttaatttaccgaaccccggaggcgtcgcatttgctccctgaactgcccatcaaattcggaagccccggcgtccgtcgcgcctatcaccgccatccgccggagacacagctctccgccatcgagatcgagtcatggctgttcgatcgccgacgtcgaccaccgtggccaaggcggtagcttgctcgacgctgccatggattatgctttctgaattccgatccacccaattaaccaagaatcaatgtaagcgagagcagtgaattcatcacagcccgatctgaagaacactacaccacagatcctcctaaattcatcgatcatgatctctctctctctctctctcttgattaatcacttgggatctgcatagttttcgcttaagaaaagaagggattagagacgacgttctgctgttaattgttgttaccccagctgaatatatgtgctccttgtaattttggttttagcttgaattaatcactagtaattacaggtttgcaagatgcagatattgtgtgagagaatggctaggtattatacttgttcgagtttctgaatttaattgtttcgagtgtggtggatcgagtcgatcagtcgagtcgagagtcgagtagagtagaagagcgaattttaatacaagtaattaattaatatcgtcgttaattattgttaatcgatacagtgaagatacatgtaagcacgtgccaatgtcgatatacagtactactcgtatcatactaggggatcactatttactgcggttgtgctcctagaaaagctttcatataaaattttcgttcgaaaagaatatgagaaatactaaaataacttacattgtaaaacggaggaagtagaaacgtagttgtggtagataacatgcagaacaatcagcaacagcaactctggtctcgtgacacttgctttgctgtgctcctcaatccggtggccaagccggatgggcggtaattggtctagttcaggaaggcccagtaagcagcccaggagagggtctctagggcccatgtgccggtccatatgggccaaaagagcactgttgtccctttacggaaaaagtacaccgaaggtccctcaatttgtcatcgagttaaaaaatatccgtcatcacttaactaattaaaaacggtcaccagaggtcatcacttaactaattaaaaacggtcaccagaggtcctttggtggttttgacccggttttatccgatgttgcggctgagtcagcgtgggatccacgtagggcccacatgtcaggtgtccatgtcaccctctcggcctctctctttcccttttctctttctctgtttctccttccttcctctcgcagggcatggggatgccggcggcggccgcgtgcgggcggattgctcggtccgatccgcacggatttggggggggggggggggggggga

SEQ ID NO: 62739 - DNA, 697 bp, Oryza sativa
ccctctgaagaccacatcatgctgatggttccaaagacgccagaagcaccgctggtagaaagctttgtactctacaactggaatgatcgccggaggttgtagctgccccataagtagtgtcgaagtgacagagggcttgaacctgattgcagtcttagatttaacaccgatacttatattcatagctaattatttttaaatgataggcatgtgatgtacctgttgactatcgacatcaaaacacctgcagtgacgaaacaatgaattcatcatagggtgtgcgtgtgtatattcatataatcatataaaaaatagcttcgttaatctcaaaacatgttgggtccaatctcaacaagatactcatgtggtaatgatgtgcatgtgtgcattcgtagaaaaaaaatgactatcaatcttaaaatatgttggtccaaactctcaaaaatactattctttcaaaaaaaaaactaatgggataaggtgtatatgtgtgagttcataagaaagaaatgacatcactaatatcaagatataatggaccagactcttagaggtgttcataagtatatgtgtgtgtgtgtttatatagaaaaaaaaaaggtcatctgtaccgtgttttgggggaaaaaaaaggaagaggtgatgagaagatcggaaacgcagcagcgagcaagaatgagaaagcaactcaatgata

SEQ ID NO: 62740 - DNA, 640 bp, Oryza sativa
taagaggatttgaatagtcaactctgtccaattccagcaatactactgctgggctggggtcctggggacttacagcaaggataatagtagagctcactacccactattaactcatcttaaagccaacatatataataaattagctataaggttggctacaatctttttctcctctctctatctctcaagccattttcaacccaatgactaggatggtgtccatagcattaaataagctgccacctaggatgaaaaatgatgtggcaagtgaataaatgaggaaagaggaggaaaccatgtcttgcatgagacatggtttctacacaacatccaaaacatcatatgtgataagtagcattaaatttaagtatgtaatagtggtatttgtattggaagagtattgtctagtactagtttcttgatgatgtagagtttatagaaactatgcctagtgtcttgggttgggaatggcctcacttatacatttaatatatttgtcttagagcttgtatgaagctagctcttatatgagagccaacactcttgattttttttgttatctctctcctccacataagtctatagtatgcttatagctcactataatacttgctcttaggctgtgttcggtataggaatt

SEQ ID NO: 62741 - DNA, 769 bp, Oryza sativa
cgtgactctaacatagttatttatatacttatcgctcacatgatttcaaacaaactcctaccatttgtttctcatgtacttcctccgttccataatataaggcacaactacttttttttatgttccataatataaggcatgcatgcatgcatacaattaattaggacctcttctccattaaattattgcttttttaagtcctccaccctcaagatctctaattctattggatgcatgcattatatttattagggtgatccaaactatgagatgataataattatttcttgatctttgggttaagggtggttgtgccttatattttggaacggatggagtataaagcattacttgagtctgttcaggtttgggttataaggcataagtattctatgaaacctcacacattttaggctgaaaatgcacgtgtggccatggattatgaactagaatgctattatttttcatgttttacattgttgagcatcttaatttagtatcatatatattcaccagttgattattttagcatactttttggaacagttgtttttgttttttcccatgtgatcatgccagtcatatgttaatctatggaaacctggccattgtgcatccatatgtgctcatatcactcagttgattcattgtgcaattcaagttggttgacatatttcctgcccattgacttatttatatcagctggcaagacatgacaatgatgctcgatcaaaagcgctggaagaagattcttgagaagaagcaacag

SEQ ID NO: 62742 - DNA, 663 bp, Oryza sativa
caagagttttttttatccatgtttaaggtgatatttgatacttatttattatccttttaggtctttcactgctttgggcagtacttctgcttgcattacgaggcctgtccaacttggagtggctccggtttacatggccttcctccgttttatgggcgacgaaaatgatgccaggaactatagttatagccttgaggttggcgcgaatggccggaagatgatatgggagggcactccccgcagcataagggacagccaccggaaggttagggacagccatgacggcctcataattcagcggaacatggctctgttcttctcaggcggagagaggaaagagttgaaattgcgggtcaccggccgaatctggaaggaacagcagaatcctgactcgggagcctgcattccaaacctattcagctgaactgaaataacaagagagaaggattcggattcggattcggtttaggtgtatattgggtgatgcgtgtggtgcacctgtgcccgcttctgtaatttgtttgtgttgcttccacttttcttccacgtagccgctgtggcctgccctaaattagttagggctgacgtgtgaggaccatgaaaaaaaaatacggcttgagctctgtgggttctgattgatcacatgataagaaatttctcgat

SEQ ID NO: 62743 - DNA, 860 bp, Oryza sativa
actctgagatacacaaccggatactagtattcatattcatgttcgcatatctgaaaaacgaaaacgtgaaccatttcaattctcactgccatgtttggctcgaatctctcgacttgatctgcacgttcatgctcattcaggatgcaggaggaggaagcaaagcatcctgtgcaacacggcaacgccggatccgtgcaaaaccaaacaaaaagcatccatccatccatccatccatggcagatttggcaggcctgcacagagcagagcagtaaaaaagaaaggagagtgcagtcaaaagctctcctctcctttcctgaacgggaaggcacagaaggcgtaggacagtcggaaggccaccacatctgcatgccattctcgtcattctcattctccctccaccgtggggcccacccatcacccctaacctaaccgccgtcgattcagggaggtggacggccaggatggaggcggcgcctcccacgacgcgcgtggtgcaggttcagagcagcagcagcagcaggtgtggcctccacattattaattcctcctctcctctcctctccttcctataagagagaggaggtggaagaaagcaaagcttagagagggagagagagacgacgtgctcatcgatctggttttggttggaaggaggcgcttcaggtcgttgctctccatctctctctgtgtgtgtatcctcttgttgttgttgttgttggtttcttggatcttgccagagaatcttgcttcgtttttgctttcacgcggatggtggtggattatctcctccctcgtcgtcgccgtttttttctttctgggtgaatttgtttctgcgttgcacgcgtatgatatagctatag

SEQ ID NO: 62744 - DNA, 5023 bp, Oryza sativa
atgtgtttcattggatttgatctgtgatgtatgtgatattggatctgatctgggatgtatttgagttgtgatgcatttcttttaggatttgtgatgtatttttcgtttgagatttggtgatgtgatgtatttgtgatctgtgatgcatttctttgcaatatgtgatgtatttcttcccaaatctgtgatgcttgtggatgatttgggatatttagggagcaaatcgattgagcaatgaaacaacaacaaaaaaaaaaaaagaatcaaccgggactgctccaccatttttagtcccggttggtaataccaaccgggaataaagatggatttttagtcccggttatttcacccgggactaaagatgggtatctttagtcccggattcgtactcccggttgtataaccgggactataggggggtttctaaccgggagtaaagcccctttctctaccagtgttatataatttctggctccgccactagattttatcgagagtcatcggtccttatactatagatccgctccacgcatgcaagacaaactggccgaagtacgtaggtacttctcatcattagtactaatggctagtgtacttgtgattcagttttgcagtatctgttatctgtatactgtagatctcgatccggtccaatcattttcaagctaggttctagctgatacgccaggtcatgttgttgaattcagtaatcaatcgagacaaattaatcatcgataattatttttttatttcaccaattcgtgtggctgctagctgatgaaaccagcaaattagagaaaatggctctaaatggtcaagagatactatcactaggtatagctagcaactatcagctaccagtatgcagcagattgtgtggtcgtcgtcgtcgtcacattaagtcattaattcgaccggttttctagatcatgtaatatgcggagtaatatatacatctgcgccgccatatatccacatcgaatgacccctttaatttattctcatccatctcagcagtagcagctagcatcgattatatatatatgtatctatgtatccattttcttttgcctagctagctctctcgtcccatcatatatatatgtatggcgcggcaatcagcagcatgggcttctacctaattgactgaaaaagtgaagttatttttgttatcctcttcttcttattattattccgatcgatatatgcacagcatctctgtatacaaatacatatataaatggatgacgtttgaaaggaataaaaggctaggaaaaaaaaggcatgcaactcacatactccagcacttgatatatatcaataatggatcagataaggccacagttgctgctttgatccacttgagcttagctagcttttgctgatgatcacaattagtaattgccgtcatccacatcggtgtcaggttttggcaagctagtagatagtggagtactccgtactccaaataaaggatgagcttagctagcttaattacctagagagatcgccgtctccgtcgtcgtcgtcgagaggaggcatgacatgagcgagagctgtacacatgtgtgccagtagttgcaggtcgatgtaattaagcgatggatgagatgcatatgtacagagctacagctacaggtggcggcgcgcgcacggcgacgcgtgtggcgacgagagggacaaggcgaggcgtgctacgactaatttaaccactgcacgccgcgccaaaagtttaaaaccccagccaatgcgcgcaagggcttcttcgcgacggcgacggccattgcgttcgtgcatgcacctggctgatccgacgacctatcagagattctcgccgccccggccggacggatcgatgacgagctagctagctatagcttagtgtgtcgctgttaacttgatgcatgctgaattagttagttcagttcgcgccgtttctatcttatctatggccaaagtacaggttgttcctcgttgatgcaatctacatcatatcgatccatggtcttttgtgtacttacttggattaattaattatgtttcactcgttttgtgaacacccgctattactatacacacacacacaatagtactactatgcccttgttttcaaatcacctccgtgacttgtttcatcttcttttaatctttatcttttttgtcaactaattaattaatcgctgcatttcggggtttcgtgtgctgaatcaaatagatcttactccctccgtcacaaaatataagtatttttagaatagtgacaagtctaacatttttttaacattttttactagatttattattaaataaactatcataatattcaactctttttatttaaaacatcttttttgaatactgttggtcaaagtagcatatttagaacggagggagtaccatatattgatcgttaattggttggcttataatcctacgtttgagtctttgaaagatcgatgaatatgaacgaaagggttgccaattgtcacgtacgcgtgtttggtgttctgaagacgcagctgatctcaaactgcagtgcacgtgtctgcttgacttaaatctcagctaattttggtcagaccacgaccacgttccgattaagttcacacgtagtaccgcttgatgacaattaatattccctcaataaaatggatggcaacctaacttcaaacagttagtggagtatataccactccgttccaaaccagagctgttttgaaatgagtgcatgcacacttatttcacacacttccatctgaaagtttacatttagacgaagaaaaaaaatcatatttattttctcggtgtcatggcgatgagagaggttcaaattcgtacaagttttcttcaaaatttgatatataattattcgaacttaacaaattaacccttcttaatttcaaccaagctcaataaagtctataattgtcctaggtccaaacccaaaacatgggtaagtagtaactaacatgtaggcctaacctactaggggaacaaaatagtagagtaaggagggacatcgaaaaagatgatctaaataggatgtttcgccttttattttgactagtaacatatcttgcataccaataagcacgcacgattggtttgggcgtgttgtatgggctcatatgtggctgatgataggttgggagttcgaatcaagatccaaccgctcatggatggtgggagaacaggaaggagaacaacttcattatttaagtaatagaggaaagtcagttatggatgacagtttttccataaagttatatgacaacctcaataaccattgtggccatggccgcttccctaaagcctcttctcctgccactggtgccacaagagcatcagcattttcactattgtcttagtggatgatgtgctctgttcccacacaaaactatgagctaagcaatcctaagaactaacaacaaatcattggtaggacgaacatcgacaacaatagttggataggtgaagtgaaggataagttgtgatgacccggcggtggttgttggtggtaaaaaaaatatgatatagtgagatgccacggatttaaagtcttgtatatgacttagatgtttgtctttgacttctacgttcttccatgttaagaactttatgggaggaggaagaagaacaacaagcttatactttagtaactttgtaatatcggaataatttattagtctatgacccaagttaataagaaacaaggcgattctcatttttgtcaggtctcatgaaggtcaaagatacctagatatgggttcttggattataaataatgggaaacaaataaggttctggaaagataaatggctaggaaacttggcttttaaagacaaatatccatctttatactctattgtccgaaggaaaagttctactattgctaatgttatgagatctgttccactcaatgtttcctttaggagatcattagttggtcagaatcttgcatattggcatgaattgtgtgcttatattgtacatattcaattgaatcaatcctctgatagctttagatagaattatcatcagaatggaatattttctattaggtcgatgtatctagctttaactaataatggttatattgagataaacaagattatttggaagcttaagatgccacttaagattaagatttttatgtggtacttgtttaaaggggttgtgctaaccaaggataatttggcaagacgaaattggaatggcaatttaagattttgtttttgtatgaaaaatgagactatgcaacatctttttatagagtgtcattatgcaaaatttgtttggagagcagtacagttctctcttggtttataccttcctactaccatatctaatatgtttgatggttggctcttgggggtagacaagaagaagagtaaactcatacttgtaggagcttctgccatatgttggtctctgcggttgactaggaatgatatggtttttgacaaatcaccatctatctcatatatgcaggtgattttcagggcaacatattggctccgattttgggcacagctgcaaatgtgtgaagatgatcgagagcttatgaaggttgcatgtcgtaggcttgagacaacggtcatgcaactccttgcaaactatggatgaagattcacagatagacttgaataaatgtgctctccttatcttagtttgatcttttatttcgttgggtgtgtttaattcatttgaactacactcagtgtttgggtgttacttttataataattggctatagctctgatgagcaaaggccgggatgttttattctattattgtagcgcccgttccgtcgtggcgcctagcggaaaaattatctcttaaaaaccctaattgcgaaatttgtttctttgcttgttgtctagtgttcgtgccatctcaagatctcaatccccgatctatcgtcgagtccaattccgaatccaatccttccaaatcaaattcctccgcaaaagtctattttgcctcccccgggggtcgatgggccgatttcctcccggcccat

SEQ ID NO: 62745 - DNA, 8887 bp, Oryza sativa
aatactcaagctttataattcacacacaggccaccgccgggctaagagcgttgggagcagaaaaatcagaggagattttgcaagcggtaaattttgcttttattcacctttgattaattgttgtttgatcgatcactgaatttatattggttgtccctaatattgaatacactcacaatttttgcaggtcagggatcttcttcgcgaaaagagttcgttcaagacccaaccggattgggttacagttcttgatggacctcaggaaggcgcatatgaatgggtacaaaactggcctgatttattcatatggttcagaacattactttgtgctcctgattattagaaatgcctcacatttgtcagattgacaatataagttctttttgtttagaaaaaactattttgttcagcaacaaatctgccaattctcttagagctgacatctgccagcttcaaagatataagttttaaaggacatgataaaaaaagagaaattttcgctttcatgagtgaattaggcaaaataactattttcatttttgaaaaacaaaatttgggcaccagaaacaaatgacgaaacaaaatccaaatgacgaaagctaaacattgaaagtaagggcaccagaaacaacattttccctgaaaatagatgcagatcatctgaatccatgtggtgcactgttctgacagttaattcaccttttgagtgtttaggatctgttcacaactagtgattctatgtctagcttttagtccattaactgataacaagtgttgctcttctctatccttataggttaccatcaattatctgctggggaaattgggaaagacttacgcagacacagttggagtggttgatcttggaggtggatctgtgcagatggcatatgcaattgcagagaaggatgcagtgaaggctcctaaaccatcagagggtgaagattcatatgtgaagaaactgtttcttaaaggaacaacatattatctttatgttcacaggttagtatgaaataccgttgagcttttggctgctgctacattgtcaagaaaaaagttattcagttgtgatacgggaacaatcttcaaaatccatttaagcatctgatggcatattgtcatgcctatttctgatgtctgcctatgccaattcataggttatattctttgcaaagcagacagctgttgtaatcctctaagatactatctcgtattgataaaaatgcaagaatagcgtattaatgcaaatttgagaaacttaagtccagaccaaacgtaagggtacttttatgtgtaaagattctacctaaatatcacgtggtattctatgtaatgttctacagcaaacacttaatctgacatagccacaaacttaatactccttacttttttattatctgctgtataagatgacatcacatgacctgtttttagtctggagtctttgaaccacatatataactgtacacatttcttcacagctatttgcattatgggttgctggctgctagagcagagatcttaaaagccggcaatggcaaaggttacagctactgtacattggaggggcatcaaggtactagtaacatacttctaccatattcttctgctatcatttaactccctgccaagtagcttatgtttgttcctaaaatttcaattgttgttacccttatgcatattttggtcaagggaggaatgtaatgcgtaggctgcattcggaggtggaggttgggaacttcacctcgccacacgcaaaacaaagcgacccattagcgcatgattaattaagcatgagctaaaataaacttgaaaaaaatggattgatataattttgtaaaacaacttacatatagaattttttttgcaaaaaaaaaaaacaccgtttagcagtttggcaaacgtgtgcgtggaaaacgagaaatagaagttgggaagaggtggtaaggaacacacccttatagtggatcgtaacctggtttaaatgaggttaccctcaaattctctatgaaacaaataccttactggtttccttgatattctttccaaccatcagtctgcagttagaattatttatagtgatgtgtataaatctaaatcctcatcaacacaaatgaccaatctgtgacaatagttggagatgcaattttatcttttctatgttggtaagatagttttgttctaattgcattgtgattgtagggcaatacaaatatggcaatggcaaatttgaagcgtcggcttcaccatctggtgctagttattcaaaatgcagggatgatgtagtgaaagctcttaaagttgaccaagcatgcactcacatgaaatgttcttttggtggcatttggaatggtggtggtggcgctggacagaagaatttgtttgtggcatcatttttcttcgacagggcagctgaggtaaggttgttgaactactgaagatgtttgcttttgttgccatgatgatacaccagtaaacaattttctggtctctgctcaggctggatttgtgaatcccaaggcacctgtggctaaggttaaaccttcagattttgaaaaggctgccaagcgtgcatgtaagttaaacttgaaggacgccgaagctgcctaccctggtgtccaaaaggataacattccatatatctgcatggatctcgtttaccagtacaccttacttgtggatggatttggtatgtctcgttaaaactaaatataatcaagaccgcattacagattttgcacaaatttatcactaatttgttttgctcttgcactctcgcaggtgttggttctcaccaagagatgaccttggtaaagaaagtcccttacagcaacgcgtttgtggaagcagcatggccactgggaagtgccattgaggttgcatcttgatagacagacagcagaaagttcagcaagggagctacgatcagagggcgtcatcgccgtaaagttttggatctggagggtgttcgcttgctcggcgctgcgcacgccccaagtgaccattttgttactgaaatcgattgatttaacctgcttctatacagtagcctgataatgagtgatacacaaggacccgccagcttgcatagttgcatacttgcatgcaaggggtatatacattttttttttgtaccattgaaagtaagacgagcctgtcattcttttcttgatctatactactccagttctgtacctctgttaggggcagtacagtagagaagaagattgaccatgtgtccatgtggtgatcccacatgccagcatgactcagctgatatgtgggtcccacactttgtctctgctgccatgtcagctccttttgttgttctccggattaaattgtcgtgtaagcgtcacgtcaattccacgtaggatgaagcagcctagtcaaaagagctatgtatgaaccttatttgtataggttttgtaagttgagggattgtatttttggttaaggacgaaaatctggcgacaaattgagactttgagggaataagttcatccaaggtcccttaacttgtcaacaaatccaattttcatcccttaaccacaaaaccagatacaacgggtccctcaactatcaaaaccggtgcaatataggtcccatggcggtttggatggtggttttggcttacgtggcacctacgtgtctaaattgacctggtcttcatctgacgtggcatagatgtggcattgacgtggcaatttgatttggaaattaataaaaagagtaaccccacatgtcagctacaccaaaagaattaattaaaaatggtgtggtccacatgggccccacttgtcattcactctcctcatcttcttcctcctctctccctatctcccctctcctctctccaggagctggcggttcggtgatgcggcaggccggcggcagcggagccagggatgacctcggagacgaggacgccggggagctgcgcctggacggggacgccgacggcgagcgcctgggtgtagatgatgaggaaggcgaagaggaggttggctgcgacgccggcggagacgacgaggagccggtcggggacggggcggttgcgcaggaggtccgggtcgtcgggcgagaagccggagtccggttcgtcgtcggggaaagctgacggagaacttggagacgtggatgccgcaggaggtggcggaggcgaccgactcgacgctggcgaggaggtcagacggggggtcgccgcggcatcgttggccgccgaacctcccttgacgccgcatcgccgaaagggaaaaagaagagataaacaaaaacaccatattttaatctgatctgatatgatcaaatgcacctcaagctcgatcccattagcagcaatggcgatatcgttgattttcacgacctgctcgctgaggaatggaggtccagttgctggtgccatgggtggaggtgtacgctagcagcttggcgcgcgtcctcctccgccttccatggccccttcttcacgtttgccttgtcgcagcacggcggccgccccatctctccttctccccctctcagctcctaccacggtgagctcaacaacaacaacaccaactctgagtccagtaacaacaatcaccgccggcgtccccgtccaggcgcagctccccggcgtcctcgtctccgaggtcatctctggctccgctgccgccggccggccgcgtcgccgaaccgccagctcctggagagaggagaggggagatggggagagagaggaggaagaagattaggggagtgaatgacaagtggagcccacgtgggctccaccatttttaattaattcttttggtgtagctgacatgtggggtcactctttttattaatttccaaatcaaattgccacgtcagatgaagaccgggtcaatttagccacgtagacgccacgtaaaccaaaaccgccttccaaaccaccatgggacttatattgcaccggttttgataattgagggatccgttgtatctggttttgtggttgcaggatgaaaatcgaattcgttgacaagttaagagaccttggatgcacttattcccactttgagcgcaagttgttatggtgtatcggcccatcaaggcccaagctagtgtcgtatgggcttgagatacacctgggccatcaaacagtctgaacgggagtgagacccaagtgtttacggcccaatgggctgtatatctgactgagtgaagtatgcccttgtcagttgtcactgcagctatgctaattagtggtttggctttatcaacaatttatcattggaaggtccttttccacaaaaaagaaagcacgtttttacgtagacatagacacgcgcacacacgggtgaaagaaacatcaatcgaataataggcagtagctaagctagctagctgggtacgtacgaaaggaatacgtagatctttagtactcaccgtattggactcggaagagtggcgtatcttacggtttttaaccgtctcttccacaaccagcctacacgtgtcccgtcggcagtaactagtgtgatctgctcctcgccaatgtcgacacctgttagatcccaaatcaagaaactcaccaaattaatcttcatctctctctcttttttttaccagctgtgatcaacacgatttattacatcgatcacgttggtaattaccggagccaaccattcaaaaccatgtgtctggctggccatctttttcttaggaagccaggttgtactacactactgctagctgctgatgcttaactgaccttgcttcctgctagcttagtgcttagccttagtatctcaagatggatgcacttacagaacttccctatctaacttggaccctctagttaggttcaaaagatagttatctttaaaagaaaagttaggttcagaacatgcgttcgttatcagctgttaattcgtagaaaagttcagtttaatttgtttaccgtttccagaacaagttaatttgtcagatccgtgtaaacatgcaaacactcatcgatcatgctcgtaaattaaatcaaattgttccatatgaaaagcttgcaaaatgaatgactttcaagcatgccctagctagtaaactaaattacacaacacctgcccttatatgaaggtatttttcttgattgaaaataagaacagtaaatgggagagttggctcaagttggtttaaggatctttacaggtacattgaagcttcctctacacgacattatatatattatgcgcatatatatatgcaggccttgaattcttcatgtcacaatctaaactggacgcagcaaacagtaagggaatggctgtattcatcattgagcacaattaatctaaccgtacgtccttttaccttggaagaccataactgtactaatcgacattagcgatgcttcaacggaacgtcggactctggtgtccagctgatctatctatctcagcactattattaccaaatcaattaccagctagagattaatccgaacacgtacgtggcgcccgatctagagccgtatatatacgtacgctaataattagctggccaatgagagaaaataatatatatggtcaatatataggagaggataaacatcacgttgttatctcccatgaaagttttcttcttcttattctcgtctatcttcttgagatgaactacttattcagagtgtacagctagttcactactttgtctgcagctagctttcctaagagatcaaaagggtttccaagtgcatgtcacgataattaaaaggtggccaccatgcatggttcatctttcgatcgagatcgagttctataaattgacctgtcaatggtatgtctgccagtagctagctcgaggttaatctattcgatacatattccatccgtttctaaatatttgacacagttgattttttaaacatgtttgaccgttcatcttatttaaaaatttaagtatttattaattcttttcctatttgattcattgttaaataatataccttttatgtatacatatagttttacatattttacaaaagtttttgaataagatgaacagttaaacatgttttaaaaagtcaacggcgtcaaatatttaggaaaggggagtatatattttatttgaaacacatgttaattgttttgtcgtacgtcctctctcaacgtattactactggtcagttggtttgttcttatcgtctaattttagatcgaaccggccgggtagtctgtccttttacggcagtcatttggtcaagtcatccgtgtacatgcatatatgtcgtcgcagccgatcaaagctagaacgccacataataaaatcataatcaactatatatatggtggttaatcatatatacacgtggattttccttgtttaattgtcgtcttgtgcaaagtgcaatgggctatcagcaagttgcattttttttattggcagatgattgcaatatggcagcacatatacataaatgataagcaaaacctgcagggtgtggaagacaatcatttggagcataaacaataagtacgtatataattataaatatttaaatacatgcatattattgctggagaagagaaacggtctttatatcaacgtctactttgatgaagagactctaggattgtttaattattccatggaaaaaataaagggggaaaaagaaatggctagctagaccggtcgttccatgcatgtagagctgcatgaattgtgagatggatgatcatgatcgtggtgaccacgacaaattaagccatcaaaatcttctctttccgttgagtgcaacagcacttcacttgggagtatatagctagcgtgccgtggtcgcaagctacgatcgagtcgagtatatatgaagctaccagagctgcactgctggtggtcaaaggcacccggccgcctcgttccttaactcttgcatgcatctatatatgcatgactgcatacagaaatatggtggattaattcctgaaattctccatagaaaagagaggcagatcgatgttaataagataattaatcaacacgtacaaacttagcttgtctcgtaacttaatttgttctcttgtatatttgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttctgggtttctaatctggaaaagtccagtcccccctctcagtgggcaaggtcctccttttatatcttaaggggataccacatgcaccatttctctcttttttgtggggacttacccccccttttcataaatggacggagatttgtatagttgccgtccgagtcaccttctgatgagacggcccacaactacctccactttcgccgggagcaggtgcgacgtggaatcgtggctgtctgctgacgacatgaccggtatcagaccagtcacgtcggtcattcttgtccaccacgtgtcaacttagcaatctacatgctcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacatgcggcgtgacacgctcagccaaaccgcaataaatgtgg

SEQ ID NO: 62746 - DNA, 619 bp, Oryza sativa
ggaatgccctggtccgtcgcgacttctccgtggcttaccgttggggtgggcaaggaagaccgcggcccggcggttggagacggcgagcgggcgcgagggaggcgactggaggtcgaagagcgggagcggcgaggaggtggtagggaggagggggatggggtccccggcgaggcggaagacgaagtcggtggtgccgtcctcctcgccctcgacctcgtcggagaggtccagctcccgcggcggcgccatggccccccaccggtggtcggaggagcctagggttttgggcgggaagcgggacggagacggcgcggcggcgagggagcaatagcaaatggggtttcgtgaagcgagagcgctagtagcggaggccttggcgtggagtgtaagcagagcccagcagcgtggccggcgggcgggcgcacgcggcggaggggagagggagaggcggaggcggccgcttcgcttgccggcggtgatggtggtggcgctgaatacatgggctcttgtcgttgccccgtgggcttaattgggccttctactgggccgtcacatatattaatttggacttctttttattgggcttgaccttgacggtgagtaagaacagaaggcgcat

SEQ ID NO: 62747 - DNA, 105837 bp, Oryza sativa
aaattaaattaacagcaagtgaaaagagaaaggagtatctctcttgttacgtaccatccacggtttcatgatgtggtactaacagtagcgagtgaattaatgattgagtgatgctagtagttcattaaaaaaaagttaataagcgtacgtcagtccaatcatctgattaaattacaatatcctagaagaagagtacagtagttcaattagtagtggtgcaacaggatgagagcacgcaagtggcatgaggagatggatggatatgcagttagtagttaagctcagagatggtggtcatggcgaattggcgatggcgtatgagtaggtacataccctcatggagacgttgcggaatcgggaggaggaggagggcttgtaggtgtttgcggcggcggcgagagggtcggcggcgaggcggtactcgtgcatgatccagctggtcttggtgcccttgggagggcggccgcggtagaagacgagggccttcttgacgccgacgctctcgccggtggcgctgtcgtggatgggcttgtcggttcccgtcgccttccagtaccccgacccggcggcgcggttcggccggattccgttggggtacttgcggtctcgcgggctgaagaaataccactcactctccccgtacaccgccttcgctgcaattaattaaccagtagcaattgaccgaacgaccaactcaatcgatccatcgatatgatcgaggaagaaggcttacatggcaggtcccatggatcgaacttgtagatgtcgacgtcggcgatgatggggacggggcactgcccggcggtggcgcggctgcggaggtagtgcaggatcagctcctcgtccgtcgggtggaaccggaaccccggcggcagcgacgtcgccgccgacgacatcgtcatctccatcgacgatctaatacggttactgctttaattagcttgtaattggctacctatagctcgatcaatcgattgatcgaatcaaagcgagtgctcatcgatcgatcgatcctccggagcagcggagggaagggccacttatatgcacgagcgaccttgtcagttagcgtgacgtggcgcggagtggcaaatgtttgtaattcttcggggtcaccaggggtagaatcggaaggccaatcgggtgattcgttattcctcgcgtccggcatgactcggcatgggctcgtgcgtggtcgtctatggcgtcagcaatgttgcaacgcatatgctcatgctcatccgtctccagctgcaactaactatatctatctatctatatctaactagttaagctaagctaagctatctctagccgtcctcactgctcatcaatctcatgtgatatctcgcatacagtttcatcgatcgttatcagctacagggaatcgatcgatcatatatagggcagatatacactcctatcatatcatatacttcatctgtcccataaatataggacagatatacactactatcatatcatatactccatccgtcccataaaatacaaactaaaactaaacgtgacacatcctagtataacgaaatctgaacataagtatatctagattcgtatgactagaatgtattacatatactacatccaatactagattggtcttttataagactggagaaatatgtagatagatactcctatgtagctttttaatatataatagcattgactttttaaagatacatttaatcattcattttatttgttttaaaaaattatgaacttattatttatttattttatcgcgacttgatttatcgttatatgttcgttaagcataacttatttttttatatatttacaaaaaaaataaataagatgaatagacaaacgcttatcaaaaagtgaacggtgtcatatattaaaaaatgatgtagtagatgatacgcgtgattatgtcaaaggtaagaaacagaattttactaatctgctcttttttttggaaaaaaaaggaaaacattattcgtgtgtaagtatataatatccgtgtgcattacaatttaaatctcataggtgaattgcacacggatattgataaatcatgaatccacaatatgagatttaatcgtaccaccggtacttttcggtaaataattcatcatttcaataaatatcagtgccaattaaagcatattcttgggtgctctctaaagaaacttattgtttatttaaataggagcatgagaagaccaattatttgtggagtacgtcacatcctgcacgtggagctatttagctgcagtggccggcgctagctagttgtagacgatgaattggatcagtcggctcacatggctagtcattatcgatcgaaaggccagaaatctctgaatagtactgaagtagacattcacacatccattgattattcccagagaaattacaactgtttggctctttgctacaatactctctccgttttctaaatatttaacaccgttgactttttaacacatgttcgatcattcgttttattcaaaaacttttgtgaaatatgtaaaactatatgtatatatataagtatatttaacaataaatcaaatgataggaaaagaattaataattacttaaattttttgaataagatgaatgagtaaatatattttaaaaagtcagcggcgtcaaatatttagaaacggaaggagtactatattgtgtgtggggctccatttcaactataattgaaccatacacagtttcggtgtacgttattattggatcatcatatctaacagattaacatccattattcatgcaccgaaactgcaatctttgtctcttcaagaggtttgcctcggcggtacaccgaagcaagctagctatatatataaaatcaggattatcctcgctcaattatgccttggaaaaactcagaaatgacactacagtaagtatgttaattgggatgatttccacttcacctgtttaactggaatggccaccaatgcacatgtttggagcatacttttatgatcggagaaaatttaattaataccatcgctaatatgtgtgagttgtaaatcaccgcaaaggatactattagctacacaagtcataggagagccactgtagaaggaaaaaaatatgatgagaaactaattccttttttttaagataattgtcgcgccccgaactagtcccgaccggaactagtccgtgacgctccaaattaacctgttaatcgataccagtcctaggaaacagtgctggtatcacagggagacagaatatcacagcaacagaggtctctttattatagagtagatgtacagtcatgctgggctgcggacagatcccgagctcacaactgcattacaaaaggaaagcggaagccaagacttggaccaaacatcacaggcgcgacttgggaactaggccgaaaccctaaaactcatcgtagccggcttgctcctggaagaactcctcgtcagcgggatccgcttcatcttcttcaacaactgggggggattatttatatagagcaagtgtgagtacgggagtactcagcaagccatgggaaataagtgtttaatgcaggcttcaaggaaaggctgttgtttttgcaattgattttatttgaactcttttctgaaatcaactaagtgagtgcttctcaaacgacacggatgagacagtgcgtctcgtccggtcggagtatgtgcaatgtatcagtcttttgaattgattcaaagttggcacccggccaacaactttcaaacggccacccgggccaacaacttttaaacggccacccgggccaacaaccttcaaacggccacccaggcctagctgatccatcagctgcagatttttcaaacatcgatcccctttcgacaacagcaaattcacaaggcagtagttaaacaaaactacgctaggaatcacctcacatccgcccatgaccgtgggcacggctgttcgaacagttttaatcacctctgcagagggggtacactttacccacacgacattactaacccggatcacccagcccgtggggatcagccacgtcgggagacctccaagatttcatgacaaggcatttcgaaagccgacacaggtttaccatatgccgacgagaggggtcccagaccaacaacaggttaggtcccagaccatactgtgccaggaagcccagggatcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaagtgtaagagcgggaaaccgtacacccggtacgttccccggtccgcggttttggaaattcatttagttcacaagcaccgacccaggtgtcgggttttccaagtcttttgtaaaacccaagttttacccaagaagttactcagattttaagtttgaaggcgaccgtcgatactcgtgcagagtgcacgattttcgaggcgcgactaggtggttacaaggaaacatggtataacaattaacagaggaaggatcaaatgcaacaaataggtaggtccgccaatctgccttgcagacgggacaagcagattaagtgtgatcctatcaatgcataatatttttcaagcaacataattaagttcaaatataggctcaagatgttcaaaggtggcttgcctcgctcgagatcttgagcttgatcctcgaaatcctcgcactacgggtcttcgggctccgaaactacacgcaaaacgggacaactcaacaaacggcgaaaataaagccctattaatgacctctaagcgtgccattagatagatctcgagatttgaggaattttggaagttgaacggagtcaaacggatttacggtcgggaagatattgaatttctaagattattggatttttggtctaaaggaaaaaggatttatttaaatcctttttgaaaaagaaaaagaaaagaaaagaaggagggagggaaatcagactttcctcgggcggctagggcgcggcccgagaggaaggggcggctcggccgagctaaatggggccggccggcccaagaaggcggcccaaagcgcgcgcgcgggcggagaggagagggggagccggtgggccgggtccaccttgcgtggtcccgggtgggacccgcttgtcggcggcacggttcaccgtgcggagggagcacgcgacgcggcgctagggtttgggcggggcgcggcgcacgcgcgcggttcgcgggggacgcgggtgcggcgggcccacgcgtagcctcacggctcgcggtggaccgcgcgcacggggagggtggaacggagggagcggctgaccgggtcagccgactcggttgtgccgaggtggcaccgacgtggcgcctacgtggctgcctcgcgggccggctggaggaagacgaagacgccggccgcgaatggacggcgggcggcggcgacgagcggcggagcgaatcacggcgatacaggcgaaagcgagcacaccgggtggttgcacgagacgaggggagacgagccaacggctcggattcgccagagggagctcgacggcggcggattgcggcggcggccaccggcggagagaaaaagggaaaacggcgacgaggtcacgaggggccgattcccggcggcgagagcatctacgcggctacgggaatccgtcccttgcaccggattaggaggaaacgcatcgagggaggccggcgacgagagacgtttccgagctcgggcggcgacagcagcgagcacacggcgagcgacggcaaaggtcggggcggcaccagctagctatggggaggctactcgtgctactacccgagtctaaggggaggagatggaacgaggagggagaacggagggatgcactaccgtgcgggcgggcgcagtgacgagagccgacggcgcgaaacgtgatcgtttcggcctcgggccgaggaagaggagggggagggcacgcccggagtccccttccgcgtccttgctcgtgccgactcctccgacacgcgcaacgatgatcggcgacggcgaacaggggtgacagtggcgtggcggcgagagacgaaaacgagggagattagaggagggaggagcttgggtttataggggcgacaatgtcggtttgggagaggggaaccgacattggacggtcaagccggcgagctggcgcctggctagcggccaaaacgacgacaggaggtgacgccggcgatgggaggaaaaagaagaaaggaagagggaaagggggcttgcctccttgcttctttgggaaaaggaggagggagagaaggcgatgaggaggagccctgcctcctttccttggaagcacgcgcagggagaggcggggccgagtcgatgacgacggcgatgacggcggggcggtttggagcggagcgacgacacgggcggcaggcgcggcaggcgctgacggcggcggcgaccaggcggtcggccaccatagcacgcgcgcgtgggaagcaacggcggcgcggcgatttgagcggcacggctcgggcacgcgtgctggcttgcggggccgagcggctgcgtggcagggcagcggggccgggcggcgtaaacggcgcaggcgcggcacgggcggcgaccacgcgggcgcgcgcgcgcgaacaacggcgcgcgggggccgattctgtgggcggggagctcgctagggatggaggcggggagagagagcgagggagggagatgggccgagagggattcggcccatcgaacccgggggaggcgaaatagacttttgcggagggattgatttggaaggatttggattcgggattgaattcgacgatagatcggggatttgagatctgagatggcatggacactagacgacaagcaaaggaacagatttcgcaaatagggtttttaagagatagttttcccgctaggcgccacgacggaacgggcgctacacaaactcttgtctacttcgtcgcaggggatctcgagaccaacccatggcttgtttgggtccttccattcatgccacagccagcatagacgcagggctctcgtgaatttttctaggttcaggaccccgaggcctccttgcctagttggcagacacgtctttgtccaattgactttgtattttccacccgtgatgtcccccgtgccagcccagagaaaacgtcgccgctgcttgtctaggcactccaaggcttcctttgaagttttcagagcagtcagtaagtagattggctgcgccgtcagcattgattttacaagtgtggacctcccggcaagtcccatgtttttgcctctccatcctgttatacgccctgtgatcttatcaaagatgtgttgcatgtccgcctttcgcatccgcccgaggatcagggggagtcccaggtatttgatcgggaagtatgctctcactgctgggactccctctaggacgtcgtccaaatcaatgttattgtatttgatggccgcgacttgagatttttggaagttggtaacgagtccagtggccgtgccgaaacgttgcaggatttccgtgagcgcttggacatcccctcttgtgggattgacgaaaatggcagtgtcatctgcatacatagatgttctcaggcgatgcattctgcctcgaagcttagagagcgaacctaggtctgttgcctttgtaaagagacgttggagagggtcgattgctaggacaaaaaggagcggagacaacgggtctccctgccgaagtcctttcccatgcgtgattctttgactagggatgccgttgagaagaacttgcgaggtagatgtgtagaggagggcacctagccagtctctccattttacagggaagcctaggcgttgcaaaagggccatcaagtagtcccaacgtatagaatcaaatgctttcgtgatgtcgagcttgaagaggagcatcggccgattcgtacggtgaaatcttctggccatgttcctcacaaagaggaagttgtcatgaatgcttcttcccttgatgaaggcgctttggttgatggagaccaaggagcgcatgtggggcctcagccgcaacgccagctaattaagctactgtttgaactacattgggcatgttatctaaactcaacccatcacaataaaacacacacaacctaattaagctactgtttgaactacattgggcttcggatttatcatgtgattcctcagtaaaatattcatcatgtgatagagctgaatggctgacacttcggtccggcacgaatcatgaaggccttttacaaaaaattgaaattggaaactgaaagtacactacgtggccactcttttttctctctttggaatgggcctagatctttttcgggaaaggacaagagctgagtggatgcacacggatatttttaattttttttcccttgccacttgtagtacaattgtaaagtgcatgttgccatgttggtaagtgcacgagtattttctatttagggggtgtttgagagagagtgactaaactttagtctctcttcccttaagttccaacgaaaatactacccctctctccgatctcgaataagtgtatacactgttaggtacgacactttagttttaaataattataccaacacataaaatttttaaggttatatttataactatatgaaaccattgtttgcagctttcagcctttaacctgctattaaaatttaaattttttaagttgatttagagagtttcttcgtcgtagttattttctatgattaacttttaaatcatgaataacatacatatataaaagttctaccaacaattttcttttttatacactgttttacgatttatcaatggtaggcgaaacaattagcctgctatacactttgataatataacatttatttagtatttatttttttataaaataagaggttaaagtgtaattttaacagtgtcagtgtcaattattcaataactaacaaagggagtacttcctccgtcccataaaaaactaaactagtactggataagacataacctattactataaatgtctattcgtagtattagaatatgtcacatccggtcctagatttattttttatgggtaaagtagtattttggagtaaggactggcggtaggcaggaagcccctccttcgtcagccagataaaaatatccaacagtacttaactgttactcgttattgttttgttttgtggtgccaatgttttcttcttggccttattccctccactactctctctctctccgaagcacatttatttttgggttatgtttgtttatgactgattgaccagcccatctaatcttggtttataggagatactaataacatatatttagcatcaagcagtactagctaggagtagttgtctgagttgatgtatataaaaaaaagagagagctagttttctgaattttgttgtgcaagaggagcaaggaaagaccagatagtcttcatcatgtggccactgcataagttcagttgtttaggtacccaagggttaactatagagggaccagcatcatgcatggtccatcatgtgatcttgcaagttgcaaaagccagatgcaaactgtatgaacattatttcgtattattaattaattatatatattgcccaagaaatggcagcacaggaaaagatctttatcatgtggctgcaaggaagccagggtggatgtgtggatatgtgcaacactactatacatttgtgccaaaaaggtcctaaatagattttgcttgcattttgcatgcgtggatcagtggaggcagaaagaaactgaagaaaagaaataaaataataagagatgtgagatcaccagcgtatgcatcatgtcggccagcatgcatggtgctgctgctaagctaaggtagctggaaatacttacggagtacctttttttttttttctcttcagccattcatttgttcattcatagcgttatccatgaaagacctggcactatctatctgtccatggtttccctaacatgggccaattttgccgcgatatccactcttgcagctttgatttgttatactgtattttacttttacttgtttttcacgaaagtgaggcagaagttctgtaaatatattttcttagaaagaaagtctttttttttcagaggtaaagaaagaaagttttattccagagagaaatattttttttcttcggagaaacacaattcaaatgcaaaaggtcacttgcatgtatgcacactcatctctaggataagatcttgttattaagggttacgttggctacggctaaaataatacatggataaggataaggataatatatgttgcacaattttttttaaaagaaagactgagcataacgatttcttttatgcagtatgaatactagctatatgcacatgcttcttaaaatacaatttgttagtaacaggtcaggtttgtgtagcaaaaacagatcatcattctcccttaaaagaaaaacaccctcaaaagaggaaaaacaaaaaaaaagaaatggagaggggccgtgggccatgtggagctcctccaataaaaccaaaagcactaaaaaaaaagccgaaagcgccttttgccgtcctccattacttttccccctcatcaaaaaaacccaagctacctcatcaccccaccatcaaaggcactgacatgtgggccatagtatgcaccctggcccacctgtcattgaccctcgttctccaagtggcacgagacggaataaactaaggcgggcgcgtgtatccggtacgggcacccgggtggttgtacacgaccgggtgatctggcggcggtgggccccacgggagggggattcgtggcccaggatcgctctccgcgcgctgactaggactccgaccgggcacgccggtcaccggtcaccggcctgacccggtaaagtaaaccccagctgcctctttgttgaatcaaccccttcactatctcttaactacaaaaacattctgttcttcaagtggatgctggttggtaacttggtacctattcccatgatccaatctggtttatagctttggcacacgttgaaaggtagagtcttgtatgggttttaagcaatatacttgtcatttataatactatcactttataatagttgggattatatagaccctaaatattaatccaccaaaatattttttttactctactattattttctccgtctcatgaaagaaaaaagttattttgtttctatatgactaaactaagaaatgatgtttagcttaatatcgatgacttttcttttcctttattacatacgcagtattagcaaatttgttagttgtctggatggcaagtctaagagcccactgttagtaaacattgtacatgtttaatgttgttttgctgaagtgttaaactaaacaccgcttgaatttaggtgctagatgaaaagaaatccaactttctaagaggctacaaatttattatttgtgtttgttacgcatatgaagaaaaactctcgttcatttatagctaggagtataaaaatacagcatgtcttgctacaattgtttttctatgaaagcatgtgaataactcatgtgaggctaatggaggcatcatgggccaagcatggctaacacccacgcggctataactataagcaatgcaagtgagagacccatttagagaggaggactaaaatgaaatttgattaatagtacaggggtgtttgtgcaagaaggaaagaggaaatctttttcccctttgtggtagcgttgccaatggcaaactccacttgtcggatctctctctctctctctctctccctctctctctcgcccatgtaccatctccatggacgacctcgccgccgcctcccctcctcacccgccgccgccgccgccggaatcccacgtgcctccgcccccgcagacgccggagaaggtgagctcgcctcgacccccctgtttctttttttcttttctgtttttcgtaatctcctctgttttcccccctttcagttcgtgaaaatttctgttttttatagttctttttggcgacttgattcgaggaaaaaggtgcggttttttttttatattccgagctgattttgcagtgttttgttcttgcgtgcgcgtgcgactgtttgtaattggtaaagttgtttggaacaacatccatccgtgtgttagctgcttcagttcttggtcagtaaggtatagataaaattgttcgattaatactgcaatatatggtcgaattgcatagtaatatcagctaattcgtagtataatcatgtgcttgatcttaattttgtactcgttacactccaatccttcacgtaatttgcatctttctgtggtgattgattagttaggcaccgtgacaacctttttggattaagcgagataattacaaaaaaaaccgattttttgatcgggtcttatggatagtaatagcacgctcattagctcaatttctacatgaagtttgggtagccagagcaagagagaagtccaattgtttactcaactctctaaaagttcttctgctcttgtgtactagtactattttgcaagcagctttcgagtactaggtaataggttggtgctgattctaagtagaaatctctcatggggttttctgaagttgctctctggtgctactctgtagacagaaatggcttgtgtagtttgctaccgtgatgttgcttgatttgtgctcttgcttctgcacagaagcacaaatacatttcaaatgggaatgcttatcctctagattctaactcagcttggactgatctcaaacatgaagtctgacacttgcacccacagagcagctactaggtctgagaaccatatgctgtaacactgttgggattaccaaacttcgttgctgtactgtagtcatgggaaactgatgtatgcaaatgatgtgctataaaaaggatccgtcgcttgcaacaaaaacaatagtcatgcccttaatcatccttgcaatcacccagatcaacatggagaatttatgccaccactgaaatccagccatgccttcctttgaaacaaattaatcaattcttttaggccatttgaactatagcaagctccttatgctaaccaactcttaccaaataagatgatccacgagagattgcatgcttagttgccaagaatttttgcccatatgcaagtaaggcatctattatagtattctgaagagaaggccaaaagtagccatcatttttgcttcgaggcctcaaaattacgacattattcaggggggggggaagagaaatatctatgttagtaatcacgacgagtccatattataactgcaattgatcaatataattgtatacaaaatacaattgcatttatggtaatataagcaatagctgtatattaaatgcagtcacttccaaatcttatcttatcttatatagtggaagtaacaagctttcttacacgagaacacgccacatcatcaaaaacatatcaaccattgaataaagagtttagataaataatagccattggatcaaaaagttacatatgcactaaaaaatcaacaatttgataaacatatgggaatttctggaggtttctagtgcctcctcttagacacatggtacaaagagagagagggcaaagataatgaagaaaacaaaaaccaagaagcttatagtgatttctcatatagtacgatttagttaaatctatagttagctagaccaagggatactttgtaaataaattaactcatgctaagaccttctgtaactaatagatcttatacagaatcaaaagtagcgcaacgcgcgactacgtggcttgtaagcattaatgtagctttgcgcaaaaaaacgtgggaagttcagctagttcaagataaaaattgcttgtagtgaatacggtgtcgtaaattcatattaagtgctgtttttcccaatgtgtagataaagtgcttgaatttgtataccatattgtttgatctagttttctaaaaaaaaatgcttgttgcttctgcaatgcaacttgttttactgagtcattatgtgatcgtcaggattcatgtgaggatacaggagacatgaggatcagtgaagaaaagccatgcacagatcaggagttagatgctgatcagatgaatagttctagctttaatagttccagcgagtgtgagaatcaaacacctagcaatgatgaaatgactggatcagagtccaaatctgaggcagctcaaacagagggtggtggatcgagtgaagagaaggtcctgaagaagccagacaagatcctgccttgtcctcgttgcaacagcatggatacaaagttctgctactacaacaactacaacattaaccagccaagacatttttgcaagagttgtcagagatattggacggcaggtggaagcatgaggaacctccctgttggtgctggtaggcgcaagagtaagagctccactgcaaattaccgcagtatattaatcacgggcagcaatctagctgctcctgctggagatgctcccctctatcaactctctataaaaggagatcaaacagcaacggcagttaaatttgcacctgattccccactctgtaattccatggcctctgtgctgaaaattggagagcagagtaagaatgccaagcctacctcaacagcacaacccagaaatggagaaacccagacctgcccggcttcaggaacaacttcagatagtccccggaatgaaccagttaatggagcagttagtgggcatcaaaatggaattgttgggcatagtggagtccctcccatgcatcccataccatgcttccctggtcctccttttgtgtacccatggagtccagcatggaatggcattcctgccatggcaccaccggtatgcacagcaccagctgaaccagcaaattcttcagacaatggaagcacagctagtgttcagtggagcatgccaccagtgatgccggtaccaggatactttccggtaattccatcttcagtttggcccttcatttctccctggccaaatggtgcatggagctcgccatggattcaacctaattgcagcgtgtcagcttcatctcctacaagcactagtacatgttcagacaacggctctcctgtcctaggaaagcactccagggactccaaaccgcaaggagatgacaaggcagagaaaaacttgtggattccgaaaacgcttcggatcgatgatcctgacgaagctgcaaagagctcaatctggacaacccttggcattgaacctggtgaccgtagcatgttcagatcattccagtcgaaacctgaaagcagggagcagatatccggtgctgcacgagtcctgcaggcgaatccagcagctctatctcgatctcaatctttccaggagacaacgtgatgtatattgaagaaatcgtgtgacaattgtagaacatgttactactataatttaagcaagtgctacagcctgaaggatgattggcgatgtaggcgctgctgcaaacatggaggcagcgtgatctgtactattgaaacctgaagagtactattcttgacatttttctataatttgcctgtggagcatgcaccagtctactgggttcatgatcaggctgtcagcatatgttttgttgtacaataataataattgttaatagctttgcctaaaggatactgatagtattctgctgatccttcagctctgtgatcaatggcccatatatttacctgacaagtttcagaaaggaaaaaaaaaaagatctgctgcctgacaagaggttcaactccgaagaaatggttagcatttttgtactgcgtctgcgtgatgtttacttgttgctttctttggttctctaatgatcccttagttacctctatgatgacctgcattagttgaagtacctctgtccttttgttcggctgtgttgcctttatactagcatctgtgtagaatgtagaccgaagtctgaagctttcctttttgattcagtacgcttattgtggatgtgacaactgaccagttttcatttccattgattgctttgttactgaatgttaattgggcacccttgagcttagactagcatgcattcatcagtcatcagtgcactcaaaaagtttaacctacttgttggaaaacagagtactcctagtagaaaggaatctgatatgataacttgataattgtatatttaatcctgtgatatatactaactttgggggtggtgttaacacaactaacgcaagggaataacaaattaaatagtctatgatccatgtgtgggcaggcaggggatgcatcatatgcatgggtcaagctcactgttttcttggtggctgcagtcgcaagccgatgttaggcaggcagcaggtatgcatcctaacctagtcgcagaagcaagcatccattcatgattcattcaaagtatgctccaattaaactggttaaaagattgtaatagcattctgtaagtaggatacttaaaagtgtagtggtttgactgatgcttgctgctgccagagttgggcatagaaaacacatactagtacattcgatcgatgaatttttggtactaggctagtagctaagctgggctagaattaagaaaagagagggagagttttaagtggagtggagtacttggtagtagaaaaacgaatgacacgcggtagcctccttttggttggtagaggtggtgagctcgccacttgcgaccagatcgaccgaccgatcaaccgctttagttttttttatacatatatataaaagctaatttctctctcacacacggttatatatacgacgcatgagttaccacatgaaatgattttatcaatatatagctatgcttggtaattcaggttcatgcatatctgtacattaatatattcaaacggccgggtgttattcttcagtgaataaaacacaaatattaggaaatggtaaggtttcgaacccagatcggttaatctatcatctgtgaagctagctggaagacctttgttttttacagcttcaacttttgttttgttttttctctcttcccttagcatagactagtctggctgattgcgtcgtgtaacgaaatattttttttcttctaatatattgacgtgcaatattttgcgtgtttgtgaaaaaaaagctggaagacatttggacgcttctcactttagtgaataatgatctacattactaatcgtactagtagtgcattcatgcatgcgtgcgtcaaacaaaaattacatgcatgagggcgcacgcaaattaatttgcttggcgatcgagacggctatatatataattgtaaaatatacatatataaaatattctgatataaagatcgagaacgggatacatacaagtacacacagagatcgaccagctagatgaaaaacgaatatagtaattaatcccctctctctctatatatatatgtatggccacagaagtacacatgcattatctgtattataattaactagttcgtcgctgcaattgcattgtatagtatatacttgtactatcgtgctgcttggtcgctagaatgacgatcaatggatcgttcatatatatgcaggctcgtcgcagtgacaattgccatgcgtacgtgcagcattcatcatctgctagctcgatcgatcgcgtaattaaccggccggcacctgcaaagcatgcgttgcttgcatatcgatctgatccaacggacaaggggtacctaaatcttgctgacacaatacgtacgttgccatcgatcaatcaatcgacgaatcgctcaactcgatcaagacgacctcgtgacctgtcatatatacatagatgatgcaacgccttgttaattaattgactatagatcgattaattaattgttctgtaagtaagtaattaattgacagggtatatagctagttagcttagtgacgtgcattgtgatgacagaatcgaattagaggagttggagctagctagcgatcgatcagggctgagactgaccaggaagtagctctcgcccatctggagagaatggaggaggatgccgtactcgttggctggaagaagagcacccgttgaatgcaccagcatcacgtcctgcccaaacattgatctcagatcgatcggtccccttggcacctccgtcgccactccgttgatgaacaccgtcatcgtcgctgcacatatcatattcatccatcatttttctttcccaattcacattacctacatatctaatgtcacttcggacaaggactacttctcaattattgcaaaagtactactcctactacaactggagtgatatatacagtgtacatatatatgatcgatcgatcaataggtggctttacttgatgattaaccaataataagtagtactaccattgatcggctggccggtggttagaaattcagtgtcctagctagtatcagccctatgtctaaattatatgtatactcatgcatatctacaaatccatgacaaaaacatgcatgcatctgcataattaagtacatatattgtattgcgccattcacgcatgcaacaattcaactactagtattaattgcattatatatactccatatgcatataatgtagtacgattatatatgcatgcatggataaattggcagtattagtttatttagtatgcatgcatgaagcatatttgctactactaagataaaagaacaagacaaagctttgcccttaattctcttatttcagtgtagtacactagctagtactgcgtaattgatcgttcccaatctcaattaccgcaaaaatacaagtgcaaagtctcaaagacattcaacgcggaagatcaaaataaggacaaattaaaattaaggaagacaaaatatgagtttctggaagatgaaacgatcgatcaagtgtatatatgcagtaatatgatcgtatgtacatgtcccttaatactctagaagagatcgatcgaagcaaagagagactgaaaggaattttctttctctgaatttgtactaggagagcaagaattattagcaccaaacggaacaactaattcccctcatcactgcatctgcatgcgtaattaaacatgtatatatatgctaaaaactagctatatatgtgcatgtttagttagagagaaattaaaggcaaattaatcaaagcaccgacgaatggaaattggggggacatgcatcatgtatgaagggctcaccaggttgacacgagtagtagagctgctgctgctgatgctgaccggcggccgccgacgacgacgagccgccgccgccgtccatgtaccccatctgcctcgagatggcgaacaggtcgtcgccgccgcccccgtagtccacgtcccccatcatcatccccaccgacggcggcgaggacggccacgatgaggacgacgaggagctgtacccggcggcgccgtgcgcgaacatcccgagcgacgaagccggcgagccggcgtggccaggcgcgaggccaccggacgaagcagtcggaggagatcccgacgaggcggcggccgcggccgcctgcgcctgcgcctgcagctggcgctggcggcggcgggagcgcgagcggcggttctggaaccagtagaagacgttggcgtcgccgacggcgccgaagcgctcgagcagcttgcggatgcggacggtctcgtccttgggcgggttcaccatgccgctgttgaagatggactccaggatgagtatctgctccggcttcggcgtccaccgcgacctcaccggctcccccgccgccgccgccgcatgcctgtccgggctgtggccgccgtccatcgccactagctagctgccttgttcggtgtcgaacacctagagctcgctagctcgagagagatagagagataggtttggtcaattgatgtgtgcttaattcgcttaattggcttgctgcgagagagtgagatcgccctacttataggagaagaagcagctagtagcttagctaagctttgatagttgtgatgagtgagatggaatctaagtaaatttcactagtgatgagaatatgaatgaacgaatggcacacatgcaaggacgacactagtgctgctagagaatctttaccgccgctcttagtattatatttgcctccgaggctctccgatcaacttgtgttggttaaacatgcatgcattgctgtataaatttatatattattaacatgttctagcttgtcactctttactttttggatggaactgaaaatggtgcctgtcattttcaggagagtccatggaagtgacaattaatatgcatgagaagtgtgttgttgttaattattagttggagtacatgatgtactgtatatgtcattttcaggatagtcctccatatgggactataagaatatgaagagtgtgtgttgctgctaattattatttgttggaatacaaatatacttagttgaactccatatatatacacatgtaccatgaattgtgacttgtgagtatgaaagcaatgtatgcccttaatcatgcgtgtggctgcagagatatatttaggatgtgtgtgatgtgttgatttggctttggtatcggatatataattgaaggcacgtgtacattaatcggaatatccctagtatttggacctaagggatatgagtgagtccgtacatgtacggtgagtatttgttgactcgctagtttaaccacatcctttcaatttttgtgaaaaggtgcattttttgttctgaaatggagttgtggaacagtctgaaacccgcttcatgtcgctagttcattatgtgatagcactttagtccctccgctttctttttaggtgaaattgaaaccgtttgatggactctagcttcagaaaagatgaagctggagctgaagttttaccaatcagacataaatgaaaccgcccccagagtagtacttggtgatggagcggtgtttaaaacctgccgttgtctggtatgtatatcttatgtggcatgtgcaggcacatattgataaagatatgatatgtacaatgccttttttttctaagataatagaggttttattaagactcagtcaattacactaagatgatacaaccgcactgaatcctcccctggtctctgcatatgatgcatacagccaaatgaaccaaaacaccctttccaagcataaaagaacatgtagattaatgactatcaattatccgtaaactagatcgccacccatattcatatgtataaaatctcttgtgccacctgatccaactatcatgatgccaccataatagtattgaaatcccggtttatagaggatagccacgtagtcagcggataaacaatgtaataacatgtaaatgagaagacatcatcttgttatatataaaaaaacacaccaggtacaatggcgcttttgtgttttagtagcaggcagctagttagatcatccctgcttccgtgaggagagtgagggggagctacagacaatggcaaggcgaaagaagaaggagaagggagcgtggtggaaacaaaaagcggctaaggcacatgcatgtggccttggaacggggaacacatgtgccccacggtttggccccctgcattgaccctttctttcctctctccctcccctgccggccgccggcatctaccttaccccttacccttagctgcattgatctcgacgtccgggtttgcttcggtccgcgtgtgatggatcaggcgagcccggagaaatttctcctgcatatatatgctgccgctttaattttctcctgccagctcgatatatcgatcgatctcagcttggttgcttgctgctgctcatcatcggcacggcagagcatttgattgggccatggatcggttttgcttggctgtttgtgacccaagctaatctatagctgcaatatttctccatcagctgcatgactgccctgcggccgcgagcatcacctgccctgcccttggcgccttccgccggccggccgtcgtgtctgctttgcggtgcggtgaacagacagcctccactgcatatgctcctcgatcaaggaatcactccactccgatccccacttcatgtcttcatgcatgcatccatccatccatccatcagagacacacacacacaccatagctatagccgcctgcggcctagctacatccatcgtcttggcttgcttgctccctgacacctcctctcgacccttccttccttccattctttactctacttaattctttcatccatgtaatcggataccctgccctgcccatgtcgatcctcaccacgtacgtgtcttcaccaagacacctacataataatatgagtaattctacggttctcgaagaggtaccaaaaatttaatgtaaaatttggtatctcattgtacctcatagtacttaggtgtaaagaggtatcgaatttacaatagaaaaatggtacctcctcaagaacgataaaattgctctaataatatacttatcatatactatgaaaacgtacgatagatagatagatgcaccttaagcaagtgtcaacctaaaccatgaccattaaattaaatactaatatacacattgataggcagtctaaagttagcagctgctgcccgctgccacatcacatccatccggatcgatttcggcgctggacaaaccgtcagtggccggccgaaaaaaggaattcccatctccttcacctccagcttcttcagctactactcatgttaccaaaccgaactaaaaccaatcaggggaacctgcctaacacctccactttaatctgcctccctccctccagtccccagtccttgtttcttaattactgaaaactaacactgcaacttactgcttccgctcttcgtaaatatatacacaatataaacatttttaattcatggaaatctatgcatttccagccaatcatgtgcttaattataagagaaattcaaacaattcagaaattaaggtttgaccatcaagttaactaaaaggaaattgttttccccaatttaaaaactttgctaaataacatagaatattgtatttatgaatggagggagtattcatttactacatgcacagcttcattaggagatattttttttagaaacacaatacaatcgcatacgctcacaacgtactcacactgcactagtagttaaaaaggccacacatttcattttggatggtttaggccaaacttatgacaacttttgagaaaaaatgtagtgcaaatctcatatatagtggaaatctggaaactatcattggatcttaaaaatgaacgcataggatttgtccatgtcacccagagcccaaaaaaaattttactcatggttaaattcaggagttaaatttttactctgggtaatgtgggcaaatcttttacaagcaatagtgcaatagaaaatcaattagaacctgaagaagctgtccattttgatatccaatggtaatttttaggtttttactacatatgtagtttgcactacatattttcctcttttggtatgataatacattagaatttttttaataataaaaactatatgcaccttctgcttctactgttagacacagggtcaatatatatattggcatttgcatacatcgtttatacaataaaaatattgtgtgcacagaaacgttatgtcgctagcgccaacttgtttctttaaaaaaaaatctcttgagacgggctaataaatttagcaatatatcgtataccaggttcatccgtgcaaagaaacccacaatgtttttctaaaaagaaatcaagatgtgacatgcagtgccatatttaatgtctaataattgttgtatcgcaagaggctactctaatttctgatatattttgagcttgtcttcctggctagttgctgacagagagaaccgttacacatcacctctgcttttctgccgtgcaaaagcccgccacggttgctattaatcaactagctaggctttaatttgggcaaatgcatcgcaccatctctatacaatttgtcggcttaatatttaacaaactagcccaagaacccgctctgctagatttgacaatataacgaatgtttcttgaattatttagaatacgttcacagtacatgtacatcagttgtacccacccatgaatatgtcttggtaacacgagcttaatagattgatactcacaaaatacctattgagagtgtgatcgtcactaactgtataattatattgtctcgaggtccatcttgttccctgtcgttaccagctagctaaaaacagagcaagaggataacattgtttggaaattgcacttgcaggacatgcctatacatgtagagtaaaattggtcacagctattacaatcattgcccattttcgtaataaaatttgtgaacaaaaacagattgcaaacaccgttgcaaaaatgaaataaatatatatataatcaccgccctctctttttgtccattacaagagtgtgaaatgactggactgcctcatttattctaggaagagagcaataattctggcccatggtaggccgattttaacaaattagtctgtgttcttccccttctttctcaactcaagctcttccgttttcagtgtgcatgtttttcaaagtactaaacggtatatttttttcttttttacaaaagcattctattggaaagttgctttaaaaaaatcatattaatccattttaagttttttagctaatacttaattaatcttgctctaattgtttgctttgtttttcgtgtcaagagacaaggttggaaaccttacctcccgaacttagccttaagctgcaaggacattcctggtgaagagttttattttttggttttcaagaattccacacaatctaaagaggtttgaaatggtgaatgaaacaaacgtcttcaatgtacggtttcatttgctagcatttaaatattaaatggtgtgaaactatttggttacaataagttttttttttcgttttcaagattatgataaaatgatttagtcccaatgaagtttcattctattactaaggcataggtaagtgtgtaaaccgagtttcatctttcttctctctcttcataagtttcttaatatgttactcctccgtcccaaaatataatagtaacttgtaggttgctatattttcactagtacaataacgatttttccatgcggtcgaagagtttgcgaaaatccgattttttcgtgcggtgacacacccgcacgaggaaataaaaaatcgaaacaaaaaaaagaaaatcaaacgccaccctggaaccctaatccagccgccaccgctggcctgccgccatcgtccttgtggtcgccggtgacggatctagacgcccgaggctaggagaccgctgccgccaccaccgtcgtcaccgccctgcccgagacccgccgccgtcgtccctgcggtggtcggcgacggatccgccctccccacggtggctggcgacggatccgctccgcccgccaccaccttagccgatgccgccgccgctctcaccaatgccaccgccaccaccgccctagccgaggccgccgccgtcaccgggagtgggtagagggggagggggagatgggaggagtgggaggagagatgggaggatgagagggaaagggatagggagagagagtgggagtcagggtttacgttaccgccggtaaccgcacggttaccgggcttaccgcaggggtacggtaatagaaataccgcgataacctccttaaattcaaataaatttaaaaaataatttaaatttttgataaattttgtacggttttgtactgtttttctcggctaccgcagttactgtgcttaccgccggggcgctgtaaccccgggcccggcggtttgggaaaccttggtgggagtggccaagtgggaggatgggaggagattgagtggcgccgggagataaaagggtgggtgagctatttttgtgtgcgggtcactttataggtccgcacgcaaaaataagtctattttcacgtgcaaatctgttaagaggtcctcctatgaaaatttatttttctatacggtcattttaaagagccgcatgcgaaaatggagcatgatttttgcagacgcgaccatttacggtccgtctgcaatctaaagtgagttctgtacaggaaaatcgtttctgtactagtgtttggatggaggtggtattaatttagcctatgtggtattttatttaatgagattgaaattcttgtgaaacctgcattgggaatgatttaacctggcctagctagagaaatgcattccctctgtacttaaatatataaaattgttagattttattcaatctttggtgtgcactgggaatgaaaattttcagaataaaacgataatatctaacaaaatgatataattttttactttctctgttttttacgatacaatattacaactcttaataattgtttaactgtgacgtggtaccgaccaaaatcgctcgacgccacaagtgcataactgttggagtgttggacttgcgccttacatgaccgagatgaaataattcacgagtgcaggaggccggagcattaaaccacatgtgtgtgtacacttagctttaattgtcggtgtgttaggtaatggagtatcctttaagctgccacttgcattcttaatgaactttaggaggcatgatgatgcttaactttaatccaggataatattttggtggctagcggattaatgagtgtctcgtactaaacttaactgcacacatgcagtgtcacatcgtgtatatacacagttacgcacacactcctaatcctaaatattgcggtggaaaatgaccggtgcaagtatatcaaacaatgatctatctcgatcgtgtgcactgtgtatatagctagctaattattagggaaactattttaatcacttgaggagatatccactcgttgtttgcatgtcacttaaatggtcatgaaaaaattgaaaaaatttgagaagaagtattaccatgtgatatattactctacaaatatacaagttcaaatttaacttctatatctcgtaaaaaaacaattttgactatgagaatacgttaactagctatagtttaattttttttcgatgcgagatgtagaagttaaatttgaacttgcatgtttgtagagtgatatatcacatgttaatatattttcttaaatttttttgagtttttttataaccatttgagtaacattcaaacaatgagggggcatctcctcgagggatcaaaatccactcccctaataattatggtgtagctgagttgctggaacgaataatccgtactggcacacagtggcagatcaagaatttgatcacgttgggctttaggccctgtttggttcacatggactaaaatttagtccctgtcacatcggatgtttgaacgctaatttagagtattaaacatagagaaaccattgacagatagatagtgcctggaccttcttttatacctcaagggttaccacatgggcccaacaacctaacttagtggagaagtatgacaatcttttcattcaatgcatgtcttattccttgactcggaagccatatccacgagcgtcacagcatgggtcccatcaaatcacgctacctgacacgggggatgcccgtgtcgctcgccatttaacgggtgaagacttctgggctgatgttacatcagaaaacgggaaccttgctttgatcagagaggacggaccgactctggctgggatgagaggatgagaacctctcaccatcatgatttgatgggacatggcaggctgcacgccacctgatacacgcggtcagtgagcaggcacactaacccggtcccatccgtcattcgaccggtcacacaccggttaggcgtgcagcacatcacattaaatgcggcatggcacgcccgctcaatccgccttaaatgctgttaggtgggcgttggggctgcccacctaatcccgtacgcgtggcgtgctgtggagggggtcggggcagcccgacctccagccatggagggggcggccgaccctaccctgggcccgacccccttcaggagagtgccacgtgagtatagggggcagcctcctcatccattaagtcttcataccctcgggcgaggagggggcagctgccactccaccctaggcccgaccctcatcgagggagtgccacgtgggtatagggggcagcctcctcccttaagtcttaataccctcgggcgaggagagggcagccgccactccaccctaggcccgaccctcctcgagggagtgccacgtgggtttggggcggcctcctccctccaaacatgatatccctgggcctatatcaccgatacaactctatttaaattcgtagtactagaattaaaaaaacacaaatattaaaagatctaatatcaaataaatagaatagatgagagacttcaaacccaggccggctagcccaccatccagtggagctagccggaagacccctgagcgtttctcgtagaatatgtcacatctcatattagatttatttattttgggatatagtgaatatttaacaatacatattcaagtgagtttcattaggccttgtttagttcccaaaacaaagacttttcacccatcacatcgaatatttgaagacatgcatggagtattaaatgtgtaaaaaaaccaattacacagtttgcgtgtaaattgcgagacgaatcttttaagcctaattgcgccatgatttgacaatgtggtgctacaataaacatttgctaatgatggattaattaggtttaatgaatttgtcttatagtttcctggcggaatctgcaatttgttttgttattagaatacgtctaatactttaaatgtatgtctgtctgatgtgataaacaaaccctaatttttttccccaactaaacaaggccttatttggaagacgttgcaaacacagaatctgtcgtggtacagaaatctggatcaggagatggaagtagtagtccctctgtcccattttaagttttaactgtaactaactataagtttctgtatccaacgtttgacctttcgccttatttaaaaagtttatgaaagaactttaaaaattaagtcacgcataaagtactattcatattttatcatccaatagcaataaaaatagtaatcataaaaaataaataaataagacggatggtcaaacgttagcactgaaacccatagcagcgtttattatgggacagagggaatagaagtgtagaacagttggacagcaatgggtaacggtaaataggggttaattagttggcgacatatatgatgctgcagcctcaactaacagacgacagatatagattcccatggatggatagatggatggacagttccctgtacacacttgtgcagtagtagagttgatttgtgtaggaggtgatggcgcgaagacaacgggaagtcgcgggcggatcgatcagatggagctagtgataagcactggacaagcatgcttgctggatccaggatccatggatatggcaacgggccaacacagcacgagctcgctgtcgcgtccagatgtgcacagacgacgccacacccttgtatccataatgcgtgcgtgaccctgatctctctccggaccatggattttcaagccgttaacacaacggaaggcactagcgtgttcaggtaagttaggcagagcagaggacgctctcgtgtcgctcggccccagagtggcacggccagcgatcagcttgttgtacgggtaaatggtagaaacgttaaaaatgaaaaaaaaaaaatggatcagatgaagtcggtctgatcgatcggattgagcacgtcggtctaaccgtctcctgttgctagtccaatctactacaagtcatcaaaagcaccaccgaccgaactgatagcccgatacacatcggtctgaacgttttcgggtctcagaaaaacacaaattgaagagatcgtgctgagatatcttaccatgacctgcaacaaaacagcttgagtcaatctataataaattaaatgcgatggacaagccccaaagctggtacaccgcaccaaaagatgtgggccgcatagagtacaacgacagcccttctcagatagtcgaggagttcccggagcaaaccacgtggaatgtgggtgcatcttcctccccggataaggacacacgtctagcccaagaaaggatgatccacttgattcagccaactataccgtaaatacagaacatgtggttgttcctggatagactatactttggagctattctcgcaaaaagcaccgtgttagttttcggatcgtcaaccgaccacttccacaccccatgaacaagccacatccgaacatccctggctcaccgtctaggttctcgggtgttttagccctatcgtggttccgtggttatggtagcgaggaggcgtgtggaccttcccgctacgtggtaggttagtgcctttcccgggaagacgttggcccactgactgcacaatacgacacccttccttcggaacaaacaaaactggtcaaataagtttctccttggctaggatgctgacaactatggctctagacaacaagatctacattacgtatattgaggcggcacgatccgacaaactctacgggcatcgcctctccacctctctccccctctccctctccacgcgctacaatgataagttgtactacggattggacgagggggcttagtataacaaagatctagtgacaaggagcttgtggcttagatgaagcatggcggtgagcgaggatggggcaaggagctcaatgatagagtcgtgctagctgcgagctaattagatctgtctagatttgttgatctttctagtcattgtttgtggttataacgatgacaatataatccccagcgccacttcatcacgtcggctaccgtttcttcgtgtctctcctaaatccaagacatatgcgagatgatgtccttcccaaccaacgcggctcgctgccatggcttcacccacggatggtctcatcctgacaagacacccgtgctctctgaaggacacgaggagccttgtaagggaaaaaaaactcagttgaattggagccataggtctggtttagtttccaacttttcgatcacatcaaaacttttctacacgcacaaacttctaactttttcgtcacatcgttctaatttcaatcaaacattcaattttagcgtgaactaaacacacctataatccgatatggcgagctagagccacttgctacttcggtgcactaatgcactatggatagcctcaggatggatgcgttgaggagtaaatcaggcggaactagaggacgaaatgacaatatatagctagcaaggaagcaaggtagggaatcaaatcaaaccatcaatctcagtggaaatctcctagcagaagcggtctaatggcagaggaggaggtacgtacaacaccctggtggccagggcaccggttgctccccaaaaggccagcacactagctgctcctggtgacccagctgctactgaaaatttatttatttgttagcgagagagatctaacgccggaggtgagacaaggaacctgagggccgacttggtttttgttttgctccctgcgagacgacgcagcaagaaatgctcatcagtgtagagagcagagacaaaacaaggtgacccctcattgtttttgctagtgtacgcgcgtggcggggcatcctatccttcgtcctgtgcactgcttttgcgtgtgactatgaacagtctagacttgtactcattgataatgtacagcttatcatcatatctgcatgctcaggtagtcagcaaatgctgcttggcctaatccgtgttgtgcccatatgctatcagctggagtagctccccctttttggccattaaaacgtaggtacgtgagccctatatacctacttaggcctctttgaattggagaaaaaacataaaaattttggaggatttcaatcctatagaaaaatttcctatgaagccctttgaaacaaaggatcaaatcctatccaatcctttgaaattcctatggaatggacaatcctatagagatttttgaggaaatttagcaagagcttcaacctcttgataactttcctttgagtctatctctctcatccaattcctacgtttttcctgttgttcaatcaaacggttattcatgtgtttttcctacgttttgcaatcatctgttttacacttacattcctatcaaaatcctacgtttttcttattcctacgttttctcaatcttgcgattcaaaggggcccttactatctactagtactcactctatcctttaaaccatagtgcaaaaaaccggaccggtgagtaacccggacgatgcctcggttcaccggtccgacggtctgaccggtgaaccgccggttgaaccgcggctcaataagttattatatacaacatgtatatctctaaaacaaaacgaagcaaaggtgagatggttactcactctcaatgcgcagacccaggttcgaatccccatcccaacacccttttctatccattttgtcaaaaaaaaaaaaaacagccacgtgggcctgtagggcatggactgggccttaacgtggcccattaaactcctttgtccggtccaaccgactcctttgtccggtccaactgagccggtttaatggccggttaagtcaaaaaccgcccggttcagccggttcaatccgggtcgaatgcatgtccggtctttcagttgaaccaagccgtggagacctctggttccggtttttttgatcgaaccgtcggcccggtccggttttttccactatgctttaaatacaaaattcaacttatagagttttaaaatttattctaaaataaatcaatttctactaacttactacctaccaccaatctgcaaatcaaaaaaaattattaattcaatatcttttacctatccattaacaaatataatttcttcattaattaagggcattgtgatattttatttctctctttaaatttttcttgggaagttaggatttaagtgtttatgagacggagggggcacttcttttttttttgtggtagcaggtgtacaatcgatcattgttcctcagaaattcaatgcatgtttgtaagttaaacaatatagtgacaatggtacagacagacagagagacaacgtccagccgggtgtttggaacaaggatagatatgtggcaagcatgcaatgcattagctcacaagctgtccatgttattcctggaacgatcaaattcatgcatgcatatgcagcagcgctttacatctcatgaaaaagaagagagaaaagagagatgcttcagcatcagacagagagagacaggtttgtgagatgaacatactcctatatggagtagctagcttgccgtgagctagctaccgatcgaggccgatcgagatagatagatagctgtgtcgcggtgtcgcttggccgcttcatcatccactcctgacgccacgcacccatccatgtgctctgcttctctcttgccgtcggcgcggatacctatcgctgttaaacacttgcattgacatcgatcgatcttaattcgttggtttcctgcataattatattaaaagtgagcaaatgaagaacaagcttagctaggcagggtgcagttcagctgtgttgcagggccggaagttaagatctaaaagcaggaaaagaatggactgcttgtcttgtctgctttctcgctgcctgtgagcttgtgaccacagtccacaggtagcaagcggtaccgttcattctcgtcgtagaaaataataaaaaaatgtcagttttgatcggttgtcctacgtaaaggattagccgctattcaaaatttaaatttaaaaacataatattggagttgattttaagatatactcatcctatttttattagcatttaagttgctaaagatctatgcataaaaattatactcataaattattttttaataactaataaactatttcgtttataattgacccatagtcaaccgatgaacccttagacctccgttgaactagtacaattttaatcactagttttgatgaggatatcactcttttggatacacatgttactcctcaagttgttttgcaatgtccaatcagtagagctcacgcctgacaattaatttacaggtgagcctgttcctaagtacttctttatgtacttttgagaatagattgctatctaatgatttaataatggttagaaactatgaagaaaaccatagaacacttggagagaggttaggagatggataaggtcatcatggacgttcaagacaagatggaaatccaactcatataaagttcgagtccacttcgggctccaggagcagtccacgataaattcgttgcccatgttgcattcggactccgatttcgacgttctacatatgtatgtaaagctaacgaggccacatttccaatagatctagtcccatgttaaaactccatccaagtcaacggaatcttcgaaacaagaaagcgttcagaatctgtccgggtgttgcgtcaccatctttgggtccattgggccatgtatcgtgtcggagtctaataaggacgcattcagggctctaaggtgaccctagaatctatatattcagtagccgtcattgagttagggttgtgttttgcttaaattatttctgccttcgtagtttcgtcaatagatcagtttgtgaaaccccaactttgagttcttgaataatcattcatctacaattgattcacacacagggattagccttctcgatgagatcaatcgagtttcgccatggttgataataagaggagacgtggtgctgcaattgtagggttcggatcgtgtgtgtcaaattttcaccaaatcaatatttatcttcacctgatcaaagatcgggcatcccgttgttatcaagttttatgtttttaagaacccaataaaattatggcactttttcaaatgagcaattttacggtactttaggatgtaccattttttctattataaaatttagtacatcttggtatctaggtattaaatttttagtacctcctcaacaattgtaaatttgctcttttcaatatgatatacttataatggcataaatcaaatttaccttattgcgttggctttggtatgatttcttttcagccttcgatttggcagagtagcaaggagctggataagaaaggaacgaacagacggtgagaggggaaaaaaaagcactgaagcagaagcatggagcagaccgccaccggcagagggtagtaaggctaaagctatttagattaggctctcctctcctctcctcttcttctttcttggcatgtctccaaactgaggaacagcccgaggtccacaaccacctgcatgcgatgcgcacgacgtcgtttccttgttttgtttttcttcgattctctcacacactattagtattatagctagccctaggtctcatggagaattttttgttcttaattaagcaaaagcaaattctttacgagtatctgtcactcgcacgagtcgaatcgatctccccttgccaattattcgttcgacctcacctttacctgtttttgttttcagccgtcttgttatatactccctccgtttcaaaaatgtttgacaccgttaatttttagtacgtgtttgaccattcgtcttatttaaaaaaattaaataattatttattcttttcatatcatttgattcattgttaaatatactttcatgtacacatatagttttacatatttcataattttttaataagacaaacagtcaaacgtgtactaaaaagtcaatgttgtcaaacattttgaaacggagggagtatattctactactccctccatcccaaaatgtttgatgctgttgacttcttttaaaatgtttgaccgttcatcttattcaaaaaatttaagtaattattaattcttttcctattatttgatttattgttaaatatacttttatgtatacatatagttttacacatttcacaaaatttgttgaataagacaaatggtcaaatatgttaaaaaaagtcaacggcgttaaatatttagagaaggagggagtatatgtatgtatattgctcctcaagcatgcagcagctaatgcgtcggtaacacgacaattcaaaataaattattgtttgtggataaaaagtggtgccggggaaaagcataattgtcgggcagcgtggctcatctcatactagttactccctccttgcacaaatgtataatgttggttagttcgtttttgagctaaccaatgtcaaataaaaaaatatggagggagtactttgcaagtttggagtttcatcctgtgtctggccgtatgtgcgcgtggcgtagtcagcgggggcttaatttggccgatgtaattttcaactgcgggttggttaatttcaactttgtatacttggccatttttatttagccttgagggcaccggtaaaaatgttaaattatgtattgtacacttttaattatgtagccacttaattgaaacaggtcatcgatcaattaggtactgggcctcgaatagttaacgggcctgttttcgtctgaaactgggccgtgacgtcattccactccgggattaagtccacttggtgtcccttatttttccgtcgagtttaaatcgcattcctaaattgcaatacgagaaatcttgagccaccaacttataaaaccacgttgaattagatcccatagcaatatggatggctagtttcgttgatgtacatcctaatcaacaagaaaaaaaaaaaagaaatatgtgtgggcccacatgtaagtagccaccaccccaccttcttcttccaccatctcgtccatcaatctcagccttgtggtgagctccgagtgttggacctcagcctcgtgagcgagctggagcagcgcgacctggcaaccattgcaactaactcatctcatacgtacggagacaagcgaatgaaaacacgaacccgaaaatctgttgcaaggcctagcactgggccgtaagatgctacagtctgctgccgcaagccatttctccaatgggccaatacattgtacaatcccatgatgggccgaaattatgccaggattaggacgaaccgttcatgggcctttggtgggccgtcgtaacatgtcctattgggctgtggaaaggatttgcttcaaatccgtcggtgccccacatcagcaacactacaagctagtagctagcacaggttctgttattcgttttttacgaaacgcggtggtgattgcgtcggtggcacatgcatatgcatacgaattatcttctcttctcccacaaatcgtgcatacaaaggtccagctgctagctagcgatctgaccaaaaattcttccatattggtcttgctttttggatccacagatactagtagatactccagtatgagtatgggtcaaagattgaaacaaatctagcaatggcgtccaatttgtctgcagctggcacacgcacacgcacgagcccaaccgtccaaaccgcacaagtgacggtcaaacgcacgcacaaatccacgatattacgggcattatattgctttccaggacgcgcgcacgaccgcaccattctccaatccacgtacctacctgctgcttttacgactacatactttgggaatctcatgatacccatattcccggcagattactactctttcagactgtcacagtttcatacactttatacaatctgatgtaagtatataatagtaatatatactagtatactactcctactactgctaatttctgtcagtgtagcacgcagaattgcaaaccacaactatacaataatcctgcctgaaaacgcgacactcatttataggccggtcaccaactaacatcaatcctagcctatactactttattagttattaactgcatcagtgtgtgccacggataaaataacatcactcagatgtggagtactagagtcatcaggtagaaaattccagccccaggacaaaatgtgtagtactaacaaatataattaagggaaataaaattccgaacaatcttatcaaagatgacacgagcgtaccggtggccaacttccttttattgacctgtgccatatatgtgccggcccattcaggttcactcaagtcatatcaatatatatttgacaaattttgttaggtagcataaataatatatgggcaagttgattaacaaaatgacgacattatgatcaatttttatatgttccgactaaactaattatactatagcgcgatgcgtattgtggcgacaatgacgcactggtttgagagaaatgtcgtgtcaatgcctcaatgccacgtaacttcaatcaagcgtacaaccaacctaccaacacgatcacgcctataccttagtaattaaaaaatgtgatggagataatggcaaagagcaaacatgtcattgccacatgtatacactggtattactatataaagaaactaagtgtccatctgcaaaccagcagctataatatgatgcaaatcaagtgctttaattttactaatttatcttggagtatatatattgtattcctttttggaaattgcagttaaagggtcgtcatgtttaattatgggcagcttcaggcataggttgttttcagttaactattccatctttctaataagttgttgcggtagcatacatattgaaagatttgaacattgttgctatctgccaaaaaaaatatattgttgtaagctccccaatgatgcactgtttttgggcattataacacatatataatatttttcatacaaattgtggtacgtggaaaaatatagaccacacacgtacatatgcatgtttctgtagttagctgttgcgttcatctcaaagcataggtatggaattgtacgctgattgcaactgtattcatttaatttgagctactgttgtgatgacagaaaaagaaatctctgaatactgctgcccaattatgcgtttgatgcagacattatcgtccactttgtttaattccttcatccagaacattcattttgtagactattaatttgtcacgcgccgttttttagtaggacgcattatatatacatgcatacacgggacggattgaggcgtacaagtttggacacaggataatatcccttcttatgggtgacgttaagtatagtatatacatatttgtgtccagatcagccatatcatccacaaagttcgaggcgctgaaacatgaataaatttgcatttgtgtgaaacaagatatggcaaagaaatatcatcagtacatgcaaataaattaaaagcattttttgtaaggtccagaaacgtataatatctagctaatgttcagaaacttcagagatagtgtgacacacaacaaacagatatattagatgctcgctagcctgttacgcagatagaaacaaagtcgagtacagctcgatcgacacgacgcacattatattgtggcctagctaattaagctttgcaacgacacatgaatttgcatatagctagccggccaaggcagcgtttggatgtgatatataagaattaaagaaaaggtgtgtacaagagatcaatagcttggtgcgtcatggcgttagctaagctagcttagctagcttctcttgttggcaacgagttgcttcagtgtgttggtgaagcacgtagatcagctagcccatttgccaatttcttttcatactaattagcatctactacatatataatagtagcagtgttaataatgtccatgactacgacatgcacaccatgttgtgtatatggtaattagctatagaggatcaattaattgtttaaacagaaaggggttaattaattgatactacgagtttagcagagaattagggcggagacttatgcgtgtttgcagcgcgtcacatataatttgggcgcattatgcagctatcgagctgaatgtctgatcggacgagatgatctggaccgttggatttattcccacgcaacgtactggatctgatctgatctctatatgggacgatcaatcatatcgcttgaattattgctggtggctagctctcatatatatccatccaaaatattgaaagcgaactaatgttgtgttgatgtgagtgtagtaataattaagaaatttatatatatgtatttacagatgcaaaagtaattaatggttactagctagctaggtgatgagtccatagatcgaaatgcagctggctgaattaacaagctacgcgcaataattcttttttgaacagagaagggaagatggaattggaccatgcattattatcgttgaatatatactgtttgagtgtcagagtgtagcagtatgaactatacgtgagatgagcatgcaagcgagagtgaattatacatgcgtggatcaaggaggactaatacttctctgggagagaagtggcaaattaaaacccaacacgtgtgtcataatcatacacatgtgcatgcttagcttgcacatagccggcagatacgacgacgccactgcgagtccttcttagttagccctctttaatttggaacaaacgaaaaataaaagaattttaaaagatttaaatcttgtaaaaaaaattctacaagactctttgaaaaaaaaaagatcacatcactaaaattccttaaaaattcttatgttcaatgggaatttcggtggctttatatctaccgcgtacctctctcttctaaatattggtttttctatgctgcgttcgaacggtttcttatatagttttccttttatttattatacttaagaattcaatgtttaatgacatttgaattctgtgttttgagaatcctatgtttttatacatttcatcggtccttgcctgcatgcacacatcaaactagagctagctagctggccgcagcaaaaaccactacttgcatgatctcttgtgccacctgtatgcaggccgaccgtcagtaatattttttaggccatgtgataaatgttaaagaaaaccttatatttagaaaatactaattgtataatatatcagggctatatatatattgagatgggactctactaccagtgccattttctttatatgtattgcagccggtggccttctaaccatattaaaaaaatgctaccatatattaacctaatgcttctttcttttatgtcatgctaaaaaacaggaattatttgtaaccaataacaactagagccatgattaaaaaaaatactaacacctacatatgtagtggcaatcgggctaagtagaagaaaaatcgttgcaacaattcagttttttcttactaaatgaaaaaaaaggggaatccttgttataagtaaaaagtaagttcacaccatcatcatgaaataaaattatttgatctagtaatgattatcatctaatactgaaataatatatagctcgttttagctgattcagtaaaacagaaagagtgatttttttatagaataatagaatccagagattctatatatatcggaacatattgctctagatcgaaacacaacgttgctgctcgatcgatcgatcaccggcaggcatgaggctagctataggttttggttttctgtgtgctgcatatacgcatactgctagtctgctactagcctactattactgtaataaacggtctaaccgtctaaatcggtttgtttggatgcatatggatatccatcctacatacagtacagctaactgcaaaagacacatgcatgcatgtagatattttgttggtttggcgattcaacacaagctgcatgtctcaacggcgaacctttcaatcgtcgtcacgcttggaccaaattttggagctgtgtttttagtgcaattattgccatggttccttcgatgataaatgctactagtaccatgcactagctaccctccaaattcaattcaattcatccatgcatggtagtatatatatggctgtatatgtatgcaaaagagaatgttgtatatatattcggaattgatctgcttgtttatgatctgcttgccgatcgacatattccttttgcagtgtgtatatatatggatggccatgtatacagtaccgaataaatctattcaatgaaccaacatatacttattgatttgatgcagcagagcacactaaatgtatagtactactatacatatgcatgtacatttgcctgtgaaatgtgacaagcgtgcttggcatgtgacgttgcgtactagtagtaatataataaaataatccatctactataccactgtgtagaatgcaggtacgcatgcatgcaaatggctgcatgtttaactcagaattttttagaggagtaaaatcaacaaatgcggggaagatgccgtgacttgattgacacgtgttgagctctggcgtgcccgcgtactactactgtttattaattgcgtgtgccattccattctctggctaattaagctaaccttaattagactgccttaaaccgcagggttaaaatgaaaacagcgagtccgcgcgccatcggttttaatttgatgcatgacttgtttactttgttatcgaaattaatcttaagattaataaaatatggtaatgtcaaattttagcatgttatgttttggtggtatcaaatcttagtagcgttagacgcgtttagttaaataaattgatgccttttcaaattagtagtgcatcaaaaaatgtgcttttcttttgccatgtaattcttttacacgtttgcgaaaaaatagtagagcatcaaaaatatcaatttttgataaaactataaaattggtaagattatgtttagtttgttattctaccaaatgttagtaacaccactaaagtttgatacggtattaaaagtgacagtatatggtgacatggcccacgcgcgtatatatgtacagaaatccaatgcaaaatgtattagtacgactagtagttgtagtagacaataacagcagggtaaaagtaaattaggcctgagcacgcagttagggcacgtcggtcataatcacgcatgcatacttaatgatatccttaagaagagtccctgacgagccaaccactagttagtggagtagtatatatattaattgtgttagataaacaaatgggtacaaacatgcctctttgatcccatcagcgatgatgattagtcccggattaataatctacctatccaccgaagcaaattattgaccgtcatctcacttaaatttgtttaagcaagtacgattatcgaggttgatcgattgtcaactttttgttcctgtacgtccgtataagttatactactacctacttaaaaaaaatactccgtcccaaaatactacttttgagtttttttaaacgtttgaccattcatcttatttaaaagattaaaaaattattatttattttatttgagacttgttttattattaaaagtattttaagtgtgacttactatttttatatttgtattatttttaaataaaacgaatagtcaaacgttggaagtaaaaaattaaaacaacatctaatttaggacggatgtagtacgtgttaggccactcccaacacaagacactagatatggtttctataaactccatattatcaagaaactaatactagacactatctttcaatgcaaacatcaatgttacatacttaaatttaatgctacttatctcacatgatgtcttgcatgttgtttagaaactatgtctcaatgcaagacccggttttcttctctttccttatttatttacttgacacatcattctagatgggagcttatttaatgttatagacaccatcctagtcattgggttgaaactggccttagagcatgtacaatagcaagctataagccggctgcaaacttattttaagaagttaaatagggagagaggagcagcgggatacagatttgcagccagctgtagcacggactctaagacacagtgtgaatgacaggtgggaccagatattaatagtgtagtatgtaagtattgtatgaatgagctattagattggctatagatgaattagagctagtagttggctatactattaaacttgctcttagtaggatgaaagatgatgtggcaagtgaataaatgaggaaagagaagaaacctggtcttgcatgagacatgatttctacataatatccgagacatcatgtgagataagtagcattattaaatttaagtataaaaaatgatgtttgcattaaatatgtagtgtctagttaatgatgtagagtttatgaaaaccatgtatagtgtcttgggttgggactgtttctcttccagccaggccacaagcacaatagtactaatgtagaatcaatatactactacagtgtcatgcatgtggcatgtgcacgccgatgtattcgtgtcacgaggcggcgttgcatgcctatgccgggcatcgcgagaccgccgcgcggcgcggaacgcgcgttcggtggagactaattaattaccgccacgcaccggattaactatgggctggcatgcagttgaattaaccctgccaccccgtacgattttcacctaaccgatcgaacagcggttagtctagctattgcagctgatcgatgatggtaattattggtgcacaggcagcggcatgcgacacgtactacatactccatggaaaagttggatgatccatcgagtcggtgcgcatgcatggaccttaattacctttcggacacgatcgagattatttttgggttaatcagtcgagcctcgttacttgctcctgcatatatatagataatcaggtcgattaatgccatgtgttgaattactagtgctactactagtagataaagttaattagctattattggtagtaggccaaggggatgaattcactgatgatgagctagtcatgtctcatcgatcgaattcttttttgctactactagaagcatgcatgcagatgctatggagaaaattgcgaaaagttactggatgaagctagggttcttcgttttattcagacacaatacgcatgcgtgatgcttgaccttgaattactagctactagctactagctagttagttcccgtaggtcacctaaaaccattgactcgatgcacttaaaatgtacttactatgtcccaaaatataagcaattttagctataagtatagacaactatatatccagattcatagccaaaagttattatattttgggacgaaagtagtatacatcaagggtgtgtttagttatttgggtgtaaagtttttaaagtatacggacgcacattttaagtattaaacgtatactaatatcaaaacaaattatatattccggctgtaaactgcgagacgaatttattaaacctaattaacctgtcattagcaaatgtttactgtagcatcatattgttaaatcatggcgtaattaggctcaaaagattcgtctcgcaatttacatgtaaactgtacgattggtttttttctccatatttaatgccctatgcatgtgtctaaacatttgatgtgatgtttttggccaaattttttttatctaaacaagaaccaagatgcatgagatgtcttgggtcagactaggaattaatctggttaacatcagggtagagctgcttgcagtaccatctatcttaacataaatatctagacagtgtacatgttagtagtgtgttactataagatcaaagctggtcagaagtactggtacctaaactactatagtatgtatttttaaattaaaatagaaagatgagtctggctaattagaaacaaataataaatgtcactcgcgtggaattaattaaatgacgaaaggattaattgggtgtttgtactttaatttgttgatgagccagctttgcagcagccgtgacacagtgacactagagtagctactaggagcacggggagaatttactatttgccactctctcaaaataccagtgctcaaatgccactctcccaaattttcattcccaaataccacccgggcccacatgtcagcctcactcagtggcaaaaagaaggagaattgtgtggtgcgagtaaattcaacggatgagataagagggagctaggcgcacgcacggttggttgggtccgttgcaacggaagctatatacagggctagctaatcgattgattagttgatggacgcatcctaattatctcacctagctgcgtcatccatcgtccactcccgcgcgcgaagaagaaatgaaaaacaaaattaggccccgttaagttccaaaaacatcacatcgaatatttaaacacatgcatgaaacattaaatatagataaatgaaaaactaattggacagttagggaggaaatcgcgagacaaatcttttgagtctaattagtccataattagccataagtactacagtaacccacatatactaatgacggattaattagtctcaaaagattcgtctcgcagtttccatacaaattatgaaattatttttttcattcgtgtccgaaaaacctttccgacatctggtcaaacatccgatgtgatattcgaaaattttcttttcatgaactaaactagtccttaatccaagctactagcaaacctaacctaactgaatcgaattgaattgaagcttcttccgttccgtgtcagggttggtgggcctatctaagagagctcaagattttaaaaaaaaaacagccgcttgataaccagtttttaaatataaaaaaactgagttttctagtttctgactcctaatttattttctaaattctataactatagtttttgagaatctaaactaaaagccggccggttagctactgctcatccctaccaactccagctagctcctgatatctctcgtgtctccactctccacaccagattgatgcttgtaatcgtatatgccggtcgccaggttcaacgtaacgtacgtgtagctagcaacgccaggttcaatgtacgtccatggaatggatatatatatactgtactacatatgcctgcaaccagttgaagctacgttgaggctaccaccagagaaacatccagggttttttaactagcttcacaagatgatgggctagacgatctgggttcgaagcccctcaccccttataatttgatattagatacttttctaatattcattttttttaggctacaaccataaggtaattaattttccatgcttactcactgaatgaggtaatttcatttctggagatctatcgagcttatccagctacagcccaaccgacggcgatagctactgcctctgcttgaccacccctgttatcacctaaacaaaccaacacgttggagtgagctggaagcttgccgcctcctgtcctgtgcactacaatgcacttcactaccagagcacaagaggccggagggaggaaaatatataatctcctcgcatgcatgcgacatcaccacactttaattcttcctcccttcgcttttagccgaacctttaactgaccacatgacaagggtattacactctaacctactccctccgtcccaaaaaaaaagacaaaccatggttttcgtgcccaacgtttgaccgtccgtcttatttaaaaaaaatatgaaaaaaattaaaaagacaagtcacgcataaaaatattaattatgttttatcatatgacaataacgaaaatacgaattataaaaaaattttatataagacggacaatcaaagttggacacgaaaatccagagtttgcctttttttagaacggagggagtagatagctctgcgcttttaatttgcatccgtccaaatatacacacttcatgcatataactgaaattatactctgctgctacttcaagagatcaacatattctgatcccaactgcacctgtactgtattaatttgcggcaaaaagtactttaaactggaacttacggtagaatgactttcattgtgaaacggagggagtaattgccatctgaatcgagatagtgatcgatcatcatgctttttttttagaattattacacacacaacgcacgtacgcacgcaaacccgctgtaaccactaggctacaagccctttcgcgatcatcatgctttgggtgtgtttaatttacgtcaaaattggaagtttggttgaaattagaacgatgtgacggaaaagttgaaagtttatgtgtgtaggaaagttttgatgtgatgaaaaagttgaaagtttgaagaaatagtttgaaactaaacacggccttttggcgatgctagaaatgtgaagaattaatgtcacgtaaggattaatggccgttatcgctctgctcatatccttaggggacaaggctttttcatctgccatgtatatatatataatttacatatattccctgtttgtttctgccctttgggatcaagcaaattaaacgcacttccttttgtctggccggccggccggtgttcaagccaaaccacagaaagcatattgtgtactattaaattgcccgggctttggagtaaaacatttccagagaatattctgccgatcgattggattttaaatgtcacattgcaaattttaatacccctgcactgccccctgaaacttccatttcaattcatccgtgatctttgagcagctataggacttgtttttaatgaggggaggaaggtacagtgttgctgtcaaagaatgataaggaagacttctctgctgcttccaaactgataatgttgtggtggtggtgacagagactctctcatcaggtccaccaaaaaccaccattcatttgcagattattgtctcttcattgcagttgcaggcacaggcaggcagcttcttctggtactactagcaaattaggccacgataattgttgtctacaatcaccaattgtagatgcatgattactattcttaatttgtccatatatgttatagtttgtactagagtagactagtagtaaataaatcttcaattctgtttctgattaatattacaacatgcatatcgatccaccgttttctgaattgtggtgtggcaggaagctgctaggttgcatcatgctattggatggaaaatgtcggtactaatttagctattttactctaaacaatggacttttttctattttgtcgtagtactcaagattcatcaaaacacggaatatttctgttctaaacttctaattaacaagtggctcgtttggggagaaattacctacagctacaggtcattgcttatatgtgtcaaactgtgatagtgagttgccttagtcatcacaaaatttgttgagcgagctaatgtcacaaaattctcattacagtcttaaatatatgagataatgctctgtatgtaacaaattaagttctgactgctggagctgacaaggcaggaattcgttagccaaatgcatgacgaaagactgaattttttcctgcgtcatataacagaattgatgactgaattttccgtagagctcactgcatcgatctgaaaataaaaaaatcagataagaatgttttcgttcgtggatgacattttcctctagatttggtctttgcgtgctaaaaaatggacgcgtcgggtaatcaacagatatactaatctcctcaatgattagattagcttgcaattgattaattatttacttcacccggttatccttttcccatttggagatctacctagtgctacttgatgattaagtattaggcaacaacttgacgcgaatgcagtggccgtattctccactgttgaatatttcgggttttaaatgcgagctgatttccattttattgccaccattaattttcgtaattaatctagtggaaacaggagtactagtagctaacttggtatgataaaaacaaagaaattaattaaattaagtcgtcgactctgcagctaacgtttcagtcgccttctttctgtatagcaccacttgtagctgataggacagagctagctaggaagcttaattggtgagaaaacgatatgtagaatttggatttattaaccttgatatatcgatcgatgcctcatcataaagcttaatagtagcaggcggcagacagccacagcctttggtttggcttcatgcatacatctcccatcgcatattacactgaaaatctacagtggccattaattggccgttgaaattttctcgccgcgaacgaagataagcattggagacggaaatttagaaagggatgaagaaatcaacgcggaacaaagtaataaactcttttagttagaaaactaattaaaagagcagcatccatgttcgtttaatttggcaggcatgttcgagtgaagaatattctaaaaagaagccctttcaaagctagacctcctccactccaacccgatggatgaggaagtgtcaaacaatgggaaaaggagaatgggatcggattagtagattagattggtttagcgccaataatttaacctagttagtcgtatcaggatgagtagcatcattggcgcgttaattaattatagcaacaatattaggacatgaaggcaaaataattaccaggcagctattactgcagtagtaacaagtgagagatggatggaggaggcgatcgaggttaattagcaggaggcttatgcagcaagttggcttctccatcacggcactcgatgggagagaggaggtcgagtcctcttctatataagagccacctctcctccatttccttcttcctaaacccatctcgatccctacctagctaagctatttcattcacacctcgatcaatctcgatcgtctctctcgtctactactagtactagcttcttctcctccatttctgacctgagctagctcagaacagagagctgagaatcatcagctagctagctaggcgtctggggagagagcaggagccatgtcggagtcggaggtgtcggtgatcaaccagctggaggaggaggagactcggctggagctgccgccggggttccggttccaccccaccgacgaggaggtggtgacccactacctcacccgcaaggcccaggaccggagcttctcctgcgtcgtcatcgccgacgtgaacctcaacaactgcgagccatgggacctcccaagtaagtagtagtctctcgttcatggcggcctagcttcctcatcgtctgctagctattcgatccgattcgacgatggagctgcatgcatgtattgcaggcaaggcgaagatgggggagaaggagtggttcttcttctgccacaaggaccgcaagtacccgacggggatgaggacgaaccgggcgacggccagcgggtactggaaggccaccgggaaggacaaggagatcttccgcggccgcggcctcctcgtcggcatgaagaagacgctcgtcttctacatgggccgcgccccccgcggcgagaagaccccctgggtcatgcacgaataccgcctcgacggcaagcttccccccaacctcccccgctccgcaaaggtattctctactcgccgccggccatggcgatggctagctcacatgtcgcgtcgttcctctttctcttttattgaatactagtatatggttgcgtgcgcgcaggaggaatgggcggtttgccgggtgttcaacaaagacttggcggcaaagattgcccaaatgccgccgcctcccttcccgcgcaacgactccttcgacctcgacctcgacgacttcctccacctcgacgccgacctgccgccgctcatcgacgaccccttcgcctccacctccacgctcaagacggagccacctccgccggccaacctgatgcacaaccactacggctacttctccctcccggcgtcagcgaccaattataaccacagctccggcgccatggcggaccaggcgattcggaggttctgcaaggcggaggcgtcgacggcgtgcttctccggcgccgacgctgacgtggatccggtggtggacgagctgctctccttcccggactccatcacggactactcctacatatggaaggcctgaccagattaatttcgtggttaatttgccatatgatcgatcagattaatcctgtttaattagttggtttattaacttgattactgtcaaaggtttgggttaactaggagatgatgatgatggagtttgtggtgatgcgagagagagagagattaggtcgcgctgatctggtctgatcaaggtgtgcagagcagatggagcggactaattcattaattagcttaatcaaattagttatataggtttgtttgtcttaattctgtatgtatatagttatctgattggggataatacatagagattactagctagctagctagtttggtgattaggggggtgatgagctagctagagagagatatctcatcaaaattaaggtctcggttggttgattaatctgcagattatatattgccttgtgtgtgataggccatgtggcctctttctgtgtatgtgtgtgtgtggatggaaggagtaaattaactaaaccccttgtacatgtaccatcagttgtgctttacttacatgatcaattcaaccattgatcgattaaccaaaccgagatttgcatccatctgtcgcttaattcttttcgctcagtgcatgtgtgctgttgatccagaataagcagctgttgcgcagaaaaatatattgatggagaagagaattgaattaaatgggtttgtatgtatgttttgtttggaggcaatgattggaacggcaggcaggtccttgtcgtggaatccacttggggaattgaatggaatgggattgagcatgcatcaggtaaggtaaattaccaaggcatacccttaattgctcccttgcctcttaccttaaccggctgagagagtggagtaatccctccgtctctcaaaataataatctagaattttttttataaacacaacacaaacacagacgctcgtaacatacgtgcactcacccctgtaaattcatacacacaccctatccttatgaacacctccttcgaatgactggaccaacatatcaccacgggcgtcttgttgtcgacggatatgttgtctaccacagaaagaataattaacagtaaatacgagcaaccgtgtcaagtataaaacttgaacctggatggattgattccatcatatcataagaacttaactagttaagttacgttcactttgcctaatatacctatttatacttgataatatttttttgttataatttaatttattttaggacggataatttattttaggacggatggagtataacaagtctattgtgacgatgaatccaagtccaagatttggaggggtttttttttaacaagcggcttgtgaatttgcttgtgggcgtgcggtgttgcatgcgatgcgatgcgcctcgctgtcgctaatatctggatggatggatggatggatggatggatggctttgccttgctttccattcgacgcaacaaacacaattaaaggctagttgcatttggcacaacacaacacaaggagaggctgaccgggttttgcgctcggccgcctcgcttcacttctcacctcgcctattgtcatccaaattaaaccccaacaaaatacactgcacttgttaatttgcgagtagctaatctgaagaaaaataaaagaacggaagtcaggagatcaggatacgtaaaactttagctggtcgcccgggactgtgtttttttaaaaaaaaaacacgaacgcgcaaaaggattgcacgtcaatagagtttttattacacaacgcaatcagccagatcggttctggagctctgtgttttcatgtgcttggccttgtacatatgtgcaattggactaactgcctgccggtcagtaacattctactgctggatttttaattactctcctcactctaaaataagtgtagttttgcactgttcatgtttaagtttgaccgctcgtcttatctagatatgaggttatctacatatattgttttaggagtggtcacaggttaatttttttttgatggaaggagtactctgcactagaagctagaatatgaatgtgcgccaggtgcatgcattggcgcttccacgttagttgctttcagatggatgatcatccatgatcatatacatacatcgatcgatcatcatcaatggggcccggccggcctgcatgcatgggagaaatctagctagctggctagcttaattagcttactcctaatcctagctagctagctactcatcacgagttggatttcgtcaggtctacctcgtgattatacaatgataatctgcatcatatcatgcatgtggggtacatcatataggagtagtatgtactagtaatatacggcatcgatcgatcgactttcgttgtgcttagatccaaagtgtgtatccaaacttcagtccttttctattatatcaacctatcatatatacataacttttcagtcacatcatctctaattttaactaaaatccaaactttgagctgaacacagccttctttgattactcaatagtgacaacctttttgtcgtcgttgacagcatttaaattcccgcactactgttcgtacgtacgaaggcatgcatatcaatcgatccatccatcattctggaagaatcaatgcatatatatcatcattcgatcgatcgatcccatgcatacatcacaaatctttatatatgatcatgcatatgcatgtctatctaggctaacggctgcagtagtagtacgattgttgattgatcatcacaaggggaccaatctatacatatgtacatttatcggaacaattatcaaagagctagttactataggatgtgtgccacgatttgagttggcagctgatatatactgatagtactcctacttaaaatgccacgcatgcagctacagcccatccttttgttcaagatacaatgtgcttaattactctgtctcaaaatataaggatttttaggttgacagggttattaagaaaatacgtgtgaatgattaaagaatgattaaagaaagtttatcattggttgagaaaagaaaacatgtgaagtagaatggttgtgattagttaagagaaggtatgtagagaaatactagctttattttagcacaaggtactatgttagaaataactatatattttgagacaatataatgtacttaaaaatagctatattttgatacagacgtagtagtatgcatggcaaattgttctaattaatcacttaggggatgatgtacactcacttttgcacccatcaaatggttaaaaaaatgaaataataaaaaatgacatatcactataagatatatatgtcacatcacaaacaaataagtttaaatttgaccattctagtttaaataaaaagaacaaactaaacctctaaaaatattaatttttagtaatttgtgtaagttgaatttaaacttgcctgtggagtttctaaacttttttttaacttcaaaagttatttagggaatgaaaaaaaatcacaatactggtattattgcacaagtgcagcaagacaacaagaccagttgcagtctagctgccatgcatgattactagatagcttggtccgtcctctcagatgctacaattttgcatgtgtgtcgacggctacgccttcatatatggctatgagcctgacatgactcgctaacgaccacaccaaattcgccaaacttatcacaagacaagagcatatgccttacatatgttatgtcacgtttcagtatcgctccatgtcgcgctgaaatttcagagctatatagcacaacgtttattaattactcctagttgatgtatgatcgaccgacatccatgcgtatgcatactctctccgtactcataaagaaaatcatttaggataatgtttaagtcaaaccttgggaatataaatcatgaataactctcaaattgttaagtttaaaaatgtaaaaattatatgtatagatttgtcttgaaaaatactttcataaaagtgtgtgtgtatatatatatatatcacttttcaataaatatttttaataagaagtcaaagttgtgttttagagaccgtgtcgttgttctaaatgacttcatttacgagtatggagggagtatatacagatgaatatgaacgtagtacgaaatagcacgacccactgacccaaacctagctagcttgtaattaactcctcctaaatcacaatggtttttaatcaggttttcagctatttaagttactcatgtcataagtaagtaatactagctactagataattaagtttgcgtattgggcaatttgcagacagctaagagttgatgtcttgaagcagaggactctcgatcccgttaatctcggtactaggtatgtatctactataacaactcatacatgataacagtaatactacttaaacacgttaatttgattcgcaatctagtagtacttgttattttttcctgttgcattgtttgatttggctaaccgatcgatatatacggaatactagtacgtaccagtctcgtacaaatatacctgtagatcgatcgatccgtatatttatcccaggacaggagggagaaattaaaggggaaaaagaaacgcgcgtgctcccaattaatcgcgtaataaacacgagatcgatcgatgcatgatgatcagggtgtaatagtatcttccaggttaatctacgcgtttcttctctattccagctgaggctaatgatgaatgaattggaggagtaagctaagtgtcaattagtaatattcctgggatatttatgtctgtccgtaggcaaactgtaccccagtacaagctatagatcgatactgctcttttgatcgtagtacttaattaattacctgtaatccttgtccgagaagacaaatccatccaacaacgactttactttgatgttgctttaatttcgagattcttaataatgtgtaatataaatcttcaatgatacgaatttcctccgatatatagtatcctctcgttctagtctagaggccacaaacgcacaatttgttaattacgtggttagtgctgaattcaaaagtttaaggcttaaggttttagaccatctaatcagatcacacataaaatataataaaacaaagtactatgaatgtaaccagagaggtaggtgtgtgtgtaaaaaataaatcaaacttatttgttactactcgatcgaaagacttgtggttttgattagccttgatgtaattttcacgctgtcgtcagcgtagcaacggttttaatttgacgaagagggctaaacgagtagggtacatatatactacaggcagcaaaacgcatggaggattttggtagctaggcgacggcacgggaaagttgaagcctggacgtatcgctcatgggccagccaggcccaggcgtgtcgacgtgtccaggcctaaaaccacaaaccacgtggagcccagggtcccacgtgtcaccacttattggtcgttgttgtctcgaagaaaaaaattgcagtgatcgatgtggacgccatctggacgcatgcatgcgtagtatataattgcatatgaatgcctccatctccatctgtatatatcggattaatagaagacgacgacgacatcgagggaatgtacgtactacatacggatagggatctgtcgtctgtgtggagccccgtcattcccatactctagaacggaagattcatctcagtcaattatttttctttttagtaataaaaatgtattacatcacatcggtcctctgtcatacggccaattagttcttactaaaataaattaaaagagtggtaggataaattcctagttacccttaagaaataaaaaaaataacatgctaaaagaaccacacatattttaataattaagccaatatatgttacatcatccataatgaaataaaattctcttggcaactgattccaacagtgtggtgtcatatagttaaataattaattagtcctcgtaatatataatgctgaaaactttatggtataacttgtagccgtcatacacggggaactaggatatttgcagaaacttatgtgaaacaactcccttatatatgtatccatctgcccaataatgtgggagattaaattgatcaacattaattgaaagcagagcagttgcttggttaacaaaaaaggagctgagatagatagatcagataggtgtgagttgtacagtactccacatttgcaggaccgcaagcgcaagtaccatgttggtgatgtactagctccatcgatcatactgcaggtacattccatgatctttttgcaatcaatgcagggctagcaaaaagtgcaagataggaaaagtgcaaagcatatatctatatctccaagatatttctagtttcaagcttattgtacactttactaggaattcaatcaccaaacacacacatgctagctattatatcttggcttccatggaacatctaactaaccataaagcatgcattcttcacatgccttattacattgtaccaatctcatttttatatgatgacctggatagctaactagcttgcacatcaggaccaaccatttatttatttatatttattagggaagatcgtatatagtggacaaagcctttactatgtattagagtataccccaagtccatgtactgctagtatttgtccttcaaacctacgtactattgcttatctacggcatgcttcactcacctttattcctggcttttttaaaaaaaatttgccaggactaccaatttagctagctcatgttttcccattttcagataatactgtagttaatatacaggttatggtacattagttggagaattatgtgaacaaactgatcgatcctcagctaccgacctgatatatgtcgtccagtaattttccatgctgtttggtttgcatttttgtcactgtcggccggtttaattgggagaaagaagcctacctagtgaattgatatttttgtccatgtaccgatgagaattgaatgacggctaatttcagttctcgagtcctagtcaaatgctgctcaagtaaaagatcttgaaagcaattgacgagggcttctgaaaagaaagaaagaaaagatcaagtgcacttgtgaaaagtactcgctagctagctaagctagtggctcatgagctaaatactgatattttttcgcaattactactcgtagttctctattgactgcattccccagcgtatttaaacagagtttcagagatctgaaatgctactgcttcatcattaattggcagtatattgggagaagaaacatgtgccgttttgctgtgccacgtcagctgttttggcttggtatagtatccattccatccacatgttccattgccaaatcaaatgggaatcaaaaattaaattaataaatgatttgtttctttccccgagctgtagctagcagccatgcatgtatgcatattatgaggataaatattcccagtcctatgatatgatccaatcctgataaacagtccaggtgcatgggatctctgatgatgcatgattcatcatcagtcatccaaagagttggggggttgatcgatcgatcgatcgatgtgttgcaggcatgaatgccacgtgtgatgcttcttgagtgtgccacttgggcacttcgatccctgacagctccctttcgtggccatccggttaacaggtggctcacatttgggacgttgcagataacatcagcagcagtagtattcgagagtttgacaagcaaaggttttaatttttctgaatttgttttttctctatccaaaagcaggcgtgcagtgttcttctgtaaacacgggcaagcaaagcatactggatgtttccaatattttttttaaggcagttgtttgcttctgtgctgtgctattagagtgcgttgctgtgataaatccctttcgattacgaagtgttttgatccaggagtttaagattagccagacacagatgcaatgggttttgatgggtgcctggcttgagagaggtgttcagttcagccaaggcactcaaaattttacttacagaaatggacaacaccaacctttcccagtttccggttcccattaattcaaacaaaaagaatatgcatgcggaggatcgaatatccttgacacaagtcaagaactgatgattatttataagtagtgtgattaaatcaagttgcagtactagtttttaggtaattaaggagatagatataaaattgttggaggtgcaagttcaatcaacagcgaaagaacaatttgtatgtggaagcagcaccagttttagtagcagcatatatataaagctgctgcagttgaggaagacgcatgatatataagtgcaggccagacagaagattacaagagaaggctttcctttggagatagatctatcttgctttattagtttagtactgtggagtagtgctagactttgtataatacagttcgcacttgtgaaaccggatatcgggatatgatcgatatgcagtgacggtgatgcatgcatacatatgggccggttagtagggtcagtgatagatatatatgcaaggatttggatttggtggtggctgcaacgcggagatgatgcgtgcagtgcgtccagaaccggaatattggatcgatgatgatgatgatgatgccaaattgccaatgccacccgtatgcagatagatggatattatggatcatggataaaggagacgtactagtattaatttggagtcaaaagagtgagcaatctccatgcggattgcagtgcagcagctagctagctatttgcgttgaatggaatcattttaagtaagcgtaaagtgagcttcaattcattagctatttgctcgtcctgtctgtttgtctctctgttgaagtatgtactgatactggatattgtagttgtaaaggaggctaggctagctaggtatggaacgagaaatactccacatgagagatcaagggtggccatgcatcactgccggtgtctggtctagcagaaagcaatcgagatcaatgtatctctttcgatcttagcttgatcgatgttcagttcggttgggtggtgagccgctcaaaagtatttctgcctgcctgattgataaaagcagtcgacgcaagaaacaaatcgcaagtagaaaagaaagagagagagagagaggaggaattaggccaaggaatattaattgggcagaccaataatacaccataattagattaggttagatggaacaagaatcatttcttcatcgtcgtcgtgcagacggactgcaaagaaaatactgtataaaaagaagaaagtggcaacagggtaataaggcctattttgaggaagcccaaatagtacgaggcccagctcatctcgttggactgaagcccaagaaagcaagagagacgaggcgaggcgggggcctgcaggcgaaggcgaggcccaagcatcaggaggaggccactttgggcattgaggtcaggcccaaagacgatgaactcgctctccgagagcttcgtgctgtggtcgtcccgcacggacccggagccacagatgagagagtagacatacggttgttgggcaccggcgtagtataaactcatcagcagtagtacgtagtgcctagagatggcaatggggcccattcaccgtttccacgcggtgaattcacctattaggtgacggggataattaatatctattcaccaaggggaataaaatggttaaaaacctctcaccatcggggatgacaggcccctaacccgactgactgtactgtaccatggctttttagatgttttggtccataatactaaagcccatttaacaggcatatctatatctatattaatataaaaaggaggagttgcccccctccaatgctactggccaaatcattcggattaatctgaaccatccatccgcgcgcaacttatttccaccatacgatttcgcacccgaggattgcacaccgattggccgaagacatcgctcatccgtcctcatccacccgctactgcgaagacatcgctcctcgactcctcctcactcgctcctcttactccccgctgccaccgctcctccgcggccacgccggagccactgccgggtccttttcttccccaccgccgggtcctgcttcttccccatccccaccgacgcggccggcctcttcgctcgcgcctcctcctccccgctgccgccgctccgccgcatcctagacggagctctgccggagctccgccggactcttactcggagccgccgccggagcaggcctcggcccctcatcaagtaagttccttaaatcctgtctctttccctaatccctaatcttctccgtacgaacacgatctgaaaacaagtgaccataagtttccttttttgttgaagtttgatatgtttatatgcgctcagacctcaatcgcgatctccctcgctcaatgcaaagcatcggacttcagcgatcaacgcttgattgccaaatggtctgatccggccgctccgctgccaaggccaccaccccgagatcgcgtggatctggctgctccgccgccgaggccttcaaccctgagcccttctgccatgagtccgcagcaggctccattgttgtgttcaccgcccgggcccctcaccgccagatcgcagtccactccaccgtgtagtcgctgcactgtgccccttcgcagctttgctgccgaggccaacgcccaggttgctagaccaccaccttcttcaacaccatattgtggcccttgacttctgcctgattgccgtcacatagacgttcatcaaccctaggtatttaccctaacaatctcttggtttagtgtcaattttgattgcaaatcttctacaaatttgccacgatgttgctcataattgctgtcacccacaggtggccatggtaccacgatgctgcggtgactgctgatacgattcctgttatgtcatgtttgatgctgaatcacgaggattctccaagagttggaagctatcaaacagcaccaggcagtcaagttgtacagatggtgaaaagtatggagaagctgcagtcaagttgcttgctgctacattaggagtaacaagtgatttttcatctgaagaccaatccagaaatattgggacaatctgactgaataactgctaattataaccaatgttttgctctaagtgttattggatgttttcattactggtacaggttgtttatataatctatgtgagttttctctaggtgatttctttgtatttctttcaaacttgatattttcctttactgtttaatattgcttgccactaatcatgatgtgaaaaataattgaggcaaagaatcatgcctttctgctatgcaaaaatgtaagcctttattctgcgcaagggcgcaagcatggttcatgcataatggtcaagagccgaagagctagaaaatataatatgcagctagctaatttgttattgtcagctgtatttgagtagtacttaattttgttttctaatgcatgaattgcaggatcaatgggtgcttgctgataaaagaatgcatataaataacaattggtggaggcggataaggaggctggtcaagtcagcctcctgcaattactagtgaacatgcacgtgcaaggcacgttttcgtaatatatattattgcaaataaaaacatattaaattgccagtttatttccactctccattgaatgatagttacaaaataactttcccttcttaaagaaaatgttattatagaacaatgccatcgccttagcaatcagcaagcagcaaattagtatctccatgaccctattgccaacatgtgagacccctagttagatttgtgaactaaaaacacctcattactgtaacaacaggaatgtatctctcatggcaacataatctctagtactaacaaatagaacatacaaagattaaatctattaaccatttgatcaaactggatgatgtaggatttctttcataaacatcacaaggaaaataaaattggatttgatccttatgggctttcaccttgtcaaatagcagtgtgcattaaaagtatcttattgttgctgctagcaaatcctgatgcacactccatttcttgagaatgtcagaaatatatgcaacttgatttactaaacaagcaaataattatgggtttgcaccttgtcaaattcaatatctcttcatcagctttgtaactcagcaaataaaatcagaaagtgtagttcttaccaaacattcccttttaagaaaataatcgacttggcttttatgaaccctcgaataaattaccagagacttgaattttaatttaagatatataaccagagcccagaggcaacttttctcaaccatgtgaataataattctcagtccaggttaaggaccagatgaataataggttgggggtttgttgaaattttgtataggtgagaaggcatattagaatagagctttagacatattcccaagtcccaacattcaattaagtgagtgtgcagagagaagttcacaggaaacataagacgcagactacttagtagtgctatgagtcaatgataaattactttactaagaatataatattgacataatcaaacttatatcagtttaaaggcatcaactttccaggtaatcaatgagcatcaagaataccttaacaacaggatgttatacacctgtactaatctggagtagtatggtcaatatgcctaaaaatgatccaatgagcatactaaaattatactattttttttgcttcaagcaagaccagtgaaaaaaaaagtcagtgcagacatgtaaatgaacatatctagaggtgcagtgtggaggcggatgatggcggacttgaggtgcggaggaactattattaggagatactaaatcaagttataacatatatactcagaatacgatagaaccttacgaacattttgttgagcagttcatgagcagaaaaaatggttactttgagtaaaatgtcttgtaccagtttagttcaacaaaagcagcaagctaagatttcccagcaaactcacgtgtatagctaaaaagatttggaacaaacatacctatatggaatcgatcaatcgctcaagcttcaatgcttaaaataagcattgagtgtaggtaagagaataagtagctaagaattatagaggctggatttagatgaatcatatctccgaagcgcaaatgcctgccagattccttatgaaccacaaggtaaccaatacaaaagcaaactggaaaaaatatagcgaaacataaaattggggctaaagtgctgcactgtcagtgtctattgctattccatatggcatcctgcaggtattgaacaaattgggcaatttctcaaacttgggaagcacacataagagagcagattaatatgctttttagtgcatgtacaattcatacatcagaagttaaacaccactatatttatcaatgtattcttgagaagttaaataccatttcttttgtatggaatcccaacttcgcctaagcatttgcagctagaagtgctcatctcatccctttcttatgtggtctttctcaaaaaaaaaaagaagaagaaaaactcaccagagatggttgcagtagcgattaactctatgaactcatgtcatatcttaccagcaagctcattttgccacatcattcctcagagctccctttggtgcgtctgcttgttgccctccaaatcttgtggctagaggtgctgccatcccaagtaggttgcctcctcttgcatgcaaagaatttttttttaaaaaagggtctattaagaactcgttgaccaaagagtaatgcatataaaaaaaatctatattttaattatactgatagcactcattgtgccaccagttaaagaacacagaaagtaagtgggagaatctctaaatctgtgatgttgaacttgatcatcacataattctcttatatttatactgccaattagattctccttgactgtccaataggatgagactgccttcctaatccaaagcacgccaatatactcgtgaattgacagaggagttatcttggccgactctatcacttgctatggtgtcattcgagggcaccggcctcattggggtgcccggactggcagcagtggtgtcaggtgttagagacctaggggcatggaagtgaggaatcatgtgcatatatgtaaatcgaaagcaatatcattttaatgacaatgtgagaataaaaataaaataaatagaagatctagattatttgacaaagtagagatgattgttctttccttaacaaccttgttgtaggttgtcttcagtagcgaataatcattccgaagctgcattgttttaaagctaaacatgttaagcagagacaattgaaaagcataagaagtcctaatgctttcaattacaaaaaatatcgttgatcatggactgaacatacaggaagcaaaacacattctataaaacccaaaaattgtcgcaaatgaaaaggataactgattcaaagacaaagcagtaactctttttgaaagttgggttgacatgaatctatattgaagaactgattgcccatgggcgcatagtattgtctaagtgaaggcctttatagttttacattgcctaggtgaagcagactctgaattttaactaagttgctaaattcaatttgatctcaggctacaaatcgcaaaaactctcattgactttcagcattcaaatcataaaaactctaattgatttcagcaattcgagtttttaattgtttcaatcaatctttggatcttgatggtgctgatcatggaggcacagctagcagaccatggttgtaactaacacatatgcttgactgtactgattaatcaatgagagttttttggttgaactaatgaaatttctactgtagtcgagagaaatgacagctaaaagaacaaagtgaaatgaagaacgggctgctgctcaccgagtcgaggaggatgttagatgccttgaagttgctagatgaccagcgggtgagtgtagtggaggaagtcaagccccttcgccgtgccgcgggcggtctgaatcatccttatccatggcatgggaccatcgagacctgcagaccattacagcgcagatcagcttccccaagtctttctagaattgacacagaggtggcggcaacgaactggtggctagggtgaagcaatcatcaatttctgttggtgaaccttactgtttgtgtagtgctttagctgaaaccatctgaaggtggtcatgaagtcctttcaaatgatcggtgctcattttgtgaatttcatgattgcttcacaagcatgaacatacactttcccttcaataataattcttttgagtgacaagagatgaactgaaagtcgtgcattcatacagaatcatcaacagaaattgaaaacatataagcatttaggcttccattcaatcatttcgcaatacaactacgtagagtactaaattaggtaaagcattgcacacggttacctacccattgaatcatttcatcgagcagtaggggagcatgggcacaaagcaatgtacctaacagctgtcttcctcaatgctgccacgtgctccggcctcatcttcatgcttttagtggtggtgactccggcgctggcttcctgcttttagtggtggcggcttggaggctgcagatgacggcaacagaggcagggtcgtgagctaaattctaggggttaggccgcagtagcggagaggaggacgatggcggagtagagaaggacaacgacagcgcgaggaccctcccacagatcgaagcctcacctcgtgcagtcgtagaagtctcggtctccggcggatgcaaggggattgagggctggcgcccggcagcggtgatggcgtgcgaacatgaggctaggtggggaggcatggatgcgaggttgagtgcactcggcggattggagtgcgaccgacggcagtgggtgaggcgaggggcgggtagaacgtggggtggagtgcggccggtggcgtgggtgaaccggcggtttggaccgcggcgaagctgggggtgcggtatgagggattgaggggggcgtcggggagaaggtttggcgaggcaaggcgcggcagcgagggcgctggtccggcagtggagtgcggcgacggcgtcgggcatcggcggtggagcattagctgatcggcagcgtcgggtgagttcgagacagaggagggcagaggcagcatcgggggattggggaccgcggcgatgggcgatgggcgagggggtgcgtgagaatattcgcaagagaaggggcgcgtgagtgtggcggcaccggcggagcagatcgtggcgatgagcgaggggcaagggcgtaccggcggcggtagcggggatttgggcggagccgcggagcgaggaggagtgaggaggcggagggattcgagcggcggagtcatcgcgcgggcggaaagcgcggtggagaggaatcaggtgggattggtgatgatgatttcctacagcgaggaggataggggatagcgatggacggatgagattagatgagatggcggatggacgaatgagatgagatggatgatttgtccggtaggattgctagaggtgaactcctttttatattagtatagatgtcactggtaatatgctttcctatagctgatcttttccctcttcggtcatgttctgttctgcttaccacacctctcctccacccaaaaaaaaaaggtatggaacatcatcatgtagaaactaaaatttaagttgactcaaattaagtagaaaacatgctagaaagaagtatccctccctcactgctgacaaaaggaatgagggcttcaaaagaattgagagtacaggtagcggtcctagcggaagaaaggaagcatatggagcaatgaattggtctgcctctactactattagaggtaatctgaaaatgatttataatctcatttggatacagttatcataaatatgtaactcataaactcccagtggtgcagtataaatttttttatatgaattttgaatagcaactagatatgacacccatgcacattacatttacagagagcatatgacatgcttgcaatgatcaaacttccgaagaaatgtgcggttgttgttgttatgagctgtgaggcccagcaagcagagcagattagtgtgatttattgattctatatgttaaaattgatatactacatcatgtttctattttttgtagtgcagaatttttctagagataatttgtgtatccattcaataatattttttttctacaactaattcaggcaaacaacaatgctgggatgatttttataagcaggacatgaacgctagaaagctaaattgacaccctggtgcctcccgtttatagatgtcaccaacaagtaagagtgttcctctcgtgtttatattggaatattgttattgcttctatctgtaaaacctgaaaaatctgaaaccattcctatactgaataatagaagatataaaatgaatatgtgttgccattgcatccttatatttatttcttcaatccacaattaactatctaaaccacttttttttattttaattcacataaattattttcgttgctggttttagtatgaatattttgatatatctccgtgcaaaaaaggattttgatatagctatatgcatgtgcattgccattcgattccttttccaatatgtaacagtagtcattgtaaatatactttcatattgtttctctctgttggggcaagaactctgaaaaatgatatttggggtggttgataggctcaccaggtaaaaaggtacttcatactatatatgtctagattcattgacatctatatgaatgcgggtaatgctaaaaagtcttataatatgaaacggaggtagtagaaactatgtaaagaaaacttccttcaatttagtttgtatgggcattattaagttacctaaaacaaatactaagaattttgggtcaaaaggtatgttttctccacataattttgatgtaagagtgatatggttcaacccataactctttaattttgatatgggtgttcagttgctacttttcttctttttgcgggaaatttatttgcaaagcactcaatttactgctctgcaattgcttcacaggtaacattcatgctttcaaatctgtactgttcattcatctatgaacatataaatgtgaattttatactgcaaaaatagctcaccattcagtttcaatagtttatgttaatgtttccgtataacattggaaccatgccccatgcatccttttattagcaatattaactgctcagatcgggctgggggtgttatcttcagagggaggaaagtgtgaggaaaaagttttcatggcatcattagttgttcccctaagaaaaacatatgtattcacctggatatttacaattttttgtttatcagaaagtaaatgatgagtataaccctaatcctctcattttagtcctcattttagatcagtattccttattgaatgtaaaactgaagttacactgatgcatgatcacagaattattctatgggattggttgttatttgtactactgagtactgaccattctctcatgatatatgaacagagcatatgctcctagcaagaaatgtggcatgggtgagtttatagtcttgctttcaccatgtatgaaatgtggcatgtgagtttatactctttctttcaccatgttgactttttgcacatttatagaatcttttggtataatgctttgtgtcgattcacatgttttattaattattaacgaccagctgcataggaaaactgaggatgtacatggttgaaaagcctataacattattactatgttcatttatctacaatcgtttggatttaagagtttaaaggataatttactaaggtggttatctctggtaattagtttcttgtcttcatctactccttttgtaccagaaaaaataatttttggatgatgataatatactaaggccaactgcagatgttgtgactaatattgcacatcttcagtgcatgcttatctagggtggacactatgtttattcccgacagttcttaatcacttagaaatagggttatgaaattcagcaacatatgtgatttgatctgaaagaatcatcaaagagttcatctttgtgtaagcttatattataaaagattttatgccaacattttatctttccaacacgtgtcttgcacgtgcacgattactagtatataatctaaccctaagtcaacaggtcaaactccaaatcctctacccatccagatctgcaccagccaccaaccaccacccgagtcagtccgccggctccgggagcccgggagccacgcgcgccgccgttcgccagtccaccgggagcccgggagccgcgcgcgccgccttttgccagccaccaccgacgccgttcaccagtctgccagccaccacgcgcgccgccactcactgccttctctcgccgggatactaaagctgtcatcgccggccgtcgccatggactgaagtcgccgtcgccggccgcctttcatcaatgcgccgccgggccggcgcggcgcctgcagccatcttcaccgggagccgctatctgccgaccatggcttcggcctcccccccccccccataagctacgacagcgacgatgcaaggagcatttttggagcattgtgatctataatttgctgatttgttgaatggagcattttggatatatatgatataatgtgactgtgaatatgttgtttaaccgaggataggttcaccacgaggaaaatttcactgtgtggtgatcggggctgaaataattatagccccgtcgtggttgacgggggcgaggacggtgaaatattttcactgcggtgacggggacgcgaacatgacccccgacggtgaattcaccgttgccatctcagtagtgcctgtgcctatgctgtgaatcagctggggcaaggcaaacagttgattgatttacagtgctgcatccatttttaccggccgatggagtagtactgcaggtacaggagcaagcgaagcaaatgagagctaaatggtgctgactaggctccgagtcagagccaggctgcagctgacgtggtggggtcgaggggaggagggccggcgcggcgggtgcagccagtggccgacggggaaggagtgcggcgaaggctccctgccgctgaacctccagcgccaccgcagccttggccacctcgcgccgctattgaggttacccacagccaccggagtcgcacaccctcctctgcccttcctcctaagaaagagagaaaaggaagaaggggatcttcaagtgggtccaccattttttttccagatcaaactgttatgtaagtgccacgtggaatgaagacctagtcaaagaagtcacgtaggtgtcacgtcaaccaaaatagcggacaaataccactgagggacctcgtttgcatcgtttctgtaaattgagggatgtgttatatttggtattttggtttagggacgatttttgtaattcggtgaaaagataaggaacctcggtgtactttgtccatcgtataagaattagacggtccgattaaactaaggtgaagcccaataaagcaagaaaggcaaaggtggccctgcaggcatgacacacgacagcaggcgaaggcgaaggcgaaggcgaagcccaagcatccatcatgagagagaaaaagaataatatgccactccattcgttgggtttagacaaaatgtcacccactaaaatgcaaaggataaaatgccactgaatatattaccttcaggatattttgccacattaaaggatttgattttaagacaaaaataccctcgactgtggaaagaaatggaggaagaaagggaacggctctactcgctagtgacggaggcgagcacacgagcacgcgggggacgcgctacgatgggggaggacggtggtgacgctgacaagagggagggggacaccggatggtggcgatggggggagaaggatgatagcgctaacgggagggagggggatggcggtgttgacgggatggctttgcgcgctcgtggcttgtctcctccggcgccgcccgtacctggcactcactgctcgccgcctccggcgtcacccgcacgccggcgagcacgaacgccgttcagcttgaccttcttcggtgctgctctctcccctcttttttcatttctctccccagtcaaggatattttgatcttaaattctttcaaagtgataaataattatgaagatatcatattgagtgatattttatcctttgtattttagtgggtgttattttctgtaaagccgatgaatggagtggcacgttgtcactttttgtagcgcccattccgtcgtagcgcctagcgagaaaactatctcttaaaaaccctatttgcgaaatccgtttctttgcttgttgtctagtgtccgtgccaactcagatctcaaatccccgatctattgtcgagttcaatcccgaatccaaatccttcccaaatcaaatccctccgcaaaagtctatttagcctccctcgagttcgatgggtcgaatccctctcggcccatctcccccccccctctctctctctctctctctccctctcccccgctctgcccgtgcgctgctcacgcgtgcgcgtgagccgcgccgagccgagcgccctccgccctcgctgccgcttcccgtcgacgccgccgaaatcgccgcgccgcccgttgcttcccgcgcgcgcgcgccttggtggctgaccgcctggtcgctgccgccgtcagcatctcccgcgcctgcccgcgcctgccgcccgtgtcgccgctccgctccacaccggccccgccgtcatcgccatcgtcacgacccggcccccgccactccacgcgctagcctccaagggatggaggcagagctcctcctccctctgccgcgtcgcccccgctccctcctccttttcccaaagtggcaaggggcaaactccctttctcccttcctttttccttttcccctccccgccggcgtcatccgcctctgtcgccgttttggccgcgagcgccgagcgccagctcgcgccttgaccgcccaaggtcggtttccaaaccgacatcgtcgtcctataaaccaaggcgccctcccatcgattcctcctcccgtttcgcttgccgccaccgcgccattgccgcccctctgtctcgcctccgccgttcatcgccaagcaccgggagagccggtgcgttcgtggacgcggaaggggactccgggcgctcgccttcttcctcttccccggcccgaggccggagagatcactcccgtgccgtcggcctctcgtcactgcgccccgtcccgcacggtagtgcatccctccgttctccctcctcgttccatctcctccccttagactcgggtagtagcatgtgtagcctccccgtagctagccggcgctgccccgactgctgccgtcgctcgccgtgtgctcgtcgctgtcgccgcccgtgctccgtagcgcccgctcgtcgccggcctcgctcggcgtagctccgcccaatccgacgctagcaatgggttcccgtagccgcgtagatgctctcgccgccgggaatcggcccctcgtgacctcatcgccgtttcccccttccctcgccgccggttgccgccgctgcaatccgccgccgtcgagctccctccggcgaatccgagccgttggctcgtctcccctcgtcctgtgcaacatcccggtgtgctcgccttcgcctgtatcgccatggttcgctccgccgctcgccgccgtcgtccgccgtccgttccggccggcgtcgtcgtctacctcccgccggcccgcgtggcagccacataggcgccacgtcggcgccacctcggccgcgaccggatcggctgacccggccagccgctccctccattttccccccgtgcgcatggtccgcggtgagccgtgaggttgcgcgtgggcccgtcgcaccgcgtcctccgcgaaccgcgcgcatgcgctgcgcctccctccccaaaccctagcacgacccgcgtgcacctcgctcacggtgagccgagtcaccgacaagcgggtcccacccgggaccacgtgggatggacccggcccaccggctctctctctcctccccgcccgcgcgcgcgccctgggccgccttcttgggccggccggcccattaagcccggccgagccgcccctttcgctcgggccgcaccctagccgcccgagggaagtctaatttccctccctccttcttttcttttcttttctttttcaaaaaggatttaaataaatccttttcatttagaccaaaaatccaataatcttagaaattcaatatcttcccaaccgtaagtccgtttgactccgttcaacttccaaaattcctcaaatctcgagatctatctaatggcacgcttagaggtcaataatagggctttattttcgccgtttgctgagttgtcccgtttcgcgtgtagtttcggagcccgaagacccacagtgcgaggatttcgaggatcaagctcaagatctcgagcaaggcaagccacctttgaacatcttgagcctatatttgaactaagttatatttcttgcaaaatattatgcattgctaggattgcacttaatatgtttgccccaactacgaggcagaacggtgagcatacctaatttgttgcatttgatccttcctttgttaattgttataccatgttcccttgtacccacctagttgcgcctcagcaatcgtgcactctgcacgggtatcaacggtcgccttcaaacttaaaatctgagaaacatcttgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaatttcatccgagcatatgatagtgcaaccacatgggtggaatgggacacccctggctgagtaattagctaatcaggggagccttgatgctgagagacaagtggatttgccggggtggtgtcggggaggacccctgggcttcctggcacagtatggtctgggacctaacctgttgttggtctgggacccctctcgtcagcatatggtaaacctgtgtcggctttggaaatgccttgtcatgaaagcttggaggtctcccgacgtggctgatcaccacgagctgggtgatccgggttagtaatgtcgtgtgggtaaagtgtacccctctgcagaggttattaaaactgttcgaacagccgtgcccacggtcatgggcggatgtgaggtgattcctagcgtagttttgtttactgccttgtgaaattgctgttgtggaatgggtttgatgtttggaaaatctgcggctgatgggatcagccaggcccgggtggccgtttgaaagctgttggccgggtgccaatcttgatcaattcaaaagactgatacattgcacatactccgaccggacgagacacactgtctcatccgtgtcgtttgagaagcactcacttagttgtttcagaaaagagttcaaataaaatcaattgcaaaaacaacagcctttccttgaagccggcattaaacacttatttcccatggcttgctgagtactcatgtactcacccttgctctatataaataatccccccagttgctgaagaagatgaagcggatcccgctgacaaggagttcttccaggagcaagccggctacgatgagttctagggtttcggcctagttcccaagtcgcgcctttgatgtttggtccaagtcttggcttccgcttcccttttgtaatgcagttgtgagctcgggatctgtccgcagcccaacatgacagtactcctactctataataaagagacctctgttgctgtaatattctgtcttcctgtgataccagcactattttctgggactggtatcgattaacaagttaatttggagcgtcacgggctagttccggttgggactagttcggggcgtgacacttttctgcgtcaggaggagcccagtttgggggccaaagacgctgaagcggcggtcgctctgcgctgtggttgtcgcagggttgttgggcaccggcgcaagatgcaaccccctacccatcatactgtacagtacagcgctgtgattgtgctgtgaatcagccggcgcaaacagagaaacagttgattgatgttttacagcgctgcatccatttttaccggcaaatgaaatagtagtactactactgctagtccagccagacgtccggtagagatgaaaatgaggtacaggagccagcgaagagaagggatgaatggtgctgactaggctccgagtcagagccaggctgcatctgcgcagcagcctatccaatctaatccacacgcagacgcaatactggtagtactgtgcacaaggacgggagaagcagcatgcctgtacaagagttttgtcccttgcgcggcggtccatctcgtcgcgcggtgcggtctctgggtgccgcgcgcggttttgcgaaatcggtttcttggctttgcgtcactcacatgagatgagatgagttgcccatgtgcaccctgctgattctctgattcgccctacgcgatggccggtgctgccggctcctgctccgtaaacagcgcttgcatttttccctttaaacaaaacataggtatctcttccgctccgttccattttctgttactcctactgtagctactctaatctcattctgcgtgccgcccaactgaatgagtaattaatcctcctcttccctaggtgattctgctctctcgtcttccaacttgcatcacgctcgtctcagacatcccgcaactgaccaccataccatacgtcttcctatacacatgtctcggatgattcaatacattagggcaagtgctataatgtttcatatgttgcttctacaagtgccacattatattgggtgatgaggtggaggagaaaagtaaagagagagatgatgagccacccctaaatcaagagacaacctccacacaaattttaaaaaggatgtgagagtattagatatattggtatttgtgaaataagatggtaaattgtatgggttgcctcttgctttatgagtgaataaaatagataaatttagagatagtagtcacatctaccatagcatttgccttatacacgcacaactgtggcctgctcttaatcaaacgaaaaaaagaaaaaaaatacagtactccagtagaaagagagcgatataaacaatacggtacgctgttcctgtgaaatctgcttcaccagcaccatcaccgcgatcaccttcccagacaggacagcttaactactgcagtactagtagcttatggctggcaaaaccgtgctatcaatagcaactggtgtactgtacaccctttttctgcagataagtttgctatcaatagggaaaaatcagtcgtacatatccacttattttgtccaacaataggctcgccgcgcttaagctggatacaaaacacaaagtgatcttgtttgttactccatactccgaaatcgtctccagatagataacccgaatagtaaaatgcgcagctacaccatgtttcccaggctaattgatctgtcccagcaatttccaaagcacacgaaaatccgtggagctaattgacattaaaaataccctacagctaggttctcgaacagaaaatcaaagcaccgactgcacctattccaaacaaacccactgaaaattgtgcgaatagtcaatcagttttaaattataagtcgttttagcttttatcaaaatcaaactacttcaaatttaattaagtttatagatgaatatagtaatattcacaacactaaattagttttattaaatctataattaaatacattttcataatatatttgacttgagataaaaatatccttttttttctacagatttaattaaacttataatcgagacggatagattatattataggatgaagtatgtaggagtagtttattaagggcatgttcactttaattttattttcaatcttaccaagttttgataaagttgtcaaaaaagtggctacatttagtttgctgtcaatttttagtaactataattgccaaaattttggtaactatactaaaattttgataattttaatgttttttttggcatcaaactgaacatgacatcaagcttaatgcagcttgactgttaatgtggtatgataactcgtactgtcgtacaacccgtttaatactcgatgtcactatcaagtcttttacagtggtaaagtacatttattacgaaggcagattgggggtggtgggtcacccatcaacgctccctttcgctgtaacgtggtccccaccgagacttgaccaaaaagcacatttgccacacgtcccccgagcgtgcaccaatacacgtggcatctcaacccaccaatacctatatacccaaccaccgctcgtgaggcccccagcttttaatcttatccactcacccccccaaccctttttacccacgccaaaaaaaccgacgcgcggcaaccgctttcctccacgtgtcccccatccgcaacgtccagtgagcatcggacggtctccaggatttaccccatgtgaaagccgttgcggtgaaaaggtgaaaggggtaaaaggagtgcgcttttttttcctttctgtttctccctcctctcgtgggcattaaaaaggcgcctcttttctccttcgccgcatctccccatccgccattgttgtgttctcatcctcttcttccatctctctctctgtgcgtgctctccgacgtctctcctctccctctcgcgtgcttggtcgctgtaggagggggttcaattgatttgaggtagccatggctgaggcactgtgcagcggcagcgtcgcgtccccgtgcggggaggtgggtgtggggttcgccgccggccttgtgaggggcgccgcggcggcggcggcgctcgcggagtctgtgccgattggtgggtacagcagcaagagcacgttcccgagtgggagggtggcgctcacggagaggaaggcgaggcccctgccacggaatctcgaagcggcgcatgggcaggtctgttcgtcagttcttcaggagatttttcagcacataatttcatatttttagttctaggcttttggataatactgcaagcatgctatttttaactctttttggggttgggatttagttcgagcagttggagaagttagctgagttcgcgtcggatgcatgctaacgttttcaagttttgttgctttttacagatgaacctgacgattgggaaggccatgaggtggtgggagaagtgcctgcagcccaacatgagggagatcgagtcggcgcaagacctcgccgactccctcctcaacgccggcgacaagctcgtcgtcgtcgacttcttctccccgggctgcggtggctgccgcgccctacaccccaaggtagaatccacgcccaaatcctcttcagtttccaataactgcaagtgttctttttcctttttttggttgctgatgagaatctgtttgattgtgccgtgcagattgctcaactagccgagaagaacccggaggtgctgttcttgcaagtgaactacgagaagcacaagtcaatgtgctacagcctccatgttcatgttctgccattcttcaggttctacaggggagctcagggccgtgtcagcagcttcagctgcacaaacgcaactgtaagctcctccccaaattatgtttctgcaaccaaaacaccaatccatagtagtgggttaatgtgctaacatgcattgctgcaaatgtgattgcagatcaagaagttcaaggatgcacttgccaagcatggtccggacaggtgtggcctcggcccggcgaaggggctcgaggagtcggagctcatggcgttggccataaacagggacctgaacttcacctacacaccaaaccaagaccttgtcccaattgcagacgccctcctgaaggaagctgctgcacctggaggtccatggctgccattgcccgcaacggcgacgcagctgttcattcagggatctgagaattcgctgttgtcatctggaagatagccggtggttcgacggcaagattggcttcaatttgtacatatttttccgcttgttctagcctgatgttatgacatgctgatgcgcaggctcatgatttttgtttatgagcctgctgagtgctggaggcatgaaattccttgcctgacggacctgtatgcgtgatgcacgtctgcatcgaaaattgaacatgctagattcattcatgattgaatcccgtaatccctgtagtattcaggtcttgaaagctttgagttctgaatgagtgtacttggttgtgtcgaaaatgtcggtacttggatctggatgctgctttacaccatgtcatgattcaggaagaaggttactgctgcctaatcaaaatgagagcaatacgaattgcattgttgattgttctgttccatcaattgggtacagcggtgccaatttgtagtattattgagagatcatgggtaaggtagagcatgattcttttgtcatggaagagtaggcaacggcgtagtgggctcaatattgcgagttggaaggtaacgcatggctgtagtaggtccttgtcactgcactcacatgagggtgtcatctttgtcttgtacagacggatagagtcgttacggatattgttacgcaggaatcagctatacacttgtttaccatcagaacaaaacggtaaaatcctgatagggttgaatttggaagtgaattgcagaactggacaattcggattggtaaagaaaagccatgtcttgacagagagtttggaaactcaactacagaacttgacacgtcaggttgggaaaagaacagcgattgaaaagagtagttcagcatcgaaaaaaatatctagacacaacagaaggggagcaacctggatgaagatgaagatgaagaagagctatccaattcgcaagggcattgtcaatttctgatgcagtcatgcagctgacgcttttggccgtctttaacttgtggcacaatcgtcgtcgtctttttcctcaaagtgtctggatcatccatgaactgacttgaaaaatatctgaggtgtgataactaccagaagaatggataaatcacaagtacataacacaaaaaataagatcgataaattgggtgggaagcacaaaatttgcagattttcatggatcttaccagttaccactaacctcacacggttggaaatgatgaaaagatggaaggacaagatgagaggagggagggcctgaatttcaattgggatggacggaactggtggcgaacttgtgccgcgtcgaagtcgaaccggccggccttctctccggcgggcggcggcgatcgtgtcttgaggagaggagagacgctgaacagaaggacactccgcttctttcctcggatgcgatttgtcccagttacagcccaatatcgaacagagataacaactgacggcccaaagtggggcctgttactaggtgatggcccaacagaggaccatgaatgttctatcgtagagcttggcgggcccattaacaatcagcaaccccgggctggtcttggaccacacatcctccaagaatagcccgttaacacaacacgagtaattcggaaggaataagtaaccccggcggcgagtgaccggagaaggcgggtgagcacgcggccggcggagcggagtggcgacagccgtgccatctgctgccggctgtgcatcgagaagattggagaggaaaggagaagagaagagaagaaagataagaaaagagaaaaaaaatagaagaaataaggtatgtgggacggtaagtgaacttattccaatatggaacggtccgacgtcacagcccatatggcctgttaaagcctgcttgccatccattaacatttctttagttgaaatccggaatttctatctagcgctgtttttgaaattaatgtttctaaaaatagtgtgcgtagtccgatgacctgaaaaattcgtgcgcatatgcccagcatatatgcaagttgaatcaagccccaactgtatgtgtttatatatgtgtcgcccagcgagaggagctcttattgccaggtaattaattaacttgtacaagatacaagcacaccacacgataatcatacggtacggacgagcataagttactcttagctacgtatataggtgggtagctagcagagaataattattctgcaccagattcgttgatatcaacttgagccttgatagagagctggatcgatgtatcgatcagctcagtagtagggctggatcttccagcgctggttgtcgccctcgcaccacttccagagcacgatgtcggtgccgtcgcggacgccgccgtggtacttgtcgccgtggaaggcgtcgaagttgaggtagatgttgttcaccatgcggatgcacctgaacccgttccccacgtcgcggctctccgtccacagcaccgactcgtccatcacctccgggttgtacggcaccagcctcacctgcacgcaagagcatcgtcgtcgatcgccatcaatggccggcggattcagattcagagaaagaacgctgagactagcttacagggtgtgactggccgagggagtgcttgatggcctggccggtggccttgttgacgagggcgaaggcagggtagccctcctcgtccttgatgctggtgctccacctcatgtccttgatccaatgctggtactcgtccttggggttcgccggcgccagcaccaccgcgccgttccgcgccgtcatcgcgtagttcgggttcgcccggcagtacaccttcaccgtcggctgcggcggcagcgtcctgccacacccgttcccctcgatgttcacctgcgacatcccgtacggcgccgccggcgcgtaccccggcgtcgccagggcgccgccgccaccgtacccgccatacccgccgtactgctcgcgccgcccgtaaaagtccatggcttcttgatttatgactcgctagctacctagctaattaaacagagattgtatagctagctgcagagtgcgttgttcgttcgatcgttgatgtgctgcctctatgcatggcaatgggatgggggatttataggggatgatcgattgatcagtagcactgatcgagatgctatctatctctctctctctctctctctctctctctagatagctgatcgatgtgcattattcgtgcactgcatggtcaggggcttaggaacttggtaggatagatgatgccattccacacttgcgctttcctggggaaaaggtgattccatccatccatggtgctttacgtgattccgtttctagtcgttttgggaaccatctcgatctggctgccgtattattgcaggcgagcgcgacgcgagacgatagcaaagcacacggtgcagctccatcgcccggagaatctcacgtattctcatgtccttgctgcgttgtgatcaagcagagaaaaagtgctgcaattccgcacaagaaaagattaaaaaggaataacgggatcgatcgagaagaaaaggaatcagccaagcacatttagaaatttattagggattacctatacaatttttcgacagaaaattccccgggcgtgcagtgtatccaccagaaatttgaaaatttggccaaaaaggaagaaaagaaaagggagttgggggtgggactaatgggtctaaattcttaacgggccgatcatgaacggaagttacacttattctccctcaactacaataataccgagcataacactaatcatgtcgtaaagtgaccattgagcagcttgaaaaaactaaaattttgattacgaaagtcgataaagataagagtttcatcaagatactcttagataggacaagaaagagcaaatttgattgatgccacctctattagtttggaacaattagaaaagtctaaaaaggaaaccctttagtttgaaataaaaagagtgatgaattaggtccaacaatgagttttccaacgaggtcgtacaaggagctctagaaggaagctaacctagttctcaaaaaaaaaaaagaaagaagaaggaagctaccttattggcaagttgtacggtggttttctacaacatggcgttaattgcatagtggaaaaaaaactggaacggactgacagtttaaccggaaaaaaatcggaaccagaggttggcggccggttttgtgatgaaccgggcaataaaccgcctttggtccagccggactaaggcaagtcaatgaatgaatgggccacacgatggccggttcatccctggtcaatgggatgcatggcaactcccgtggccatcctaccaatcggatgtactctctccgtttcaaaatgtttgacaccgttgactttttagtacgtgtttgatcattcgtcttatttaaaaaaattaagtaattatttattcttttcatatcatttgatttattgttaaatatactctcatgtacacatatagttttacatatttcataatttttttgaataagacgaacggtcaaacatgtgctaaaaagtcaacggtgtcaaacattttgaaacggatggagtatgtgttagcattgaaatacatacgttacatgcatgcacttagtaaactgcggttcgatcggctggttcatggtcaaactgtccgagaccggtgaaccagaagggtgactgggtcatctaccggtccggttttttccactatggttaagttgcatccggtaaggaaaaaaaaggtgggactcatcttctcccttcacacctccacctctcctctcctctcctctccctatccccccgctctctctctctctctctctcggacgggcactatggctcgtttgtgggcatgtgggcatgctttagcgtaacactatggttcattggctaggttggggtctctgcgacccatcgaccaaaggcgtaaggtggagagtgaggaatgaggaaggaggagggacatgtttagattgtagccaaaataaacgttaccaagttttggcagtgccaaaatattggcaagatgacaatattgctacaattttagcaggatttgtgatcaaatttggcaacaaactaaacatagacatattttttggcaactttaccaaaaatggtatgatattaaagtgaacagacccgagattataacatctgggaccaatgattttttttaaatcagacatgtggatcctattcttcatatgtttttttgtttttttccgctgattgtaattacatgtaagtgacttatcaggtgaagactaggtcaatattttttccacatatgatacaactgccgtctaaaccaccgcgggactcgatatacaatgttttgatagtaggggacgctctatacccattacttgaggtatctaatgtgaactcttttctttttgtggctacctgcactgtttgtacgtatgggccatgatgcagcccagtgcactaaagcccaaccaggactgccttgccggcctcctgcgcttggtgctcttcgatcgtgtgtcctcctccgtggcctagccctagccgcccgttccaatccaacggttcgcgacggccagaaggggttcgtccgggtgaataaaaatccgaaccccttcacgagatcgacgccttggacgcctctctgcttttcgagttcgacgaaatcgggtttcgtcctacccaaattcaaagcattttgtttcatcattatgacttggagaacgtgttccagtaccacgccttttttttcagcaaaattacacgtcacaaacagaagaaggggaaacaacagggtcgagacaaatgagccattcataattcattcattaggcatacgaaaagtagagagtacaggggaaagcaagatgagttgcatcagatttctgaatcatatggcccctcctcctgcacttacatcacccactgtttcatctcatagcaatcactggctcgcaaaaggacacacactgacacaaactcgaggacggacggacaccattgactgccatactccgatcgatcgaacgaacgaacacggtcttatttcggtagcagatcgatcaaattattagctagagtagaagcagagcagacgcgacgacgatggcaatgcaatgcagctccccctccccggaatctctgcagatgcaaagaagcagcaatccaagtgtcagaatctctgatttcttcagaggatccgaaggaaattaatcgatcagcgatggcattgtgcattgttagcggtggaacttacaccaggggaggatcttccagcgctggttgtcaccctcgcaccacttccacagcacgatctcggtgccatcgtggatgccgccgtgatccttgtcgccatggaaggcgtcgaagttgaggtagatgttgttcaccatgcggatgcagcggaagcccttgcccacatccttgctctccgtccacagcacagactcgtcctggtactctgggttgtagggaaccagcttcacctgcatgcgcagagaaaatcgttcgttgtgattcagagattcgttgcatatgtaagaaaatatttattttgtaagaaaagatttgctcaccgggtggccctgtccggtggagtgcttgatggcttcgccggtgaccttgttgaccagcgcgaacgccgggtagccttcctcgtccctgatcttgttgctgtgcctcatgtccttgatccagtgctacaaaccacaaccacaaatctctcaaggtttttctctatctgaatagtagtatataattaagaggagaatacgtacctggtagtcgtccctggggttcttgggggcgaggcaggcggtgccgttgcggacggtgaggcagtagtcctcgcctgcggcggagaagacgcggacggtgtggacggggacgccgccgatggtgcaggcggtggcggcgccgggggaggaggagtgagcctcggggccccaggggaggatcttccagctctggttgtcgcccttgcaccactcccagagcacgacggtggtgccgtcgcggacgccgccgtggtccttgtcgccgtggaaggcgtccaagttgaggcgggtgttgttgaccatgcggatgcagcggaagcccttgccgacgtccttgctctccgtccacagcaccgacgcgtcctcgtactccgggttgaacggcacaagcttcacctgcacacccatcacccgccatgagtccatgacatcgaagtcaacgttcttcgatcttccatggcagcacgcacaaagctagcagcaaaatagaaatatagtattacggggtgggactggccgagggagtgcttgacggcgagtccggtggccttgttgacgagggcgaacgccggcatgccctccccgtccttcaccttggtgctgaacctcatgtccttgaaccagtgctgcatttcaattcattccatttcagtatacatcaaaatccgatcgaatatagaaacaaaagaaaaggcatatataagaagggggacctgacctggtgctcgtccttggggttgacgggggcgaggacgacggcgctgtcgcggacggtgaggcagtagttctcgttggcgcggcagaagatcttgaagatctggttcgggtccgacggcgccgccggtgcctggttgtggtggtgcccgaacccaaacatcttcgacccttaattcgatcggtgcaactcgcgactcgcgagagaaatgtttttgtgctgcgactgcgagcgatgatgcgaggaggagcgagaggtgccacgttttatagaaggccaaggccggccactctcaccctcacccactgatcgatcggctcggctcgatgacgcgctctcctgtgccaactcccacgttcgctgacagctgggcccaccggtggtcctcgactggctcaaacgcgtgacatgcgtgcgtgtatgttttgcattctagccgtttgatttgaatatttgatatgatatgatatatctttggtgtttaatgtactctcagattcggttccatgaacttgacttggatgctagtaccagtaattcattgtgctgagatttgcattactaaatgtgcgagtaaatgcaaagatttgattactggtgcacagttaattgctctacttactcagtggaagactagagcagtacaccaacttcattgagtatttttggagcagcctgatttcttacaaccggataacataatatcactaccattaccgtgacaggtatgtgggtcatatactcctattgttccacacgtcagtgcttgtaatggtagtgctgccattatgatagagaatgtggatcccttccaacttgtaaaacaacactttctttttcagaaaagcataaactctttcacccgaaataaaaattaaggggaaaaaaacaatctttgcttaagaaaagaacaaagagagatgctgcttgctcgctttccattgtccgggaatttcgaccattgttttccccaaaatcgaaaggtatgtcgccacgaaggacgaggtgatcgaaatgcatgccgtggcccaggattgaagcgtgcacctgacgcaaatccataaaacaagctaagagatgtgattccagctagagatgacccttgtgacggtcgttttgtacgtttgcatccctgtgctacacaagaaacaaaggcagttttacttttctgaatcaccatggatcgcccatggatggatggttcgatcatccctgtccgtttccaatgagcacatctaatctgacctgaatgatgcatgatgcatgaaaggtggtaaaaaagttgttaactgataagagaataatctttttacccggcaagctgctctatatcacggccacgcagcgcctgtatggccaagaacgttccagatttcaacacctaattaatcgacgcgtcgcctgccttttgcaatgcttttacaggcttaagctttgttgttgtgcttaacaacaatgcagcaggcagaaaacgggttagctacatgcatctccctttgatttttgttgtcacgtactactctctcaacttgtcaggatgaaaagtttcgactctttaactttctcaaacgaaaacaagtcaagttttcgcgaacatttggagtgctgtgcagatagcaacgcgttgctggtttgtagtagtatagtaccgttgtttcaaccgttctacccttatagctcccgcaatggtaaaataaggtactctctataaaacatatacatctcagcaatagactcgattaatagtaaaccaccttaatagtatgtctacatttgtatctatagctctctcatgcattgcctcgtttttctctatagattatctctaagttagtagatagctttactctctctcttcatttaataccttctaagtaggaaaatatactgacatagatcttttgtagagagcttataaataaccagtgataactttagaggagtaggtgaagcctgtccttaaactcaccttacaattaggagtagtaattgctatgtgtaggttgtcctgtggagtttgtggacgttggagcagatgatgttgcatttgctaaattggtaatggtgaatttattattgtcttggtgtgattaggtgaacacttttgtcctgtctagctagtatagtactccacaaaccaaccttgacgatttcaacagaaaataaaaaggctaatctaatctgttagctaagcttggctgggtttatctggactggatggatcatgggtgtgtgggtttagctcaggtaggcacacgttttgccaccctgctcgtatactccctccacccttaaaaaaaactcaacctactgatctcttctagttcagatttattgtcttaggatgtaacctcttctaggttaagttttttagacgagaaaagtattactctatgatatctccctcgtcataatcgaaaacaagggtgcttatctcatgaagtgccatgtggatgtggatcaacaatccctagctcaaaagcattttagcaggggctcggtttaagaaaaaatgttgttttcgcaaagggttactaatatatattactccctccttcccatattgtttatcatataataaaatttaaaatttcttaaattaatcatcatataaccgtgcgcatggacacgaatttcatcggaatacaactaatgtagcaagagagaatgtgtgcatgctaaaaatgtaattggcatggtattttaatcgatgcatgtattgtgaaagaatatgtgtatggtgtctttattgatgcgatttaaattattcttgttcttggtgtataaacatactatttatggttaatctatttgggatgaagggagtactatttatggttaattatttttaaaattagaacggaaatggataccttgacctttccattcgcatggcaccgtgttgccttgtgttttaaagttttgaactcaattacatactaccttcttttcaaaatgtatagcgcctttgatttttttataacatttaatcttattaaaaaataatatgtaaaagtataaggtaagattatattttatttgatgataaaacaaatcacaataaacaataatatttatataatcattttgaataagatgaacgatcaaatgttatgaaaagtcaacgacgtcatacattataaatggaggaagtactacttatagtgtagtcacagtataactaggctgtaattacacccgagttacatcgatagtttttttgtttaaaatcgatcgatagcgctacaggtagactctttttttttttttgtagacgacgtattcatcaacaaggagaccgtgagtgcttttttatattggcacaatctttgggtgtgctttatattggcacagtctgtaaaggtaggatgtttgtgggtgcacggaggctgtgagcatgtgtttagcaaagaaaaaaaaagcagcttcaatgatgccttcattttctcttgaggaaggatgttttgggctggtgaaattcacgtactgaatgtttggatcatcgtcgtcatgtacagctaataggtgggccattcatattacgaagtggaggtccaataacaaaacttgggccatatttgttcggaaaaaatggatgtatttaggggtaagcaagaaaaaactgaaaccaaagaccaagctaaactgaccataccaagaccgagaatttcggtatctatactgaactaaccaaattttgttcggtcatgggcttcggttgaccgaatcaaccgaaataccttctaagccctataagcccactaagcccgatagagaaactctaattttccacccctccaagtcccaacaaaccccacatccacaccacccaccctgccaccccggccttttggttgttgcgtcgccgtcacccgcttcttcttgccttcgcgtgttgaccaagccagcgcccccctccccctccgcccaacaagaatcgcctcagcaccatcgcgttgtgctcgcgcctcctcctcgcaccacaccgccattgtatagcctacctccgactcccctccagtcctctactcagacctcctttcttgctcatgctggcagtggcgcctcgactccaacgatggcgacatacagctggcctcccctcaacctctctgtccactcctgcacgtaccggcggctactcctcgactccaacaaagacgatacatcaagccgtcatccccttccctctagcagttttcttgatttgggcacaaggtggagatggcggcggagcaggagggcacatgcaatagtcggtggttggttgaggggctatcgacgaagattgcaacctggcctccccagcccccatccactctgattttttttattttggataattttcttgtgattttcttaatttatctcctgattattttaatcatgatcaagatcgagaccaaatttggtggtcttgataaatttctactattgtccagtctcttttcaataaccgaactaaccgaaaaaagacaggatatcaagatatcaagatcaaaattttcaatctgaccaaatgcccaccccttgatacatatgggccctattacacttttcactaattttggcccgtttggaaccttgcttcttgtctccgtctatactctagtactagtctactcttccaaagagaagatgcagattgttcgtctgtacttgatacatcagcttctcaatccaaactgtttgcttagtttggacggtttttggtgcacatatggagataattaacgtaggtttgctcaactgctctttgactaaatctgattgtgttgcgtgtgcatctcacacccaaaagtgcattgccaatcctatatataagaggacgagcagttcatcattttttttcttcatgtttagctgttcggccttgttgaaaaaacagcactacattgttaatttcgtccgtgatgtaagacttggacgcttgggagttaagagttagaccaatctgcatttttccaagataagaattgaattggacccatcggcatgcgaacaaacggtagtgtacctgcagagtactgacgatgggctgacttgatggcaacctagaagtctctagtccttaggagtagtagttcttaacaacaacattagactcggacttttgcaagcccttaatctgaaatctcgattctgttataaaattttagttagctgattttacgatttttacaatttttatgtatatatacaattttatgattatggccttacacggaaatttttttgcgaacgcgcaaaaggattgcacgtcagtatattagcaggaaaagagtttttgttacacaaaacaatcagccagactggcttatgcctaaaaggggggggggacttgaagctaggaactactacgacggttaaaaacacaactccaaacagcgggagggggcagagccacgctacatttccaagaaaaccccaaaaaaagtaacactagctaaagaccacagctggccctccgagcggatggactccagaaccactgcaaccgaagcgagcacagagtcgaaaaccctggagtttcgttccttccacagctgccaggagactaggagtaccaaggagtcgaagccgctgcggaggtgctcaggtaaatataccctggaggatgaccaccaatcctggagccaactgccacgagggggagagagggcagcccagccaggaggggacaacacacggagccagacctgccgagcgaacacgcaatcaatgaggatgtggttcgctgtctcaagctcctgagcacaaaaggggcaagcagagtggctatcgataccacgcttttggagaagatcggcagtccaacagcgctgctgaaatgcaaaccaaaggaagaacttgcatttagcagggcccttcgcgtgccagagtaagtcggcacaggcaaaagagtgttggccaaggaagaacgcctgatacgccgatcgcgctgagtagcactggtcacccgtccaacgccagacgaggtgatcctcaacacccggcgagagctgggtaggaagcaccgcgtcccagactaacaggaactgagagatgactgggacagtgagggcgccacgtatgtcaccaacccaggagttgttcgctaacccagcagtaactgtgcgcgatccccggaagcgtggaggcacggcgtggaggaggtcaggagctatagaagctatcgagcgaccatcgatccaccgatcagtccagaagagcgtggactgaccatctcccaggatagagaaggtggatgctgcgaacatgtcggagacactccactcaataggggccttcagatcagaccagtaggggtgtcccgagcgctgaagccagagccagcgaactctcaaggcaaagccagccaccctgagatccggaatgcccagtccaccgagatccctaggacgacaaaccctcgtccaggacacccggcactgtcccccattggccgagtctgtacccatccacaagaaggcgcgacgcttcttgtcaatggctttgataacccagcttggcaagccgatcgccatagaaacggagaaccgactagactagaaccgagcgacccgccagagtggttagacggcccttccagggggggagccgatgggagactttatccacaagcagttgcagggccgcttttggcagcttgcgaactgacagtggaatgccgaggtaggtgcagggaaactccgagatcgagcaaggaaaagaggactgaaccagctccaggtcaagaaccgagcagcggatcggagtaaccgagcacttggtgaagttggtccgaagcccggaagcggcaccgaagacagagaggatgccttggatgaactcaaggtcttgccgaacgggggaaaggaagagaactagatcatcggcgtagagggatgcacgatgtcgaatagcacggtcattgaggggaagaaaaccacccgaatcagaggctttgcggagcatcgcattgagcacatccatgactagaatgaaaagcatgggggaaagaggatctccttggcaaagacctctccgatgggggaaccatggacctggcaccccattaaccagtacccgggaagaggaggcactgagaatgagggagatccaatcacgccaacgttgactgaagccaagctgggctagcacctcaagcaagaaaggctagctgaccatgtcaaaggccttcgcgatatccaccttgagaagaagtcggggaacgcgtttggcgtggagcgcccttgcctcaatctggacatagcggaagttgtcatggagagagcggcccttgatgaaagcgctctggttaggcgccacaagctcgtccaggcgaggggagagacgagaggccaagatcttggagaacagcttcccaaagctgtgaataatgctaatcggcctgaaatccttaacatcaacagcctcgtccttcttcggcaagagggagattagggcgtcgttgagggaagcaaaaccttggccgttggtcaggaacaaggagttaagggccgccagaatttcgaccttgatcaccggccagcaagacttgtagaaacggcccgtaaaaccgtcaggactgggcgccttatcagagggcaaggacttgatcaccgcccagacctcatcctctgtgaagggacagtccagcccctcaagctgcgcagggcggaggccaagagagtggaggtctagggcgagttcacgctcgaagctcgtccccaagatggcgcaaaagtgagaggaggcaagctcttgcagcgcatcatgggagacgacaagctggtcaccatcacgaaggcgcgtgatgaagttcttccgcctacgagctctggcgtgcaggtggaagaacttggtattggcgtcaccctccttaagccagaccaaacgtgaacgttgacgcgcgatagtacgctcaagcgaggcaagaccaagacacttcaactttaaatctcgccacagccaggtctccaagggggaaagagaccgactctcctgcgcaacatcaagccggaagacaagttccttcgccatctgaagctgcagacgaacactgccaatgtgatgttcactccagctctgtaagcgcttggccgtggtagagaagcaccagggaagagcagcaagagggggtaggttggtagggggatgccaggcgtcctgcacgacttgaagaaagccgtcgaacttgggccaaaaggcctcaaaacgaaaacgatgcgctttcggggaggtgacgcaggtatgaaggagaagagcacagtgatcagaggtgatagaagaggccgcttggaggaggcaagaggggaaaagctcctcccaatccgcagagaagaggacgcggtcgagcttaacaagcgtaggcgactcgcgctcattgctccaagtgaagcgacgtccgtgaagcagcagctcctggagttccaactcgtcgacgagtcgacgaaaacgacccatcatacgacgattgagattaaggttgtttttatcccgagcttcgagaatgaggttgaaatcgcctacgacggcccacggccccgtgcgagaggagcgcagcgaacgaagctcatctaagaaacgaagtttgtaaggctcctcctgtggcccatagacgatggagagccaccagggggcgacatcagaagagtgtcgaaccaacgcggtaagagagaaatccgcaaggtgaacatctgagacagaccagacagtcgtccgccaggcaagcaacaccccccactccgaccgaccgcagacaagaaggaataatcaaagtcgaggcctagcatttccagaatagtacgagaggggattacatccataatagtctcctgaagacagagaagagagacatgctcatcacggactacatcacgcacagcatccgggcgggcacgcgagttcagacctcgcacgttccacaccaaaacgttctcattgcatgatcccattgagggggaccacaccgagagtagaagagaagaaaccgatcagccgcacacgaccaacgcctccgcagccttgcccgggggcaaggagccggagaagagcgaggagagcgcgatgatgtgctcctgggaaagtggcttggagaagagggcgttgtaagccgcgatcgcctcggccgtgaccgggcccctctccggaactaggccgagcttccgcatcaggttgcgctgggcgcgcgacactgcgtggatcggcccctcaagcgcctcaagtgccatcttagcagcgatacgctcactgcacttcggcacaacctccaccgccttggcggcgagaggcggcagcggcaaaggcggcgggaggagcgcaggagggagtggcctggagcagctggtgaggaaggcgcgaagagcggcgttgttacacggaaattttgatttaattttatgatcacaacgatcttaacaaacctgctctgtgcaataatatgacaataatcttcagtgttgacttaattactcacggccttttatagctagcggaattaatcgcgggtattaggtgtggtgtcattgggattaaccatttgtcataattgagtcgtcgaagcagatgtaccaaacatagatcaaccgcatagtactgtagtagagtatcaaaccggagcagtactcatctcgccagaagcaaactgggcagagtagacaggcatctcatgacatgaactagtagaacttcgtacaaaagatgcgcatatacgcatggatccacaccaaatagcagggagggggtcatctgatctctgctgacagcgagaccctgatttattctgcagtgacataaacacaggacacgcaacagtaacacgacatgcatgcatggtcgaactcgaacagtgccaaatgcaagcacaggtgacggatcgatcgatgcttttgttgacggtctctcgatttctgcgtcagaaggaacaaaaccaaacaatgtcagttgaaagattctgactaattaagctatatatcggtgataattacttacaccaggggaggatcttccagcgctggttgtcgcccttacaccactcccagagcacgacggtggtgccgtcgtggacgccgccgtggtccttgtcgccatggaaggcgtcaaagttgaggtagatgttgttcaccatgcggacgcagcggaagccatggccgacgtccttgctctccgtccacagcaccgactcgtccaggtactccgggttgtatggcaccagcctaacctgcgtgcagacgaacgtgtcagatcatcaactactagtgtagtagtggttttgcgacaaattcacatcatgtgacgccattccagaaatcgtaagcgttgattgctactactacgacgctccaaccactacgttgactgattttttgacatatatgaaacagactgaattaattatctaatgaagaagatgtatgtatgtatgtatgtacatacagggtggctctgtccgagggagtgcttgatggcttccccggtggccttgttcaccagcgcgaacgccgggtagccttcctcgtccttgatgctcgtgctgtgcctcatgtccttcacccagtgctgcaaatcggatttgaacatgattagaatagttagacaagatcacgatggagttgatctatcggtgttaagaatttgagatggaattgtatgcaacggaaataacctggaagtcatccctgggattggttggtgcaaggcagacggcgccgttcctgacggtgaggctgtacgcctcgtcggccctgcacaggatgcgcacggtgggctccgacgccagcgcgcggggcagccggttgccgtaccctgcaccgggtggtccgaccggcggtggacggtagccgtagcccggctcatcgtggctcggtggcggctgcggcgggtagaacgcaggtgcggggtggtagccgtggccaggttcacggttgggcggcggcggcgggtatgcctggtgcccgtatgctggcggcggcggcggcgcgtacgcctcggggccccaggggaggatcttccagcactggttgtcgcccttgcaccactcccagagcacgacggtggtgccgtcgtgcaccccgccgtgggacttgtcgccgtggaaggcgtccaagttgaggtagatgttgttgaccatgccgatgcagcggaagccatggccgacgtccttgctctcggtccacagcaccgactcgtcctggtactctgggttgtacggcaccagcttcacctgcatcaggacaggagcgtcgatcgatcatgcatgtaaaacagttaagatggcgcgcgaagactgcatgcgtggatgaactaatggtgattgacatacggggtgggattggccgagcgagtgcttgacggcgaggccggtggcgcgattgacgagcgcgaacgccgggtggccctcctcgtccttcaccctcgtgctgtgccgcatgtccttgtaccagtgctgcatgccatggtccggattagagagaagctagtaattaagagatgagcacagagccacatagcatagcagaagaagaaaatattatggtggtggtgcctggcagtcgtcgcgggggttggttggcgcgaggacgacggcgtcgtggcggacggtaaggcagtacccctcgtcggcgcggcagaagatcttgaacgtcggctcgtgctggggaccagtcgccggaggctggtattggccgtggccgtgcccatggtggctgaacatgctagctagcttccaagggccggcgtctggttgtctcgctggtattcgatcgttgcaaatggcacctcccgggttatatagaacaaattaagctggaggccggccggcgagacgttcgttcgttgagaccgaggccgcgtacgtggtgccgatcgatgagaccacacccaccgtgtcgtgtcatgtcatcttctggagtacatagggcctgtttagttcgcgaaaagaaattttttagtgttacatcggatgtttgaccgaataacggaagggttttttggatacgaatgaaaaaactaatttcataactcgcctggaaaccgcgagacgaatcttttgagcctaattaacccgtcattaacttatgtgggttactgtagcacttatggctaatcatggactaattagacttaaaagatttgtctcgcgatttcctctctaactgtgcaattagtttttttatttatctatatttaatacttcatacatatgtctaaatattcaatgtgatattttttaggaaagaaaatttgagaaacttgtcgtttccgcagccaagtccccgttgcccccacggggtcaccgggtgggtagtctcttctctgtcaaggcaccggttaaatgatccacgacagacacctggcgtcacacctttcaactttcaactattacatgaccacaaaggatgttgattttgattcgtgaggggataaccctcgttgtcttgtctttatgtcagtcaaatggttataaaaaaatttgaaaagatatattaacatgtgatatatcactccgtaagttcaaatttaacttctatatcttgtaacggaaaaaacaaatttaattgtaaatatacgttaacaagctgcggtttaatttgttttttcgttatgagatatagatatgaatttgaacttgtaagcttgtggagtgttatatcacatattgatatatcttctcaaattttttcataacagttaagtaacatgcaaataggatatcccatgcagtgatcaaagatagtttccctgaccacaaattcattcgctccggcatcaaggaattctttgggtttgggcctgcacgcacacaagaggagagagacggggcccaggcaggtggtatttgggccattccccgtggtggtgtctcatccttgaataagttcactttaggtccctcaatttgttgtcgtgtctaaaattcatccctgaaacacaaaacgggtacaacgcatccctcaacctataaaaccgtgcaaacaaggtctctcagcagtattgtccttggttttggcctacgtggcttctttgactaggttttcatcccacatgacattgacgtggcgcttatgtggcaattcatctagaaaaataataaaatatgtggggtccacatgtcagtttcacacacaaacaaattaaaaaatggtggggcccatgtggccccacatgtcatcctcactactccctcttctctctatccctctcctctcttctctgtatcgtctctctctccagccggcggcgaccggagcggcgactcccggagcaagctggtagagcagggcgggcagcggccggaacgggtgattggtggggcggagcggcgacggacggagcaaaggggcaaagcggggcgggtggagcagagggcaaaggggccgcgggtggagcggcggggcaaagcagggcgggagaagcggcagcgaacagcggagtggagcggattgtcgtcgtcatgtaactggcctaccaatgtgcccacaccgacgccagcggcatcatcctgctcctctaggatgacatttcaatgtctccgcaagagatgaaaaaatcccatctcatgaggacgtggagacgattaatttggcggcgacgagctcccgggcgagctcgtggacacaacactggtaccctcgcacgagctccacggcctccacctccgcctccccgagttgcacgcacagcgccacagccgcttcagctcggcgcgccaccgctcggactctagctccgaccacaacgccaccacctccgctctagctcggcgctccgccactacaggaccttcacctccccctcctccttcgcgcgccttcttccctctggcgacggcggcgatgctgacgaaaatggctagtgccatatatgaatcaatcgagcagcagctatgtcgagatggcataaaaaattggccacagcaaatcaaacttgctctgcttctgcttggtgattgattgcgggtagctgtatttaaggacgagttcgtggctgggaaggcgaccagttcagtgcacctgggacatgagcggttgcagccctgctcgtgcagcaccaccgccgtcgcccactgccgctccgcctactccagcagcgccaccttcccaccccgtgctcccacgtcgctgccggagcaacgcgtggagtggtctccttcgacgacgccggaaaatggatggtgctcgccggcgaccgctcgagctcctcctccggccacctcgaggaggcgaggggggtggctgctctcgctctagccggctgctggaggcgaccgctcagcgacatggccggatgggcgatggccccaccctcttttattattttgtgtgtaattgatatgtgggtcccacagtttttaaaattattttttatccgattgccacgtaagcgccacctgggacgagacctagtcataccaaccatgtaggcgccacgtcatctcaaaccgggcacaatactaccaacggacctcgtctgcacagttttggtaagttgggggatgcgatgtatctggttttgtagacggaggatgaaaatcagactgggcgacgaattaagagacctaaagtgaacttattcctctcatcctccatccccgctgcttccggcggctgccgccattccatctcccacttccccgtccattgccatcaatcctcacgccaagctagctatagctacgatggaacgcccttccactcccgactccggttgggtcatcctcagcaccatcgccgtcgccggccgccgccacagcaataatggtagcaccgccattaattggcaccaccaggaacggaaacaccatcgatcgaggtatgtatccctctagatctctcgcccacccaccaccaaatccctccatcgtcttcgtgcacagctccgacatgaaccccgccctgttcccgaccatcgtctgcgaggccggcgacgccctcctcccctctgtcaacgtgcggtccgaaccctactgtcgctccgacgaccgcgcgactacttcgtataccgcatgccgacgcggcgacgcctgcccgtaggaagcctgatcgtctattgggcctagaacctacaactccgtattgggcctatgcttgacaactccctattaggccctcctacgcataacccgagcccatctaagggctcatttagacttttagagcccaacacaagcatcggacgtgacaatggaataagttcacttagtgaccctcaaaagtgatcgaaatctaatccatgaccctaaaccacaaaaccggatatctcgaccccccaaatcttaaaaccggtgcaatttgactcccttagcggttttagagggtggttttgctgacgtggcgcctatgtggcggtattgaccgggtctcctttacacgtggcgttgaggtggcatttacaattaaaaaatatgtgtgggacccatttgtcattgacagaaaagaaattgtgggacccacgtgtcccatctctctctcccctccctcctcgccgctccctctctcccgcggcgggcagagatggcaacgatcggcggacgcgcgggcgtggcgcggcggcctgcgagcggcggagacgcgtgagtggcagcgccaggcactggaacggcaacggcggtggcaatttccctcttggtttgggccctcctctccctaggaggcccagacttgaattgaacacaagtttagcagcaccaacacttgtacggaataaactcctctcatcctcagcaacaatacgggaatctaaattactttcgcagtataattctcgtattgctcttttgattactgtcgaagcacggcccaggagtgaacacctccagcgcagagccccgtagccatcgagattgcagtaactaacagtgctactttgcctttgctgaaactgacagggacagtttaactcttctgtccgtccaatggtaaaaactagagagagatacgtgaggtaaaactctactgcctgggtatgataagtacattgagaggtaaagtgccgtgcgaatttaaccgacctggacccgaatatactgccctgaaagcctgaacctgcagtgaaatggttggtctttgaccattccaacggggtcctatcttcagaagtcacccgtaacattggtgatcgacaatcaacttttagtattttcgtcatcggtgacgtggtggttgctgctgacgaaagcttttacttttgataagtatgatgagtacagtaaataagcaagcttaacaaaaacgctgactgttaataagttgaaaatcttcagacttgagtttcagtctctcagactgcatctttgcctcttcctgaaaaagtatgtttccagtaaatctattcctcctttatatgtgctctatccataatccatccaatccgtccttttcaatctacagccgcctagcctagattatactagattatagtacttggaaacaacttctttgctaatttaagaacagaagatgaaagtttgccgttagactgcatgcatgctccattgatattacacctacttcagccaagaagtaacacatccatgcaatttccatttcccagatcagagccagaatctattgcatttgatatcttctacaatcctgtatactagtagtatatcaattggctacagtaaagtattattgttctgtatatctagtaatctttaattgtacaacattccctctctacggtgtaaagtactatcaaggctccagcttgcttttgcactgtgcctgaaatgaatacgtaggagaaaaaatcgcatacaaatgcctaattgttcaatactacaataattctataccgtaccccaatcatcatcgtcgtccatgcttccatccgatcttaatatcgtcggcaagattgttcatgccagtacgtagcatccgtaaattcgatcgactgcgtttgatcgatttccatggccattaattaagctagttaagaatatattcagaatagctgaggaggaagcatctggtggttgagtccggcgaggactgacgacggcgtcgcttgcaagccgcccaccacggactgcggcgccacgtcgaagcatgagccgttgagcctcttcgccggcgtgtggccgccgccggcgtagtctccggccgggctcgccttgcgcttgccgccggcaacggtggccgtggacgccgtctacgggttgcacttcgcgaggaagttgtccccgacgccgaggagctggttcagggaggggtggacggcgagggcatgctgatggtggtcggccggcggatctgcggtggcgtcaaagatctgggcgagcgcgtgctcgtcgaagagctcggagatggaggggatcttggggagcttggggatgagcgtggcgctgatcatccgctgcgcgta

SEQ ID NO: 62748 - DNA, 5498 bp, Oryza sativa
gcgctctctctctctctctctctctctctctctctctctctctctctctctctatctctttctctctctctcgccctctcccctccccggtgcgctccctttccccctctccctaccgttccgcccgcgcgccgggcgcgggtgcacgggaatcgcccgcgccgagcgccccctcccctcgctccccttctccccatccctggcgagcttcccgctcgcaaagccagcccccgcgcgccgtggttcgcgcgcgcgcccgcgtggtcgtctgcgccgtccgcgtggttgccgtccggccccgctgccctgccgcgtctgtcgcccgtgtcgtcgcgcagctccaaaccgcccgccgtcatcgccgtcgtcaccgcccggcccccgccactccgcgcgcaagccgccaagggacggaggcagcgtccctcctccctctgccgcgtcgcccccgctcccctcctcctttttcccgaatcggcaaaagggcaagcccctttctccctctcctttttccccttttcccccgccggcgtcatcctacctgtcgccgctttggccgcgaccgccgagcgctagctcgcgcccttgaccgcgcaagtcggttcccaaaccgacattgccgcccatttaaaccccagcctccctcccttcctttcctctccctttcgtctccgcgccattgccgccgcccccgtgctctgttcgccgtcgccgttcgttgttgcgcgtgtcggaggagccggcacgagcaaggacgcggaagaggacttcggccgcgccctctccttcctcttccccggcccgaggccggagagattactcccgcgccgtcggcctcttgtcacagcgccccgacccgcatggtagtgcctccctccgttcttcctcctcgctccatctcctccccctagctttcggtagtagctcgagtagactccccgtagttagccggcgccgccccgaccgttgccgtcgctcgccgcgtgctcgccgccgtcaccgctcgagctccgtagcacccgcacgtcgccagcctcgctcggtgtagctccgtccaatccgacgctagcatcgagttcccgaaaccgcgtagatgctctcaccgccgggaatcgacccctcgtggcctcgccgccgtttccctcttccctccccgccggttgtcgccgccgtgattcgccgccgtcaagcttcctccggcaaatccgagccgttggctcgtctcccctcatcacgagcaaccgcccggtgtgctagcttttgcccgtatcgccgtggttcgctccgccgctcgccgttgccgcccgccgtccattcgtggccgggtcttcgtctacctcccgccggcccgcgtggcagccacgtaggcgccacgtcggcgccagctcagcctagaccgggtcgagccaaccccggtcagtccctccccgtgcgcgcgttccaccgcgagccgtgaggctgcgcgtgggcccgctgcatccgcgtccaccgcgaaccgcgcgcgtgcaccgcgtccctcccccgcccgcgcgcatgagccgcgtactccctccgcacggtgagccgagccgctgacaagcgggtcccacccgggaccgcgcatggtgagcccggtccaccggctctctctcctccctcccccgcgcgcgcgtcttgggccgctgtgggccgccttcttgggccggccagcccgttaagctcggccgagccgccctttttctcgggccgcgccctagccgcccgagggaagtctatattccctccctctccccttttcttttctttttcttttccaaaaaaaagggatttaattaaatccttttcctttagaccaaaaatccaataatcttagaaattcaatatcttcccaaccgtaaatccgtttgactccgttcaaattccaaaatttctcaaatctcgagatctatctaatggcacgcttagagttcattaatagggctttattttcgccgtttgttgagttgtcccgttttgcgtatagtttcggagcccgaagacccgcagtgcgaggatttcgaggatcaagctccagatctcgagcaaggcaagccacctttgaacatcttgagcctatatttgaaatctaattatattgcttgcaaaatattatgcattgataggattgcacttaatctgttgttccgtctgcaaggcagattggtagacctacctaacttgttgcatttgattcttccattgttaattgctataccatgtccccttgtaaccatccagttgcgcctcgatattcgtgcaccctgtgccagtatcgacggttgccctcaaacttaaaatctgagtaacaacttgggtaaaactggagttttacaaaatacttggaaaacccgacacctgggtcggtgcttgcgaactaaatgaatttccaaaaccgcggaccgggaaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggatttgccggggtggtgtcggggaggacccctgggcttcctggcacagtatggtctgggacctaacctgttgttggtctgggacccctctcgtcgacatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagtttggtttgactactgcttgtgaaattgctgtgtgaaaaggggttcggtgtttgaaaaatctacagctgatgggatcagctaggcccgggtggccgtttgaaaagttgttggcccgggtggccgttgaaaaagctgttggccgggtgccaaccttgtttaaattctaaagactgatacattgcacatactccgaccggacgagacgcactgtctcatccgtgtcgtttgagaagcactcacttagttgtttcagaaaagagttcaattaaaattaattgcaaaaacaccagcctttccttgaagcctgcattaaacacttatttcccatggcttgctgagtactcccgtactcacccttgctctatataaataatcccccccagttgctgaagaagatgaagcggatcctgctgatgaggagttcttccaggagcaagccggctatgatgagttttagggtttcggcctagttcccaagtcgcgcctgtgatgtttggtccaagtcttggcttccgcttcccttttgtaatgcagttgtgagctcgggatctgtccgcagcccaacatgactgtactcctactctataataaagagacctctgttgctgtgatattctgtcttcctgtgataccagcactgtttcctaggactggtatcgattaacaggttaatttggagcgtcacgggctagttccggtcgggactagttcgaggcgtgacagtttgtttgccgcatccactaagataaccattggtgatgggaatatagcgtgattctgggactctgcgtggattgatgggagaagaccaaaggacctcatgcccctagtatacgcaatttctaagaagaggaaaaagaccctgcgccaaggaaaggagaatgatgcctgggtaggtgatttggcactggagacaaacccagtaattacagtggccctttgtggagcagctggttgccctatggactgcagtccacaacgtgcagttagaagaagaagagtcagaccaaatcgcctggaagttcactcctcatgggcactactcggcttcatcggcctacaaagcgcagtgtgttggcgcgcctgacacaacttttgacttcttgatctggaaggtctgggcgcccggaaaatgcaaactccacgcttaacttatcatacagaatagggtttggacctctgaccggcttgcgaccaggggttggcaaaataatggcaggtgccctctctgtagaagagaagatgaaatggctttgcatcttgtcgctgagtgcaggtatacgagacggatttggaacctcgttgcgacatgggtagggttccaccagctaaaaccccgacgctggggggtggcgcaatcggttaaagattggtgggaaaggctggcctctgtgtctggcgtccccaagaagggactccgcaccctgattctactcatcgtatgggaagtctggaaggagcgaaataggaggatatttgatcataaggaagccgcaacctcgtatctcctttcaaagataaaagaagaggctggcatgtgggccttagcaggcgccaagcgtcttggagagatcatcccgcagtttgtatagtgtacagctttccttgttttttgctttttctttacccttaggggttgtatttttctcctgctatattcaatgaataagcacattcttgtgctggttcctttcaaaaaaaaaaagataacatcacttactttgtaatgcaaatacttcttgaaattcttaggagaactagtagtaggttgatcttaatcagatgagtatggttttcaaaattgcggcaactaatttcgtgttagaataaatttataaaacgtaataagcttatgtctattggaggtagatctacatataacatttattttttaaaaaaagtagtatttgagaaattattgaaagttagaattttaaagggaccatcaaatatttatgagtgacgcgatgtgccagctgctgccaaagctcaagtctgaagaaagagtacagtacgcaattcttcaggcctattttagatgggccttactctgggctcatctttgtctaaagacctgtaaaattccagcccatacatgtgaattggccaggattgaggcccatatcagcgaggtacatgacagaattttgtttatttatacattttttattaaaatatttacaaaaatatttttttatttcgaaaatttacaaatctaatcgccctcccaaagggcggcaagggacctaaatgcaaaatttttatttgtgttcaaaccctttccaccggttttaattgcttaaaaactaataatgcttattcgatacttcaaatgattttaaatgaaaaagtgataaactacaaagttatagatctcatcaagatctacaacttttatataaaatttatctccatccaatgtcgtttgagatgtagatctgagattttttaaaatgtgttttatattttgtaacgaatatttgaatatctaaaacatgttaaatgaaaaagttgttaactacaaagttgtagatccccctgagctctactattttgatataaagttttattacatctgactttatataatataattttaaattataaaatcatagagct

SEQ ID NO: 62749 - DNA, 873 bp, Oryza sativa
taatggcgatttgaccgccattaaccgcgctgatgatgggggcgcctagggcgcgaaaatcagggggtcgacctggccatgcccagaatcgtcacccatgccgcctggactcccctacctgccaggcatgcgatgggaccgacggcgggcccgcctaatcgcgcccgtgaacatcgcacgccccgcgccgagtgtgccgctgacaggcgcactaaacgcggggcgtgggttcaatgggcgatgtgatgagtggacgcgagaaacgatgaggcaaccgcaggtgtaggaatcgaggaggcaaccgcgagggcgtgaaacgaggaggcgagcgcggtcgaggcggggataaaaggatagggaggcggagatttcgtccccttcctctcgccgactgctcgcccgcacactcgctcctcaagccctaacgcttctctcgctccacgctattccgtacaccaaactcctcgccgtttccccgccggtcatcatggcccaagacgctagtgacgttgtgctcccggtgtcgcgcatcacggcagagaggcaccttagcctcatccgcaagatcatgccggaggacgccgccatgatggtgggggagtcacggccgcggccgcggtacccagagcgatccgtgcacctcctgtccttcgccatggtggggttgatcctgccattctccaggttcttccataaggttttggatttctacgaaattcatgccttgcatctcacacccaacgccgtgatgacactggccatcttcgcgcacttgtgcgagatgttcgtcggggtgcggccgacgatgcggctgttccagtccttcttcgtcccacagctgctgcaaggcgcggtggtgggaggatgctactt

SEQ ID NO: 62750 - DNA, 592 bp, Oryza sativa
  unsure (1)..(592): unsure at all n locations
ccacattgcctgcagccccacttcggatgtccgacgcgtggataatataccaatccaacagcttgccttgtttggcactatccaacaaggctgcacatggcatgccttggcccggctcccaaaaggggattgtgcagatgtggaacgggacgactcgccttcaggcatgaccaaatcgctagcgactacntgggtggtgactacaaccaccatgaaaagagaaacctttgtggacaacgcagcagaagaagcacccggcgtcacaaggaagatggacatagcagaaaacgaggatctgtggtagaaaaaaacaaagatccatctgcgacgccagtggcaccaccatcgtaggagtgcgaccaccttggtcatgggagaacatgctgaagtggccactgcccatgtcccaaacggcgtacttcttggtgcgcgctgtggtgtcagcacccgtattgtgattgccaccactagcagcgcgtcccctttgagcccttctttcctgcttgtactagttatacaccatcatgttctcaatgtcactaagtactgatgatccatggatcaagatcatttccatcgcatgatatgatca

SEQ ID NO: 62751 - DNA, 623 bp, Oryza sativa
gtccctcccccccataaccctccccttgccctaccgtatgatgttctgtgcctgctacttgtgtggtgttgatgcgtgatttgcttagatctgaagccatgctgctaatccgcgcgaaaatttttgcccccggcgattctggtaggaatattttattgcttcgtgggaatcgcgtgctcccagttctataggagttgttaggttgttgtgctgggtgtatttgtttggaagagaacattagagaaatggccagtatattgaccttggagtgtatgctatctagattggaccatgcagtgttgttaccgattgatcaaggttgtcgttaggggttctaatccaaggcgctgttctgggaatgtgactaactgtcctctatagtgattaatatacaaagagacaaggggatgcctggcgcatttagatatgcatgtgcatttgtgcttcttcgttgagttattcgttacctaaatcagttaggatgctggcaattcatgcccaaatgatgattaccattaaaggatcagttttttgtcagttttgcaattgcaattccaacttctaaagctcattggttcattttgattctgcatcaccatttgtacaactgtggtatgatcctg

SEQ ID NO: 62752 - DNA, 1739 bp, Oryza sativa
ttcgatacagcttataacgccatcatcgggagaactgcacttgtgaagttcatggccacatcccactacgcatatcaagtgctcaagatgctgggaccgaagggaacaatcactatttaggggaacgcaaagctggcggtgcagtgcgacaagcggagcctcgacatggtcgagcaaacgcccaccccacccgccacgtctgagccacctaagaaagtgagcaagccaaataagacgccaaagccagacggcaccatcaagatcgttccgctctctagtgctaaccccgacaagactatcaaaatcgggactacactagatgagaaataggaactcgcgttcatcacattcctccgcgataatgccgacgtgttcgcttggcagccgtgcgacatgccgggggtccccagggaggtgattgagcacaaacttatggtgcgacccgatgccaagctagtaaagcaaagactgcggagatttgcaccagaccgaaaacaagccatacaagaagagctcgacaaacttttgaaagctggcttcattagagaagtacttcacccagagtggctagccaacccagttatggtgcggaaggccaacggaaaatggagaatgtgtgtcgacttcacagacctcaacaaggcatgccccaaggatcactttcctctccctcgaatagatcagttggtggattcaacagccggttgcgagcttctaagcttcctcgacgcttactctggctaccaccaaatcagcatggcaaaagagaacgaagagaagacagtgttcatcacgccgttcggggtattttgctacgttaagatgcctttcggactgataaccaccgggaatactttccagcgtacggtccagggcgcacttagcaaccagcttggcaacaatgtcgaggcttacgtcgacgacatcgttgtcaaaaccaagacaagtgactcattgattgacgacctgcgggaaacgttcgacaacctcggacgatatcgcctcatgctcaatctagagaagtgcacgttcgaagtaccgtcgggcaagctactcggattccttgtttctggcagaggaatataggcgaatcccgagaagatcaaagcaatcgagaacatgaagccgcccacatgactcaaggaggtgcagaagctaaccggatgcatcgcagcattaagcagattcgtcgctaggatgggagaacgaggacagcctttcttcgccttattgaagaaacaagacaaatttgtatggacacaggaagccgaagaggcatttattgcactcaagcgctacctatcaaacccccctgtactcgttgctccccaacctaatgaagaattattcctttatattaccgccacgccatattccgttagcaccgtcattgttgtcgagacagagaaaatacagcgaccagtttattacgtcagcgaagctctccatgacgcaaagacaagatatccacatattcaaaaactgctctacgcagtcatcatgacatcaaggaagctacgccactactttcaagcccacagagtcacagttgtctcctccttcccccttggcgaagttgtgagaaacaaagacgttgtcggccgcatcgcgaaatgggtagtcgagctaagccaatttgatatccactttgtgccgcgaacagccatcaaatctcagatactcgccgacttcgtggccgattggaccatgccagataataagtcagacaaccaaggtga

SEQ ID NO: 62753 - DNA, 1500 bp, Oryza sativa
agtgggcggacttcaaaatgcgcacccaaaatccctttaaataggcgcacccccgacggtgcgaattccaaggaactgagagaaatccccgccggaaatttctaggtccattacgcgcggcagtttttgacttaagttcaaaattcactcgtgaccgttgggcttcaaacggcatgttcgactacacgtcatctccgtggttctcgtacctggaatgataacgttctcgacacccgaagtcgcgaatggtcgcacgagttcattttgagcagaagtcgggagctactgtcagggttacgggtcaggcataccctctacccttcgatatacgttacgtatcgacatggcatacccacgcgtatgcggatatttcctttatgatctaaggaaacctttcacgaaatcaatagacgggaagagtccttctcggataagaactgggttacctacgtattgagctgggtctgggtctggtgtgttcgagtcctactcggagaccaccagacctgcgatataaaagggacccctggggagggcatagaggatcgaatctcagagccaacacaacccacacagcctacgaagccggagcctgcgaggggccacgtcgtcaagagctagtcgaatcaactcgactacaatctcgccggattcgacaagttccatctttcctttgtaacctgtgttttccaccatataatcccatatcaactggattagggctattacctgtcaaggggcctgaaccagtataattcttgtcttttgattacttgatgtcgtactacgtagatccttgtaccagcgtaccccaataccctctatatccagtctacgtacagtggcgcgccaggtaggggcacttggtactcaaggttctactactatgccatcaagcttcgtcgacaacaacgtcaacaccagctccagtcaagcactctcagcttcaataatgctggtatggactcaagtcggcgaaatcgtcttcccggtttacaccacgatgccgatctcaaccggtcctccaatgactggaaacgagaacgcagtggctatgaaccaggacggctccatgtcgaaaaatccacccgttgaaacagagaacggattatcgactacatccaaactcgtgaaggattctgatgcggccaagtcttgtccctccgacataaaccacgggccaacaaagatgacttccgaagttatctggtctttgtgtcctatccacaaaaccaagaaacatacccttcaagattgctaggtattcatcaatgtccgtgctgaaattcgcgcctgcaaagaacgcggaattcagcgtacttctctaactcgggatgtctattgtcctatccacaagacaaagaatcacgacctctcgagctgcaaagttctcctcggcgccgtgaaaactccgtctcctaagtcatacgtccccgttagggataacggcaaggaacaaggagcgactccagcctcagatcgattcgttggggtaatcga

SEQ ID NO: 62754 - DNA, 752 bp, Oryza sativa
tacctcaccgcctttccccaacatgtcgctcgtcgttgagagattgctcgattggcccagacggttcgccagcacccgcgtggaggcggccgctctgatcgacaccaagaacctcaccgcgcatctcatgtagatctcggcaataaccatcatgtcctgcgagggaagtaaggcagaggtccatgatagctccaccgccgatgcctattgtcggaagaagaccaggagaagggagaagaagatgagaagggagaagaagatgagggcaaaacaaacattttacatagtttttctctcatcaattgggtggatattgtatttttatgcgctcggtgtcctatggcaaattaccacgctttcgaagtgtcattaggaaaaaatcacattcttacgacgtctaccagcaaagataataagtttttaagtgtcatgtagcaaattttgcattttgattcaacaatatgtagtttacatgtttccactatatatatggtttgcaatatatattttgccagattatgaacttatgtgagacgtgtgtggtaccagtagtgtaattattgatgttctacttgttttcaaggatgagatatgtacctctagaatatatatttatggagttatgcgctttttgaggaccggagtctagttaattatatacatagtcaatgtttcatttagaatcttcaggctttctagttttacctttaggacctcgcaagagtaacattataggggaaaacactattatg

SEQ ID NO: 62755 - DNA, 977 bp, Oryza sativa
agcctgctgcatcagcatagtcgttcttgagaagattggccaaggccatgtggtttgccttcacctttggagcgcgattggatgcgccaaccccaatggcatgctgaagtagctcgttgtaacggtagtcctgcttcttcttccccagacagaatgggcatctgaacttttcattgcctagactcaccaccggcttcccagacttgaggtccatgtagcacttgtcagcatagtcatcaatatctgcatcacttagctctgactcgtcggaggtgaaatccatggcagacctgagtgacacggaaatattcaggtgagaacattgcattgagctcgaaaacagcactggatgcacctttgttacaaccacagttaaaaaaaaatcaagcaaggatgtagtaagtgtgcatatggcattgttcagaacatcagaggaccacacagaacaacagggcaatggtcattcatgattagaataggaattacgattgcatttcaatttgcatttgcatgacacaacattagacagtgttacagattctctaacactaaatgtgcttcagtagaagaattgaaataagtcagcagcaaaataattatgaaacaagcaacacaaaatcctacagttttgaaataactcactgatgtgtgttcattttgcaatctacttcttttttttagcaagaagggcagatcccctcccatttccattaaagaaaccagcacagaacatttcaggaaccactacactcagaacaagtacaggaaaagtatataacctgagaagacctgataggcaatgccatccccatttgcacccctgaactagcctaagcaacaatccagtaaagttccagcaaacaaaactactgccaatgaacagaggtgatgcaatctattgcaattgcatcagaaacagccctatagaagcgaaactcgaaatatctacacagtccaagtataaatgtataatcaag

SEQ ID NO: 62756 - DNA, 2954 bp, Oryza sativa
tgcatagataagggcaacttatttagttattttgatacatcttaggcgggccggataaactagaacatgatactattcttttacatgtgtgtgtgcgcgcgcgcgtgtgtgtgaaatcttcttggaatcaaacagtaacctacatgtcacttcaatttagacagtttactacctattcttaaacatttttccttctgtatagtttacatgcagaaaaggtgcaatttcaccatttttaagttcataaaattgatttttttatcagggagttttagaagcaataaggataagttgtttaggataccctacgaggcggacattttttgaattcattaatcgctttggtattttgcaacccaaagttctaggtcgaaggtaaattaatgtttgtttagttttttctcatttttacgggattttttctctcctatatttatgctaatcttttcaccaatactaatgtgtttgttggcagtcatgatgaagtagctgctactaagatgcttcttgggaaagccaatcttacaggctatcaggtaattattttaaaatttagaactaattcccctaaaaaaagttataactaattaaatcatgagtaaattcttttcatttcttcagcctgtcattattttattccatgaaaacagtaacctgatgctatcaaacaaatcaatttccatgatataatgtgcatttttgtttacgaggccactcctctctgccatttagcagttgtagtttgtttcatataatagtttttttcccatcatctttgcctgatataaatcaaaaggatattgaaatgcactaatgttggaaaatacaagggttcccataacctttatatatatatatacacacacacttataaaatagtgtgttaacaaaagttggtatatcattttgctaatctatgatctacctcactttttctgatttcaaatttacagatagggaaaacaaaagtgttcctccgtgcaggtcaaatggctgaattagatgctctcagaactgagattttgggactatcagctaaaaagatacaaaccaaagttcgatcgcatgtggctcgtaaaaaatatgtcatgttgcaacattttgctacacaactccaggcagtatgcaggggtacatatatatttatatatattattttacatacaaacactatttctttcccccatgaaattggctttaaggagagagagagtgacttctatccttcaattgtcgaaggtacaatcgcaagatggcggtatgaaactatgcgtagagaggcagcttcattgaaaattcagacatgctaccgtaaacactgtgcaaggaaaacatataaagagatttgttccgcgtcaactactatccaatctggtttacgtggtatggctgctagacacaaactccatttctatcggcaaacaaaagctgcagttattattcaggtatttacaaggttttactttagtcagctatcgtgattattttttttcattttaaggttttaattttaactccataaaattagataattatgagtcaataaattactcatttaatgatgtcatcccttgcagagtcattgtcgttgctacttagtgctctcaaattacaaaaggatgatgaaagccataataacaactcaatgtgcatggagaggaagagtggctagaagagaacttcgagaattgaaagtggtaagagcaattactttctccattctccctttcccctaggcatcaagctacaacattagaaacttttgttttgcaaactccagtgtagcttgtcatcaatctttctattttttttcattatatagttcttgttgttttatttcttcttaatattaaatcttctctatttttttgttcagtgcatgtcttagtgttaatgtggtaagcgcactacaagatactactggaataaaagaagtatgctagttatatgtagaaaggaacttaacagtaccggcaatgctgctacaaactcattatgtaacctagtttgcatctttcatagtttctatcaatatttttgcacaggcactctttttctgccttcctagaattgaacgaagagtaatgcaatttgactccttttatgccttcctagtctaaaaatcaatatccaatttgatttttggtgtgacttgccacttttgcattgctttcaggctgcaaaggaaactggtgctctacaagctgcaaagagtaaactagagaaggaagttgaggagctcacttggcggctacaattggagaaacgcatcagagtaaactagtgcactaaacacatgcactcttttccattaagttatctttatttatagtgcaaatgcatatagaagtgacatgatatttcctatcttttactacaagcaaagttatccatcaataaagaattatcatttaaatggtgtgatatctctaaggcacgctttgacctaactttacataccaacaaatacgttatgtctatttgcagtatgcctctattattatatgtgctacatataatattgattacacttgtccatttatagtaagttgtctccagtgaaaaaaaaagatggtatttactttaattacgaaaagagcatagtcccattgtttgaactaaccaacgtcaaacaaataaaaagggatggagacacaagaagtggaaagatagtttggcagcaagaagaatactgatagtttggcagcaagaagaatactaatgctagtatgatagcaaagtatcaggcattgcataacaccacaaaatgaaatttcgatgattatgtaattcctatgcttttttattcatatttgcaggcggatgtagaagaagccaaggcacaagaaaacaagaagctccagttacaattgcaggacttacaaatgcaattgaatgatacaaaagaattattacaaagggaaaaggaatctactaaggcggaaatggagaaa

SEQ ID NO: 62757 - DNA, 724 bp, Oryza sativa
tttttctttttttaaagcaatgtcgagacaaacaatgttcatggaagaagttataaaaataagcgaaagtgttttcattggatacaataataataaagctaaagatgatatgttgggagctcaacttacatatatttcattgagtgcatatctggactttagattttggagtactcctggctcatgcaaataagctagccttgtcatatcctccacaccacctcggggagattctgtatccttaggataggcacttcccacattaatggtgaccttcttgccagaagtgcagtttactacgagatcattttcattgatctcctctaccaggccatccatccaagcctcatctgggtcctcgacccagacatgagatcccacaacgaaacgactcttggaagcctgtaatgtagtttaaaaaaatattagatggagtatttggagccgatttcatatagagaaagaggagtaacgatcacacacaaaggcataggtatttgtacacagtcctacttgtctacttagatactacaactaattcaatttacttaaaaaaagtgaaattggtggagtgttaaaatggcatcacaatgttctgtgcatagatttgaggataattcagtgagtgctaaataaaaataaaaagtatatcatatatattcgctataatatatgctagcatgagcccatgcgctctctctctctctctctctctctctctctg

SEQ ID NO: 62758 - DNA, 7156 bp, Oryza sativa
agtagggcggcggggcggaggagtcgatggagctgaaggcagcacgcgaggggaggggaggagacaaggctggcgggcggcatggctagggctagggctgccttgccactggaagtctggaagtcgatgtcgatccaatcatccaaccatggggagaaagagaactacaagggaagggagcaccacacccccacccccacccacccacccacgaggaggaagaagccgatggatagatttacccctttttttaactgctacctactcggctactcctatataagcacaagagagaaagaaaagggctagagagctgctttggtgtttcttgggccaagctagtgtgtgcagcaccatcagatcaagtacgtgattcctagtgctttgctgaattactaagcgatttatcaatatattttttccaacaatcaaattagaagtaaaaagaaaaaaataaaatatcagggtttatcagtacttatcataaaacaaacaaatgatattcacgctttaaaacatattgataaatatatgttaaatatttaaaaatgatagatagatttgataaaatattgtagtcggagggtgaactcctcaagcggagaactagaaagcccccattttagttcggcggggggcagcggatgagaatcgaggtttggaggaaggagtgatgtggaggggggtctggcccctcaagaacgatgagacaaaaaggggtttatacaggttcggaccgctaagaggcgtaataccctactcctgtatgtggttgattctgtgaggaacaaagtgtatccgtcggttgaaatccgagagctccctctcctcactaggcctggaccttcttttatacctcaaggggttaccacaggggcccaaaaatccacctagggaagaaggaaaacattctttgcatttattacatgtcttattcctctgacagagaagaccatgcgcacaacatctcagcatggccccatcagatcacgccgagcgacacgggggacgcctacgtcattctgcattaactgcttgaaaacttccaggcacccgttcccaccaaggaaagaataccccaatttaactggagcaggaaattgtccccagtttgtatacgaggcaaagggcttctcatcatggtgatgtgaccagatggcaccgggcacatgccacttgacaggcggtcagtgcgcggtcagtgcacaggtgcactcaccctgccacactggtcattcgagcgtcgtgcagcctatcagccacgcctacacgccacggccgtaggatctgccttaaatgcggttaggtgggcgttgggcgcgcccactcaacccgcacatgctggcggatgcgtggcctgacccctaactgtgaaggggtagccgccgctccaccccgggctcgacccccctcgggggagttccacgtgggtgtttgggggcggcctcctctctctagacatgatactccctaacctatatcaccgacaattgtgcaaatgatgtgagggtgtgatgattggatatgcttgtatgtttatttgtagaattaaataaattgtcgatgatgttgtatgcttgcatgaggttaaatatgtaattattgctagtgggtgatgatgtggtatggttgcatgttgagctttagatttagtgggctataactttatagaaagtatagataaaacaggagaagacgttgttacaacggagccgtcggtgggaaatccacttttgactccctcaaccataataccgtataccttatcccctataactattaaaaccgatgtaatttgacttcctaatcattattcatgatgtggctcattgacctgctccaaccagctaacgtggctcattggccccacatatcagtgcccctcctctctctctcttcccctattctctcctcttgcatggttgcatctcctccggctatggcacccatccctgcaactacctcaacttgaatggcgatgaggtgaacggggcgggttgaatgatgacaaggtgaggcaacccgcaagtagggaggtgaccaactttgatactttgcgcgctacctgcttcgcgaggaaccatgcccacaacggcgtcacagactctatccccaatagcaagcatggcccaaacacgtgcaacacctattgtgtcgtccctgtgcccaatagcgtcgctgggcatgatgtcaacgacaggtgcaatgttgccactgtcgaggacatctttacggcttgggtcatcaaccacgtgaggatgagagaggcgaaagcgaacttcactcccgtcaatcggccctacagcacgatgtctgagctgttacgaggggttggtgctgtcgctaccgccctcgccgctctagggtcgtcatcgccgttgttcctcttgggcaccaccgcgcatatatggtcaatgaggtagcggatctagacacctccagccgtggcttgccctacaacacggcacctgagccatcgccgtattctctcaagggagggagggggggttggtgctgccaccatcatcctcgctgctcccgaccgctacactgttctcccacgtgctcaccaagataccgacaaaagggggaaaaccataaaagaacccgaccgctacgctgtcctcctaggtgctcaccaagataccagcaaaagagggggaaaccataaaagaagtgagttgagtggattcattggggagagaggccaccaccaacaatggcgagttcgtggtggtggcagtgtggttgtcgtccaagagcccaccgtcacctgcctgccaaggctgatagaagaggaggggaaacgaaccgctgccgcagcaaaggagagatgagaaagacaagccacgttagcgaaaaccgctttcaaaaccactaagaaaatcaaattgcaccagttttaataattaggagggtcaagatatcgtattaccggagtcaaaatgcacttattcctccttcatactaatggcatatgggaaggtttgtctgacccaactaaagcccttgagatattacaaatctgcaaaaccaaaatgtacatatgtttggtagatctgaatgatattgagataagaagatggcaatttgtaaaagtaaaacgtagtcgggagctgatgctcataaattagctaagtttgcatgtactacaaccctctttttttctttattgagggtacttgatttgtcgatatatatttatgcaagtacacttaaaacctgttagtcatgaataaaactctgaacttttctttcctcaaaatatgagagagggagagagactgctgcacctttcctctcaaaagctttgccgcatctgcatgggtttttggctatttaagggtcctcctcctcttactactagcaattaatagaatgagagaattaattaataatttttatggagtagtcagcatttttctctcgaaaaacaaaagagaaaaagaaaatcatctcgatctcaatagcactccgaatctggatcgatcgggtcgtcgtcggagaatataattgatcaccatggttccggtgaatttcggggattcgtcgtcgattcccccagtggatgcggtggtgccaatggcaatggctcctcggttactctgcttcctcttcctcctcctgcagctgttgctcttcccccgcgtcgccgccatcgtcctcgccgcaacccccgtcctgcttctcgccgccttcctcctcgccctcgtcctcgtctacagcgagcccaacaacaataatgagcccgatcatctgattccgatcaggatcaggtcgcgcaatccccatgcccatgaccatgcctcctcctgcaccgcctccggatcatcggacgacgacgacgacgcccaagactcggactcggagtcggtctcggagcctgccgatgatgagaaggctgcggtgtggacggcagaggacgagaaaagcatccagaacatcggctcgctggagctggagaggaatgccgctgtggagaagctcatgtcctcaagaagcatgcaccgctactacgccgccgaccgcgacctcatcgacctcgacctcgacggcgatggccaccagctgccccccggctccgctccctccatgcaccgcaaccccttcttcttccacgatgaccaacaagcagcagcgtcaacggcgaagctgttcagccgacacgagagcttcaggccatacttcgtcgccgacaagacgcagcagccggtcgtcctcgagagcagcggtggcggcggctcttcctcgtctttgtcttcgtcttcctctgccagcggcgaccgtgccggccagcatatgaagcaagaagccgtggctgacttttcctccagctccaaggccatggtggtgacggtggatgcagagctccccaaccccaagtccatggtaacggtggatgtagagctcatcagcgactcctcggatgatgacgacgacgacattatgtcgttgcccggccagcaaataactaaggtagcgagcagcatgtcagacgacgacgatggggaatcctcctttgaggtggagagcatcacacgacaggtaaatgaaactttgcatgcccatgctgctgctgctgctgccgccgccgccgccgcccgtgaaggaagagaagaaaaagaagagaagaacaagttggcatcgattgaggaggacgagaggagggagcgcgacgtctttccgtctccgtccccgttcctccggcaaactctgccaccattaatggcgacggcggtggttctcctcctcctgccgccaccaccgccgctcccaaagcagtcgtagcagcagccagatacaagacgccctccaagaaggcagtcgtaggtttcttccgaaaatgaccaacttaattaattttaattagttactgtttcttcttattcttcaattcaattcatcttaatttagccagctcaatcttttaccatacgtcacttataaagaggagggtttatagtatgtcgtagtacactgtatgcaacacgtttgtattgtagtactacgtatgcatgcatatcagaatatgtacagagtagtacagttcagcaagcacgtaggcgacctttctggcttctgggtcgcaaagccagctgcgctgatgattctgattcttatctcacccatgcatccatctctgttctgcatctaatagaatagagcccttgaaagcaagcaaagaacaaggaattatttaatattaatgccttacttgatgcatacgtacctttgcctgataccccttttccagcaacagcaaaactaccatgcgcagattggcatcctcttccaccgtttcgtttggtaggcaagcaagcaaaagacaatccattcctggttcctctccttaaaaaccaaaccaagcgggcctatgtttactgaagattagtctttaacaggggccaattccttcccgtcatcaaacagacagacaaacaaccaacacaatgatgatcaattctgccttaacggctgcttccttccaatctcctcccactttcatcaaactacaagtacagctaaggcctcagaagcgccgcctgcaacaccaacaacagcttctgattgttggcaacaacggggcaataacaataggaaagcaggagttcgtgctaaagcctgtacaagcaacactagggccaaattcaactggtggccgcgggggttcgcccctacccgatgtgatccagcagttctactcctccctcaacgagaaggacagcaaacgtcttgaaaacctgattgctcctgactgcatcatcgacgacaacgcatactataagctgctggacatcaaggttttacttgttcttcattctcatattacagacctacagtatataagctacagcattttttagtccactgctccatatatatattggaaaccgagctatcaagacctggttaccatactcaaaattattcacagcaacttcgctgcatgtagagtacccaaacctacttcaggagactgatggatgcaatgggaaagaatttcaaatttgccatcgatgaggtttctcaaggagtggaacccactttcgcagtaatgtggcatcttggtaagatactgtgtaatacaactcaatagaagtgataagacaatcaacttggataatggtataattatattgcttttacagaatggaatggtaaaaccatccccttcaccaagggctgcagcttctacatatgttcaagaaaagaagcagcacttgttattaggtagttcatataaataactgctcttgggagattttctttgtctatttcaaaaacaatattttttgtttccatgtttcctttgcattcatgttagctgactcttagagctataacgttgcagtggctatgcttcggtttagcctctaaataaataaaaataatattccccttctgttatctctgatggtattctaacacaatgcaggaaaattcatatcttccaagagtcaccagtgaaaccatgcaagttttcactggtaggcatgctaatgagtttcttgtctatattaccatacagtccaactgaatcagaagtataactctcactgatgaaatattccaatgcttacaggaaatactaaatatcgctaccaacttgtttgacacattcccgaatatagctgaaggtacatgcttcatagaatcaactgtttagtttataatgttggtagctaaaaagcagtctaaaaatgttagtgcacatgcaggtttattaaataatccagaacaagcaatacagccctttgtgaggctttacaagtccttcgtgaagcctttcatcgtcccttttcttgcatactatacccacttttggacatacttggctaaagtattgactatgatgctccatttgttgtatagaataatcaaatggtatgtttaaagactagaatgactgaaaagtccatattgtgaaaatagaaattatatacgtaccttatctgtgcacaaacaattacaggtagccaaacaagaaaggggactgtatggggactaccaatggatcagaacttttcagatgatgtcatgtcgttgccagaagtttatcttgtccattctcctgcctagaaagagtgaacatcatttcgtttttaaggaatttaccgttactctattagtataaaactgtagataatctctggaa

SEQ ID NO: 62759 - DNA, 1395 bp, Oryza sativa
cctgctctaatggaaatttaagagagagatcactccgctaagtaaacgagacagaagattcggataaatatgtcgtatcctatttaaaatagaggcaacgaaccgattcaggtatgtcataccctatttaaaatagaggcaacgaaccaccaatccattagagcttatttaatatttaatagtatatttaatagtatatccaacaactcgctccaattaatttatagccaccaatccatttgagcaagtttaatagtatatccaacaactcgttatccaatcatttatacaatagttatttataagcatatattacaccattaatatatagtcctactttttatatacacacaacatattaacgtccgtgctgcaacataagtcgttatttataagcatatattatattatttatggtattaatatatgatcctacttctcatatatacacaacacattaacgtccgtgctgtagctggctataaatctatatatatacacaacacattaacgtccgtgttgtagctgactataaatctatagcccgctttcatgatattgaagtctgttcttagcccgcttccgctttctagttgcccgcttttctctctattctgacgctagtcgaaaaccaacgctttaagacgctatcggagactagcgatttctattgctgcgatgcttaatatgcccgcaacttctattgctgcaatgatgattggaaattgcaagtggtagtaacttacacagcaaaagaataggaaatgcagcaaagataataactagcttgcactgaacctcacacttctgaaagagactcttgatgtttcaactatctacgagaaaataatcactaggtgatcaagaaagtgattatatgtcaggcacagcacacaaataaacccaacatgactaacttctactgtccgtgaagttctaaccatttaagcaggggtaccaaatcatcatctgcagggagcataggcgacatgaatctcctattatacactcaaaaaacataaaagcccaagttctcgaaaaaggaaaaaagcagccgccaaaatggccgcgataagacgtcaaaatcaaaggcttatgttgtgtctcatgtctcccttcgggacctccggcgtggggcagcagctccatccttctcttcctcttccttctcgtcctccttgccaccgctgcttccagctgcttcggactcggtagactttggttttttgacctcggctacgggcttcacaggagcctagggaatgcaaatcttacgatcagccattgttgtttaactaccaaacgaggagagcggaagcatatgtatgttgtgagagtaacttaccgctggcttcttgccgccgaacaggatcctgaagagcacagtcacaaaga

SEQ ID NO: 62760 - DNA, 5794 bp, Oryza sativa
aatgagcttgagtaactgaagctgttgcatttctataaacatccaatctggaagtgatgtcaattttgtccctgagatttcaagggttagcaagctagataaagcagatatggaacgaggcaattcctcaaggttggagcacatggaaagcaagagctcttccagttttatcatatcttggaaaagatcacagggaaaaatgtttatgttgagctgagtgagatcaagatagagcaagttgttcacatggcatttgtcatttggtgacagagtgttgccacgattggagaaattgcataggcttttgaggttagtacatcctctgagagaaagcaacctgagattaaatagatgccaaactgaaggagggagtgattctagtggtgtataagaaaggtcaagaatagaaagacaagagagtttaggcaagatgttgtcaattaggttaagcaagcttggtttgtgtgagaaatgacttagaagaagtgcggttgtgccactagatacttccttgttggttatgcattttccacttatgtgccatttctgatcctccgttgtctgctcacaaaccaacttgatccatcccatgttctgcaaacactgctcctcatgaaacatttcgtcttcagtgagatggtttataacgagaccgtgatatgctaagaagtgtgcagcagtgtcagtaggctcatcaactttagttgctggagcaaatggtagctttagtaatgaatactccagaaacgtttggaggatgatgttcccaacttgatatacatcatcatggtgcctgatgcccacattgtggatgttgtcttgaactgctcttggtggtttgctagcagtaaggaagccttgggcagcccagtgacgaataagctcttctttggtaacattaataccattgttgttatctgcattaggtggcgcatgacattgtggaaagagaagcagggcatagtgaaaacaccggagggcaacgcggtgccagtgctccacgtcatcctcctgccccactgccttggagatgtccttggctgattggtgcagcgcaaagaggataagaaccatgatatcagcaccagagaatgactcatacacgtcatcaccttcggacttgctcttgctacagacttctcgggaggtggcggataccacccattcagagcccgaccatgcattagcaggaggaagccgcaactcggttgtgaaagcactggtcgtgatgggcttgtacaggttctcaaccaccagcaggtacctcttactgtccagtgtggcgttgatccgaggagccatttcccaaaacaagtactcacgcatttcattatcccccgacacaccccaggagaaatagtttgtctcctccatcctttgcttgagcctgtggtattcttggtcgagcagccccagctcctgtgccaccgcggcgaccagctgcgcctccaatctcatgacgaagctgcttcctcctcccactcgtttttcctctggattgatcggcgacaccttgattacttgatcaaactgtatgttacggggaaacacatccagagcgagccttgatatggcccgcgtgaaggaagctgccggcccaaccccaacattccaatgcacgttattatcccggtaaattttatacgcaagttttgaatattcgtcagtgtcacggtagccacctagcctggtgagatagaggcgagttaattaattagtactgtgcaatttagtatagttgatttattagtgctgaacgatatttactgttttctatccacatatatgcatgcgtgcggccggctgcaggccagatatgattcagcaatatatatatccagtgcatgcatatatatatatatatatatatgcaaagcaccgtacgtccgttggcccgtttcgtgcatgtgtgctcgcttagcagccttgtctacgtaaacaaaataataataactaggtaacccgcgcatatttgcacaactagcattattatattttttttctcatataatagcttaaagaatttcatattttattatagaacatattaaaatggcaatataattttaaattatgtactaacttgactctacacttttttttccaatactcctcatttttttaattcctaatttcagttatttataaattgtattcctatatagactctagactcttctcccaatcttgttttttcaaaaaaaaataaattttagttatttataaattatatttctatatggactctaaactctacttataatttttattattctttaactccaactttcaattaattgtaaattcctatatggactctactcttccaatttttcttatttttaattctaaattctattatttctaattgtatttttatatggatgctaaactcatcttcaatattccttatttttagttccgaactttagttatttataaattatattctatatggagtatagacttatctgtcaacattcttttttttaatttccaattgtaattatttctaaattgtatggactctaatcttctcttcgaatatttctttttttaattccgaattttttctattttaaattgtatttctatattgactctatttttccctttttcttcgattaatgtgagaatttttaggccgtaagagcgaacatggtgacttctttttctaataataataataataataataataataataataataataataataataataatagtggtagtagtagtagtagtagtaataaggagccagctactcaaattctacattctacaaatatacagtagaacctctcatagcattttttatgcccaaaataattatgatgagtccaagataaactgtaatatgtgttttacgtgcatatataaaaaaactaactcgcgcgcttatacggccaaaagacaacactatgtacaagctcggattttcactagcgttgattttgggacaaccaacgaaaaataatccatccgatcttgttctgcatcggcatatttgcaaacgaaaaataatttatgaataaaacttttatatacgtattcttagaggctaaaaaataaacttcgataaaaaaaaaccctaaaaccaactccaaatttaatgtcgaaaatttaaattttgactgataagcataaatataagcgaaaagatgaggccctttgacaaggtatacttatttgaatttgaaacaagaacatatatactcccttcgtcccaaatcgcgtccccttttatgaaaatcaaactcagtagcttttgattaataatcatactaactatattcatgctaagtattatacatgttatattattatatttatattttgaagtactttaatgtgatactaatttcatattagttaaaaacataacatagaataaattatatattgatcaaagtatgttattgaaaatcgtataaaaaattataatttaggacggagggagtgtacttaatgatgagcctatatgtataaatatcggtgggtagatttcaagcattgaatcaaaagatctttgcactcgggcgcatctcacatgaatacattatagttttgcccatttgccgtccaattgcagtgagcaggggcggattcaggaaaaaaaaataggggctcagttacacagtttcttcaatctacaactatttaaggacctttagtttatcattcatggtgaaaaatcgaaggggttgttccgggggtatccatgggtcttgtgggtgtagaggggacttgagttcccctgcacccacattggatccgcccctggtagtgagtattatttattacaaacttataataaagaaagcttgtgaggctaattagttgtgcctactgcctgcctaatataaaaatcctctaaaattttaccatcagttcaaaatactaccgagatatgttagataaactatatgaagattcatattattagattcacaattgattgtagttctataatatttattgtagtttttttacattatagttgtcaatgttatatataggagtataataacttgattcctaaaaatgaatgtaggacactgaaatgacaaatcgctgaaatggtgacgattttttttcttaaaatcaaggtacgggaattgggaagctttgtttagtcactcaagtttcaaccgggtcaatttggtccctaatgttattatatttaacacgaaaagctttttttttaaaaaaaaaacatcatgtgaacccacggggcctcgcttggctattggctatatattaagttcgggcctgtttactttgataccattttcaatcttaccaaattttggtaaagttgctaaaaaaatagctatatttagtttgctactaaattaaagtgtacatgccctttattttggcccagtcaggcggtcataaatgacaatatgtttcttgtgatttaggaaagatctttgaactaaaatcatctatgtaaaaataatctttgacttgcgacaagtttttacaaaaaaaaaatggcaatatgaagatcaatttttctgtacagtttgatttgcataatctaattaactcccatgaacttaccttctgtgtccgcattgtagtaggaaaaatagttgcattaggcccttcacagtgctcctatgtggagggggtgctatgtctacgtggagggaaaacaaggtgggacccatagctacggtgggttcttcgcttctcaacaaaggaacgaggtgctcggccaaaaagccaggcgcagggcccactcgacgacgaaaaaagaacgacgcagctcatgcgtcgacggatgccgccgcgagcagatcagccgctgccaccaccatcgctcggaacccgacgccgtcggggagctcgtagctgcgccgccagggagagccggaggctgccgccggggagctctcggccgcgccgccggggaagcctgagggcgccgttgccgctccacgtcgcgacgaccctgccgctgctcccgtcttcgtccgacatcggtggtcgagggcgccgccgcacggccgtcttcccggcgccgccgcacagccgtcttcccgccaccgccgtcttccagatccgcgccgcgccgccgtcttcaagggcgccgccgcacggcccggaggacgccgccgccgccgcccggcccggaggagaggagagccggcgctggcagagggaggaggggagccggcgtcggcgaagggaggaggggatttgggggaggagaaatttggggatttgccggtttgggggtagttggggatttgtgggtcccactagcagatatttgtgggtcccactcagtgcttgcactgtgaagagagggtcttcatcctagctgtcaggtgggtgcttgcactgagaaaggccttttagaattaaccagtaatagctttgaaaatgcagtttaggctagcagagtaaaaaacaagaagatatcataatagctcatcacattataaaatattaacgtttcgccgcttgattcatactcattcgatgcttctctaaaatagagaaggagagaatttaatgataacatctcgagaaggtatatatgtacatacaagaaagttacataccagaatttttcatgcttcaaacgctcacaccatttgtggaagaaaggtgttcccattagatacaattatttatggtagaaaaccacggtatccacaagacctgtatgcaccaaaagttatttgaattagtcgcgggaagtgattacaacatatttttgcattggaagatatagacacttttcttatatgtagaaccctctttcattttg

SEQ ID NO: 62761 - DNA, 768 bp, Oryza sativa
catgcgattgcggcgtcacgatatgctggtctgtgtcgtggaccctgtgagcgtctgttttttttcccttaggtagtactagtacacacaacgctaataatcaactagccgttgcgatgtggcttactttaattttgttcctgctcttataggattatcgtaaatatgctttaactaaattgcatttaaagtttgtagtatatgttgatcctgtggacgttgccagcttatttatatatgagtagcctcactacctgttcctcgtgtgaacatatcgtaatggcatccgcgtgctcccctggacagcattttgtgtaattccttctgtattgacctgatggtacatgaggttatttgaattttgaaatgaagaaagctgtcatgtatgctgttgccacttgtggcgttttgttctttcatctttacttcaaaaattctccatatgctaagtcgtgaaattgaaaggcatgtctagcttgtacagtttgcagtaaacatatctacttttcattttatctgccagtgtaagattacgctaattttctacctcaattaaaaatttatgttttttcaatcggttctttatagcgcacataagatggcttaaatggtgatgtacttactgtggtttgcaggtgtatggaagcacgaaaagagtgatggacatgaagactatggcctgcttgttagtgagaaggccaagaaatatgccataatcaaggagcttgatgagcctgttactttgaaggatgggactgttgtcctgca

SEQ ID NO: 62762 - DNA, 5838 bp, Oryza sativa
cgagaggcgtcaatgggcttcggcatactttcttctacgagaaattttataggaagattacactggaaattttggtactacctccaagtacttatttgtagtactagaggtaaccataatttctagaataaaatttggtatctcagtagctcgaggtaccaaaaaatttcattaagaatggtaaaattacccttcttttaatgtttgagcttttacccaatcatcaaaattgagatgttcttgtccattaacattattactcctatgaattctaatatgactaaactaccatgggcaggtaattctaatgagatttactccggtccaacaaaaagtacctcgaggtaccggtacctcacggtactaaattatttctaatcgttagatcttgttgggcgggatgggtattgttagatccaacgatcggaaacgatttggtaccatgaggtaccagtaccttgaggtactttttgttggaccggagaaaatcttaaattctaatatgtttttgaagttgtattttcttcaaacgtacacacacatatatataagattgataatttgaagttgtattttcttcaaacatacacacacatatatataagattgataatttgaagttgtattttcttcaaacgtacagatatatataagattgacgaaataccctccttggcgatcgatcgatcagagatcttaccaggttgggcgcgatgatgcacgacagcgtgacggacatctccggcggcgggatgacctcctccgccttggatgtgtccatgatcaccaccgtatctcccgacgggacggacttcactttccccttccacaccggcgccgccgccggcacggcgccaccggtcaccatggtaagaagctagtagctagattaggctccctgcaacgagataagaattcgttaattagcaaactaaagaacaaggtaaaaaaaaaaaagaaggcattcatgcaagcattatgtttgcgtgatcgatcgatcgatcgatcgatcacgcagatcacagcgattctagaggtgttatgaggctgcactcaatcgattaaatttcaacttatcaaattgcactatacattggtaccaatcaatcgattaattacgtacaaagatcaagttatcaaatctgatcgatctggaccaaattaaacacgtacgtatatagatgtggatcaagggaagattttatatatggtaatcgatcaaaagaacccaatcaagaccaaattaaaagaagggcatgcatatgcatgtaagtctctaaaacctaattaactaatccaaggagaaagaaaaaactcaccggccgaactagatgcgacgtcggcggatctcgcgagtgcctcgtactgtcgtcgagggttttgggtgtctttgcgagagaaaaacaaaacgggtaggggtaggatatatcggttgggcggacgtacgtacgccctatttgtaatgagattacggttgtgtggcgctgttggggaggaagttggagtcgtgtccagagtccagagatccgcggcttcgttggcactcgtatgcgttttgatcacgtccgtcccctgtatggttttgatgactttcgtccggggctctgagccctgattttttttttcttttgcacatgccaaggcattttcagtttgttgacactttcaatcttattaaatattggcattgctaaattttgataagacaataaagtatacacacttcaaccattattatctcactaaattttagcagttgtagaagcttcttcttttaaaactctaccaaaatttgccaaaggtatcgacacaaataaagccaacactgtcaaattttggtaatgccaaaatatgctaaagttttattacccaaatgtgaaatggtttatttgggcaacaaagtgaactagcccttagtcctttttgaaagcttgttttacaaatagacctctaaaaaaacttattctgaaattagactttttttcgcgacagtaacatcattagcatcgtggtctaacatgacggcgtccctagccaccccatggaagctaaaccactcatatcatatatgaagcctatgatgttggcaccgcgaaaaaggttcattattgggataagttttacaaaagatccatttgtgaaataagttttcaaaagggaccaaaaagtgaaaaaaaaatctaggctctctatcaccgatcgatccatcggcccgcagctccacaccgcatctctccaggctcgccccctagcgatcaatctctctagcgcacatgactcgcactcgcactgccacccccactcaatcgatctgggcacgctaactagcacacgaatcacccgagagtgaaggaggaggagagagcgctggtggaggacaagcacgccggcgtcatcgcgtcggcgtgtgtcctagctggctcagtactagattttttttttttgcaagcggtctaaaatgatcttccgaggcaaacggctaatccacctgtaggcaaaagcctgcgagcatcaagaggaggaagagctcgtcggtgttcaagaagctagctagttcgtcgtcctctttcgcaggaagtgcacatcgaggccctaccggccgtagctctttcaacactccgcacatcggcctaatcaaagtccgcatgaagtctagggccgttttgtatactttatcttgaccatggagaacgcagatggaattatctggaggagtgcttcatttagtactacctccttctctaaatgtttgccgctgtttagtttaattttgagctaaccaacaataaaaataaattgagggtattatacagtaataaatgcatatgaacatgcatgagaaaaataatggtactactatagtactccactacaaacaaaccaccacgatttcaatttttcatttagattggtaataaaaaaaaggcccaactagctttgacataaaggaatcccatttaaggaccaactagttctcttgaacaattattaaacaattaatagtgactaaattatatatgagaggaaataaatagaccttctcacacagctagctacaacaactatatagtaagagatttaaaaccttggtgctcactttagtccagtgatgagtccttcaatgcaccaccccaatgcgcggcatggatcccagccacaactgatcgacgtcccaccgcccccaccgctgaattgcgttgatcgtcaagcctatctgcaagctcgcagttagtgtcctaaatatgggacacccaatacttatgcattaagctcagcagggtacaccatatatatactaagtgttatacgggatcaagccacatacatgaaaggtgttttggataaggaacaagaaatagagtatcatttgggcgctacaaggtctatttggatcgtatccatacttcggttttgagagatataacctgaccagggtacgttccgaattcccctccagatcagaaccctcatcatcccaatcttcatcaagacattgctgctgtggatattccggcgaaggatacttcgatgatttcggatctgggagacatgacctgaccagagtgcattcccttatagattggaaccattgtcatccaacaatttgattcgttaagatcaacaaagcacgttgccgctgtggaaagcaacaatttagtattgtcgacggtgaggccttcgcgtagatcgactagtttcgaactaacatacgccgccaaaaaaatccgatccgtctgacaattgtgccaaagtcttcagatctttgttgcaatattgcttactactacgagaacccatagacaaatcgaatcaccaagccatagccacaaaccacactgataaatagctaggaggagatcaatcgctattcgtcgacatcaaatcgccagattgatcgtagttagcgggttagaaattagaataactaatatgctcccctattgtaatgcgtgtggtgaatgccaaagatatatacatataaagtagagtaggattattactcatcttaagacccaaaccactattaaaatccttgtcccctatctacttaatgtactatctcacgtataccttatatcttcatattctataaatattgttgtcatatacaatcatttcgaccttttttccaacttctactctcttggtttaaccagacatacacttccaaattgttacatattattttttatgaaaaaatcccatataaaatttattttagaaagtcatattaattatttttaattttttatttagttaatatataactaattatagattaataacttaactcattttctgtcctaaaagttcagtttaaaaggaataagttattaggcatgtttgagctggagctagaacttaggcaaatagtttcagctccacctataattggaatggagttagattaagcactcttacaaaataaactaaagaggtggagctaggtttacatagcttcacaactctgctacactcgactcctgatactaaattagctctaacctaatcttccaacacagggctcgttgacatggccctagtggggttggttgggtgggctgtgtacgcggaagagaccgaaccaaataaaccgcaccgcagccgtactcctccacgaaaaggcgaaaacgaaaccgctcaaccgctgctccattcccctccttcgttcccccaacgaaattgagacggaggtagtactaaaaatattgagaatttgagataagagggtggaaatctctcccgtctcgttcgtctcctccgcttcgctcctttgcgccaagacgcgtcgcggggctgaacagggagagaggggcggcgatctccatttgccgagcagagcagagcagcggaggggatcctggtgagcatccatccacatcctctttctttctgattcatctcgctcccaccgggactacttttgtcttggaatttgcttgcgttcggttcgttcgttaaccctagctttctcttctagatctggaagaagctctcctcttaatttcagagccttaaccttaatactactactactgcaagtaacagtttgtttgttcccccctcaaaaagtttgggggttcaactgaacccccccatgtcccaagttggatcatccgccccctggttttgactaatgagatatccgttcgattccctgataaataaaccctattgtgcatactgaatcacggactaggtggatatgtctaattgagagccgtcgtaagtccacatggacgagtagttttgaattggtcctcctgagctatgtaaatgtgggttggtgttcctcaaactttgctgccaggtgatggtctaagtggctcatatgagttcaagtacttctctgctctagaaaatggattttgtactctttagcttggtgatatgtgttaatctctacaattatcatgactctggagaacacagatggaattatccgggaaagtttcattcagtgtggtggtcattaatgcatatgaacatgcatgagaagaaaaaaatgttacgatctataataaggctgcgttcgataggatgggttgggaacccatcccctccgcacggaaaacggagctgtccattagcgcgtgattaattaagtattagctttttttttttcaaaaatggtttaatttgattttttaagcaactttcgtaaagaaactttttgcaaaacacgcaccgtttagcatattgaaaagcgtgcgcgcagaaaacgagggagagaggttgggaaccttgaggttcgaacgcagcctaagcagttattgtcagtaaacctgaatatgctttaatttatatcgtagtaatgtgggttctattcaaaatatt

SEQ ID NO: 62763 - DNA, 5994 bp, Oryza sativa
ttcctatttttagaatagtgaacagataccgactttgtcacttacacctacacctaacaccataagttccacttgtgatacatactaagaaagatagtacgtctccagaaacaggagatgtccaaatgagaatgacagtgcagggatgaaaagaaaataataccaccatgtggaacagttgcagaccattcaagcaacagactttgtcataaaatataaaaaatcatcgtaacaatttggcaatggaattcagaaacacatcgtaccccaaaacgaagtgttggatatgatgtcaactgggaaaatattggcccaaaactctgtgccatgggaacaattacaggcgaaaataatggaactgccaagcttgcttcctgcaaaagaaaaagaaagaagaagaaaaactacaagtaatattctactagtagcttttaaaagaattaatagattgaacggaacaaaaattcttttcgctctggttacaatagataacatcattccgtcctaacatctaaatgcaagtgtcttatgacactacgatttttgtaccaaactaacagagccgcatcacatgcttcgcagctgatgtacccgctccatgtagattgaagcgtacaaaagttcttacttcactctgaaagttgcattactatggattaccaaatttaaatatctactcaatgaggaatgtccagttatccacttatcttatcaagagatacaaactaaagcaataaagtatggatccctggtcatctacagtgtactagtatggtctttacctatatgtatgtgtcttccctaagccatgcaattttctctactacttcgaaaggacagtcatcctccttcctccccttccaatctcacgtataaaaagcgctaaaaaaagagaaaaaaaagtgccaaaaactaaccaactgagaaaaaaaagaagaaaaccaggaaaagaaaagacgattagttaacgaaaaaaacaactctgtcctccccatatctgtcccaaaaaccaggaaatgtaatctctgcctcctaaaaagaagaaaaaaaagaaggaaaaaccaggggaaaaaagaacaagcagttagtcttccggtgctttactcgatccacggtcccatccatcctaatggtatggatatatcctcaattaaataagcccattgcaaagcatgggattgttactagtgttaacaaggaggggagataacacgcaaaaaacataccttattgttaaaggccatcaatatatttccacttcgctgcacagcgtatcttgatcctaatagaagcaaacatcagtgataaaacaacatattacaccgctaactgaacaagcacaaatttaatcttacataaagaatacttcatagcccagaagataaatgaagggtgtgtttagtttacgctaaaattggaagtttggttgaaattggaacgatgtgacggaaaagttggaagtttatgtgtgtaggaaagttttgatgtgatggaaaagttggaagtttgaagaaaaagtttggaactaaacaaggccgaaatatgcacttataatctcgtaccaatgagaaggtggatcacagatcccaaagaatgcccaacaccaaatgtgggaaggtcatttacctggaaaaaaaatgtttgcttagtatattggacaatattggagttaattgttatgtgaaaaataacaacttacaggttcaaccatgtttcttaagcacctgtcaaacttaaattgaacttcatctgcgatgaagaaatgatcaaagccgctagcatatggcgttgcgatcaccaaagctcccctaaatttcaaatagactgataaaatacatgtctgctagagaagtggaatatgtagaaagatagctctataggaaatcataatagcagtgtaaaccgtgtagagctagagctaagaagtactgtatcattttcttgaaatgaagatgcagttcattgcttgtaatattatcaaaggacaaactttaaaaatgattgttgtttcactaactttttgatagattgaacatgcgtgtcttgcttagaaccacataaagaggtgccttgcagttaataatgacaaattacacaccaaagctcttattctctagattcatggtcaagcaatgatgcactagttaaacacacaacaaagggagggctaaattttcaaaggttgcatttcgggtatagaactatagtcaactctccagcgttacgaacaaatcaaatgccgcgctgtttcagtctttgagcagaattagactgttgcacacagataattttgggtcattgggcattgcttgtccacatacttgtctgcaagtcgttcaaggaagaaacgataagtgatctgaggagcagctccaacaaaaatcccaccaacgaagtgaacaacgaacgagggctcctgtgatttaggcttcagcacccacgctccctatcagaacaaccagtagtaagtaaaatcactctgcatcaacaacagtagcaggaaaattttgcactctcaattgaggtcgcaatcaccgaagcgcacctcgatctcggtccaatctccggtcgaaccccagccctcccgggactgcttcgccgcctccgtgatcaccctgttcgccggccgcaacaacaaaagatgttatcaatctaggagagagatttcgcaggcacggaattagccatcgcctacctctcgatctgcgagtagagctgtatcgatccctcggacggcgccgggggagccgacggcgtggcgacccggggcccctccccttcctcagcagagcagcatgagatggcggcgcgcctcctcctcctactcttcccccaaccccaactactcgtcgccgcaactctacttcctcttcgggaaccccagaaacggcagaccgcggaggaggaggagggccccggggtgccgccgccgccgcgcagctgcacggtggacggaggcggcggagacacaacccttatcatcgccgccgactcgacgccaccacgtcgcctcgctgcggccgtacggactccgcgcgtgccgtctccgcttcgccaacccgccccgcgcccacagcgaccgcgagagtagagctatcacgcgcaccgcgaccgacggctcggcgcggcgcggaggcaagtgtacactgcccgccgtaggatgccaccggaagcgaacgcgcgcgccgtcggattcgcttcccggaaatggacccgacccgtcgtccacgcctcgactggtcaaaaaacccaaaagcgcctcgcctcgcgcccgttgctgccttacacagcacaccacactacccctatactactagtagtagcttgcccctgcgcttgcttgtgtcgctgtggctcgattgcttgcgcggcgcggcgatcgcggccgatctatcgattcgatgcggccgtgggagcggcgtggcgtgggcgcggagggaggcgagtcggtgggccgcgaggacacggacacgaacacgaacaccacagccagtagcgcgaacgcgagcacgagctcgagcaccgccgcgagtggtagcagcggggcgaggcggaatggggcggctgcggcggcgggggaggggtgggggagaagctccctgtcgacggcgaccatcaacctgagccaggagtacacgctcgccatccacaccagctcctaccacgagatctgggcgaagatccatgtggacggcggggatgggcagcgggagggcggcgtcagtggtggtggtggtggggaggaagatgaggaggacgaggacaggtgcaccctcgccggcgtgctccagccggaggacgcggtggtggagcgcgcgctgggggacgcgccggacacggagctgacccgcctcgccgcggactacctccgcagcacgcaccacgcgtcgctgctctgcctctccctccgccgggcgctgcgccgcgcgcgggcgctgtacgggcccatcacggacctcctcgcgctgataccgcacgcgcccccgctcgccgcgccgcaccgcgactgcgcgttcgacgccttcctcctgttcgaccaaatgcccaacccgttcccggcccccgcggccggcttccagggcatgcaccggagcttcgtcggcctcaagaaccacctcgacctgcgcctcctcagggcccgccgcaggcgccggctggtgcgctgcgcgacgcgcgggtcgggcatctgcctaatcgcctgcgccaccggcgctgcgatcgcgggcctcgtgctcgccacgcacgccatcaccgtgctgttggccgcggcccccgcctgcgcggcgtcgcgcggctcctgctgccccgcaaccgcttcgatgaaacgcctgcagcaacacatggaccggcttgacgctgcagccaggggcgcctatgtgttgaacaacgatgtcgatacaatcgagcgcctggtgggcagactccatgccaccgtcgagagtgacaagctgctggtccggctggggctggagcgtggcaggggggagcaccacaccatagaggaggtggtacggcagctgaggaagaaccacccgagcctgctacgccagctggctgacctcgaggagcacatctgcctctacttcgcagccgtcaaccgagctaggttgctccttgtaaaccacctcagtgcccaatctgatcctgacagactgagtttccattgtcatgatataattcaataacagtatccgcttcaagaaaaaacttgatgttggagaactgttctaggttgccaaatgcaaaatgagatatactgaaggaagtttacacaagctcgttgtttcttgtatgttattatgcattcgatatctattgcctgaaactgtgttctcgggtatctatttaaacttgggtaaacttagcaattgtactgtttgctactctacaaatgatttttttttttacttttgcaattattactatgatgtcgtaataacttaattattctgaatttagttacaacgctcaaacctatctttcaagtttggaaatgcaacctttgctgttagacaaccaatgtacaaaatttgaagtagtttataataactacagaagattttattttaggcctttacatgcatttgttgcagatcaaagatgaaatgatttgtcaatttgaatggttgtttgcatatcatcattacaaattacatagcaatgtttgcatgtgctattcagagctaccctgaattacttaatctgttactgttgttgaatctacacctgtttgttgaaacctggagatgatgtctttcttgcagtatcggtattggttgcaagctactttaagaaaattataggcttcttaacattctgtcaagggattgcagaagaacatagttagaataatatttaactgataaaggtttgtttaaagtccagtgtttaatttgtattttgcatcttaaaggactgttgttgtgttgtatgcatttttcttgcaggcacttgactatagactctgcaaatggataagtttcatgctgataatgttcttaactgcaatgtcgacggaattcatatttgttggtaatctcagcttaaaagatgtgaatactagcaattagtattctatctcaagctttggtttgttcatctctcaattctttaaatcttgaaacattgctggtatagtgatatgtttaacttacaattacaaaatgatatttcttttagctcattcaagattgccaactgcagtacaatttcatcttcgaatccatcttaattcggtaattcccatattggacttgatctgttcattgtatctgatcatccgatatacaaacttgaaccataatatttcatttgaaccgtaacttggcagtaacctataaaaaatatcttgggatattttcaattatcttgtagtattgtgatccttccttgccaaccaaccaaccaatcttgggatattttatgaaactcatgagcctttttgggaaaaatctctctggcattaactgttgctgcatcaataacacaatccaa

SEQ ID NO: 62764 - DNA, 26048 bp, Oryza sativa
  unsure (1)..(26048): unsure at all n locations
atttctcagcatgggtacaacaagagctacggtgcacggccactaagaagagccgtcactcagctggttgaggatgttatcagcgaagcaattctgtctggtcagttcaagcctggtgacaccataatggtggacactgatgccacggggaaaccttgcttgagccgactgaatgatcagaccgtccaattatccgatccgacaccaacactttgaaggttcaaacaccctatgtatattcgtgatttactcatttattcttccacaccgataagcaagcttcttgtgcatgcataggttccatagttcatgtacatagcctccacatgctggaatttctccatgcatataatgtaaatttgaatctaacatcaactgtacatatcattgaatttcaaaaggtacttgaaccatttacatgattagatggtccaatacgcatccatttgctgctgtgtccatctagttgatttacgcatcactggaagtggacttgggttctgaaggttttcaaccttcacattacctgggaactgcattactccattcagtctacagtaatacgaaaagaccatcttggccaagcagctttagttctcttaaagaacttacctctgaagaaattgcaagatacactccacacaccgggataacttggaaaaggcccaatagattattaacttataacatacacaacttatggaaagtgttctatcttgacttgcccaattggaaatatcaaccactcagcataagattcaaccgttcaagactaaaaacaggaagctagtaattcgagggtaacttcagtgcatatcatccatctaaatttatcatagtttgatgactacaaaaacgtctatgagctatcttttccaatcacacttctgcctaaagagctcatccttgaaatagctagattgtacttccaagaacacgattttatgcaacttgaggaaaagctggtgccaacaggctgtggcaatcgatttaagttgatttcgttaactcagggtctctgcaaaagtcgtgtgacgaaaattatatcagatcaatgaaactaaatgctacataccagaaatttgtacagctgttccaaacctttgaatgtgatcaaggatgagaagtctgggaccaggggggatcttcacatctctaagtgcactggatcaatataaacatagaattttattattggtaaggacaactttttggcatatagaattttattattggtaaggacaattttttggcatatcaatattttttttaaatacttatgttttttcatctactgtaggaaataaattgaataaaaaatatatatacctgtcattgagtaggggcaatgtttgatcagtaagaagacccttcttgaaattcttctcatagttctgaagccctaattgtttcaacatatttctcccacgggaatagtatatatcttcactcggtggctgcgaaaatttctgaccaatctacaaaatagatttgtaggcaaaaagaattacaactgatatcaaatttatcgctaaaaaggatagtaccaatgggccctaaatcctaatccactgacaggacatcaaacaaaaatatcaactagttgcaatgcacatgtctaatgtcaagtactaatgaaattggtactcacatccagtactaaaatcttgagataattcaagttgtataaaaatggctttcattagaaagagaaacattgaaattcttaccatgaaaaaaccaccttgaaatactgcaaaagctacaccagttgtaattgcattagcaactggatttggagaccccattccactcacaatggagaataaagcgccagaaccaaacgctgctgccatgctatcgaaatgagcacttgtcaatcacgcaggtgaaaaaaaaatcaagtaatcaacacgatttatatagatagtcaataatcagccttccaaacttgtaatatacccttctggtgatagagtcggcatttctttttcggttttcagcactaatttataaattagtttcttaactagtaaagcatttaaagtttatcataagacccgtagatgcttttgttatgtttctatcttgagtttgttgaagattacaaaatgtactcgcaccagtgagtcaagtcttgctcattttgatttaagcagtataatttcttaggtagatttttcataaaaacacagacacgtggctttcaggtttcttacatctaatattagtcagtcatgagtggcttacaccaatattaatttgacaaaagaaaaaatcttagaaactcaaactagtagttatatcgacaactggtaagcaactcacatgtgggaaagaaagaaagggaatatagtatatatgaacagaataagatgcattcgtgcaataagtgtactggctttgctgctactaacgagtatttacatgacagtaaaatagaacttgtgaaccctcacctgccctggacatcctccactcctcttatccttctcataacacaagatattcctgcattagcaccagtcatgacggcaaagtttcgggcttgcaccagtggtccacctgccaaagcctgaaatacacacaaaaaaaagatcccgttattctgattgcttagaggagaacacagaatggttcctttgcagttctttacatcaaggatactgatatagtgcgaccttttagctctacacagacaatcttgaggaacaataaagactattgcaccagtaaaacaaatcaaagcagagtgtttgctttcttaaaatgctaccacatgcatacaaaaagcacccatcttccttttctttaataaagtttgcttccttcgggaattgcatcattattctcaaatttgaacaaaagaaccccgacattgtcgatgcataccagataaccagttaccgtcggtgctttatcaagaaatgtttggtcgctttatattctactataatcctcaacaagcatccaagaaatattaaatttgtttactgcgcccctattattcctattattattgagtatactgtataactacgagatgtatagtataggaagaagacgagacctgcgcctgcttgaaggaggcgagggcgttggggtcggccccgggcggcggctgcggcacggggaacggcgacccgccgtccggcgcgagcgtgcccatcagcccgccgagggcgccgccctgcacggccccgacggcggtggcgacggcggcctcgacgtgcgtgggctgcttcgccagccacgcccgcaggccggcctccagggtcttgacgcggtcggtcagctccgcgagcgggttggccccaccccgcgccgccgcctgcgccgacgccatcaccaccagcggccgcctcttctgctgccccatcccttccatctcgccgcccgcgcccgcgcccgcgctcgcctcgacgacgagagggattggaggtggggttgggggggcggggagaaatgggaaaagatagctgttgggttgcggggcggctggtttatcccctcggatgctccgctcggcgctcgctataaaccctccgcggcgtcgacgaattttcctcgcgaccagctcacttctacccacccgcctctcgtggatcacatgggccggttcttctgggctggggggtggcacgtttctgggctgtgtgttcatactggcctgtgttgatctgctcctggactccagggaagtaggggatcggcgtcctttgcaggaataagtctacttttcctccctcatcttatgcccctggttgaatcacatccctcggctgcaaaactgggtataacacatcccccaacttcaaaaaccggtgcaaatagaatcccccggtggttttaatagcggtttcatcctacatagcacttacgtagcgggttgacttggttttcatcttacatagcatcaacgtggcgcttacgtggcattaaattttaaaaaaaaacaaaacgggacccaaatgtcattgagtaaaacaataaaagtaaatattgggcccacgtgttagttcatctttctctttccgtttcttagccacatgtctccgtaggggtgaaaacggatcggataatatctgatccgatccgcttcgaatccgttcgaaacgaggatatggtatgggcttttcgaaatccgggggatacggatgcggatagtatgagatggatgcggatgcggatgcggatatggtgtctctaaaatccgacattatgtgataagccgtttgccggataatccgagattatcaacatatataaccactctatctattctatataacataagttggtacatccaatgccctaattcattaattaacatagatttttaagtctaaggcttttatcgtctcatgtcacactcacgtagctatattttttatattatggacatcatgtattcatgttgtttagcacttaatcatatacttattacgatgggtcatttatggattattgtattattgttcctgagattgctaactcgattttgcattgattgcatatacacgtaacatccgataaatttaatccattttcaaaccgattccgcactatttctgacatccgaaacaatccgctccgcatccgcatccgtacaatatccgcacctgctccgaatcggcttaaaaattatggtttaggatatggtatgaccattatctgtccaaatccgctccgttttcatccctatgtctccgcagagtgataggggatggatgccgtcatgccggcgagggagcgctcggcggcgagcggcggtgtatggcagcagtggcggctgtgggacggagagcaacaacgcgaaggcgaagacgaggtgcgcgaaagtggaagtgggctctgcgccgcggaagtgggatcagcgttcatcaccaccgccatctactatgccggtggcgtcgggggcaggagccccttcttccctcatccacctcgcttgcccccgcccccgcccctcccctgccgccgctcctcatctctgggacaatcctgtaccggtgcggaagaggagcccatgacgttggcgaccccggtggagccatggaggacgacgagaaggaggcgccggcgcgcgcgaccgcgactgccgggtgcacgggcggaggcagagcttgtgcagcgccggagcctagagcctggaggaggccatcggcttccgccaggagacgcagatggacctcgtcacctcgctccagcgcctcataccgacctcgtcccctccctcgaccgctctcgctgcatcatcgcctgaccgcccctttgctcccatcccgaaccccgacgccggccacggcaagagccccgccgcctcaagacccaccaccgccgctctctccgagaccaagtgcgctccacccgctgtaagacctcgccctgatcctcccctgcctctgtcgctgctacccccggcggcctcgacgttgtgcgcaccatggtcgtcgtgtgcctcctggagctcgtccccttcgccgagatcaacaccgcaccactcgcgcgtcgcctgcaacggagagctcattcgccagcgaggtctagcggactgctctcgctgacctagtcgtcgaactcggtggcttggccgcctccattgtagtcctcgtcctctggcggacttcgcctcgccatcgctgccgccatccaccggtcactaccaattgctatccacctgaagagagagaaaaggaagagggaggagaaagggtagctgacacgtgggcccaaaattttttgtattgttttacgcacttacatgtgggtccatttagatttgtttttattttagtgccatgcatgcgccacgtcgattccacgtaggataaagaccaagtcaatccgccacgtagtccgaaaccactgggggagtcgatttgcaacaattttaaaagttgggggatgagttatacccggttttacggttgagaaatgcaattcaactagagtcatgagttgtgggaatcaaaatagacttatttcctcctttgcatgttgttttggatacgctgggctggcttacggggcagctttaacgggtgtggtttataagccgaagacacgttaaaaacgaaaagtaattttagtgtaggattttataattttttaaatcataatacaaacacaagcgcttatataaatatattcatactcacctctataaactcatacacgtacaaatgtcctattgatgtgagcacatttgaaaagacctgcatatctagatattcacgaaatcactatagacgtcttgttaccgattggtatgtttcatactactgaaagaataattaagtatatttgtaattatatcgtctaaaaaacattgttgataaataaaaggtaatgaaagaaaaatacttgatcgaattaattatgttctggtatgcacaacagctgtgaagtactttgagatactagaattcaaattttaatacatattatagggttgtttattttgaaatggagcggaggtagtgcccacgcaggtacatttttagtaacaattcagtgaggttaactgatttatcattagtcctctatatattatcatgtgttggggaacagtacatatactggtaatatatgggtttgggatgcaactgctacgtgtgtagtcgttttttcaaacatattttatatagtaataatcaaagaaaagttacttttgttcttgaatttaaaattgtctgggccagctcaaacaaataagggccaatggtccaattataattagatatgcatatcttcaacaattaggtctctttatccaattgtacagcgatacttggagagttcgtaggtaccgttggaatgaattatccgcctttccctatcagcttaagcttttgggttgaactggtcagtacatgcaacttaatatggtatcagagccagaggtctcgagttcgaattctggctggcgcgcaattaaataaaataattgcagctcgcgtgaaggggagtgttggagtgtataaagtgaattgcccacctttccctatcagcttaggcttttaggtgcaactggctggtgcatgtaacttaataggtacgaattttttcaacttaggttgcgttctttacctccggtacgaattggatctggatttttcaacttaggctgcattctttacctccggttcccaacttccctccctcgttttccgcgtgcacgcttttcaaactgctaaacgatgtgttttttgcaaaaaaaaaattatatacgaaaattgcttaaaaatcatattaatctatttttttaaaaaaatagcaaatacttaattaatcacgtgctaatcgtggctctgttttccgtgctagggactcccgaacacagcctagtacttttgaaaaaacttattctataaatagatccagaaaacttattatataaatggattcttttcgtggtgtcaacgtcgttggcgccgtggtacaatatgacggcgccaatctctctcacctctcggtgaaagttaagtcgctaatctgaagagggaccatggcaaacaaattaaatggacctatttgtagcagaaaatgacctatttgtaataaaaaaaatatttacaaataggtctttaatgtcaatgacactgacatcgaggacctatttgtaaatatttttaattacaactagtcaactagatatttttttattataagtaggtcagttttttaaaaaaatacaaattgatcctcggcgatcgatgaaaatgagctaagtgttaaaaactcaggaaaatcatacctaaaagttttataaattcttgaaaaaaaatgagagatatgtgcatatatgaaatacattctcaccaaatgccaagcccaaactcaacttcattcgagagaagcaaaaatagcaaatttcagataaatagtgtcatcttactattcaaccaatttttcttgttttgttactcccaaataaagttgagtttgaacttaaaatttggtgagaatatatttcatatatacacctattttaattctttttataaatttataaaacttttaggtatgatttttataagtttctaacacttaacatgttttcatcgtatacattctcatgaagttagtgttttactcaaccgaatttctcgaacgaacacaccatgggtagtgcggtctgaaatctggaggttgcaatttgaccatacatattatagctttttccatttcttgtttaattaccatactagtataacgtaacttaacccaaaatactacgagggctactagagaacaggatactttatataggttagcgtatcagcttcctccccgtaagtctagcattatccccctcccccaacttccatgtgctcgcaccccccacgtcttgagctagtgccggtagtgtcgtaggcaacgatactggtcacaacagcaaggaacgatagttgagcctaggggaagggaaaaaaggagaggaagcgttgatagttgatactttgcaggtgccagccctagccttgatacctaagtactaggactgatacgtgtgagtaccaaccatgatacctacgggtaccaggtttgacacctaaccatgatacccaggtaccaggtagcaggtctgatacctacgagtaccaggtctaacacctaaccatgaaacccaggtaccaagcctgatacctacaggtatcaggcctgatacctagttatcaattgtgatattcacaggtaccaggcatgatacggggtaccggtccgcgataccataggtatcaggcatgatacctacgagtaccggctgctgatgatacattgtagacatacctgcacacaatcgggcgaggagcatgatggctcaccatcacgttgcccctttatcaccatcaacaacgcacgttgaaggaggaggctgaggagcacacgttgggcctcatcctcccagttcctgatgaccttgcttcttccaagtcgcccccgccgccatgagagctagatccagtgggtgccaccatgcctcaaaagcatgagacggaggaggtggccatgagacagaggaggccatgagattggtgttgcccactcgctctggatctagcagtgaggagggcatagtactctagatttatttttagggccactctatcatcagagtgggatctggaagagagaaaaaacaaagagtgggattggataagagtaaaacgttatccacttatcccgtgtctacgggatactgtacagtagattttctgaaatactacagccaaacaacatcaattggcatgtgatgtaggtaggtgacatgtggccgcattaattggtcacacacgacgacatgagagtactagtacgagacagaagtctggtgcaggctgcagccgccagccggcaacacaccaaggagtgtaaagttttggcgtctcacataagtcattatatagggtgtcgtatggagtgttcgggcactaataaaaaaattagttacataatccgtcagtaaaccacgagatgaatttattaagcctaattaatctgccactagcaaatatttactgtagcaccacattatcaaattatggagcaatcaggcttaaaagattcgtctcgcaaattagtctcaatatgtgcaattagttgtttttagcctatatttaatactttatacaggtgttcaaacgtttgatgtggcaaggtgaaaaattttggggtgggatctaaacaggcccgaactcagtcgaccgtactccctccgtcccataaaaaacgaatctaacaccgaataggacatatcttactactacgaatctggacatagtactaggatgtatgtccatattcatagtaatagaatgtgtcacatccggtactatgttggtttttataggacggagagagtacacgtttcttcaagaaaacaatattccttccatcctataaaaaacgaatctaggactagatatgacatattctagtactatgaatctggatatatgtatatcctaattcatagtattatgatgtgtcatatctagtaataggttggtttttttgggacgtggggagtactctcgttgtcccataataaacatatatataaattttcgtgttcaattttaatcgtccatccttttaaaatttattttttaaaaaaattaagaacataagtcaaacataaactgtgacagcgtcgatcgtgacacaagcctaacgtgacagcgtcgatcgatctttgtcaatgcatggccagccgatcgatcgtctcagtccttgaagatgccaaaggacgggttgacgatggagcagccgccgtcgatgagcaggttgtggccgctgacgtagcgcgcgtcgtcgctggcgaggaacagcacggcggcggcgatgtcctccacgcggaggcgcacgcccttgaggttggccacggcctccatggcggcctcgaacgcctccccctccaggcccacgtaccccgtggccagcggcgtcgccgccgcggcgggcgacacgcagttgacgcggatcccgtggcggcccagctccgccgccgcgttctccgtcagccccaccagcgcgcgcttggcgcacgtgtacgcgtgcgacgccgtgccggccaccgccgacgcgaggctcgccgtcccgatgatgcacccgccgcgccccgcggccaccatcacccgcgccgcgtgcttcgtgcccaggaacgggcccgtcaggttcacggccagcacgcggtcaaagtcggccttggtgctctccaggatgctgtggcacgccgcgccgccgatcccggcgttgttgaacatgacgtccagcttcccgtacctcgccacggcgtggtccaccgcggccgcgacgtcgtcctcgctcgtcacgtcgcaccgcacgtagctggcggtggcgctcccgagctcggcgcacagtcgcgcccccgcctcgtcctggatgtcggcgaccacgacttgcgccccgtgcttcacgaacagccgcgccgtgcactccccgatgccgctcgcgccgccggtgatcagcgccaccttgcccaccaacctacaccaacgtacacacgataacatggcagagttacgtgtaagatcaccgacaagctcatgcatcgcacacaacacgcgggaaaaaaaattaaaccgttgtgatctcactttcttgcagactcatgaacgtcgccgtagctgctacccgccatggccaccgcgagatgagaaatcgttagctctctcgatctgcgactctctgagtaagttagtttggcctgagacttgatctcttttatagtagtagagccggctactgatcagctagtttacacaactacggcaaattgtgtggttcggcatctccaacagacagattcccagcggaagatgacacggcgcatcggcgccggcttggaccttgtggtggaggctgactgtgcgagtatatgattttgcttagtagttgacggaatgcaggagctgtttagatttagatttagccaaaactggccgccccacgtcgtcgctagcggcgtgtgccattttttttaagagggtagctatacgggatcttgttgctacaggatactttaagtgattcatcccttactttttttttataggtgagattccacatggtgaatatgtgctcccttccggtacctggtaccacgtaccataatcgcgatacctatctgattcctttaactcctttcctttcttctgtataggtaagatttcacgtggtgaacatgtgctccctcctagtacctgataccacataccataggcgcgatacctatccgattcctcctcggtatcgcgcgtgcgatacctcatcgctggcaccgctcctctgcagtcggagcagcacaatataggctggtacatgatacctgatacctgatacctagtacctggtacctagtacctgatatctagtaactagtatctagtacctgatacctagtaactagtacctgatacctagtatctgatacctgataccagtatggcactagttgcatggtgtgtagtacctggtacctatggaattggagagattcacaaggatgggacaggggaatcgatactatccatataagtcagaaaaaaaaatcagcaaagaaaatcatcaatcaaaaagagaaaacacacatgaggaagggatgcaagcggcggtgaagcattgccagctgggggaggggatggaggaatcagccagagtggaatggagtgcaggaattgaagaaatggatgcgagtggcggagcagcaccgccggcatggggaggcggatggacggaggggagcggtggcgcgagagctcgcacgttgatttggcaccgcgctgtgcgttcctgagccagcgggagtagctccgcgcggcgccagcgaagaagagcgggccgagcgtcctctatgctcaacgcgccaccccgcgcagttagccgctattgtcgtctctatgctcttgaggttggtagtcacacagaggaggaaagatggaaggggaagagaaaaaaaagagaataagatacttagatatttagtgatagcagttatccgcgtgtacgaaatagtgttgagtagtttttctttttttttattaagggcggatgcattacggtgataatcggattgggtatagcagccttcgttttcttttcgatgtcaaacaagtcggcgaggccattttggccaacgcgtgggtggagatacgcgcgcgcatgtcgagctacagcacataggggacgtacgctttccaaaaattgtcacgtgtaacagtgcgagaacctcttttttctgtgtcaggtccctttattttttagtgaaatgcacacggaagctgaatagtaataagctattagaggaataatggggttggctacctacgaatgggtttgtactaacgatgtttcaaactcgacaaatgcggatgtagtatgcaaatgaaaaacggaataggccataaagtccagctggcacgctctcctcccccgcgcggcaatttttttcgttttcttttttttttgcagttttttttgctttctttactctcttctttttttttctcgattttctttttttttcttttttctgattatcttttaatacttaatctgtccgtgctacactacggcgacatttagaaatacaaattaaaatcgatggatatagttattatgttgttaattaaattgccacatgcataaaataacataattattatgcacgaacatgtataaggtcttcatcaatggcagcacccgctgtttgatgaatttttgtactataaaattcacagaaaaaataataaatcattaggcatcaagttcatatgcaaatgctatttacagctcaattttagtaaatacacgttaggggtgtctttatgacgtgtggcctaaaaatccaattatcacacaatatccgaatataatcaatattggactcgttttgctgtatatatcaaatagaaaatgatggttcgaatagaatttaagtttgatgcgcaattgaagagatatacgctagtaaaagagaagagatcaactagtgctagtgctagcagtcgttaattggtttgctgccactcgtaaattatctctagaagaaacaattcgatcaactcatataaagtgtggggcccaccgtcatttagacatgttgatcaaggattatctctatcacgtgcactcagattttatccacggcaaagcaaggctctatctgcagcagtgcgggagaagagatcagcgcgttaaactaccaacttgcgcaggaggttcggaagagattaggcaggttggttaccatcgctgttgcctatataagcgttgacccccaggacgccagcaaggatgaaggggacggagaagggaaaagatacacagtgacgagaaaaatagagcgactcgctcctgaagaaaccacagcaatccatctgccggcggtgctattagaagattaaatctcgccgacggttcgcgagcaggcgtgtcatgaaatgaagattaaacatctctcgtcattaagccaatgtcgcaggtggagatgatcgtggtagatgataagtatgatgataacctgatagtaaaccggctgttcttatggatgatcggagtacctcttttctcctcaataattaaagtgctctggaaatcaaatcacatttgctttctcgaaacataaacttgggtatgtctaatctgcggattggactatcctcgtattatttataatcaaaacacatgtttttatggtgcacatgccgggagcgagcctcaaattataaaacaaaggaggagtggagataaaaaatataacatcgatgctatgttcgtgaccaatgaggccgagcgatgcattggctaaagctgaaaagtactatggccaccacatatgtgacgaaactatggccgagcgccgacaaattataaaataaaagagattaaatttcatcgtcggcaattcgcgatgagattaaccattgccagcgatgattgcgccggcgttcatcatcaagtcgatccgtgtgtgctgcaggcgtgatgaaacatcagaggagccgatcaaaatcttcatatgctatttatcatcaacaacacagtgaggccgtagtgctgcgctgttgcacggcccggttaacagaaaagtaaagagaagcatagacgaatatatcgtggatgcgttgtgaacttgtagccatggatatataagtatcccagcggcgcatacacacgcacacgtcatctttgttaagtgattaatatagggtgcaaataaatacaaggcgagcctgaccctcgtaaaggttggagcgtctaaattattaatatcaaatattggatgagatatttatttgtataaacttgggatgagtttgagtcttattggcatcataccaaccatgatttatacatatttatattcatgccggaagagttacatatttgcctcatgcatgtcatgtacaggagcaattcttttcctctccaaattctaccggattgatgggagcaattctcacaattcttgaaggcatgcattattcgctaaataaaacaacgctagccataagggcgagacgtgcagatttaaaatacacgtcaacatcgtggccgaatgtcaacgagatgaaatggccgattcatcaatatttgtattacgtctgagaccgacaccgggaatcagcggactgcacgcgatctccagtcaacatacctctccattaagcattcctcgtgaaggcaaaagatgaactcctgccggagccctcatgtatttgtaaacattcatgttaatgaatcatgattaataaaatacagggtttccctattttctatgtgttcgttgttttgttttcgtcaaacacccgcgccaccgtgcatgcatgcttgcgtctgatgcgtgtttccaatgcaggagctgccggtgcagcagtaaggcgacacggtgagcagcctggtgtacgaggcgaacgaccggatgcgggacccagtctacgactgcgtcagggccatctccttcctgcagaaccaggtgtcacagctgcagatgcagctcgccatcggacagggcgagaacctctgcatccagatgcagcaccgtgatggcaacgagaacgagaagaatgtgagagaggaggaggagagagagagaggagggaaaagagagaaggtgctgacgtggaccctaacatgtggggtccacatggggacctacgctgactcagccgccacgtcagacaataccggagttaaaaccaccgaatgatctaaagtgaacggttttgtaagttgagggatgtcgtatatctgattttgcggttgggagatgattttgtatctcgatgacaagttgagggaccttgggtgtactttttccttttgcttgatgcttggtgccagggtaggtttgcagcccagtacagagtaaacaggcctaatctagccatcagtcaagatccattaggttcctgagcccttggtttcttttgtgaataaagtccaataaaagtcccttaaatataggtaatatctaattcaaccactcaaccgttacgactcctcgaattattaaagccagtacaaatgactctaggatgatttcgatggtggttttaactgaagtggaatcccaatcagtaagaagaaaaaaaaaatcccagggaaacccacttgtaccagaatagccatgagcccgagctcaacggggaggtagagtccaagcccgagctatgagttcttctgccatcgggcacacccgtcatgccatcgttgttgcagcctatctgtgctctgcaatgacattttggggttgcttagatccactggcaaaattatttttttccctatcacatcaaacgtttaaacacatgcatgaatcttttaagcctaattacgctatgatttgataatattgtgctatagtaaacatttgctaatgacaaattaattaagtttaatctcgcggtttacaggcgtattctgtaatttatttttgttactagactacgtttaatacttcaaatgtgtatccgtatatccgatgtgacacaccaaaactttacacccataactctaacacagtgtcagggttacggataaggcatatcttctatcctgcgacttatggaatatactaataaggacttatggaatatactaataaggtatatctttatgtacacggattggttccatgtacgctcttaaggatttgttttaaatcacagaaaatatctccacgagtcaagcgatttccaaaatcctactcggaaggggtaaagtttctgttataccgtgtcgaatcaaatatccccatatttttcttggggtcaagatgatccacggtataaaagggactcccggggaggggatcaaggcatccaattcaattgccaacacacccaccagtttacgaagccggagtacatggagtcgctgggagatctcatcgaaaccctcgactacgatctcgtcggtatcatctatttggactacttgctttgtaatctgttctcgtcatcatcaatcccatataaactggactaggactattatctgataaaggtcctgaaccagtataatcgttatcttttgtctgcttgatatcgtattatgtagtattatgtagcctcgtaacaatgtaccccagtactcaactcatccggtccatgagtataactcgtcaacacacagcctttataactcactttctaatagtccgtatatctgatatatgcaattaaacctaaaatttttccacaactaaacgaggccttaggtgccccaaacaagatctgttgcctcgccgttaggtctttctactccagtcagttcagttccatcttcagcagcagatcgcgaccgtcacgtcatttcaacgcatcgtgatacccatacagctagccaggaccccgcgcgttgccgcggggtgcttaagcaaaacaaaatatttaacatatgaacaaccataaagatttctgatgggaaaattttctatacagaacacctgtaatttacatagacaaaagtgtattcgagaaatattccatcctataaacctagaagataaatacctaagtagaaaaaacatggaggtgacatgattttacttggaagtacaaacatgacaaagtatgatatatacaggtgattggctgcaagtctatgatgaacaatggactatctatgctcaattggctgttaacctaggtagcttgattccatctatgattttattaccagtattgactctcttactatgtgacgttgagttgaaagacagatcagatttcttgcaaactcatcatcactgacatcaatatgtagccagcacacatgccataggaaagaatgaagaatccatagctatcctgataattgacaaatataagaattaatcttaatgatttgttttttatatggtgtataatacaaataaagagcatcttcacatgattcttcgtgaactaaagcatcagatgaatttagaataagaaatgtcatatatgaagggcaatatgtacttttatgaatgataattttatccttgaatagagcaaaagatcatttacaaacaaatagaatgtcaacatgtatatgagatgctctttttttttcatctgtggatcattgtggaaatggaaaccatgatattaacggtaatattcatggcaaggatattgcttgtaagatttgactgtgtttaagaaggaatttaccttcggaactaaagatggaataacatgtgcaggagccgtaggatattgtatgattttaatgtaaagtctgatgaacttgtcagtaattttgcatagctgtcatcacaatcatcaagctgcaacatttgtatcaagacataacttagcagttagcacatttgaatgttgcgatccaaaaagaaaaataatgcaaaagcttttgcatgagataaatatgagtaaatccaatgtataaattgcaacagagcatctcctatgtatgatttatgagtctttttaccattcaacatttggtacctcgaggtactacaattttttggtacctcgaggtacgaactgttggatggcaaaattgctcatgatttatggcacatgaaaatgaattgatggcttagactataaatgagcagcagtagtctaggaaagcttctctcatatagatacactaaaaatgtaactatggtttggggttttaaggtacaggttttccataagattgttgctccaagcagtaaacatcttctggcatgaaaggcggtacattcttctcatcagtcaattaggaacctgaagcaggtaaaaaaagaaagatcttacatacaacaaagcattacctaattatttaggtgcaaccatgaatgccttaaaacatatgcagttagatcgagtagcacaatgtctggcaagacatacaggacaaaaagatcgatacctgcaaggaaaagaagattagcctccatgccatcataattgctgaaccacagccagcgcaaagatcacatttagacaccactaatcaaatccacacagggccaaatcatcgacatggtgagtaagatttggtaaaagtttaaaataataccttgagctataggaagacaggcaagtgcttcccttcctgccaccatagccggaggacagcaaagccgaggttgagcagtcacacaaacaaccaatagctgcataacttgcacagatcgattcatcgttgaactgttgaaggacgtaaaacttaagtttatgcgctataccctgccgcctcagctcgtccgccgcaatgcgcattacctaccaaaaccctagctacaacatgagacaaccaaatctggatagagaccaaatggaggatggtagaatgggatgctatgtcatgtgtggcgaagccgggggtaatctagagcccagatggccatacctggacctgtggtcggttctcaatggcgcactgtttggaatcctcattgtgaccggcagcaaccgagaacccccaaccatagccgacgctgattcagtaaggagaacggagggaaggagtcggcggggaagaacggaggggcgaagctgaatgggatcgatgggcgatgaggtggagacgccgatttctgatttctccgcggtaatggggatcgatggggaattggggattggtgagcggtgggtgcgtggcgtgcctggctgaggtcttggggatgacgacgggcgagcggatcaggggctcgggctggcgcagaagcagacacgcggatgttcggatctcagcaacgtgggtgcatcggacggtccacgcgcaggcagggactgttgcactgtagcagaatcgtgagctctcgtgaagcgacgcactggtggtagtggctcaggaaaactaaagatttaatatgatatgatatgattaaccctgtgcacctccagttcccccctgcctaccccagcttccgtccgcgtcggtcgatcgggccgccacagcgctactgttggtttggctgcacctgcacatgtacgcgcgccccccgtgtcgatctcactgctgctgcactgcacactgcacgcgacgtgaaccaaacagaccgcgacacgcctggcgcttccgcactcggcaacccccccacacggattgggatcacctgcagtagctatagctcctgcaacttaagcagtcctataaccaccattggatcagaaattgatgtcctagatctttcctaaatactgtttacagaaaatcgtacacagtgtgttcctgtagcactgtttggaccgttgattatcttgatccaacgatggaaaacagtcccagctgctaaacttgcagtctgtactgtaactgcaccggatccttatcccccccgcacacacacgattgggcgatcgtcgacgtatgcaaacgcacaacgcgaggggttgggagagttgggaccctctctgtgacacaatgacaagcgaacgtacatgcacgtggccctgagcctgagttggccagatgcaccaccaccatcaccatgtgcctgtgcctgtgccagttgtgggcacgctagctgcagtgacagactcacagacacagacactgcttctctaatttaacaaggcggcagcatgagcaggtgctagtgctaagctaatctgaccggatctacggtcgagatcgagatcgagagagagagagagagagagagagagaggaggaatttgttaatcggcccatcgccatcacacatgcaacggccgagacagctcggcccacgcggcccacgcatgtacgtgcacatgtgtggcctcgtgtacggtctacttcctccgtcaaaaaaaaaaaagacaaatctggtttccgaccatccatcttgtttaaaaaaattatgaaaaaaattacaaagacaagtcacacataaaatattaatcatgttttatcatctaacaacaataaaaatataaattataaaaaaatttcatataaaacggatagtcaaagttggacacggaaacctagggtctgccttttttaaaggactgagggagtacttgctgccgcattgtctgcttcaactcatcgctcggtcactgacaagtaaaaatctcccaaaaaaacgtactcccaaatgtggcgaacagatcatcaacaaatcaaggtcaagttcatctggagatcgattgatttcatatcatagcagggtttaaccatggacatcacataacaacacgcgcgaaataaataaagaaattatggaggagtgtagttcgggtggccatcgaccgaccatgccggatgtgacttgtgtgcggtggtgtttgttgcatgttggatggctagctcgtcgccaccgcggccatcgccatgccgccgttgccggagacgccgccgcggttgtggggcgcggccatgatggatttgctggaggaggagctcgtcggcctcagcgctcgcatcgggctcgccagcgcccacgcccagctccggtggctacgcgcgccgtgggttcttgcgctgggggcggcggcggtggcgccgtcggcagcggacagccagtaggaggacgacgtgggcggcggcgcggcgccgagaccgccgaagaacccggcgcacttgatgcggtgctgctgggtggactcgtactcgtcgtcgtcgccgttgccggcggcggagtggttgccgcccaggtgggcgagcgcgccggcggacgacttgggcttgggctcgcggtgggactccacgcggcggagcgcgcagtcgccgaagccggtggagaggcgctccaggaagtcccccgagaagctgcggctgccgcaccccacggagcgcgaccgcgccaccttcctcccgaacgacgacgacgacgagccctcgctacggcggccggggctgtccggctccactatcgcctccagcctccgtcccagcgacgctgacnacgccgaggcccccgaccccgncttcctcctcncngacgcgccgcnnccgccgccaccgttggccatcgacgccgagccctggtggccgccgctcgacgacgaggacgaggagtagaggaaggaccagaagctcttcttcctcgggctgtccgcggtgaccgcggacggagcgggcgccgtcaccggcgtcgtctcctccggacgcggcgccaccgacttgctcctcttgagcccgccagccgccgaggccgggatcaccttgcgcgccgcggcggcggcggaagggtggagaggcagtgacgacgacgacgactcagcagcgacgtggctggtcggagtggacgaggaggcggaagccggcggcgggtggaaagggctggacttggacgaagacaccaacatgccgagcttctcctgcaggcagaaggcgcatatgccgccgccggctgccaccccagccgccgcagccgcgccaggcgggtacggatgctcgctgcagtacgccactccgtcctggtcccccgccaccacaggcgccaccgccaccgccgccgctgccaccgtctcccccactttctcctccattctcacacccgtcacctcacctcctgcgatcgatccccgcaagcaaagctccgcaccaccggatcttggatacgcctacgcgacccaccgcatcaccacaagaggtcaggccgtctcgatctcgatctgctgctggtcgtgcagggcgtgggggcacggggcgcagtcgcgcagaggcggatgtggcggggtgtgtggagtgaggagtgagggacgcgacgcgaggggggtggtggtgagcggcttgttattttagcgccactaccagtggcagcgcccgcttctttttgtccggctcgtgcggatgggggggcgtgacaaggagagcacgtggggggtgggggtgggggtgcgtgcgcgctgctgcggcagcagcgttctcgttctcctccccgcgtcgcgcgtggtgctccacgctgcggccgcgcgctgtcacatggcgcgcgcaatttttctgtatggtatactagcaacggatcttatgccgcgctataacccaggttttactactactactactacctcgtaagtgaccacttgatcgaaaaatagttagaagaatgggatagccgcgccgtgaccacatctatatcgctcgtttctctcgatcactcgatgtactaatgtaggagtatactactactactactactaccaccaccactactactactactactactactacgtgcaaatgggcaaatggccatgccgaaatgactgatccaaccttgccatatcttaacaacagccacatgtcttcggggagactacaacatccatgatcagtactacctatcgtatgctgcatgtgctagcatgaggtattgagcttgcagccctagctaatttgatttcatcacggatacagatctcaaatctactgaaagagcaactgatctccatcatggaaggagctataggatggaaacacgatgtagtataggggtagtgattaataaattgaggtgccacgagaccccgggacaaacagacaggatttgtacaaattctaatggtcttaacagtaactcttaaccatgctccctgggaatctatcgtttgttttagctctgtccagggtggcacgtacgcttagctacatgtttctaatccgatggagtttttattacaaaaaaaaatatatctgaatgagtggtcgatggatcatcagaggcgactggcgagagtaatttccggtccagcacattgcaacgccatgccattctgtctctacctctcacccagctacagcatcaagggatgtgcggcacatggttcccatcggtcgacatcatgtacttctacacacatcatcatcgtttcggttagttttctgagcccctgatgctacacgaggggcacttgtatatactactcctactagtagtatgctcgcaacaggagccgtccatgtgcgtgcgtgcgtgcgtggggagatgcaccgttgcagtggacatgtcgctctccgatccgcggcttgcgttttgcgtacgtgcggttcgggctgtgtctgtggctgtggccaccgtgctctcccggcgtccacgcgcgcttcccggcgcggccagccggtgcatcggtgaatggtttcgtgatcttggcagagatcttttgcatacgtggtggcttttagttccaggtgacacgaaaaggttgaaagcagcaggattccagggagcagcggttcacggtttcgagatcggctcatttcggctcgatgcgttgacatggtggtagagactaatctggggaattttttatatagattttgtttatgaactatctatacggggattagggcaaatactataaacatccaagcacaatctcctaggtgccacataagctaaaatggtgaggtggaggagagaagagatgagagagataagcagccacctctcatgcaagaggcaaccattacacaaaattcaagacaaaaggagagagaggaagagtagattgggcaaacaaacattgaggctagtgtattagaattagtatagatgtgatatattgtatatattacctctatatttattagttgatgatgtggtcaaaattagatgcaacaacctccttttttataaaacttgcacttacgtgaacgggattttgtatattcgtgcacggacagataatggattggagtacaatcttgcttttgtcattcgtgtaggatgactccaaagttagggactcgaggacatttaactatttacttcatccgtttcacaatataagactttctaacatacgttcatataaatgctaatgaatctagacacatacactagaaagtcttatattataaaacggagggaataccgttcctagatctagagcagaatgggatagcccttcagtcatcaattaacacttaatactccgtactatagaacttgttttaattgataggaaacagatcatacgaaaagtaaatttcaaataactacaagtatttattaaaactataaatttcaaataactataactattttactaaaactattagtttagtacaactttggccgtgtttagttttaaagtttttcttcaaacctttaactttttcatcacatcaaaacttttctacacacataaattttcaacttttccgtcacatcgttccaatttcaaccaaattttcaattttaccgtgaactaaacacagcctttagctaaatatttcacggaactgcaacaatagtgtatgactttatcaaaaagcttacattattcacctgaaaagttttgagtacatatatcatacacacatgcaatactttatatcagggtaagtcgagcccatatgtgataaaatcaactgttgttgctgttgttgttgcagcagtcttatgaaatacccatctgaagtaaaaggatagttttaacaaataattacagttttacgaagaatgataagcacgggtgcatacctcggccagtttcctcggagaactatagaccttccgttgctaccaaatgaacatttcttgtaaaactgaactgtagatttgcggacaggactgtgcagtactgtgcacccccagtgcctgtcaggatcagagcagccacaaacccataaactcatcgctctattctagtccttccaaatgtacatttttttaatggaaatgtacattcataatactccatcaagatagattacattcaacaagtcatgcgctacgatgtacagcatatatatacaccactagcatgtcggggttgaaatgcaatctacagtttgcaatactcgtcagttgaatcctcttgacgtttggtactggcattcccaacctgctaaacctttgtgggggtgtcatcatgaacgaagtaatcttggaccagaatttgactcaatccatgaaacaattacgtcaacaagtgtattgacatcctttgagatttgtgctcgtagaacgcccgaatccgcacctaaagtgctacctacctccttagcaacagcctcccatggtgtccctgttgctagatttgtcaggagttcacctcctctgtttactgcatcggccattgctggtggaacatcaggaagtacctgaaggaaaaatatgtgattactta

SEQ ID NO: 62765 - DNA, 5353 bp, Oryza sativa
ctaagctacttcattagtgattagttgaaatgtagatcagaattaccttttggttatagaaacacctgcaaattggtgggtgattgctaatttataactgttcgtatttttagaggtctttcaaatgtaggaattttgcaggcttttctattatggaaaccaactagcttgagaagtatagatagatagatagatagtgtctgtattactaaaagcatcaaattattgaccaatggatcagtattttcttttataacagtagaaattcttggggttactctgcctaggcttcccggatggaataatgtgcccaatcgtcagtatttttgttcttaacaagcaaaatcatagcaattttttgtttctgtaaaaaaatgatctgtgttgatcctttgaccaaatccgaaactaccaatgtcatgttcaccattatttttttttttgccctcccttgtagcttcttgttgcaatttacgattgtctggtctacttgaataaggcaaagtgataagttacttatgctatggcatgtttttggcaccgaaggattgcaattcacattgattttagtataccatttatatataaaaaagccttaatgttggcgtgaaacattttctgtattttaatgtttcggacaaagtgttgacgtgaacttggttcgttgtgctttcccttttctcccccttggacttatgctttgttcatatacatgaattcctttatgctctccttacctgttaactttctccctgacagctattgcaactgtggtgactgttgctgaaattctgaaaaataatggccttgctgtcgagaagagtgagtcttgtttctcataattgataacttgattgcatcctccttctgttctcgtagcttactccaaaatttgtgcagagattatgacatctactgttgacgtcaaagatgattcgaggagtcgccctatgcagaaagccaaggttaatgttcttcccatgtttaacgtagatctttactttttccagatgtataagtgagcgtttcctgaaatcctatgattgtcttggccagattgaaatagtgctgggcaagacggacaaatttgacgaactgatggcagcagccgcggaagagagggaggccgcggcagcggaggctgaggccgaggagcaaagctaatattagaagccaaaaagcttcctgttgtagctttaattttagtattctgctgctaggtgttgtatttggaactccttgatacatcaagggcttgtgtaatcaattagtggcacagcttatttggtgtgcttttacttgattggttaagttttgatgccaacttatgacagtgaaggtgtatgagtacggtgctcatcttgatttgccccaatttacatttggaagatgtctaattgctttaaaagtcttgttctttgtgtagttgatggatgcttctctccatcatgcgctaaaagtgaaatcaaactggaaatacagggatcagatgcatcacagctgcatctccagatagtgaaatcatgtgctgggaacgaaacttagggccctgtttgattcagtttagaattattataatctggattattatgagtaagatgaaactgtaagctgaaacaaaccagtagattattatgctagattattataatctataagccatattactataatataataatctcctctagagatgctttttctagattattgagtggctaaagacccactacccttatatgcctctaataatccagaaaaataaacaactcgtagcttattttatgtcagcttattataatccagcttagagtaatctagatttaataatctagattataataatcttaaattgaaacaaacaggtcttaagctgaaacaaacagggccttaattcatcagacacataaacccatctgcaaatacttaaattaaattgaaacatttggtagagaaatccaaatcacaacaaacccatctccaaatgcagaataccatccaatacatcgcaggtacatcggtctaaaaagttgaaatctattatataattaaaggaatagaaaaaggagcctccacattcgctctcatggcctagaaattctcacattaatcggagaaaaagaaaaagcagagtccatatagaaatacaatttagaaatagcttaaattcggaattaaaaaataaggaatattagaagaggagaccggagtccatatagaaatacaattaggaaatagctgaaattcggaattaaaaaataaggaatattagaagaggagaccggagtccatatagaaatacaattaggaaataactgaaattcggaattaaaaataaggaatattagaagtagagtatagagtccatgtagaaatacaattaggaaataactgaaattcggaattaaaaataaggaatattagaagtagagtatagagtccataataaaatttggaataaacataataaaattaaaagtagagtttagagtccgtataaaaatacaatttacaaatagttaaaattcgaaattaagaaaaaatgggaagaagagtttaatgctaatataggaatacaatttagaagtaactaaaattcgaaattaaaaattaaataatattgaaagatgagtttagagtccacatagaaatacaattagaaataataaaatttcagaaataaaaataaataatattagaagaagaacatatagtctatatagaaatacaatttacagaaaaaagaaatattaaaagacgagtctagagtccatatatgaatatatataatttacaaataactaaaattttatcttaaaaataattaataactaacacgtatataaaatgcaatatgaatattacacattagtagttttgtaaagttattgcaaaatttaaaattatgttgtcattttaatatatttgaataatataatgagaaaacatatatgctattatatgagagaaaatataatgatgctagccgcgcaatctgcgcgggccatcatgctagttgaactaaattgaactggaaatacatagattttattgaaaacaaacttgaaatgcaatacatagatatattgaaaacaaacttgaaatgcatcacttcattgaaaacacaccatatgcctcctgaacagaggaaatcgaatcctacgatgattcatccaacttcaaaccacagcaaccacaaacttctctccattttttgcttcttttttttcttcttttcttgcatgcttccatcatcacacccatgcacaatcagccaccatcttctccggcgccggcgagcccaaaccacttcacgcaaccttctccttgatctcctccgcgcactccgcctccagctccggcgccgcctcctcctcgacgagtaccttcttgagcgcctcgtagcacatgaaggagatgccggcggcgggcatgagcttgatgcagctggggccgaggccgcggtagaggcccgcggcgccctcgccgcggaggatgcagtacatggcgtggagcacgtggcggtacacctgccggccgccgacggcgccgacctgcatctgcttgcgggcgacctcgagcgggaaggtggccgtgctggcgatggcgcccgccgccgacccgatgagcagcgtcgcggccgggccgacgtcggcgcgccccgtggcgcggcggtacaggcggcgcagcgtctcgtaggcgtagaagttggtggccgcgtagggcaccacgccgatcaggctcggcgccaggccgcggtacagctcccccggcccgccctcccgcacgatcttcacgaacgcgtgcagcacgttgtcgtacacgtccttctgcaagaaaacgcaacaatggcggtggtgattagttggaaaactcaatttgggatatctcctcatttttacatgtcacttaaaagatcattaaaaaattttagtagaatagagatatgtcacttcacaaacatgcaaatttaaatttaacttgtacgagtagaacgcgtaatttatgggtcaaatttgttatttttgtttcgaattgtataagttgaattttaacttgcatatttgcaaaagatatatcatgtattgaatcgcatacacaaaactaggggatgtcatctggagggggaaaaaaatccactttcgtgattagtttgatcgattttgaaggttttgatgggggtttgtgtgtgtttgtgtttacctcgatggtgaggcgggtcttgacgagctccatggggtaggtgcagagggtggaggcgacaccggcgagggcgccggcgacgagggggacggggatggggatcttggcaggctcgccgtcctccggggtgaggtacttcttggccgtgtcgtaggtgaaatgctgcaggacgccatggattcgatcacgagaaattcaaagaaaaacaaagtggagggtgtgaggttgagttggttgcctcgatggccttgctgggggcgacgcggaggacgttgacggcgttgccgcggaagaggccggtccagccctcggtgcgcatgatccagcggaagacctcggccatggagccggcgccgcagctgccgaccatgaggtgggtgcggatggtctccagcggcgccacgaaggtgcgcgacacggcgccggcgatggcgccgctcaccagccggcgaaggtgcgggttcccgatcttcaccctcaccttcctcagcgacagcagcccgccgccgcccttcatcttcctgccctgcctcttcttccccgccgcctcctcggcctccgcggcggcgagctgccgcgcgacgtcgcagttgtcccggcccttcgccgcagacggcaagctgagcccgacgctggcgaacagcggcggcgcagccgtccggcgagggaactccaacctcttgctgctgctgttgatgcactccccttccaccgagctccacgggaacgacacctccgggacgaaccaccccttcctgtccaccaccgccaccgcgccgccgccgacggcgttgttcctcgtcaccatcgtcgtcaccgccatcatcgccgccatcgatcacaccaaaattaaaactacttcctgctgctacaagcgcaatcaaaattaaacaagaagaactaaaaccgatcgatcaaatatgacaactacgcacctagctcgaggaggaaagaaagaatcagagcgagcgttgctgcttctggcttctgattcctggctggtgttcttgggattcttggcaatggcgccccattttatagccattccgtcccgtccaccacctgcacggtggcgtgcactcctcgcgacgaaaagccccccacacagctagcaagccccgctccccgccgggcactccaccaacggggg

SEQ ID NO: 62766 - DNA, 7990 bp, Oryza sativa
ctgcgtgcgtgcgcagttcgatcagttgctccttctcgaggaggaagaaacggacagtggccgtggtcctgggcaggtgcattcatgtgctctgcgattttcgaaggtaggcatgcaagcaatgtgctactggttgttaggaggctgggatggaatggaatggaaggcgtgaatcgaagcattggcaatttggcgtcgggcaaagaaagaaagagcatgagctgcaaagagcaagggaggttttgggctttttggcggtgttcatggaaagcggagctggtagattagctgtacgtagtaacgtaaaaggccgtaacgtaaggggctagaatagataggtggctggagagcggagcacggagccgcgcgcgcacgcgcgggggcacgtttgggttgcccggcgacgaggctggtactcgcgcgcggggaaggttgtgggcttctgtgcgtgtgcgcagatggtttattacgaaaccacttggttttcgcggaaacttaaataggtttttttgttgggttgagatcacaaaaccgctcagtaaattggtcgagctaggaaaaaagagtttaactagattttaaagttttggtaaaagttaattgaatttcacggctagtcaatggtttttaagatggttttcgtgaaaagcagagggaacggacttcatagcggttttggaaggtgatttggtttcgtgaatccatgcagactctatgtcagaatgtatatatgtgaatgaattgtgcggacaaatatcgcacatcggttgtcaccatctaggtaatcttgtgtatggccacacaggtctcaaagagtggtttcgataaaaaaaataagaagagtatcggtatcctagcaagatgatattcagctggttacaaggtcttaacagacaatggaaaaataaaaactctcattttctgtgatacaatttcaaaattgaaggcgagtttttttccccttctgaagtgaaatgataaatagtaatattgtaagaaaataagacgtaactgataaaaaaatatccctttggactagtaacgagcaaccgaccattagattaggagctatagttatcaccaggatttcgatcgtagtctttaactagtgttggtatagaaaaactattagtggtacggttgacaaaacccacacagtggatatgccactgctcaaaatgtgagatttgttcttttctcacttgaaactttgggtattgcatacatttatgccactacgatgatagaatctgacaaggaccatcatcactccaactcactcaacacttatacttgtctttccttcgaatgcttatagaggatggattgattttatgagtgatggattgttatgttaaattcaagtgttattgatataatgtgatgaacacatgatggacctatttgtatgaatacacgaatgagtagcacacaactctatgtaaaattattatgggaccataagatcgaaaaggcgatgatgcaataacttagaacttatttcatcctcatgccaccaaagattcgcctttggcacaattttttctcgttgtcatgatccaacgcaactacacgctataaggtgacgtatacatcaacctttaacttcaaaggtaattaactattatgctgtttttttatgctatatgtgttgtcatgtattgttaccggctcatcgtcactaaggatgcctttagttccgagttagccgtttcaccaaactcatcctaattttatacccatactgttgttaacagtgaaattcgataagcccggaatagtcatcggcttagagtcagcgttggcttcgacgtcctgagattagccgatgagagttttcaagtcgtcagttgtcagattcttgctatattcagttaaggaaattgatctactaaaggaagcttatccagaagagactgagttcaaagagaatgcagtatggcaagttatctattaattaggaatagtttgttagtttccttttatctttaggaaagtgtgtttagtgtcctataagactttatcttttccttttatttttaggaaggtttctttcttatccgacaaggatttttatacccatgggtatatgtacacccggggtctatgtaatctatcgctacgatcaatacaatttggcgcatcgcgaccctttttacttctacttttgtttttacgttccggcggaatttggaacccgacgcggggctgcatcgtcttcgatctccggcgaagggataagtccaatgttccaccggtccaggcaattgtatcatctacgtcggcgtcgttcaaggctgcatcagtacattcgacctctcggattactctggtttggataatatatttgcctggctatttatcatatgtctatgttaatctagtcctagcatctcaatttagctctatcggctgtctctcgctttagggtttctaccggtatcggctaaatcaccttgctagattagattagcttaggcatctaccaccctgaaaatcagtcaacagcttggttgtctagatattgtgtttcttttcatacttagtgctgcatcagttaagtttgatctactaattcgtgcttagaaccataatctctagcctgttttttgactgccaataagggtttcatcggggtttcagccgatgagttatctaggcgttgcatcggcttacaaggattgtatacatattggatttagccgatcgcaataaagatttaattgtttaatataatcttgtggattttataacatcggatctccagctgatgtatgctttaaccttcgaatcgatgcttatttatcatatcattttttgccgattggtttatattggatcatattgttatatacatcatcatcaaccgattgtctttatatcattatctacattggacatatagccgattgcttaaaccctatcgctatcggctggtatcggcatcggctatttatcggctatcggctggaactactccgtcggcttgtcagctgatcgactgtttgatctactatttgcatatcttgtcagttgcaggatcaaactgactggcacgcccgcatctcaccaacctttggacctgcacaggagttaagcagatctcccaggccagtgtgtttgattttttcgtcaacaactgtgacggttggttatatatgagttaaaaaaaactcgacttgagaggggtaagcccgggcactttgcaaagaaaaagaccttctcaagctgttagataaaagctccgaacctttggcccactcttacacaaacgacaccgtagcatatgtgagaacgacaagcgatttaggccgggccctagacctatgcttaggtgtgtgaccaacgagggaattttttaaaccctagcttgaaattcgctcccacgtttttttccttggatatacacttgtatcgaataagttttgtcccgagacaacatacactgcctaccttttttggcttacatcatgtaggctggtgaaacatatttgaatttcatttccgcaaggcaaaaaccttcattttgtatgtttaaagacatgtctcgcaaaaaaaaagggaactaaacaagatgttgccatatgttgtaggatagggtaaagcttgttgtacgaaaccaaacatacttatatgcgctccttcacattcttccatgctccatatagcctatggctaccttttcccattatttttttcacatagtgtttgttctcctacagtctcatcaccgattgctactcctattatggagatcgcacgctttttcagtgtataatataattaggtgttatttttaattatgattgatgttttagattctactagttcaaacttttgtaatttttgaaaacaccaatggatctcgtagcatcagaattcagaaaccctctaaaaagaaaataaagaacttaaaggaaaaaaactcataaaacatcacgacaacaaattttggacggagccgtcagagcgacagatttatggtcacattataagggagcttttaattatttgccactgttagtaatttggtcgcgcggaacaactcacgatggcctcaactcaaagctccccaaaaacccggaagccgcgccgcgagctcgcctagggttttaaaacccatctcccctccctcccccgttccgccgaccacctgctccgccacctctcctcctagggttccggcgagcgacctccaccccggccatgccgccgccgcccccgccgcgcgagctcctggccgtcgtcgaggcggcgctgctcgggccatccccgccgtcgccggcgcagcgcgtggagctcctccacgccgtccgcgatgccgcccccgcattccgcgcgctcctctcctacccggtgagcccctcgccgcccctagcggtaggaatcgttcggtgttcgtccgggagctcggttttgatttcggggtgttttgggtttttgggcgtctctgtggtttgtgttggtaggggccgaaggcgtcggatcggactcaggtggaggccaaggaagtgcggctcccggacatgcctcccataacgctcgatgacaccgacgtgcagacggtaagctccctcgccaaccatttggtgtgatgcgctatgcatttacctggttatgcttggaacatgtgagaaatgcgtaattcttctgcttaaggtgagcatcacgtgatttatgtacccctgatgttgggcgaaacttgaaacttttgattagtctctggtagagatcctatgtggggtcatagttgcaaaatagtatcaagtctgttgagatgagctgtaattttgcccgcgagatagtgcgattttatctcttcctgagtattcagttgatttagtgcttttgtttctttgtagttttacaatgaaatgctttctataaaatctggtggctttgtggtcaaatatgtttctggaggtgattttttgggtgggaggtagcttgttatgcaatgtatcaatgacagacatgtatctttggtaggacaattgttcaaatttgtgaactcttgagctgtgaccttatcttaaggcgactaactgagatcgcatatgacactacttgctttaggtgcctatttccctcaaaacaaatgctaattaacacagtgaagtaaaattaagactagagcttgttgatttttttaattgatactggccaaccaaagaaccgttagaaattactgttgtgcttcaaatacagtaagcatcaacatggcttatgacaccactctttttatgcttaagatatatgctagagaaaacaagccttagtgcccaactgcccatccagtgcaatgtttgaattcttgaacctattctgacaagtctttacatgtgcactacgtctgctatgctagtgtggaaacattaccatttggttgcatcacccattatttgcttctttatattgaaggatcagatctgggatggctgttgtttgcacactttcacctataatgtagatccccgtgatttatcatttatttgttgatcatcatttgtccccagataaatgacattattttgagggctcttccttttgttttcttcactcaagtcaaagctcatatacattttttcaggccctgaaattgagtgatgaactcaatcttaatgagattgagtgtgttcgattgctagttgacgccaacagggaggtacacttttcagtataatagttatctctaattctatactatctatgtttacttcacctgaccatttgtgcggtggtggttttatagtgggttctatatggccgagagccactggaaatatataggctcgcagctggcctttggtacatggagagaagggatcttataacctctttgtacattctgttacgggtagtctattgatcgtgctcattccagttattaactagtctgagttttgaatgatgcatttaatagttctctttatcttctgcagtctgttgtacttgaccaagggcttgatgctgatctgatgtatgaaatacaaaaccaaatggaggctctatttattgagggtctcgggcagcgtataattacactagtaaaggttagatttgatggagcttgtgtactctctttcatgttttatttaatgagcaatgttgaacacgaatgctgtagtaacaatgagaaggctaatgcagatttggagtcttctcttgacagatgcaatgtacgggcttaacctatttttgtgataaatgtggaaaactggagagtgcatttgaactctagcttgtaggcttaaaaatagttgaagcaattgatgtgggtagggaactagcaaatattggtgctgttctgacattttctattcatatcatgtttgcagttcaatctgaagttatgacgttccatcagcacttctttggaactattaagcactgaaaaatatatagcaattttataagacttctagtaaactttcttagctttgatttatttatatttatttaggttcgtacctagatttttatgaacatttaacataccatagtgtttcttttattattattcttcgacatatttgcactcttgttggaagctgtgtcatgtctgcggcatcacttataacaaagggcgtatcatatttgggaaaatttattgtgctgtgaatatggaaaggtttcatatcatcttttttttttgggtgaaactaagattgacggttttaacttttctccccataaaggaacttaatcgtgaagaatcaactggtgttggccaaccaagctctgagcattatgtgcttgatttcagaggggctcttgtggagaggcgtgccattgtttctcgcgagagattaagtttgagccactgccttgctctttctgcacttattaaattgatgagtaagttaaatgctctgtatagttgctaatatcacctgatttgaccttctgatgtgtccgcttagtgacttgagtgaccatcatttcaatatttttccctgaaattcaaatataggaagcttgatagtttttctgagtgatagagaaccatcactaatgatgaactttatgtaggtcccagggaggttaaggatgtattttcattgttaaaagactgtgcagctgaagttaatgaaaattctagcgtggagcttcaggtttgaagtttgaacaaatgactttgaaattgcatttgtagacatgctattggtataatttgaattgtttattgttgttgtacaactcttactatcatttattgttgcagatcacctatggcgttcttttttctcttgtagtaacttttgtttctgatgccttaagtacttcccatgagaaaccatctttgtcatcttccgattcttcgttcaggcgtgattttcatgagctggtaatctttacagatgcccaacctgactatatttccaatgagttctttcctattatttgtttagttggaacatatggaaaaaaacatgctcattgcatgctttcattgttaacatgtcaggtgatgaggtcagataacaatttgactattgaaggatttgttggtgttgtgcgacttgcatgggcagttcatttgatgttaactcaagatcgaagcagtgcaagagatactctcactagttcttcgagagatgtgacagatatatgggcatgtctggagataatctgtcgccagaatagttttcaatttttgcaggaacgtattatgcaaacagctgcctacaaggtatttattactgtctttatgctagcatcctgggttgtcgggttaaagaaagtatgttgctaccgtgcataaaagtatggatcatgttattccctatcactctaatgtggctttgcctgtttgacctgtaagtatgaagtaagtacgttgctgcttcccaggaatttgagttcatgaaattttgcatcatgattcatgagatcagaaggtgtactgcttttgtttgagcgtaagttgaaatagagcatgcgattttgcatggttgcagatgattacaatggctatattagtactttc

SEQ ID NO: 62767 - DNA, 1216 bp, Oryza sativa
tttttggacattacatgctcgcactgttctcttttttcttccttttttctattacagaatatgtctattgctgtaaatagaaggcgttcaagtatgctttcccatgatgtttttcactttactaagctctaatttcaaggacatcacttatttgatatttatgtgctctcgccagaaagaacctgagctagtgcatggaaacgaggaactttggacctttgtcatatctgcaggagaagatcacaccaatacactaactcttgtggcattccttggacttcttagtactttggtatgcaaaatgttgcataacactgctgcacattcaatcttttacaccgtttgtaacaatctggtcttgtaggcttccagtgaagttggtgctgccaaagtctacgaactgctccagggaaaagtttaccgttcacttggttggagcactttgtttgattgcttatctatttatgaagaaaagttcaaagaatcccttcaatcttctgcaagcgtgatgcctgagtttcctgaagcggatgcacaggcacttgtttcgtatttagctgttctccagaaggtcttcacttctcagcatactgtcatattatcttggttccatccaaacatattctagcaatgctgtgaaatctttaaggactttgacctattttttttacacaatgcttttttttttttgcccagcaagagcattgtattccaatggttattttcaccttacttatgtgctcttgtggtggatttcattattttgatctgacaagttaattatggcctaacactcttcttgtgaagaaatactgactatatagtaaagtaaaaaaagctagagaaactgtactcaaaactatagctaggaaatcatacctagtcttgtaactccttaaatggttatgctatttccctcagaggttatcatggtaggattcttgtcaactgttaacatttatcttagctatttattctgcttttggattcttaataactagcatgttctggcccaatttgtgcttaggtctgacatatgttttactctctgtattttggattttagctagatgacttttctccagtcttgtttaccttttgtctcagatgcattcaatcgtaaattggtctgtgtcgcttttgtttctaacattcatgcatattcataataatctgttcctgtttcttcttttgcccatgggtatgttctttatga

SEQ ID NO: 62768 - DNA, 688 bp, Oryza sativa
ggcctaggcggcggctagtgggtgcctaggtcggatagtcagatccaagaaattagcaagcataacatgaaaattagttatataacaccaaaatagcaactaaataccacccaagcaagttcagctacctaatgcaccatatagggggtgcctagcgccaacttttagaagacagtctccgtatattagggatgaaggggctagatggctatgttgaggtctttttggagcaattatgatggcgcaacattcaggagtcaggacatcacaaactccataaatatcccacttggcaaataagacaatgttaactatgtttccgtgctgcaaatctcatgtgttatttttttcacccaggttttggatttgcttgaagttgtccagttcagatgtccggacacttccattaaatacccccagatgctttctaacctgagacttgaatcaaaggtctgccctttaaacatcaactttttaagttcgattagttatcatctgattctttctgctaatagattgaagagatcctaaggaattccgcgacatctgaatttggtggtgtatattattattcagagcgaggcgatagattgattgatcttgatgcatttcatgaaaaacttctccaggtcattttttcagccttattcgttgttattacacttttatgtttcctatggtttttttt

SEQ ID NO: 62769 - DNA, 2114 bp, Oryza sativa
attcctgcagccctttctgcatcgcacttgcattttgtcatgggaattgggcatttgggccgtgaggccaaggcccatggagccaactctagggcagatgaacagcgcagtgggtactgtggcagcggattaggagataagattagggaattgggaaataagataaggatgggattgtattcatttggagttaagcaatgaaaatcaattagtctaatctcttcccctaatgttcttctccccaacctaagtctacattccttctccaagagccaacaccacttgctatctctctgaggtggttatcctgtcatggccttgggtcgtggcacatctggaaatcaaaatttgtttgctctataatgaaacgatgaaaacatagccattttggataatcgggagtttggagcgccctactgaagaatttcactttttaaaacccatattttactagaggaaacaccatattgcccagcccattgtacggccaactctttggtcctacactacacctacatcattgttaatttgtcattaccccacagcacttttggccaaattggatctgcagggactgaggtagtctcacctcagtccctgcaggaagtgaggatgttgttaaaagctaagttatttgctgggtgtggtgttttcctttttcctgcttttcttgatagtaagttttttaggcaggtgtgaaggaatagcatcattcacaagctgcattggatagatactttcttataatagctttattgaatgctgcggtacatttcaagcattgtttgcttgtgggttataaatgcaacatatggtatggtgagaacccatgaaaaatgtctatagttctccatagttacatcaacccagttgtaaaagagcattatcattagctattagctcagggcgaagtaaatatttgcatatactgctttatcctgaattttatcatttcatgacttgatatttcatataactttgtagttgtgctaggcctggtattatgagattctggcctacggaggtaccacatcagctagaactgattgtccatggcttgggtttgatttgtgcttgatttatgttatggacgctgattcatggatcgggtaatggtctgaagactgggataaagtccatatcattctcattggcattggcttgtccgatgttcaggagactctgatcaatctacctaagtaacctaactttatgattttcctgcttaattaatgatggggtacatgggctccctttatatataagaaggattgatttgacatctgaggaacaaatctataatattatagacactaatctgatctatctctaatttactgacaagctttatctgtcttaactagataatctcctacctttatttgacttattcctaatttgatgattaacctgctaattagctgtaagggctgtcctggccatgccatgacatttatcaacagtttggtgaaaattgacaggtttttagaggatgaaaatttggcctcaggtgataattttgtcaagagaggtaaaatggacttgttccattacttcctggaaacgtatttggaaatgttgggcttccctccggtgcaaattcttcatttggctggccatcaataataggtgttggacagccgatcgtctagctaagcgtgggctgcagcacacagtgatctgtcccctttgtgatcaaagtgaagaatccatccaacacattttgatctcctgtgttttttctcgccaagtttggacggcaatctttttgagactagggttagctgaggctgcgcctcagccctctaccgaccgctttctgaggtggtggagccaagcaacgaagaaccagccgaaggaggtgcggaaagggattaactccttggtaacattagtagcttgggagatttggaagcaccgcaacgactgcgttttcaataacgccaatcctagagtagcgacgtcttgcaagtgatagaaaatgagggccatctttggggtgttgctggagcttctcgccttcaaaagctccttagtgggacggctaacctaggcaactaagctccccgggttgtctagtgtgtgtgggtcttggtaggagggctcgggcgggc

SEQ ID NO: 62770 - DNA, 15797 bp, Oryza sativa
ttatatatactattctcgatttagtcatagttgtcaatactcaatacaatgcaaggtaaattaaccaggagaagcttggataagctaaggcatcagttttttcaatgacaagtacttggaccatgtatccaggtgaatatttttattagcttatttctgcaatatgtgatgttcacactgtacacacgatgctattttcactactgcaagaactcaaacaaccacttttgttcagcatgtctagaagattagatcaacaatattgataatgtcaaagggaaatcatattgaatgatgtttctacagcatttcactaatctatctctacagctgttgggctacaaatagctaactatatatttgattctcgtttgacattcatttgacaaataatggggtgagtattttctttctatcttgatagttgcattttacatgtgaatcatccatgtcctctcagcttcctgttctcttgtggcccatctatacttttacctctcagcttcctgttctcttgtggcccatttgatcctgcccacagcatatatgttggcgtttctccattttattctctgtggctgagaagagattgcacattggcacatctggtttttttttttttttttttactgggacatctggttgtttttcactgcaaaagaatgcaaatgcactgttagccaggtttttgaatcactcatcgattattgaacagggaatacagtttatctctgcatgattgatcttcttggactgctatgctaaatatgtcaggcacagtacaagcttgccagtccaggaaactaactaggagtataaaacatgataatcatagctggatcagataaatctcattgtgtcagcaccaaactgtaactgattaaccgtcttaagctgcagacttgcagtattgcatgagcaaaagactgctgggtacggtcagttatcctactgtaatgactaatgacagcaacttactggtaagtgatttggtctgaaacaacatccttagctttaagttgctggatcggccttcaacgattccaggtggtttggttgtaccaaggaaattggattacaatagaaggattccaagttcttttttttcccccgaaacacattataggtactcgtgtacatgtgcgtacactcatgaaatatagtacaacgcgtacacacttagagcaagtttaatagtatagctcactactagctccaaatcatctatagctaatataatagccaattcatacaatagttgtttactatactattaatatctggtcccacctgttatacacacaatacgtcttggagtccgtgctgcagctggctacagatctgtagcccgctgctcttctctctcttctttatctctttaaaatatgtttatagttagcttaaagcaagtttaatagtatagccaactactagctccaattcatctatagccaatctaatagctcattcatacaataatacatactacactattaatacccggtcccacctgtcatacaaatctgtagcccgctgctcttctcttcttatttatctacttaaaatatgtttgcagctggcttatagcctgttattgtacctgctcttagagcaagtttaatagtatagcccactactagctccaattcatctatagccagtgtaatagctaattcatacaatagttgcttactaaattattaatatatggtcccacttgtcatacacacatcgcatcttagagtccgtactgcagctggctacagatctgtagctcgctgctctttctctctcatcttttatatcattaaaatatgtttatagctggctaatagtctgctattgtaaatgctcttatagcctgctattgtacctgctcttacctctaggaagttgcatgtgcaataagtgcctttgaaaaatgggcctgttgtatacacactggcacactcatccctatgaaactaggtgtatccctgcgctttgctgcgggaattattaaccaattttcaatatatttttttcgataatcgagctagaagtaaaaagaaaaaaaataaaacgtgagggtttatcaatacttctataaaacaaacaaatgatacttgcaattttgacaagtgtatgttaaatattataaaaatgatagatagatttgttaaaatattgtggaaatgaagtgagggtgatgatcagatatacttacatgttgatttgtagaattaaataaattatactccctccgtttcacaatgtaagtcattttagcatttcccacattcatattgatgttaatgaatttagatagatatatgtctaaattcattaacatcaatatgaatatgggaaatattagaatgacttacattgtgaaacggaggaagtacatgatgttgtatgcttgcataaggttaaatatgtaactattgctagtgggtgatgatgtgacatagttgcattcagggtttacaattccaacgaaatccggtcggattttgcgaaatttcgacattccgacgaggcttgaaagtataaactgtttgagatttcgaggagtttcatccaaattcaaatttgaattgataaaaaaggaaagaaacaaataaaatcttataatatgatattaatagaatctattgggatataaatatttgaaaaaaatgatatattgtgtgtatttactgaaacttacatcagtaaagaaaagaataaataattaaaaaaaggaaaacacttacatggcccggattgcatgtactaggcccagtaagtagttggtccaaattacatatttttggtccaaattacatattactgatcgaaatttcgatgatttcgatcggaatttcgccaaaaccgaccggttttcaagaacttgtcagcaaaatcagggaatttgtattcaaattttggtttatgaaatttgttcggaattttccggttttccaccggatttcgcgaaattccgaattccgctagtgcccgaaacggaagggcctgtcgaaatcgtaaaccctggttgcatcttaagctttaggagttagtgagcatcaactttataataagataggatatgaatgtagtgagcaccttgaaagaagcataacttaagattaacaaagctaccatcagctttatggtcgcatgttgagttttaggagttagtgggcatcaactttatactaaggcaggatatgaatgcactaagcaccttgaaagaggcataacttaagattaacgaagtcaccgtaaacatcttgttatagactgaaaacttattgttaacagataccatgtaaataccaacacacttgtgttcaggttatgacatgaaactaggtgagtaggctccatcaactacgcttagggctagggatgaaaacggtatgtaaacttttcgaaaaatttttcccggggacctatttttcgaaaacaaatctgtcggttggaattttttcagaaacgaaaatgaattcggaaataatttctcgaaaacataattgaatatgataaaggaagccctcgtcggaactcggaatcggtcggaaactttccgaaaaatttatcggaatttccgaaattataaaggcctataccatagtctataattcctccccagtccaacccaaatcaacatcctaattcctaagtcactcaattcagcccaatccaatacacccaattcaaacttgagaattggacttatatgattgtgttttatgatgtaatgttgatatttgagacttgataattggatttgacatagtttaaagattagtttgaggggttttttattccgataagttttcattaccgtatcagcgttggaccgttttcggttttgacaatatttgattccattttcgtatccggggtttccgattccgaaaaaaaatatgaaaacaaaaccgataaaggtggtttccgtccattttcgtaccgttttcatccctacttagggcctctttgagttataagaataaaaaaacaaaggaataggaaaaacacataattccgataggaatacaagtgtaaaacggaggattgcaaaacacatgaatgattgtttgattcgataggaatgcatgtgtaaaacggaagattgcaaaacacagaagtgattgtttgattggaccgcagaaaaacacatgaatcggatgaaagagatagactaaagtattttttccaagatgctgaacctcttgctaggttttctccaaaaccgttttataggatttggaaaaccccaatcctctaaatcaaaccctttgattgaaaggggcacttagtttgtgaattccaagttacttctaccacgtaacaatattaaatttgacatgtttgcgaaacaagaactaatagagagtgtacgtttgtaattaagcataatttcacgggtacgactcaaacatatttgaaaacatgaccaattatgccacgaacagccaaagcaacacccaccttaacatcagcagcatcgacagcgacccaaacaagcacgaggattatgatctgatatttttcgtcgcgtatcagccaaagacgggggccaacgtcaatcacccgacggacggtccagatcacgacgtgacacgcccggtttctcctcgcccaaaacacgtgtactaccccgactatacgagccatccatgaggggaccacaacgagaccccacctgtcagtgacacacttgccctggcacggcacggcgacgcgcgacgcggccccgcgcagccgccgacacgtgggccccatgggaggacgaggccccgggcagccgccgacacgtgggccccacgggaggacgaggccccctttgacccgcctcgacgtcggtgccgccgcgtgaacctcctcgtgggccgaggcgagacgaacacgagagaaagacgaagaaaaataaaaacctccaaaaaaaagaaaaaaaagggagaaaaaacgccgcgggttggattaaagaggtaggttttgatgctggcttaaatctcaccccgtttcgtgcgatttatttatttattatctcgtcgtctcgtcttcctccctcctccgcctgatcgagatcgcttctgctccagccgccgccgccgccgccgccgaagtccgcaggtgcgaggacgccgacgagtctccagagagcaggtgcgtgcgcgttctccctccccttcttcttctcccgctcggtttgtttcgttcgtttcgggtgatgcgctttaatttgcatgtttgatcgattcctgttcgtggagacgggttggattgggtgatcggtgcgggaggaggggggcggattcacggaatcgagggtagatttgtgcaatttttgcgggcgatgatggcgtgtctccctcccctggctatctcctccgtgtgtcgaattttttttcttgcgagcattagcaacgtctcgttcgcgcgcggtagggtttgtggggggagaggtccccggcgtcgagattcgtgccgccgttgatcgttcgacagctgttgcatccgattcgatgtgggtgcgcgccgcaggggaggggtggggcagagctggtggtggttttttgctcttggagccttggatgagtgggggcatgatccttgttgtagagtatagggacttacagctatgggtttgtggattttttactggtacatatcttctttagttgcaagagaaaagtgatagctatgttggctgtgggtttgttgtgtgctctgaatttttttttaggcttttgtagtttgtcttatgtgattacctttgactgtcactcattttaaacttttcttgtttgtcatactaagtaaggtataagtcatgcttagatgaaagtatgaaaccatgtctagtcatcgatgttatgtgctattaagaaataaataggatttagcacggtgagcgcgtctggatatgtgtgcggggctgtggctgccaacgcgcaacgctcggttatgatgtgctatcatgctgtgcactgttcatgatacggtccatctgctgactggggctttgatgccctgaaggactaaacctaaagaggatttagatctttttgttcatctccatgatgcattgcagtgcaccacatcgaatgtatacaagaaagctggtcagccaaactgggtggtggctaactttcaccttgtcaaggccagattacgtcatcctgaaactatagtagtgcatgcaagtgtggtgaatcaatacagcacacatgccatggaatctattgtacccatggtgtgcgcaactgcgcatccaacttataacaatatataattaaaggtttgtgtactgtagtgttgctctgttttgggtagatgccttcatcctagcccatacgtgtgccttcccattgctatgtgggtaatggcgcaagacacttagttaaaccagatctatgctcgtgcaattgttctcagtgaggaattagtgcatgaacgactaggaaacagatgtgctctgcagtctgtctttggaatctacaggccaagatactccatgcaagatttcaagtgcaactaatcattcaatttctaggaataagagcatactttaagtcttaaaccaatgtttgcaaaagtgaggacagcgtatgattgtttatgactgtttgactattctgtgagctccaatgaggtccgggtaggtgccgcatggcatgaatttttgttgtttatatcaagttcaactggtgttcatatatatcgttcatatatccatgacacgctttcctcacccacataggggactagtgctttacattgtggaatctgtatccctgtgatcacaagcaatttaattttttagtgaaatcagaagcagtttaatacctcaagtttatataaatggtgatttgatcccacaattgactatctaccaagatttaaaatcatattctgctacatatagtcgaacgctaacatggatttttagtttgcactttgtagtttattaatgtatacctagtaatttcccatgtagaactcaggtacttagaagcttagtcatgttttagccgcaccagtcaaacagatacttttgacagtgggactattgctgaagatttttggtgttctatcagtagtactcatactggttttagtacgcttattaacacaaaagctaaaaggcttgagctgttcttcttggttgtgcaaaagcagagaatcaaagcatgttaggttatcaagtgatcgcttcctttggagtttggtcatggtcatgcatggaagcacttccctaggagagaatccaagctagcttttggcccctcagtttttttcccaaggactccatgatttgtatttgcttctgctttcacttcacccaagagaatggaatggaagagaaggcatatcatcctatggttttgaaacctacatatcccctcctggcatctactatcagtctaccaccagtgctagtgctagcaaatatagtacagtgacataatagaaaaaatagatagatgaaaagcaaaagtaaatccactgatgtaaagcctcaacctcaaggatgagcacaagtaaaggggcaaggaaacaacagaagagatgcaaaacacaaccggaaataaaaggaggtgaaaaagaattctaaagaggatggtcactggcacccttgaagactactgcctcttgatttctctatctttattgaaattcatgcattattatcagttatgcatcaggccatctctatttgctttctgccatcatgttcatcttgggttgtgaaatgaaggttaatttaagatgatgggatctttctctgttttcggaaattccttctcaatgtttcctcttataaaaaaggataaagccaattgctcaccacttacagctcagcaatccattatgtctgtcttgatttcaagtggttccttttctttcacttacccctgtcagcagtattaactccctgtcagtatgctttgggtttgcattagacaaaattgcacaactctattatggatatgactagagggctagaggctactatttttagttaatatgaacaaagttgtgtttccgtagcaccttattgttgataagagagggaacacaaggggcccaaagaggtgcttgaatttctgaaaggttccgaggatgtccttccaaacaaataagctcaggcaatgactgagcaaaagtgcatcaagtaactgatagttatcaaacttttatttgttactcttgtcaacataagaactatattaattaatcccaatctcagaataaatcttattcactgtgagatattctctctgaagaaaaaagagtttcgttcggtagatttaactttagttgagatgatacttctttcatggttttaaactagtgtaagttttgctttgtaacttgcacatcatgtcatttccatgtagatgttcaccttgtaggtatgttgacaaaagttttatgcccctttctatccttgcatctcgaatattcacatggtctacaagatcatggatcaattcatgcttgttccttcctatccaaaattttagccagtctatttgtaatctataaaaaagtcacacttcatttgagctctgcttgatatctattttttttggtctatactgatttatttctgccatcttaattagtgacaaaaaatgctttagccggttaattatgcttacaccagagtcatgggatttttcctagtttagataaactgttctatgttacactaacggatggttgatttgctattttggcggataattcaccggacatagttttaggcttgagccgatgtgaccgtttgttggaatggatgccatggaatttcctcaattattgctagtgaaagaaggcaaagttagcatcgaatataagggatgagaatagctttttatagttgcaagaatggatagttatatagcaatagatatagcataagttcagaatgataaccaccattcttgtcacctcatagacttgctcttttgagacctcacagattaactcatttaggtctatatccattttctcgtagaatcaataataagtgctgcttttacactctgcttctcttcttttcataagtttggtgtaatgcttgaaatagttgtgcaaatgcagtattctggttccatcacacgtgtgtggatagctctggagcaccggtagcacaattgcacaattcagtgtgatacgctgcattattaggcataactaattagattttgcactcttttagaatagatatggtttgccttgccattttggaatctgctaaagaagagggtgatgtgttggcccttggaaaattggaatgtcaggaattctgtctcacaacagttaacacagcaggcctcaactgcatgtctaaccaaatatgtacctattcttgatgtgaaactatacattcgctgtccataaagttcctgatatgtcagtctcgggtgaacacagattaaatatcatgtggtcctgactcgtctcagttatcctcatttgattggaacatttgaactagatacaatcaaatcaaaaccctcaggatcacccttttattctctgagacttaatctgaaactatttgtatctctcttatcaaaagcagaaaaaggtcagtcaatactcaaattagaatctttgccatttttagacatgaaacacttcttgattcagccatgcttgtccaaaattaaatatcgacctaagcacaataattcaggacctaatttcgagtcttttctttttcctcttgaaaccatgatgtgtcagtttcaagaatattggttatcactagctccaacactgtgaatcagtcttttacttgacctgaagatgtacaatccttttcatgtggaaatttgggaaatgtcaaacgcaccagtcttgcaaaactgttttctcatgagaccaataacttttgactcaagctgtacttaaagaacaaaaggagatatctaattgagtgtagatttatttctaaaaatttccagtctgatctaaagtcccctcttattgttggtccataatgctccctgaaaacagaaatagtggataatacttgtactaaccattagctccatttttctgaaatgattttctgttcttcctctgacattccatattagctttggtggctttggttctatatgtattttgctaaaaatattctggtcgaataaccactgttacataactaattgcatcttaatttcctaagcacaagaatattgcgcactagtgccatccctccaccccatgtctcaaaagatgttgccaaggcaggcagagatgcagggtaaaggaagcattcaaactccccatatttcttttgccctttaatggctttctcttcttttctttaactcccctcttctttctagttttacgtgattctcttgttcttcgcgggccaaagtgcaccaaagaaccaaaggcacaaagataacccgcccctcggtttcagcaacccctgccaccgcactataaatacccctgcacattagcacctcgctgcatcaccctttcacctcacagcattttccaccttagagctcaccaacacagcagctgatacttgtttaggtaactgagcttcctgttagtgtttgttcatttgttttgtatgcatgtaagcatgttggttgtggttttcctatttcttgaatgcaaaaggttttgcaaagagagaacagctgggttatcttataagtcaagtgtgcttctgggcttcagtttgatcattttttcttcgcccttgctctgatccaataatctttaatgagtggtacattgttgatgtgcagggtaagacaagatgaacaggaagccaggagactgggactgcagggcgtgccagcacctcaacttcagccgccgggacctatgccagcgctgcggcgagccgcgtggcgccgctgatcgcggcagcggtggtggcggtgactacgccaacttcggcggccgtggtggttcctccttcggtggaggctttggcactggctctgatgtccgcccaggtgactggtactgcaactgcggcgcgcacaacttcgccagccgctccagctgcttcaagtgcgctgctttcaaggacgatgctgccgtcaacagtggcggcgctggtgcctttgatggtggggacatgtcgcgctcgcggggctacggcttcggcagcggcgccgtccgcgccagccgccctggctggaagtctggcgactggatttgcaccaggtgcgtgtcatcactagttaggctatccttttcttttggttttaatatctgtttgctttagcaaatcaactattcatagccaatatatgatttttcccagcccttattatggtataagacagtacatggcatggataatttacatggttaatttagtggtagttacggacttttgaaagcttgtaatatttctccgtaccatttttgcatattagggggggggggtcctgtttcttcagaagagacaggaggatcaactaattatgctgcctgtcttcattcaatcattcatgagaaagctagtggttctgttatgctgcacgagaatattagtagcttatgtatagtaccgtagttgtaactagaggtattcatccatggttttctcaatctgtggaaaaccggaagtagttgagatgacactatatttatcgtagcatgcggcaaattgatcagtatggcctatttttgaacagtttcattcaaaatctgaatgaacggccctaggcctcgagtatcactgatgatgtggtcgctttaaatattatactgataagcgaagtgtctatgtcacatttttagctccctggcaactgtagcagcatagcatgttccatacatctccaatgctggatttgcataacttcgcaatatatgtgtctaataatgaactctgctttctgttaactcttgtattttctatgtttgatcacaggtctggatgcaatgagcacaacttcgccagcaggatggagtgcttcaggtgcaacgcaccgcgggactccggtagcgctatgacatacgaaaattacttgtaaattatcgtgaatctccccttgtctcctgcctcatgtcatgatctgatctcgtgcgtgttatgcatttgcaggcactgaggtgtaatttgccgtacgtgtccgatcgatctggatccgatgaggcttgcagcagtgacgacgagcagcagaagcagcgttaagagttgtgatgtctacataagaagaagaagaaagtagaatgcaaaagaaatctccccatggttttactagttttgtttcttcccgttttagatttggttctgattcccatttgggaggacccgtcgacccctgattatctatgttttacccgttttatttcctgtttctttcggcatgtttgctcttcgatcgagtcgtgtaacccgaaacgcttgcgcttgagaagtattattattattaactagtatgttgcttcttaattaattgccctgctcgatcgtgttcacttcattatccaattgtttgtttgatgtatttgttatatgcattttagtatctaaaaaatgttatcttatcggacagtaatgggataaccagaagtgtactgcgaatgcgaaatgtcaaagcgggatattgcagtaccatagtttggttgggggacaatgccatttgcagaaatcaactcttgtggatttagagatgtgcctaactgttaggagcaatcaaataaatgcattttttgtccttcaaaattgattatggtctactttggaatataattttttttagagagattgtttttctccagggcggcgtaaaccggccgaagttttttagggagattactacgaattgaccaacgaaatcccatgtattcctaagaatcctttatatttgagccagttgatgccaagtatagcagaaaacacagataaaatttacaatgtttgcacgtgagatcagcattatatagagataaaattcagtaagcgtgcgtgtgaaatctatgacattcggaactagtaaggtatggcaaacttggacatagctacgtccggtgcgccgtcacatgtagccgcactagtatacaagtatattgtaatagtaagtactcttttttctactactactagcagtagttgtacaactctttacaaaaccttgcgccagcacgtgcgcggaacaccactaccgttacggtgaaactagacccgaagtccaatgtggagggggacacatgcatgatcaagggtgcatgggtggtgaaacttcactgtcaaaaagtttcaaagttgcattggatgcccttgagatgcactcactgatattgcctcgctcttgtctttactcccgactactcctcctcctcctcctcctcctcctacctcttttcttttgcaagtaaaaaaaagaaaagaaaaagaagcagcagcagcagcagtgccatgcatatgcagcgtttgctgatatgcatgaggagacgaggatccctgtccctgcatgctgctgctgcagtcaaaagatggcttcgctcgccgtcggcaaagccatctgagctgagctttatacgtggccgcgcgcacgcagcagctttggctcgctgcgctgcgccggccgcgtcgccgcgcgcttgcgttgcgtctccggccacttgctttagcttcgccagcttttatcgtgtcaaaggcggcgcggcgcggttgcgagagcgatcgatcgatcagctcgttgctgcggccggccatttgcctttggagtttggagatcaaccaccgtctcatgtgtatgtgctttattatcgggaaatgctaaacgacggtatgtatatatcccgtttaaatgggatgatatatttgaggtagtatcgtccgatacctcataaatatcggtttatatctcgttcgaacagaatgttatcttctagatattgtctgatatctggtatatacatcggttgatactcacattttagacgataccgtccgaatgagataccgtcatgtagcatttgtgctaggttagcaagacggtggttgcatatcagcatgtgtgtatgtatgtatgtatgtgggtggtcccgtgggccgtggcggcccaacagttaacgggcctcgcacgtgagccgggaagtcggtctcggctcgcacgcacgccgcggatcggagagcatctgctgctcgcctcgctgcactccgcgaattttttttatttataattttttttattaaaagttttacaaaaataattttccattttgaaaattgacggaattagtcgcctaccgccctctgggagggcgatttttaaaaatcgccctcccagagggcggcgaaaatgacgtggcagccggccgttcgctctcgggcaacggccgtcaacgaaatttgcaggcggcccccttgccgccctccgctagggcgattttctactgtgggggggccgcctgcaaatgggccgcgagggggcatggaattttgcaggcggcccccttgccgccctgggggagggcgattttgtactgtgctctatattttttttaataaatatcaatagttatcaaatctttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattgtagtgaaaaatgttctacataatctcaaatctagattacgtattaccaatgaataggcttccattttcgtgtgtggtgtgctagtgggaaagaatatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgaggtgccgcttttcatgtgtgctgttgtggactgtgcgcgctactagatctgacactaccgtgaagcgccgaaagtgtgttgtcgtgagtataagttgttctagcaccatatgaatgaaaagaactatgtagacgagacaaacacaagtagtactgcagtagtaatagcaaaaatagtactgctttataagtttgtaagccaaaagaaacggtcacataaggactgaagaggtagaacactactgacgaggcctcttacccctatccctcctaccctgcgccctaatgtgcccctgggagtacgtgagtcggtccgggggtacggcacggccaacccgtcctgcctgtacaggtgtgatctctggctgctcctgagtgtgcgcctctggagctcctccaagctgagaggagcctaggacgtcgtggtggtgtgcaccatgcaagtcgtcgtcgtagaactggctagtaggaccagtcctaccggcgtgagacgaagaggccccagtaccgaagatcccggctgcaaatcctgctggacaaggaccatcagtttcgtacaagtatttaacagtagtaataaaaagtaaagtaccgtgtgggcgagggatcgacgctccgtgagaggaagagctggcgaacgcgctcgaagaggtggcgaacgcccctgcggagctcgtggaagcgccggtcgtgcctgcgaacgcgctcgaaggcagacgaggtcctgcgatgaggaaacgtgcagttaaaacatggtgacatattcgtgcaaaagctgaaacaaaaatgaactaatatctgggctgaactgta

SEQ ID NO: 62771 - DNA, 5661 bp, Oryza sativa
aacaggaacaagaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgttgcgacaggagaagacgagcatgaccgcacgcatcttctgctgcatccggtcgaaggtcaccctctgctcaaagtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagccaaggtagtcacggtagttctcctccgtgtgtgggaagagctcgttgatcacctcctctgtagctaacacccagtcgtcaacgtactgctgtacacgtggagcccaaagtgcgcctgccagctgtccccgtcgagtcaacctgtgaagagagttaaattatatggctcgatgatgtatttatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcatcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacaatcatccggtcgcaaataagcatgtatgataataaacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtaaacatacgcgtaccaaggaacgtgacgggggtcgacacgcaaccactcgcgcgacgtgcgtggacggaaggtgccgagctgtgcaccctcaactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaatgactcacacatattaaacaagagtacaaacaaacaaaagtgtttagtccgaacactcatcacgataacattatgatacaacaccgaatagttcgcaatactacttgtacaacaatagtcggaggtactcattacaacaacattgaattgaaattacacgatagaagtatttagtccgaacactcattacatcacaacagtattttatttcctaaatcgaaagcattgttataccatggaatcgcctgctgcacgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagtaagaacgtgtgagcaaggaaggtgatgaagcttcggcttcatacaactgtaggtacatccaccatccgccttcaagacacattcctgcacgacttgcttgcgatagataccacgcctgctcctatcaacacacattatttcataccgatgcacttgtgtgccttgagcaacaactctatgtctctgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttccgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcataaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagctttaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattatacggactctctccccctcatccgccatacccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttgcacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcagggctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtacattacattctccagatcaaattaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaagtgagcgaaccagcagggcttcgccgctccccttctgctgccctcccctctctctttcgtttttttttggatttttagtgaatataatgaaatttcacagaggaggggctgggctttatagggggggggg

SEQ ID NO: 62772 - DNA, 1356 bp, Oryza sativa
atttcgttgacggccgtcgcccgagagcgaacggccgtctgccacgtcattttcgccgccctctgagagggcggcggtaggcgactacttccgtcaattttcaaaatggaaaactatttttgtaaaacttttaataaaaaaaattataaataaaaaaaattcgcactccaccgtccggagacggcgagcggctgacgtgatgtgggtaggaagaacgcgtactacttttcaaataatccccaaattccacctgctctcctggtcttcctctcaatccgcttgccatcgatcggctacccaccaaactccctcactccgctgagtgtttgacctgcttcggcagcggccgcgagagcttccttgggtataatcaattccccttttccactcgtaattgctggcttcttgctcgctatgaattgcatgttcttgattggtctgtggttgtgatccgtccgtgttggtggtggattgggagtttgggggaaaggggaatggttggtgatgtcgaggttgatgaaggaacgggaccggaggattcggtgttggagttggtggcggccaggagaacgcacgccatgtgttcgtcggattgtcgcagccagctctgagtattgaattcttgctaggggagagattggagcttcgttgctgttgctctagtggtttgtttgaccggaagcgaggccatatggatgctgtgaatgttcttgcctcggcgacccagctggtgtccgcgatgctcaccgcggtcggcgcgctggagcaggcggctgccgacttcgccgaggctcccaggaggctccaggttcttgaggattttgtgtccgaccttgggctgttgatgcagcaatccaagcagaagcacgcgcacaagatgcacgcgccgcagctcgagcgtcagctccagagcctaggcaagctgatggaccagctccatgccaacatcacaaaggcgaggcgggtgttgaagaaaggcaaagggaagaagggcttggccagagttgtgtggagctcggtgacaggggaccctctgatgaagtatgttcagctgatcagggatgatctcaactggtggcttgagttacagaagctaacagagagtgtgggcaatgtcatagcgtctacagctaagagtacgccatccttggtgagagtcaagtcggagcatggctatccagtgtcaaagaagtgcagctatgtcagggagctgcttatcaatgatggtagtcatcgagttgtcctgattgtcgggtatctggtattgggaagtcgtgtcttgctcgacaaatagcttctgacccgcctggtaattttgtggatggtgcaattgagcttagttttgggcggtggtgc

SEQ ID NO: 62773 - DNA, 692 bp, Oryza sativa
tacaaagtatctcattgtttgaatatctaactgacccaaaaacaaagtttagaaaaggaatcaaggaatattagaagcacatagtctgaattttgcaaatattcatccaacgtaggttctgggttagaaaaaaagacagaacaactataatgggggcaaatccaaaagatacagatatagcatatctgaactaaatccacaggcataccatcacctgaatagtatgtaaactgggtattttccattctactaaatccgcatatccactaatatacaacaatggagcgaggtaagtaacaatgtttgaaggtaaccaaccacaaaaaaccttataatattacacatttaccattgttgccatcaagacggttgttcattccacccgagatacacaacaagagttagaaatgttcacccatcagcaagttcctgcaaagaaagaagcatatacatctttcagttaaaaaataaccgagatagccagtgacatatctcaatactaaaggctttcttgttactattgtacaagtaataagttcagagcttaatgttctaagcacaaagttcttttaagaattaagagtattatcatctatattgctctaagcacatacattttcaagacttcttgtaagaccacacgcataacagttctaatctgtaccaaaatgtcatattgtaagatttgctgc

SEQ ID NO: 62774 - DNA, 34836 bp, Oryza sativa
cagtaggcggaggagtgatcttggatatgattatggatactcccaaatggatgaatttctatttcagccttcaattgttatctagcatttgaatctctgaagtaattatttcctgttctaactgcaggtattggctgtacgctgctgttatataccggtcattgcttgttacaaatgatgagatgcgggaccacttgtttcaactacttggcactagtttttttccaagatggaaggagaaccatcaggtttgtctctcattgcagaagtgaaccacacaaatctgtgttcttttgtagaatgctgcacagtacaacccattgagtaagagatatttcaagttcttttgcacggcagcgtatcctgtgcacccgctcaccttggtgcactcatgcactcacgcgacatgggaccttcgatctccatcggacggatataagatgagagagtcttctttttacaaaataacccttcgattcatcttcttgtctcccgttcaaccactttccccaaatctatcccctctgtgaggcgtccatggcagctttgaatctcgaaaaataaaacaatgctcgacggagatggccgctagaaattaagattaatcaagattccagcatgcagccgtcaaatccttgctcaacgatatgtatgatctcaacctcaggatctttgggttgattgcatgatatatatggcatgccaaaatttcgaatcaaacaagaaattccgatcggatatgcctttgatgcacacatctgcaacccccgggcaaagactcatccattccatcccatgggcaagaactcttctctctacagagtcaggtacactgcgccgcagctgctccatcggccgaacaccatggccgtcgccctggacacgctcgcccgcgcatcgtccctctccaacaagctggacaaccacacgcaccttgaggcgtgacatgccactggccgcgccgccgcgctctggatgtgctatctctgtcgccaaacatggcttaatttgagccgccattgacgtcggatagagattttgaggaatacatcttggaaaggacccaacacaggaagacaaaaggaatcaagggtctatttacaaatttacctgtgtatgtgcgggtggttttatgaaaaaacgtccctttgcattacatccgtccgatggagattgaaggttccatgtcgcgtgagtgcacgaatgcaccaaggtgagcgggtgcacaggatacgttgcccttttgcactccattttaacgaggtgttgccttggtgaagcttgcttgaggccctaagttctgagtagctcttacatattttttttctggagcgtaaaaataatattttgagtgaattttgctcttttttatgtaaaaaaaatggacacaataatcctgggaaactatgtgcaggtcaggttaacattctcgggccgtggttggaattttcacctgccgcctccttattcaattgtcattcaggtgattactctaaactgtagtaaagttgtggagtgccaggaatgcatgaactatacagaatggcctgaggaacgtggtttgatgcaggaatctgaagatggaagctggcatgtaccaacaacaaatggtgatgatattgagaaaccacggcagtggatttgtgctactaggaaaatttcagggaaatcgtctcaagcacttgcaagggcagttgggtaagtgcgatgggttgcatctccattgacgggattggtgcatgggaatggcagccaaatttcgggccaggtatctgcgctgctcctttgttgaattggaggcggcttgaagagaatcacaccattatgtaaggcggccggcagatgttgatggaattgagggctagctgctgagctgacccaaacgatggctgtcaagttgtaggaagcaaagtaaaagatttctgtagcacatgaaaaagtttgccactctcttaaaatgtggatgtcatggttgttttagctggccattggttgtacatgtacatgtattttcctcaaggttaaaatctgaaacagcgaggactagtcaaacaagaggtcgtgtaactgaaattattattactagtaggagtaaagttgaaattgatggagagaatataatactctagtgtacatatggttggtccgtccgttatccttgtgggtggagagtagcgaatgggagcaggccgcgtggaggcatggagcccccaggcaaggcgcgtcgcccttccagccacaacatccactgtctctctctctctctctctctcgctgctcttcatccgattcaactcggaccaccagatttcttccttccttccttgcagaatctttcattgttcttgttgggaggaaggagacgaggcgcgcgaggcggcgagagggaggaggcattctagcatatacagatacagagccaggggaggtatggaggagggccttgcacgagcacgacgatgccaatagaagctgtggcggtcgcttctttaccgatggcgtcgcgcagcgccgccctgtgcttctcctccgccgccgctgcccggagccggagcaggagccggcacggcaggatggccgtcagctgcgacgccggggcctcagatctgctctattcctctctggtactacgttgtactccatccgtttcaaaatgtttgacacatttaactttttagcacgtgtttgaccattcgttttatttaaaaaaaattaattaattatttattcttttcatatcatttgattcattgttaagtacacgtatagttttacatatttcacaattttttttaataagacgaacggtgttaaaaagtcaacggtgtcaaacattttaaaacggatggagtcctagtatattatctctgtctcaataattaggatactaattaattcatgtgtcgctgataaccttctgaatgaatgttattgttatgaggcaaggctgccaagctgcttggccctcccaccagcttcgatgccggcaagctgacggtagagttcgcccacagccacgggaacagcagctccgggttccccagagcttacaccctcacccactgcgacttcaccgctaacctcaccctcgccgtctccgacaccatcgccgccgaccgccgcctcagggcggacgacgtcttcgccgagtggaagcagcagcaacagcaggagggcatggccctgcacgtgcactgcttcgtcagcggcgccaacctcctgcatggcctcgccgccggcttcaggtactacgtcttctccaaggagctgccgctggtaagcaattatatatcgatattttgtactactattacagtagtagtagtagtagtagcaattaggaaggtgaaatcaactatgataagctgaatgcaggttctcaaggcagttgttcatggcgacgcattgctgttcgcggagcagccggagctgctggaggcgaaggtgtgggtgcacttccactccagctccaacgctaagtacaacaggctcgagtgctggggtcctctcagggaggctgcaaacgccgaggcatgccttccttctctcttcccgaattgcaaattgcaaatgcaaatacctgctagctgaactcaatgcaaattccaaatgctttgcgtttgcagacgacgcacaagaggcatgcgctggagcaactgcacaacgcaatcaccaaaggcacaagaaggcgtaggaggaagtggtctagcccggacgccatcttcagcgccctgctcgcccttctcctttgatgcatatcgggaaccccacacattgtcttttttttgctctgccttgtgcgcatcaattccaattctttcatccaccggacacttgacatgtatgtatagtatgtacccactccacgatcaacaaaatgagaaacgattgcctttccaagcattcctccttaaattaactctgcttctgcttgctcactcaaatcatgtttggataacatatgccacatcatgtataaatagttcctctacgttcttcattcagaactggggacaacatatagctccaagtgccatgtgctctacatactacatactactacctcctctgattgaataactaaaggggattcatacatactgaggtagtaactacctttgatcgattccaaggtagtaactaaaagggattcattcatactactagctcaagtgccatacgctctacatactactagctcctctgattgaataactggaagggattcatacatacaaaggtactcgtaactacctttgttacgctacgctacaagggtagaagacagaagcggcaggctcaatctatccatgtcgcatctctgcctcatcctctccaccatttcaccaaacttggctatcaactcaccctcatcagccagctccatcctcttgatcctttccagcatttcatcaaactttgccatgtgttcctcatgcagatcgtcgatctgcatccttatcttctccagatggcttctctcccacctgttttcatggagcattccaatgagctcggctgcatactcctcctccaaagcaacaatccgtcccattgtatctcccaaaccatccatcttcttgctcatctccttcacttgatcgatcaagctctttttctcgacatctctacaaatgtgctcccaaggagcatagcagcgcctcaccataatgtctctcaccttcctgcgcataaataacatgttcaaaaacatgccagaacccagaaggaagtccagggacagtcgtacctcgtgaaagcaaaacgaaaaaaaattgtagggcataaaacaatgcaggaagaagaaactatacaatcgattctacacacagcaagctataacaggatctctgaaaaacaaaactataagtgggatcactgaaaaatgagtaagaaatgacagacctgtttattgcaccgtcgtcacccaaagttgcagtggtctcagttttacagaacaggacgccatgacggttcacgccagctataccttgttgttccaagaactggatgtgcttcttcaaggactcatccctgagatatatgtgcaaagcatggaatataaaaaagttgtacccatacacaaacagacaattatcaaaagttacttaaatttatttttaaactagcacttcggtttggaggaaggccagggcaacaaaacgagggttctgacatcggtatccccagaataaatccattgaaaaatctatacactttgccactttggtgtgcagtttttgactgatcgataccagagtatgaatatgtttcttctgaaacttgaaccttttggcattcaacctatcaaatgatggaaactatgttcacgtgtatcccaaaaaaattacaaattggcaggtgtgaaaaaaaataatactaagaaatacctccagctcttgaggaccataaagaaactgtaatttagtacggatgagaaactaccagtaataaaagactgagtacaatttcgatggtattgaatataacaaagaaccggagcagacttcttacatgacaagctgctgaccattctccacttgcattttgtgttgggtgagagaggcgtcaaacccatgtggcggcaaactagagtactcttgttcattctgaaggtaaagctgtatggaaaggaaagaaccaatgaaccataacttccaatacgatattgtgatatagtgtagagtacgtcacagtctgaattgcagttgtgattgacaagaaaaggtatggcatacatcctggttataaaattgcggttgttctttgcattctgtagctgtcctaaaaagacctcccttgaagatctgaaacagcaaaaaaagggaaattgcacctgtaaattaacatggaaattgcacctgtaaattaacatttgttatccatacaataacttgctgcattcttgtaccgatcaacatacaaaagaaaaaggtcaggttttccaagagatggaagatgaagatgattgagctcagactgttctagttgtttctgtttcatataagcccttatataagtatgatttacatttaacagtttaaatacctgttgcttgtaaatcttctcctcaatggtcccacaagttaccaaacgatatacaatcacatctttagtctgcccaattcgataagcacggtcgacactttggttatctatgctataaagtaaaaaacatatatgattaattgaagaaagttgatgtaaagcattcacaatttagaattgctgggtaccttggattccaagcaggatcaactactataacccgatctgccttggtgagtgtattgccaagtccaccaacatgtgaggtcaacaacaatattggactgtcaagcccctcttgaaagtcctagagggtgcaatgcaatgttatggaatccatggcttaacataacagacagaaaaatgtgaaaaaaataaggaggtaccttcagaatcttcttcctctcagatatcttggtggtaccatcaatacgcaggaacttatggccctcgatagatacagcatcctgctttgttggaatgattatgacaactatccgaagattaaacagacatttcaacaatgcaatgcttgctattaaactttatatagattagtaaacaactaaaggcattttaattctatactgaaagcatatatgatacaagacacaggtaatcatggacacacgtatggcatgattactgacagcaattaactaccgatatgattcttccagtaacaaagcatagttttcaaatgggaaacttttacaaattgaatcaaataaagtgttagcaatatcacaagcacatcacatgcatgataaagcaaataaaggttaatataagaataggctatacctgaataaggttaagcattacacgtgtctgtgaaaatatcaaaacatagtggccctcttcaacaaggttcctctgcaacataaaaaaatgtagcatgatttttcataggaagtggcacattaatccctttatatcagaaacatattgtatttttcttctgcagaacatccaacgtagccttttgacttgctaacttttaccaaaatacaggaataatctatacaagtgttacgttatgatatatccaaataaagtacacatctatataatttttcttttagccagtctagatataagtaaatattgcagggagaagaatttaataagtttaattgctccatatactaagcacattttgtccatggactggagggactataaaatggacatttcataaaagaagcactgaccagtaagggaaggataaaagctatcttgcaggaggcgccttggacaatctgtagtcttttgtcagcataaaggttatcttcaagaatcctttccaccatgcacatatctcggttattcagcatggcacccatttcttccaggaaatcatcagtatctcttttagtcaaaagtagagggtgatcgcatattttcctcaaaatctgtttgtgttgaattaaaacaagtgagcacacacatgcatgcacgatgcaccattacatattttcttcaaaaatctaccaacagtaaatggaacatggcatactagaaatttcaattcactccaaggagtgacatcttaatgtcaacggaagcagacggtaggtaaaatgatgaaagtaaaaacagtcagtacataaataccgtgctagcttccaaggatgaacccttcaatgctccagtttgtgaacgaactggatctttattcaggaaggcttcatacaatcgcctctgcacccgaaacaaaatcatcaataatctataaagcatagacacataacccttttatactcccaacaccttcattatacaaaacctagagcaatcgtatactggtggaataccagagtcaaatgcccaaggagttctataaatggaatagaggtttgcagcagaacagcaaggcacttgcctggcaagatgtcaattttaaccagataaccaattcattcttctgaggtggccttttgtcatctttcgcgccagtatctacaaatatttcacttttcatacgacggagaaagtgtggtttaatccgctctcttaattcctgtgattaatagcgttcagaacagaccaaaacaaatgatgcaacaagattagtacatcaggcacaaacttattatgtcgaaagagaacatacttttgctgcatttgaagccatttgcttctcttgatcagtagcattcttgtcatttccacaaagaattggcttctcgtacctaagttcgaacctgcagtaaccaagagaatctcacaacacttgactttacaaaataaatattcataagtatagattgattttgcataagtattgtataagaaacaagggggagttaagtgatttacgcatcctcatcaccaggacatctgggcaacagaaataaaacaaagcccacatttcctgccagaatagtgatgctcagtggaagtaaaagaagataaatagaaaggttagaggaaaagtcatttgagatgagggtacctttaatttattttgaataggtgttccagtgagtacaatgcgatgagcagaaggtatttgaaacaagctctgtgccctttgcgtctttgtattcttgacaatgtggccctcgtcaagaataacatagtcccacagtggttcttcttcgttgttgtcaacattgttaccgttgccattgcctcttagtaacatgtaattattccggacgatgtggtaggatgttagtagaatgccaccctcctggtgaaagattcaacttgcaagtagtgtacaagtatggaatgggttgatggaaagatgaattgaggatgaagtgtaaagttaagatgagaccttgaaggtgcagttaagttgatagcagcgatcgtttaggctagggccagagtagctggcggaatgcagattaattagagaagaagtaaagcagtgattgatgtgtggatgtaagtaaagatgtggcttcttacagtctgatgtggtgttgaaggccgaggagtgagaggtgatttacccagtgagtcaagtcagtcttaggggcgacaattaaggctctcttgatcaaattggaatggaataagccggccagcaaagcagaaacctggatttggacccggccttgcccttgtgagaccatacattgattgatgtactccagtggattagggatgggaggaggtggaggagaggagaaaagaagagaagagtacctggatggtcttgccgagtcccatgtcatcggcgaggatccctccggtggcggtgcagtgcagcgcccagagccaggcgaggccgtcgcgctggtgcgggtagagcgaccccaatacgcggcgggggatcttcatcttcatcttgatggcgccgacgccggcttccaccaccatgttgactagctcctcatcctcatctacctccacctccacctcctgttgaggttgaggttgggaagtcggggccattggaacgaatcggccgttggcggcggcggcggcgagggctccgcggccggtggtgaaagtggaaggaactttaaagacaacaagggtactactagttgagtttaaacggaacggagttgagtttaattcagatcccttcctgccttcaccccgcgcccgcccgcccgcctcttcttccttcgctttcaaactttcccaatcctttaaagttcgggcctgttcactttaacaaatatactaaaattttagcagcaaactaaatgtagctaattttttaacaactttactaaaatttggtaaagttttaaatagcattaaagtgaacaggcccttccttccaactaccattggattttaggaggggttgtttggttgaagtttgaactactgttgcttttcattcctcaactattatactataataacaaatcaaattatcatcattttcttaaaaccacgcatacagtagttttcatttaccggctacgatattataggtgtttttaagaattatcatgcctttgtaaatataaggggcaaaaaccaaaccaaagcaacaatacaaggataaaacccctctctttctttccccccttttgccaatgaccaaaagcaggctgacttcagctaataccagcgtaatttactggtactactagcactgtttaatttacaaagccagagccttcacaaccaaaacaataggacactccaaaccatataatagtatgtactatgactactgtttttttttttgcaaaaacttcctatagaaaagttactttaaaaaatcatattaatccattttttgagttcaaattagttaatactccaattaattatatactacttccgcccctaaatataagggattttgatatgatgcaacacatctttatacaatgaatttggacagcactagaatatatcacatctcaccaaaatcctttatatttaaggacggagggagtaataactaacatccttttggtcaatattctctttttctcctctcagacacaagcctaagaggcacccgagatcagcatgtgttccgttccgtggtcgtcacaattagtacaagtagcatgcaaaatgtcacgccttagtgactactagcatgcaagcatggaatttaagcaaaagaaacagacatgccctacactagacagacagatcatccaagcagattacttccgttggacccttcctctccaatggctccggagaagactcgatcacggtcagcttttcgtccagctcatttatctgcctccttatcttgtctccacgatctggtagcttcgccacaagcacctacaacagcggcaaatggtgtaagacagacagacaacacaccacaagatgcatgcaacaggttcgggtgtctttcttgctcccaccgtgtttgcaagggtttgcgaaagccggttgattttggccttgatttcctcaggactttctgtgcttgtgctgttcggggagtatgttcgagcaatgaactcttttggcttcatcgcataggcagcactacacaaaacaagcagcacggtacacaacttaattatgcagcccaaaagccattgattaagtcccatgaactcctcttacccattggcaacatagtcagatgaggctcccttgtagtagtgcttggccattggcatagctcgacgactgctgcacacagaaacagcatacatcacctgttagacaccaaaggtaacagcaacaaatggatacgtgttgcaacgtgccagatcaatatttctctgaaagcaaaacaaacatatgctgcactttgaagacagtaaaattaacctgtccaaaccatcattatcattcagtgtaggtaagattgctgtcttagaaaacagaaggctgtgatggctcacgcccgctatgccttgttgctccaggaattgtatatgcttcctcaaggagtcgtccctggtacatgccgcagatcaacaaacttatcatcagtgaacatggaaatcattaccaacaagccagcaagtattgctcagggattgagcagctcttactccagcaaatgcatttgagaaatactacttcctccgtttcacaatgcaagtcattctagcatttcctatatgaatgtgggaaatgctagaatgacttatattgtgaaacggagggagtactacttttttatgcagcagttcatcatcatatgctttctacatatggcagtaaccatgaaatattgcagagcaacctaaacattttgccgcacattttctgctgatatcacaaccatttccccttgtttttttgtgaaaatgtagtagcataagcagcagtcacctcatggaaaacataatagtggtgctagaattaaccgactaaaagtagatgtcctacatcacaagttgttgtccatgctcttcttgcaattgcttttgtgtcagcgaaacatcaaaaccttgctcaggcagactgaaaagctcttgaatatcctgaatgtacacacaaaatagccatattataaattatccaatatgacagagaaaacaataacaagaaccgtatcacactaagtaccctcttgctgaaataacgagtttgttctttgtgctctgtagctgtcctaaacagagcccccttgaagacctggaaaaggggcatgtattatctcattagttagaatctagcttttattttactgaagtaaatatgcaatatgcaaataaaggaataggggtataacactgacggagacattgcaggaaaaacatgtaatggcacaacccagtaaaaagtgtcaccagtcccaccttttcttttcttacatgaacccagccccacattaaactctcaaatttcaaattaggaagagaagttaacttcaatgaaaaaccgtactttatttcaccccctagaaagtacaagttaatagtttggtgctacatagagaatctcaaggaggcatacaactaaatatgaccatggactcatcttttcaatattttttttttgagatatcatattttgaatcagttgcttcagtgaataacaagcgcgataaaaggcataaacagcaagtaaattcttgaccatatttaaacctgcaatttgtatatcttttcttcgatggttccagatgtcataaggcggtatacgatgacatctttcatctgcccaattcgataagcacgatcaacactttgattgtccgtactgaagatgggaaacaggagcattagtaaacatacagagacaaacattcagtaaaataaaaaggcaataaactcagtaaggaaacggcgttgttcaggtaccttggattccaagcaggatcaactactatgacacgagctgccttggtgagtgtaagtccaagcccaccaacttgtgtggtcagcaaaaatattggagctccaggaccctcttggaagtcctgatcacaaatgcattccatgtaagcaatatagcagtaacaattttgcccatggcataaaagaaggaaagggaaagacagagaagaaccttcacaatcctttccctctcagaaatcttggtggtaccatcaatgcgcaaaaacttatagccttctaatattatagcctcctgttgcagtaataagctacattagctactaggttgaagtagtaacccagaatgcatatcttactactccttactactttttaaaagcaggaatttgggggggagggcaggtaacggtaggttttacacccatctctacaccagaacttttgtggctgtaaatatataggcacgtgtgcattatttgtaagatttttacataaaaatattatatatttgcatgagtatatgtaggtggtaattggtctcatataatcgtgtttataagttctaaatttgagtacaatcaatgttaattattagatttacattatatttagttaggatcctttccacgcacgggcatgatgatagtaatcgtaaacattacaagaatgataaaaatggtcaaaggagtaggaaatgaacattgaaaaacacactatggtcagataggctacatcagggattcaggggtgtactaattaaaagcctgctcgaggtcaagttcattctgttaggtaatttgttttcaacttctcacaaatgagtgtacggcaaccactaaaggaaaagaactccagtctgatacaatgttttttctatcattcaacgagcaaatatgttctggaatagttttagggagaagtgtagagcaaacaaaaaaatattcaatttaaaaaaaaacacacattgatgataattgaaaataagattgctagattctgaatttcaagatgtaaaaatcttaacagaagttaacaaaaaaaaagtcccatagaaatcatattttcatgaaactatatgtaatcactcaattcaaaaaatatatcactactagtactgcatgaggataaaccaaaaaagttgattctactttctaccgaggcactgaggggactgtcaatagtatatgtgattggatgactatacattgacaggaagaaatcaggccttatcaagggctcagaacaattactttgctaggataacaaataacaatataccaaaatcacaagaaaatcacagaactgtatgactataaagcaaacaaagattaacataacaagaatagactttatcacctgaataatgtttagcattttacgagtttgcgagaagattaagacgttgtgtccctcgctaacaagattttgctgcaacattaagatttaccatttgttagataaacaaatacataggtgacaactaaaatgtggatcatcaaagaacacttacgagcaaggacatcataaaagataacttgcacgagacatcctgaccaacttgcaattcaacgtcatcatcatcatgagccatatctgcaaggttcatggccattttctcaaccattcccatttcttgattatttaacatcgcatccatgccttccaaaacaccctcagcagctttcttagtcaacaacagcggatgatcacatattttcttcaatatctgtttaagaatacaagaaacagaaacaaacataagtgcaccaatgagtgtacataaatcctttttctgataaattgaggatatcaaacaacatgacaatgtgcatcacaagaacaacaagagaaagcaatgcactctcgcatgaaatatgacatatgataaggaaatggaaagaacataaaggtctaaacaatgctgacaacatataaaagcaaacaaaatcagcacagataaaaactttgaaggtgatgcttaccgtgattgcggccaagggtgacccttgcattgatgaatgaactagttcactgttaagaaaagcttcatataattgcctctgcatccaaaaaataaaaaaggactaatattaagatggcagttaaccaataacaaaaccagagttttgcatcagtggaaaatgatctgtacctggcaagatgttaatttcagccagataattagctcattcttcttagcaagctttttatcttctcccgtgccgctatcaagaaacacttcattcttcatgcgtcgcaaaaagtatggctttatccgttctcttaattcctgtaataaatgatcatgtacaaaaccaaaaaccacatattatataaaaagtagaacagcagacctgaagaaataatctggaagaatgggtggcagttaaagaaatgcaacaaaggaggaggctcaatgtaaatagctttccctctcatggaaccaactaaaagcccatttttattagttggtatggaaacataattccattgctttacaagtcaaattggagtacacgactgtactactttgatgatacatgattgcagtacctataataagaagtatgtctgtgtccaaattgctgtcttctcaatgaaataataataacaaaaaataataattccgcaaaaattggaatagagtaaacaccataatcattaatagtcaaaatgctaatgtggtggaaaatctggctctcctaataattaaatatccagttcagacacaaaagtaacatgaaacaggatcatctatcacaacatgaaaaaggattagtacctttgctacatttgagcctatgtgcttttgtcgattggtagcattcttgtcatttccttgaatgatagcgtgctcataccttgctttgaacctgccaaaaacaagagaaataaacaacactagattgtgtaatatgaagcaacaatggcaatgcagaaaaacaacgggcataagtgtattactgctccttatcacccaagacttctgggcaacagaaataaaacagagcccacatttcctgcaagaataatcaggattacttgcattggttcgtgcgccaattataaggcattaaaaattaagagagtaggataccttcaagttattttgtatgggtgttccactgatgacaatacgatgtgcacagggtatttcaaatagactttgagccctctgagtctttggattcttgataatatgcccctcatcaagaataacatagttccataatgtttcttcctcgtcatcaaaatcattggtgaagttgccttttatcatcttgaaattgtttcgaacaatgtcatatgttgttaaaaggattccaccctcctgtagaaagacaataatatgctaaaacagctggtatttattgtgatatcatggaagaaccgaatattcttctaaatgatgctacgaacaaatacaactcaaattttaacttttaggacttccaagtattacaaaacccaaacttgcaacaagccaggtcaagaatgtggctagtcaaagacacttatgttaggagaccagaccttgaaggcatatttaagctcatagttgcgagcatttgcattgggaccagagtagctgtcagaaaagaaaaagggaacaattagcacgagataacatgacctctatcaatttgagggaagatatatgtcaacacaaaatatcctactctctgatcttatctttgaggctcacaactgaaagttccttggtccaatgagtcagaagcgtctttggagctacaactaacactctcttgattaaacgggaatggaacaatccagccaggaatgcagaaacctgcatgataaaaaaaggatgagaatacacatcagtcgattgcacatttagagcgagacagaactcggctcttcatatgcataatactccatggacactaccatgtaattcgtgcaatgaaggtaataataaaactgacagtagttagacaactggtagtgacaaaacagttctgttcttctatcggacggagactgctttcgatttcatcataaatgcatgatgtggacagcacaaaagattcagatgattaaaagtcctgccctgatcctaccataaaaaacacacaaactacgcagaggcctcccctgatcgtatcattaatttggaaaaggaagagcagtaatccttaatcctaatacatggaaggtgatcactaactagtatcagtggcaccacaagtattctgtaagcattaaaagtagacgaaattagaaggatgagagggtcccagtcccacctgcatggtcttgccaaggcccatgtcatctccaaggatccctccagttcccctacaatgcagaacccaaagccacctgagaccctcacgctggtgggggtaaagcatgttgaatatccttcctgggagattgtagggcttgcgcgttacacctgtcccagtgggctccatcttgaagtcctctgtcttctcccaaccaacatcatcagcatggttttccttcccattctctgcatcttggtcgatgtcgtcttcatcgtcatagtccccaaaaaattttgaggccttggattcggttgtggttttccttgacaccgtatcaaaggcataagctcctttggctttcatcttatcatcgttgccgcggcccccaaaagaagaagaggccttgaacaccttcctggtgacctcctctttaacaccaaaaccaccgtaggcacctcccgcatcatcgtcgtcgtcatcacagtccacaaaggatgaagagggtttggtcccatcattaagctgagactgagaggggtcggggtcggcatggagggcgcagggaagtggggacacgtggggtctgggccttgcggtgggcctgtcgactgacagggagtcgaggcgggtggtgagatcgtccagtatgtcgcggatgctgtcgtcgtctccggcggactcatcgccggcggtagagagcttgcagaggcggcggcggccggccagcttgaccttggcgggttcgggctctgcgaggaattgaagtggatggagttactagaaaacggaaccgagagagagagagagaagggtaccttgaggaggcggcggcggagggggtttagggttagggttagggttagggtttgggttttgggaggggccccgttggtgcgtgcgggtgaggcggaggaggcgatcgttgaggccgttgggtgtcggagcggcgagcggcgtcggcgcaggaggggtggggtcgtcgtccaggtcgccgcagatgtcgaagggcggaggggacgccatcgatctgcttccttccgagttctgacgacgacgacgacgacgacgatggaggaatggattggagatttctctcttatcttctctcgcttgggttgggttgggtgttgggttggttcgggggaagaggggactgaggaagaagaacttctccgcggcctatgtaccagaaaggaggcggcgccgcggggtggttcaaatttcgaatttcatccgaaattcactcctcgccttctatgcttcttcaacacacagcaacggatacattctagcatcgttcgttcaggccttcagggaagataggggagtctgaaactcgttttctccgcacacgcttttcaaactattaaattgtgtgtttttttcaaaaaaataagaaagttgctttaaaaaatcatattaatccatttttaaaatttaaaatatttaatactcaattaatcatgcgctaatagctcacctcatttttttttattttctcaatcttctcttttcatctcctctcaaacactttatagcaggtacaataacaagttataagccagctataaacatattttaaagagataaaagatgaaagataaaagcatatttatagccagctaaagtacggactctacgatataatgtgtgtatgacatataggatcatgtattaataatgacataatggagtagtaagttactattatatgaattgggtattaaattgactatagattatttggagctaatagttggctatactattaaacttgctcttaagctgacaatgctgtgttcgatacagttcccaacttcccctctagtattccacgcacaagcttttcaaactaaaagtttatatacgaaagttgcttaaaaagatcatatcgatcctttttttaaaaaatagctaatacttaattaatcacgtgcttaaaaatcatattatccattttttttaaaaaaaatagctaatacttagttaatcatattatctatttttttaaaaaaaaatagctaatacttagctaatactccgtttttcgtgggcactgttcgtgttgggaactggctggtatcgaacacagccttattgacggccactccgttccgttccatcaaaatttcacaatcatgaagatgaagtaagattaagtgtttcacgcaaaacgagtaataatgtgtgatgaattgaattttaattattataaacttgaaaaatggattaatctgatattttagagcaactttcatatagaaagctttcgcacgaaacgtaccatttagcagtttgaatacgttgccatgttggagaaactaaagcaacctcagttcgatagggactgtatgtattgtttaaagcctgtttgtaaaacacataaatttataggagttatataaattgttcgtttcattccatttgaatttattaaaaaagaaccagtctttaacgggtttttccaaatcttgtccggataattgaattgatggtttaacttttgaaccttcctgattattttaaatttcctttattttacttttttccctttattcgtcgtttgaaacctagtcttctaatactaatttacaatgatctttcggtggtagatgatgtatttgttaaaacatagtagacgacgtatctgttaaaacatagtaactttactaatctcacgatatgatgacataaattttcggagttgcttataagtatactagttataaagcgtactcacgaagagtaaggaagtagccctccagaattgagcctaagggcctatttattttcagcgacttggatgagattttccacgatataaaacatctaattttccacgatactggttataaagcatttttaactaatatttttagcaactttaatgttacaataatgaaagtctatatatgtggagtcccatctatatggactgcttttgctatatacattgttgctgcccatggagtagttaggtaaagtctttagtgggtactgtacatcactgctcgtctgcccagggtttaccaaaccgtttggggtggggttacagccccttccgatttgatggttagggtatcctcaatgttgagccacacaacaaccattagatgggacccacgtacatatatctttttactttacaaccaatgctacaatgtttaagatcttctattgaccttaagctgggacccactaaaaataatctatataaattcttttactaattcttttactatgaagaattaatagacaaagtaattttatatttcttatggctaactttaagctttaagattagtcatatcaatatcctcttacaaacacacatctctatgcataaagttgtattaagaatattattttattgcgaagtgagcatagctcaactagttaggttccttatggtggaactagcccactcgggttcaaatcctagatttgacacgggtgctcgcggcgcctatggtgacttcatcaatctcaagatatgccggcccagtcgggtagggtgtgcgtgtgtgcgttcataggggtgtgtgtgggtgtgcgtgtgtgcgttcataggggtgtgtgtgcgcacgttgtgagcgcctgtgtttgtactatatttctcaaaaaaaattattttattgcttatggtcacatttacatgcacattagagatgcccttattatggtaaccgtgtggtcatcacgaaaactggacgattattgcgagatattgaaaagttatcgcgagataaatataataaccttgtgataaccatgcggtttggtaaactctgcgagtgcccccgcgaggaagaaaaccacgggaaagagatgcgccgttggattatcaatcgcttcacgagttcactgcgcacactctccaagttgcaagtagtgtgtgttgacttcgacacaatctatcgatgtcgatgccgatgccaatactcctcctcctcctgctcctcccccagggccagggccacggcggcgccggcgacatctgcatcgtgggcagcggcatctccggatcatccaccgccttcttcttcaccaactacaccaccgccctctccggtgcccagctccgcgtcttcgagcgccgcgctaaggtcggcggccgcctcgccaccgtcaccgtctccggcgatcacttcgaggctggcggctccatcatccacccacgaaatctccatgtgcgccgcttcgccgacctgctaggcctcgaagccaagaccgatggcgacgatgactggctcgggatttgggacggccaccgcttcgtcttccagacgctccgcccgctaccgcccgggacgtcctggctccgccgcaagctgcacacccttgttaactcgctgcgcctctttaagcgctatggtctctcgctgctcaagatggacagatttgtccaggttcctcctccataatcttctactaccagtattcttttctcactactactagtagtttttttttttgagtaaatttcactttggtcaacctttatttaccaaattttcacattggactagagttagacttatattttcacttaacaccatatatatagttaccatcattttcactttggactgggtttcacaaattacacataatacaatgattgtagatctgatctcgtttccttctttttgtgttagaaaacttagaattcaacaatttgtactagcactacagttgggtattgtaaaacatgtaatatcttttctagaaaaatagttcttaaacttaatatttctccaatactgtctttagtacaagggttgtgaatgttcatatgtagtagttacaatcattgttcttgcactaagcatagttgcatggcgaatttccatatcatcgtttcttgtaaaatgcttagcacctagacaacaactggtgtgatggtaactataatacccggtccaaagtgcaagtaacggtaattatacgtggcgttaagtgaaaatatgagcctagccctagcccaatatgaaactttggtcaataaagatggtccaaagtgaaatttactctttttgaacttttttttatttatttatctgcttcgctattattaatataatactcctagataataacttgccatgatctctttatttgctttgccatctaaactaggtgatatccccgaacgatgctttgtgtacttgtgtgaagcaaaataaacattctaagcattatgccttaatgtagaattgtatagtaagaggatatactgtgtatgttggtcgattgattgagccccgagggtcggtctataaacagagatacacatggttagagacaacaatgggattagcgacaaggaaggtgtccgtataaatcaaacacatatcctaatatatctctaactaccatgtactcttaacacttactaggtaagagtgaacagggaaccacgcagattaaataattgaaatgctcaacttttcttgatgatgtgtcctgtcgctcctctgaaggagcaattgcagttagtgggtgataatcatatacaagtatgcgattagctagttttgcttcctttgtcattttcttgactgagttgaatattctattggctttactgattagtgattaacaacaaacacgctgaaatgtgttattgctgtatatgcatgcaggaaatgttgcaaagatttatgctctactacaatggctttgaatcccgacctgtttttgacacggttgaggagatgctcaaatggtcgggcctctatggcctcactcgcaggacactagaggcagagctgcttgatgctggcctcaattctcaaactatttcagagcttgtcactgtatgatatgattgctctctatgttttctcctatcttgtttcaattgataacccactaatttctgcagacttggttttttcttagcttcccaagaattagtacatttactggtggtcttaacactttttttttcctgtatacatatttcggtctaaagataaaatctcttcaaaattttgtaatctagtatctccaatatgccttgaccagtgcctttccacctttacgtttctcatgaccaattataaattaaccaagcagtggaactcatatcagtagtcattacctgaatatcagtcaagcatatagtcagtgtatagcgcactcatcaggtcaaattttcttgtttactttttcaactgagaaattattttttttctcgtttaattaattttcccagaaacctttatgttaattgtgctatcctgccccatatctttggcaggtgataacaagaatcaactatgggcaaagtgtgagtataagtggccttgctggtgcggtttctttagctggttctgaatcaggactgtgggctgtcaaagggggcaactggcagctagctgctggattgctcgaggctgctaacgccaccttgcatctgcaagaaggcatagactcaattgaatatgcaggggatcactatattctgaaatcgaataaaggtcttgaatataattgtgtagcaacggtggttgcaacaccacttgacgaggtgaacattacattcagccccccaatctccattccagcgaggaagacgcagcatacccatgcaaccttcgtgaggggcatcttgaatcctgtaagtgtgtatggtgctccctgtaacaaactagtttcccacagcaatgcaccaaggcagcaacttaaatgaagaacatgcagcaagtaacagatagcatggtctgaaactttggttgatgaaagggcagccttgtttggttgtaaagtatgagggagtctgaaactttgtttgttatggtgcagaaatttttcggtctaagctcggtatcagatattccaaagctgataggaaccatggaggtccctgagatcccgttttcaagcatttcgattctgaagaagtacagcgagcaggacatgacttacaaggtgttctcgcgtgtgaagctgaatgagagcttgctggaccagatcttcaggtaagcagtaagcgggctgtcgtacatatcttaatcttgctggaattgattgtgtggtaattaatgaatgctgtaacacaacaacaacaacaacaacaacaacagtgggaggaaggagacgatccggataaactggcctgcgtatccacactatgaagctccagaagtatttgctccgataatactggacggtaaacagctgtactacgtgaatacattcgagagcgcagcgagcgccatggagacgggggccgttgcagcggaaaacgtggccaggctcctcattgcaaggctcaggctgcctctcccttcccgacctgctgcgcctgcgcccgatcaccacgaccagcgagcagatctgtaactgtgactctgtgactgtgatgtgaggaggtcatcgcatcgatcggctgtattgtttgtgtctaacatgtctggaacccacatgttcgtaggagttttttttaaataataaatcagccagcaggtatattactaatcaatactaagttctagagttaaaatgacatggaacccacatgtatgaatatgatgatgacctccttagtaagtaggagtatgttttcacagaaatgataagttatactaggctgaggctaagttagttgagactagttgggaacaaatcttttgcgcacagaaaatggagcggtcaattagcgtatgattagttaagtaatactttttttttaaaaaaatggatcaatataattttttaagcaactttcatataaaaactttttgaaaaaaacgtacgcatgattagttgattactattaactattttaaattttaaaaatagattaatatgattttttaaaataacttttctatataatatttttgcaaaaaacaatcgtttaggccttgtttagttactcaaaaacttttcaaaaaacatcatattgaatctttggacacatgtataaagcattaaatatagataaaaagaaaaactaattgcacgctttgcatgtaaatcacgagacaaatcttttgagcctaattagtccatgattaatcataagtgctacagtaatacacttgtactaatgacggcttaattaggctcaaaagattcgtctcgcggtttccaagcgagttatgaaattagttttttcatttgtgtccgaaaacccctttcgatatccggtcaaacgtccgatgtgacatctaaaaattttcattccatcatctaaacaggcccttagcagtagtttgcaaaatactactatttactgtttgttgaatttgaaaggacgaaacaagaacaaagcttggcttactggagtagaaatgtcggatgtaccctcagacattcacaaggaacttaagtgaagaatggtgaaatacctgatatgccctcaacaaattcaggagggaggacccttgatgtggaagcaactactctttgccttccttggtctctttggtctttgctagtgagtgtgattcatttattcattcgttcctcttctctctctgtcgtcgtcgtcttctctcctcgaacccccaaggccccaactcagtccccaattaaaaagaagagaaagcacaagaggaggaggaggaggagacgagcatggcgatggggcctccgcgcctcctgcggggcctgattccgcagctcctgtcagtggacgcctggcttccctgcacctgcagcagccggctgcagctgctgctctcccacttccactgccgcctccaccttcgctggccctcctgcgccgacgccttcaagctccttctcgcccttctcctcgtctccgccgccctcgccgaggtccgctacatcgcctcctcctccatggcccccacgctccgccccgccgaccgcgccgtcgccgaaagggtctgtctactagccctcaccctaccctagatcggctattacacccaaatctgtattttccttttttttttcttcccagataaagggaagggagatagtatttcattactagattattattattactactgatttttgaccgaacgatgcactctctagtagtacttcaccccggacatactccctccgtcccaaattataaggcctatattcgatgacatactttgaccgttaatttatttaatattatgttcctaacaaatataaaattaatatcatatgaaagttcattaaaatatgaatataatgatataatatgcatagtacttaatatatatgtatatatatatatatatatatatatatgtgtatatatatatgtgtgtgtgtatatatgtgtgtgtgtacacactactagtcaaaatttacgaagtttgattttccttaaaaagagagcgtcctgtaattttgggacggagggagtatataactaacaaaatataaatgcaatttctgctaaaaaaatgaacgcaatatcctttattgacatttctctctctctctctctctctctctctatatatatatatatatatatatatatatatatatatatatatatatatatatatatatatatatacacgctctttcagatcacctacttttttcggaggccatctattggtgatatagtgtttttcaaagtgcccacgaccttacaggtttcattctccttcctttccttccaccgtccatctccttgtttgctgttttaagatatggcacctacactacactactttgcatatcagaattatggcgtaaataaggatgttgtgttcatcaagaggatattggcaactcctggagatttcattgaggtacatacactacatccatgtcttttatcctacttaccatatgctgcagcaaaggacatttcaagatgcatacataaatcaattgctgtgctgcattggaatgccccacccaacataatacatgcatttttatttgtaggttcggcaaggacagcttattataaatggtgttgcacgaaaagaacattacacagcaagccatgcatcatacactatggaagcaatggtttgtgcaccacctatctatatgcgagcattgtctccttgaacaacattgaggagttgctattgccaggtccagagatattaaagtgctgttaacacaagggttaacagcaatgacaagagaatcttcatttacttacaagaagatgatcaaaagtggcctggctgctccgtgttgttgacttcttgagtgcctccttcaggcctcagatggtggatgatctcttccatccatttctgttctctcttctcgaccaggatcctgtactaaagccatgtatgatcctgcagcgccttcctgaaggccacgtatttgtcatgggtgataaccgtaataacagctgcgattctcgtgcctggtaagaaacacgttgcgcccacattcatatagatgcaatttgatcattaccaccacttaatattgatgaattcattcatttagctgtggtgtgtgctcttgacgttttgagtgtgccatgaacctggtccaattgtgattatgattaaacatgagcatcctaaatgtagagctagagtggaatgagaacatatgcttattgctagcatatttcggttgtgagaatgcacctcaatttgctgattcattgctggttgtgaaatgaaatgtgcctttatagctgatctccagtctatctttgcaacctttgtctgcgaagtaggggactactgataaacaatcttcttattacttgtggtgcttgtgttagcaggggaccgcttcctatcagcaatataattggaagatacatgatgtcctttacaaggtcctccatccaataaccaaggtaccaagacgaagaagattgatgaccccaaggactgcaaactacctgatgctgtttgatattatggtgataagttgataacgatcgagttgtatggaaactagcaggctgccagatgggtggagcctgcaaattgtatcagtagccctgtagtaggttgggagaaggaacttttcgactggcatggttggttttaggcgtcggtacacgttagtatttgtcgcatgccttaacggcagtatgcatttcgcttgaaactatctattttagtgaatcagttcaggagaacatccagtgctccaacctttttcaatactgccctctatctgcagttctgcacggcaacaggtacacaaacctgagaatttttagtaccttttaacttgaagcatatgcatataccgtgacaacacaacacacgagtcaggagacgtgacgtgagggcctaaatactctgagttttttttttgaagccaaatactctatgagttgtacccaaaagagactcgtcttttgagtactagctcctacagtatgcatgtatatacataccctcctaacatgtagcttagttatcaacaagcggacatcaaggtggtgaccggaatgattctgatgatctaagaggaatgccttcacattcttcgtctgtttgtttggagaaacgaaatgatgaagaggtcggaagacggaacgacgatgaagttgaaagccctacagaaacaacaacaaagtggtttcagaatttaggaagaaacaaatgcacgaccgtacgctgacaaactcataataccatcggccatgtccttcgttttatgaagcaaaaatgttccagaaaggattgttacgaagccacacgcctctgtcacaatttgtgttggattttgcctgtcccagtcctgcatgtcaacaaattcatttgcagatcgacaactataatgttctggctgaaggatgtttaaatacatgctatcttatagcctatgaaattgaccgcttgaaaatttatattgaagcaaacaagaaagagaagatcagagattcagagggatcaattttttttttttaaaaacatcataccttgaacatgatgacactagccagtatggttaaggatgtgaacatggtataataaattggtgatacaactgctgtattaaaggtgtcaagtgcctgaaatcaaggggagaatcattatcacagaactcttagtaatgcacaaagtttcccaaatctcaaggcacaaaaatctagtgaaaactctgaacttttgagtccctactaacttagataatcctgaaggactagagcacagaacgaaattgtatgccacttttctaatattctcgattttggtacagtagagcttagaatttcagttggcctcatcgtatgctagtgcatagtcaaagaagggaaaaaaaaaatcttcactttgattcagagcgaggaaaccagggtaccttgttcaagtaattcatttgggtgacaatgcatgagaggacaaccagggtaaaagcccatgtctgtggatatataagttgattcgttccacaaaaggtcaacttcaaagctataccaagtgctttcacactcataacctgcacaattcaaccaacacctttgaaaaagaacacagctaaattaggcaaaattactgggatctaaattagagagtacataccgagatagagcctacaagagagcaaacaccaatatacaccatgacatgagtttgcccgtaaagtgggacaaatcggcaaacaagtatggcgaccatagcaagtactactgaaacatagaacatgaaggctgaaaacaataacatcgcatagttagggcttggtattaagccacaacgaaattcataaagtacagtaagtgtatctttgggtaatattaggaacatgtttagagagaaagcaatataacagaaaataaattcataaagtacagtaagtgtatctttggggtaatattaggaacatgttcagagagaagcaatgtaacagaaaatgcctggttcagtagccaaatcccacacttccgttactgactcaatctcacgctccgcgggggcatgaaggacaattgtggtggatcccacaacacataagatgcatccgagaatgccaaatatgtgtagcttcttacgcagcataaaatgcgcaagtatagcactgcagaacaaaagatagctctcaagcaaacagtagatccaaaacagcaaatacataataccgtaagtgaaagacatgcctgatgataatgctgagagcaccaagaggagtgaccaaaatagctggagcaaatgcataagctgcaaagtttgcaacttccccaacaaccactgaagaagaattagagatatggacaatatgacaatgaactatatagagaaacactaaacagacagaagggtaaaagcgagagaagagaagaggggtcacttgtaatcatgccaacccaccaaagaggctcatacaaataagaatagccgccaacccctgtcataaacatggcacaaataagggtagcgtaccaacacactggcattcaattggttaggaaaacatacaaatatgcagagcaacagcctgggataacattatagcagaagctgagaattgtgggtgggactggcatgcatcatctagatatatagtctagtctactctgttgttgagacagcttcaaccttcaattaccaggttgtaagtaaacaagaaacgtatagtgcagcagtggacatactaggtcttactaatgcagtaggatggatttctatttcacttttgacaaattgttaagataggatgatttggcatgtgggctagaggaaagtgatcaaattaatgatccacttacttatgcgaaaaagaaaaagaagtcatgatgagcagatagatagataggcgatggtaggcgaggacgagtagtgtaccggctcgaagagcggaggaggaggaggcggccttcttgaggcccttcttcttgatgatgaagctggcgccgatgaaaaggctggaggagagggcgagcaggaggcccttgatgttgtcggcggtggacatgccccccgcgtaccacctcccgccgccacctcgcgcctccatctccatgcctctctctgcccttacccgcctagggcttctttcctttttcccgttttccttttttgcgtttatatttactccgtagtaatccaatccagttaattaattttactctacaaaatactgcatcagcttgctttgacgggagggaagcgaggggtctacaattctgaaagaattctacctacatcccatctcgtggaaaaaaaaatcaaatcaatcagcagtcggatatattacgcttttaactgattgcgattctctcttatatggagtatatatagtagtgtaatacacacactgttacacagagatagatagaaacactacacggcagtatcaggatgcttttaacataaataaataaataggaataggagtagagttatctatcctgatcctagatggatggatggatgatgaactcactcttggtttggcgaattggtttcctatactcctattacagatgattactagagtttgctagatggtgcaaggtagttggagtagcgggcttgagcaatgagtttgcccgatttcttcttgaggtccacgagcgccaccccaactgccttgccggcacgaagaacctttgcttcgatctcaatctcttcctgcgagtgcgaaacaaaaatcatcaaggaaaagtgaagcagtcccgtccctagtgttggagagggaaaacaaaattagagacagatacatacatcggggaaagctgcatccaagtaggagatgttcatctccaggggcgaggtagagctagagctagagctgctgttgccggtggtgtggaagacggcggaggcgacgaggtgaatgagcgaggccgtggcgccgccgtgcaggaagccgcccgaattcttgaggacacaagcaagtgacgagtcagatggatcagatcaggtggaagaaaagaaaagaaaagattactaccaggagtcgggaggggacggtgaagcggcagaggaggcggccgggctccgcggcctccacgcggatgcccctcagcacgaaggcgtcgtaaaacccggagggcagcgccgccgccgacgacgcgtccgtcggagtcggatgctccagcacacgccgggccggctccatccccgatcccattcccctctctattctcaacttctctcttcttctgtctattctagtctaacaacaagagatactagtagagagacaaatttgggtgtgtttggcatcgccttttctcaacccctctccctcgtataaaccgttaatcagtattttttaaaaaaagtttctatgcgaatgttacttaaaaaaatcaaattaatcaaaatatctttttttaaaaaaattaactaaaacttaattaatcatgcactaataaatcaccaaggactctctctctctctcctgacttgggtggcccactccagagtcgagtcaggctagccatggccatggatgccttcggctccatgttcggtgaggccaagccgccggtggcgatgcggatgcgccccatcctcttccacgcccacgcccatactaatgatgtctcccaactccgcctcctcgccaccgacctccactccctcgcctgggaccgctccctctccctctccgacatcgacgatctcgtaatcctcttctcctcccaagccctaatcagtatcagtatcagtcttcacatcgtgctttttccagagagacgacgtcgggatcggcggctcctgctccgacttcctggattacctcaaatcttgcctctcctctggggaagtcaacctcctcttccctcacaatggtcggtacccgatctacctacactacgcttttttacactacatcttccctatgctcatatggataatactataggtcttgatcgcgttcatcttgttgctacaaaggcaaagggcctacctcgcatcaccatttccctcaacacccttactcactccgcgttgaatgatgccattgccaatttctcactatcactctatgccgcttttaggactacgcaggaccatgcatccagaggtcctacccgcttcattattattcactctctagtactattacccctatgcttttgtttctcttaaacattgatatcccttctttttcagaacaagagcgagcgtcaaagctgatggagactctatcatctgaaaaggttgtttccctaatccccttattactttacttattattaactgatgtttctgctgcctgatgaaggagtacatcgttagcataaatggaaccatacatacatttcttctcgtaacaatgttaaaccgtttattagcattctaggttgccaacttgacatactgctagtcatgcagccctaaagttcaaaaggacagtttttgacatactacaactttattgctggatgtttaccatatataaatgcttgattattattttttcagtaatcacttcttttccccacaaaatttcaagcatgaatgctcctgcatccttgttctctgtgttggcctattgtaccaggagatccagttatcattgaggttcaatgtcagatgctgcttgcttgctctgtttaattaaatttctcagcatatttttgtaatggcaaagcaattcttaatctctgccatagtttttttcttcttgttgcaatagttggttatataaattgtattgtgtgatgttagtaacactctttgatttcacaggaaaagaatgaaataatgcaaaagcaactccaagctctttcttttctagacaaaagaaaggcaacaaagccaaagctggtggccaatcaggttccaagtgtgtctgatgtgactcagggctctgatcaggttattgttccagcacagcagcaaacaccaggtaaccatgcttctccatgcagcactgaaacaaacaattctgtgttttctcagctaatgaaattgcaaacctgcagtagtttcacctatcaaagttcctccagctaaagccacgaagaggatagcccctgtatctcggaggttgtacggttttcttgaatcgctacatttacatgaaaagaaattttattgtatctgattgtagaccagctctgactcttgctatttttcttcagggcaagagtgcgaggagctttgttgcaagatactgaggaagatgtcgaagaatagtcagatattgccttttctctgtattgattagttacaaacttctaaagcgtgagtgtgtggtttgttagttttggggccatttttacttgtatcaaatctatgaaatcaagctaatgcatttattgacacaaatctgctcactttttattgtgcacttcatttttctcttgtttacctgtttggcataagctaagtgtgcttattagttgtcttttagctgatgtggtactaagatttttttaccagttattgtattgcgcatggatttttttttaaaaaaaagacactatgaatcagagaaccgtattttaacttccgctggctggctttggtgtatacaatttagtggtttaatttcttgcagtgtctatattcatagaatgtaccagaatgtgtctatattacggttatcatttaaaaaaccatccgcaccttggcatatctacaatagaatgtagtgtcaggtaaccatatagaaagatcatatacagacatctttcatgtttctctgcagcttgcatttctttgcctgctgttattcatggaacgttttatggaacatctaaatcagggggttatggtttgtttgttcagacgaatgaactccatgatgaatgtttctatcatatggaattgcttggctctgagtgttttgcttcaaactacaggtacatggtgtagctactgtgcttgttttttgtcgtatggcatgctattgctccttagtactacctccgtttcaggttataagactttctagcattgcccatattcatatagatg

SEQ ID NO: 62775 - DNA, 3185 bp, Oryza sativa
  unsure (1)..(3185): unsure at all n locations
aattaatttaacaattcgatttgtggaaaaaaacgaccgctaatgcctttgttccaaccttaaatggaatagcaagcggtccgttttgcgaaaattctgatttttcgattgaataaaatagataaaataccacaaatcgcccaaaataaaattagtacgattatcgcaagaaatcgcacttaatttcaacctactaagcggttataagtttaaaattttgcattattttaaaataattcactacttgttgtaggactcgttccttccggtagagaactaggactttcttgttcttgcagaccatcaggaatttgataagctttttcgacaatatatttttttgtcggttcagtgcctttaataaagtattccattaaatcatcgcctaagaagcctgtcgtagcatcaattttagtttcaataatattcggtggtagtggcgagatgcgctcttttttatcagctagcgcaactttcatatatttaatccaagcgggcattgcggnttttgctcccgcttcacctttacctagatcacgtctattatcgtcaaatccaacataaactgtggtaacaatattagcaccaaacccagcataccaagtaactttggaattattcgttgtgccgtcttacccaccaatatcttaacgtttaaacgccttggcaatggctctacttgtaccatccaaattctgcccaggttcaccataaattgcactattaaacgcattgcgcattaagaaggcaagctctccattgataacccgcgggggcgtagcgcatacttgcatcatttttgatagactctgtcatcaaacttggcgcttgaggtttaattgtggttgcaatttcaggttcctgatcatcttcagtttgcgtattgctggctgctggattagcatttatttcatcaatttctgctcttaattgatcttcatcgtgaattttaacaccatcaaaataggttggttcttggtatgctaaatcaatgtgattacattctaaacaagccaatgcaggatttgctttaaataattcattgccttggttatctaaaatacgatcgataatgtaaggctcgattaaatagccaccattatcaaatacagcataggcacgagccatttcaagcggtgtaaaagaggctgcgcctagcgcaagtgcttctgttgccataaactgatctggattaaagccaaaacgacttaaataatctgctacataatctacacctgacatttgtaatgcccgaatagcgaccatattttttgacttacctaatgcaacacgtaaacgtaaaggtccttcgtaacgtttatccgcatttttaggttcccacggtttttgtccttgtttattaatcgtgatgggtgtatcacttaaggtcgtagaaaggcttaaacctttattcattgcagcagcgtaaataaaaggtttaatcgatgaaccaacctgtactaatgattgtgttgcacgattaaaacggctttgttcaaaactaaaaccacctacaattgcttcaattgcaccgttatcactgttaagtgaaactaatgctgaattgacttcaggaatttgccctaacaaccattccttttttttaccttggtagatccaaatttgctcacctaagtgtaagctaatttctttgccaaatattgcatttgcttttttcaattcagctttatcgccattaggtaacataatcgtgtagctatttttattgaacccgataatcgctgcaccaataaaaggttctgaatgtggcaatttgcttaaatgttcaatgattttttcatcatcccaagcattacctgtccacagtatttcagcaccacgccagccatgacgggggtcataattaattacattttcacttaatgcatcttgcgccgctttctgatcggtagaaagtaccgtggcataaactttaaagcctttattataagcaacatcttcaccatagcgtttgaccatttcctgacggatcatctcggtcacataatcagcacgaaactctagtgcagtgccatagaacgtcgcagtaactgtttcagctttagcttgttcatattgctgttgagtaattttaccgacctctaacattctacctaatacgacattccggcgtttttctgcgcgtttaacggaatagagcggattcatcgtagacggtgctttcggtaagccggcaataatcgcaatttcactgagggttaattgatctaaacttttgccaaaataagtttttgctgctgcggctacgccataggaacgatagcctaagtaaattttattgagataaagttcaaggatctcttctttgtttagcacgtgttcaatttcaagcgctaaaatagcttcttttattttacgttctaaattacgttcaggcgttaaaaagaaattacgtgctaattgttgcgtaatggtacttgcgccttgagtatcaccttggcttgaacgccatacagcacgaataatcccttttggatctacgcctttgtgttcataaaaacgtacatcttcagtggcaataatggcatcaattaacgtttgcggtatctctgctaatttaacaggaatgcggcgttgttcacccacttcaccaattaatttaccatcggcagtaaagatttgcataggttgctgtaattcaaccgtttttaatgtggatacatctggcaaactttgtttgatataaatatatgtaaatcctagcgcgactcctcctataataatgcaggaaagaattgcacttagtattatttttgcgatcttcatcgaaaaattctctttggataaatgacgaaatagaaatttatagccaagataggccaacaaaacgttaagtataagctaaaaatgatgaaaaaactgcttaaaaaacacttattttttggggagtaacagccataaatgaatatctttagcaaaatatgcaagaaagaaacaaaaaaacggcagattggtcttgccgaaaatgctgagtattattgcgttgtctaccaaaatagcgatcaaataatcgctgattggcatattaaaccttttaatgttcaagcgtggttaacgcaaacgcttccattcgatgaagtcgctacatttattcgtccgattccatttagctatatttggcgtaaatatctcttttttccacttaatctggataaaaatgtact

SEQ ID NO: 62776 - DNA, 3307 bp, Oryza sativa
ccttgatcttgggcataagcagtacgcttgcctatttatattagtatgccgcgcactaattaggatgtcgcattaaacattcattttcacccgtagggaaagatatttccttacgggaatgtcgttctctatttttgggacaaacaatatgaaagttgaattgactttagaatgttttgccggatatttaaacaatgactttactaatccgattgataaaaccttggtagatgagatcaagacgcaagcacgtcaagcatggcctaaacgtcctagtgataaagaaaccattcgtattttagtaaaaatgccggcaacttgcggacaacattttcgttatctgaaagtgcgacaaaaaaacgaaaatacgttacaaatctatcacaatgcgttattgaaataacacctttcatttattcaccccggcgggaacagttacccgtttggggactgttcccttattttttaggagaacagtcatgaaaaaatacattcaacctcaaccgaaagatttataccaacaaatcaccgaccaaatcattgatgagctaaaaactggcacaatgccttggattcgcccttgggataatagttctcctccaatggtaataccctgcaatggagaaaccggtcgtcattattcaggtattaatatattgctcttatggatgagtaccatgagacagaaatttacacagcgtaaatgggtcacctttcaaggagcccaacatttagaaagtaaagtacgagtcgaagaaaaaagcaccgtcattattttctataagcaaacacagcttgaagaaacagatgatgaagccaatgttgtttttgacgaaaatggcgaaccgaaaatgaaaacgtctatatttatccaaggccatcatgtattcaatattgaacaatgtgatggattggaaaaatgccatgaaacatttccggaacacaaacctaatcccaataaagtagctcgcccagaattagatgagctgccaattaatatgggaatgcaagtgtataatcgcctccaaagtaaagcttgctatataccggcccgggactgcattatcatgccggattttaagaaatttcattccgctgatgattattacgctacactcttacatgaatgtggtcacgcaacaggccacaaagataggctcgatcgtgatggtgttaccagatttgataaatttggttcagaacaatatgcatttgaggaactgattgctgaacttactagcgcatttacttgtgcgaatgtaggtgtagccaacaatatttctcaaaatgcggcgtatattgatcattggatacaaatgctcaagtccgataaaaaagccattttccgggcatcatcacaagcacgcgaagccacacaatatctactggatatatttcacaatgaagagcaattagtagcttaagtaatttatataagaagccaacaaatgttggctctttcatcccacaagggaataacttcccttgattggttgttgttcccttctctttcacaaaaacaaggagcaacttatgccaaattggtgtgaaaacagactaaccgtaaactgcgaaccatcacggttaaatgaaataaaatccaaacttatccgttacaacgatgaaagtaatccaatattggattttaatctattaataccgatgccggaagaactggatatcgtcagcggcggatttggggagcgcacaaaaatcatgctggaaatgccacaggatttaccgttgactgaggattttattgccagacatatcgctgcatatgacactaatgatatgtgttatctgcatctttccctattgtcccaacaagagcaatggcaagttaaagactttgtgcaatggttggacgaacaccctgataaacaggcgaaataccaatatgacttacctcttgggcgggagtatttgaacaatattgctaaatacggagcaagtgactggtatcattggtgtataaaaaattggggaaccaaatggaacgcagagatgcttgacgatagtattttagaaggtcaaaaacattcattagaatgcttctttaatactgcttggtgccctccggaggaatggtttcattcactttgtacagcctttaaagattgtgaactgaagctgtatttttatgaacccggcatgtgttttgccggcttttttgaatcacatgctgacaattatatatcttattatgtgcaaggacagaataaagtcgacgcttttgcacaagaatatatttatatataggttagcataactatttttttaaaccctcgggggtgattccccgaagggaattactctcgatattataatcaggagtaattaatgactagttacgaaaaagaatttacaacactgttcagtaaaattgcaccgcactttcgccgctcagagcttttctatgactttattactatttttggcttggagttttacttagccatttatagtaagcatgccaatgaacagctagtaaaacgttatcaaactgcggtgagtcattacactggcaaagagaagcaacaactaagccagctcttcgtcatttatattaatgcactggagcagaaaacgtatgattttctcggtaccgtatttatggcgctggacttgagtgatggttacaaagggcaatattttacaccgccacatatcgctcaggcgatggcagccatgacgttaatggactgtcacagcattattgagaaacgtggatttatgaaattacaagaaccgacctgcggttcaggtgtaatgattatcggaagctataatcatctacgacaagagcatttcaatcccaacagcaattgtgggtaagagcgcaagacttggatttcacgacagcaatgatgtgttatatacagatgactcttttacatattcccggcgaagttattattggtaatacattaaccgatgaggtgtgctatcacttgtatacgcctgcgcacatactcggtaacgggacgatgaggttgaataatatgactgaaagcgaggtagaggctcaccataatactgatacagttaataacccaccattcgagatcgactgggaaactgaagcagtgttttattaataaaatgcgcttaccttttggtaggcgcattttgtttgataatcaatttgaaacaaattgattctaaatgtatcattataaaataatcattacttaatgatatagaaggagtcagtatgtttgtaaaaaccattaatgtaagaggattagaaccacaagtgctagctaggatgcaggagcttgcacaacaaaatgaacgctcttta

SEQ ID NO: 62777 - DNA, 656 bp, Oryza sativa
tgatgccgacttgttgccataaatggatatcacgctccatacgatagccattagtggttaacgcaattttatgaatgccttctgtttgtgaaatggtttcgactatttctagaaaatctttacgtaaagtaggctccccacccgtgattcggattttttctgtaccaagattggcaaaagtgcgtgcaagccgtttaatttctactaaattaaaaaaacgttgtttatgagatggtggtctgtagccatctggcaagcaataattacaacggaaattgcatacctcggtaatagataatctcagataagtgtattgacgctggaatcgatcaacaagatcgcataaggatggatcgccaatagttttaattgggatggcttgcataggacacctttctaaatacgagaggaggtttgatttctcaaaatcctttatgatttgctcaaatttaataagacttatgaaagtaggctcggagtctaaaaataattattctaataacttaataaaataacgcaatattattttatcaaattatatatttatgtgtgatttttgttttgattgcatttttaagttaaatgattaaaataaaacatcagggtaaataattttatagttttaattaaataccaattttcattattaggtatag

SEQ ID NO: 62778 - DNA, 995 bp, Oryza sativa
taaccgttcatcaagtggtaaatgataaagtgactaattcagattggaaagaagtaagcacatccgtttcattaccaaaagcagcattaacggcggatattaagtcgcttaatgattttggtagcaatttaaatcaaacacattgtagtggttgtcacgctccaattagcgccaatcattacacagcaaatcaatggattggtgtggttaactccatgaaagatcgtacctcaatgtcagcagacgatgttcgtgcggtgaccatttatttacaacgtaatgctaaagatatggcaggcagttcacactaattcagttaacttaaacgataccgagcttgttagcctaagtctattgataaggcagcaaagcctgcaatataagcggtcgagttgatgaaatatttagctattaatcgcttattttgcacaggatagtaaagaaatgcactatcctttcatattcagaaaggtgtcaaattttcattcactttcagaggactatccagatgaaaaaaccagaaaatattaatccgagccgtcgaggttttattaaaaatacttcgtttggtcttgcagggacatctttagccggtggtagcgtaaatgcattgcttacaacagaagccgttgccgcagaaatgcaaactgtcgttactgccgcacattggggcgcattaggtgtcgtagttgaaaacggtaaagtggttaaatccggtccggcaatgccagtttctgttgaaaatgaattacaaacagttgtgccagatcaagtgcatggcgaaacacgtataaaatatccaatggtacgtaaaggctatttagctggcaataaagacacttctttacgtggtcgagatgaatgggttcgtatttcttgggataaagcctttgaattagtcagcgatgaaatgaaacgtgtgcgtgatacttatggcccaagtagtatttttggtggttcttatggttggtatagttcaggttcattgcatgcgg

SEQ ID NO: 62779 - DNA, 1306 bp, Oryza sativa
ataaacaacaataaaaagctcaacttgtttatctaaccgcaagtcatttttagtaagaaactcacatactgcgagcatctttttatggttatgaatactgactctttcaaattgcataaaatattaattaatgttgtaaataagaaaccttaataataattggcattctaccccaaaaaaatcaccacttctaatcataaagaggtatttttgatttttgtcaagaatttaaactattacccaaaatgctctgtgtatttgacaattctgaggggctagacaataacaggcgaataatggacaataaaccatcgctttatgatccattcttacgctattatgctatttttgactaaatttattaccgctattattttgccgccgttcaatacgctagcattactgctcctttcattacttctttataaactaaaacatttaagactgagctatttttgcactattttgaatatcacaacgctctatctgtatagtacaccttacttttcccaaaaactgattcaagcggtctcttttagtgaaaaactaacaattgaagaatatcgacaagcacaagcgattgtcgtattaggtggcggagtacgtaacagccgtgaattatttgctgactatgcaattgccgcaacaccattagagcgtatgcgatatgcagcctacttacataaacaaaccagattacccgtactggttacaggcggaagcccaacaggcaagcaacctgaagctaatattatggcacaagaatttgctaacttctttgatgtacaagtgaaatggattgaatccgcgtcaaatatcactgaagaaaatgcccatttaaccaaagctattttagataaagaaggcataactaaaattattctcgtaacaaatgagtggcatatgaagcgggctaaaatgttgtttgaacgggagggctttaatgtacttgctgcaagtacctcttcttatgaaggattaaatattattggcgtattaccgtttattccacaagctatcgcaatgcaaaacagcagtatcgcactcaaagaatggttaggttattggaaagtaaagttaattaattaatcgctattttttcatcgctaacagataatcaatgattaagccggcaatgtctagtttactggctttttctatcccatctaatcccggacaagcattcacttttagcactaataagcctttatttgagcgaattaaatcaacaccagctacatcaagccctattgtttttgccgcaagcaccgctaattgttgttcagcggtatttaattgaataacg

SEQ ID NO: 62780 - DNA, 12775 bp, Oryza sativa
attttccatttcagcagctgtattttcatggaaccattttatctgtgttgacagacaatggcatgttcttcccttgaaccgcagcagagtcgacagttgaacctgaaaagatcttctttctcccagcaccagcactagcatcatcaccacagggcgaaggcatgaacaacgtacgtccttccatggtctcgttccaggacagcctcttcctctgtgacatgttgtactgctaaatgtccacggcgccgcacagaggcaggtcgtttcgcctggtttcaggattgagcaggagctgcatgcgcttgtattgcttgatccatgattgatagtccattacagtgcatcctcgttggtgtcgtttctagaacaggacatgcgaatgtgagttcgctatgctgtgtggttgcatgtctggaactgaggcggtgaggccccctttaattccaaggaaaatcatagtaattttggtggatttcatttctatcggattttggagttttgagtggagagcctgacactcatccttatgtttatttatacattgttatactcttgttttatattattagatgttttaacttttttctattcaaaatttctttaagcttaactaaattatagaaaaattaacatcatctattacaccaaattagtttcaagtatctattgctatgtagtttttcttgatcaaacttaaaagaagacgccgacccaccgtcctccatccctgtggctccgactacgccgtcaccactagggatggcaattttacccatgggccgatgggcacgggcgtggatgtgactttttacccatgggcacgcccgcccgaaacccaaagatgttatgggcaatatacgggtttcattttttacccgtgggtaacccatgcccgacccgatacatatgtattagctaattttgactcatttcttaattcttatatcatttctctcggttcatttgtgatgctaactgatactaagttatgatgtaattcaaattattgttgataaccgataatttggtaaataaattattgattttacttctctttgttaaattacatatctttcaagttattattcatgtgagatccactaggtacccgccggacatacccgcgcccgctgggcatgggtacaggcatgaagttttgcccgctaactctagtgggtagggtttgggcggacaatgtcgagcatcgggtcgggcatggttttgctctacccgtgcccgacccgacccattgccatcctagtcaccacctcgttgccctctcgagtccaccgcccacgaccatccctataaaaccgacaaactcctccctaaactcccccctttttcccttctccccatcctatgtcacccccaaggccccaaccctaactgggactctaaatggttgggattgttgtttgctggagttgaacaaagtcaaaggagttggaggagaagttcattggagaacgaatcacgaagcagatccgaaggttagacatttgtaaatttttgctcccatttttatgtcaaatgtggtttatcaattccgcaattattattttggacttttatgatgtagtgcttgtgcttcacggaaaaagaaaaaaaaaatgaaaggtggtcctactgaactagtagcagtacagtagttatagagctgcatcctgcacgcatctatggtgaggccatatggagatggaggcagcaatgaaacgaggaaacatgatcgatcgcgttaagggaaacagtagtactaggtgctagtacagtagtagatggtcaggagggggaggtagacgacggcgaggatccggtgctcatgaggccccgggtgggcctgctgggcctgggcctgagcgcaagggtgcaccttgccctgagcacggcgtagccgagcaggcggtacgcggcgacgaatcccagcatgacgcccacgttgcgccaccggcactcgtcgccgagcccctcccggcgcagcacctcgtctccggtggccacgcaggcgcccatcacccgcgccacgcacctccccccgcccgcgaactcgttcaccagcagcgcctcgaacggccacttgaacagcgacaggtagtgcatgaacacccagcacgacggcatcgccgaccgcgcgatgaagtagccggagaagaggaagaaggaccccatcaccccctgtatcgccgcattccccaccacgaagtccggcgccgccgccgcgaagcacaccaccaccgagttcgccgtgtacaggatcagccacaccagcaccacgaagtagccgaacgccgccgccgtcctccggagccccgccatccagtacaccggcgccgcgaacaccacggccagcgccagctggaacggcaggaacaccaccgcgttcgccaccgcgtaagacgacacgcggtacgcgcccgacgacgtctccttggccaggatctcccgctcctgcaggaagatgggcagcgcctccgtggtggacgacagcaggaaggtgaggaggaaggcgaagaggccgacgcgctccgccaccttctcctccccgaggtcgtagaagatggaccccagcgccaggccggccaccagcatgcacaccgtgcggcacgcgaacagctgccgcgtccgcgccacgttcttgaagaagcgctgcgccagcacgcccacctcgcgcgcccaactgttggcgtaccggctcttcttctcaatctccatctccatctccatctccacgtcctccttgtgcagctggaacagctgctgcagcgtgcaccggtcgcgtgcctcggcggcgctccggcggcggagcgcgtcgacggagtcgatggagaactcgacggtgtcgacgtgcgggggcagcgcgaggcccgcggaggcgagcagggagcggagggcgtcgacggtgccgtggtggagggcgcagccaccggcgagcaggaggacggagtcgaacatcttgacgatgcgcgcgccgggctggtggatgctgagcagcaccgtgcggcggcgagtgtcggccatggcgcggagggcgccgacgatgtgcagggcggaggcgctgtcgaggccagaggtgggctcgtcgaggatgagaaccgcggggtcgtggactgcctcgacgccgatggagacgcggcgtcgctcgccgccggagaggtccttgaccctggtgtcggcgacgcgggcgagggtgaggtcgtggatgagggcgtcgacacgggcgtcgatgtcgttgcgggcgccgaggcggaggcgggcgctgaagcggagcgtctcgcggacggtgaggagcgggaagaggacgtcgcgctgggtgacgtaggcggagacgcggcgtaggtcggcggtggtggcgggggcgccgttgaggaggagctggtcgggaagcggggaggggtggaggcggccggcgaggatctcgaggagggtggacttgccggcgccgctggggcccacgatggcgaggagctcgccggggcgggcgcggcaggagacgttgcggagaacgtggcgggtggtggtggtggtgggcggctgctgctcgtcttcgtcttcctccctgctccatatcttcatcatcatgagagggtgagcgcgcttgggaatggggatggggatgcggatgtggtggttgatgccccgagcctccacctcgcaaccacctttctccatgccccccattctttgttgctcctcgatcctgcaggcagctgcagctaaacaacacagtggaggaggagagtattgttgttgtgcatcgttgttccgtgtgatggatgatgagtgtgagctgctagtgatgagcgagcgactactgtgtgtgcccgtgtgagctacgtgcgtgcgtgcgtgccaaatattggttggtcggttaaaaccttttctctttcacaaggacggggggggtgcctgcttggtttatggttggctggtactactccgtactcctatcatgctatggctttccctgttttgcaccctaaactacagtattagtgttgtctgattgaggggcagaagtgtcctgtgattacaactgatctgaggaagctatcgaatcgagcagtttgtggttgggtataagcgagcgcgcagctgagccaagggatcacatgacgttgtcggctagcgagcgagccagcctcagccagccagcttcacatgcatctgctgctttacctccccggccgggcggccagcctcagctaagctagccgtatcgtcgtctcgtcgttggccatcgatcttctaccgcctaccgcccacctgcaccaaaacgcatccatcctcgcacccgtatccgcttcattactgcactagacaattattaacaatgttcaagttgatcaaaacaaaaacaaaaactctaacccggctggcctgtctgcatttcttatatacgttgattttgcaagcaaccattcacgcaattattacccatcttttattatacagaaactattactccagtctattacatgatgtccccatactacttgttatttggggttctaaagtagcaaattttacgaaaaagtatgttgggaaccgtgctctttctgtcttttactattaaaaatggtaacccatgcatctaaatacaatctagcaaaacttcaataactaatcttttgctaccaaaacttttatcaaacaaatttgccacaccaattaggattcgtagtaaatgaaagaaactggcacgtataaccagtcgccttcttctagaaacttctcgttggcacatgaaaggatggagatgacggcctaagccaaacctgctctgctgcatgcaggaataggaggaggtgaggtacgggaggatcggatcaaattcgtggccaggaagactcgagtcgtcatgggttttgtaggttcccaggaagagaaaaatatctggctgagcttggccctcggggccatgtcattgatatgacatcattgttaattaagctctaagagcaagtttaatagttttaaattatctatagccaatgtaatagtcaattcatacaatagttacttactatactattaatacctggtcccacctgtcatacacacgttacgtcttgaagtccgtactgcagctggctacagatctgtagtccgctgctcttccctcccttcctttatatctttaaaatatacttatagttggcttatagtatgttattgtacctgctctaactgttgatgtgttcttttttgatgatatgcggggatgggtgaaaaataattttattttaaaacttactacatccgtactgaaatataagcttatattttatcttatattttaagaaggaaggagtaaaaaatatataataattaattaacacagctagtggagacgggttgattaacacaactagtgctagctagcactgatgcaggtgaggccatatggtgtttgtcctccagcgacccgtgaccggtcgtcccgtgacccgtgccaacatatacgccaccccacgcaccacaccaccaccacctggagggatcatcatacgtaggagtaggagcagatccgcagcaggttacgctacaccaaaataccatcgctgcgtttgttcaattgtaaccaaccatataccccagccactaatagctcatagaatcctccttttttttgtttttgaattgtttttggtttcttggatttctgtctttccgcttttgtttatgtttataaaactttacgaaaaagttccgattgacactttctgtttccaagaatgcaactaaaaagggaaaacttttcgaactgtttttatcctagtttacaaagacaccaacaaatgatttctcactttcacagcaaagacgaatgatttacggtctaaattgacaaaaaggcatgagcaaatgtaaaggtaaaagaacaatttgattgatcgttaaggattcagtgattcaatcaaatcggtcataccacttattccacatatacttctccaagctattctattagaaccaaactcggatctatgcaaggaaacacaacaaattgcctaaattggactgccaaatttgggagtcattaggctagctatcaatcgcagcaaatgactcacggacggtgacgtacgttcagcaaatagccgattcatccaccaatcactacaaaatcagccgccagtgactaattcattcctactagcatagaatagcacattcgcaatgtcaacaagcccactatttcattccattatttttctttttttaaaaaaaaaagagtgcatgatgctaccgagcatgatataacgaggacctgcttaaggcggacgtgtcgagtccatcaggcgttcaggcattcgagctcgagaccagtagagagactacatgaggatgaaagtgaaacatattttcattgaacaacactaacaataaaagaggaaacatcctttcgtagatattcagtaaattgaacttaatacattatatagctgctgacgtaatggagattatatgttttttttgtatgcatcattggggtgggcggttcaacatggaaatatacagaaagcaaaaacaaatcgacacaaaccaagcttatcactttcagcaaccaatatttcatcaacaaagagcccagattagcatcaccagcatgttaacagcagctgctagcggcagcatcggcttctggcggcttctgcttgaagatgttcttcttcgcacctgaggaagcatcagccaagaggcttggtgtgtccaatatctgcatcatgaacgcatatgcatatcattaacagagctccacatcccacatataaattgtatctatcaagagcagctctgtaacaaactaacaaacttgacataattacttttaataatgtataatttttgtgacaagtgttctactaaatatgttttacaaatctgaatatgaaaattgctgtcatattgcaatgtgtattttatctgtaagatggttccgcttatgaaaagtatgatgcgaactactactggttctctcaaaaaataaacagatgagacaaacactaaaacaccgccagtccactatcaagcatgagcaagcaaaccctgaacatccaatcaatcatttgctatggcaccgcaaatatataaagtcaactttctctcagcagtaatttcacagtccaacatgtagcaaaagaagaaagcaatgccatgtatgaatcaaaatgaagcaaatctgtttatattgcataccttcaggacgagttcctcaaagcattgttcaacattcactttggttttagcactgcattctagaaataaacacccgtattccctggcaaattcaatgccctctttttttgtcacagctctctcactttcctgccaaaaccaagcagctatatttagatgtgtagtaaaaacatgaaaacaatacatagaaaaagaaacctatgcagaagaacatcataattagaatgggattgaacttcagtgaagcataaagagcagaagaaagtgtagaactgaagcatataataattaccttgtcaactttgtttccgacaagcatcttaatacaatcctggtttgtagaatagaggtcaatttccttagcccatatgtcagaaagattggtgaatgtttcccgtcgagtgacatcgtacactgagaaatcaatttccactgatcaagatatatcttgatattcgataagattaaaacacaatcctccatttccttctataaggcttattttgagtggggcacaaaaaatatgagtaaggaataaagagaagatggttaaaatgaccatgctacacagaattaaatatcttgggaatgggagaggtgatggctagtgatttttttgtctgattattagtcaattgtttgttattaatgtaagagagtctgttataaatgagagtaaacaaggagtagaagtaaaaacatttacacagagacctatattttggattttttttttgaagaaactacaagacttatagaaagaaatgggagtagtgaagattccttcaatgctgcaaacagaagcaagcatccgcagagatggggctgaagacaattacccataataataccctgtgcacctctgtagtatgagctggtcaaggttctaaatcgctcctgtccagctgcagaaaaggtacacaatgccaaataagaaactaacagaataatgtagctatgggtgttaaaagacacttatgttttctagagacaagctgtatagaaaaaatcagaggttcagaaaacagactgaaatacaaacacgtcatggcttaattattcaaaacagtgaggcaaacaagaagataaacaagatcgaatgtctattctataccattatatataaaatgagaatttgaggatttgccactgcattagcagttgcaatgtagaacttgccactcacacacttggggtggaaaatcgtagatcaccatatactaggccttgtttggcacacagctccagattccaatcaaagctggatttgaagtttgtatgttaaattatagtggtttaaaattttgtatttcatctcaaatgggaacagaatgattcatccaaatgttatcatcgtaatctcatatctagatccatggatttgtggagagctaggaaaacccagctccaaaaaatcttggatccagagttgtgccaaacagggcccaagagatcgcaaattctcaaatttcctaaaatcaattacccaagaataattccttacgcttttatcaacagcaaaaaacataactaaagaataatcgggttctacttttgagaaataacttgcttgtgcttttctgttttccatagccatcccaaaagaaaccttttatattgtttacacctgaacatgcaggaaaaataaaaacaaacggagccataccatttaggagtatgcaagaactagagagagtgcttacatcatgtgcattgagcctgtttgagtctgatgtaataaaacaagtaaaaaaaagagtagctacattaggcttgatttttagttgcaaataagaagaggttacaggttgtctgggatccattgagctcagatgtgctttactttctaccgagtaatgagaataattaacaaaaaaaaaggtaagcctttggggacagcacttgtcttgtgtaaataagcatttagacgacgagtaaagagatttcaagtggataatccacttacttatagtaatatgggatgaaaactaagtgcagcttcaatatcaacagttagcccaggtgctgtatattcccgcagctatggggggctggctattttaagctggcgcttgacttgagacccgtgcttaggaggatcaataaatgatctgaacagggtcatattggatccgcgtgatcagtgcagtgtgataatggtgatgcgtgatacaagaaaagaagaatgatttggaactgaaactgagacttaattaggacctgtgtcccagatggcaagcttgagttttttgccaccggtgttaaccatcttgaccttgaagtcgacacctgaatatacaatccgaacgcgattagcaagaaaaaaaaatttttgtgggggggggggcgcataaattttgagcgggcgagagatgaaagtaagcaggtgccgggggatgatccctgttacctatggtgggcgagagatcctcgaaagagtcggaggtgaagcggaggaggagactgctcttgccgacgcccgagtcgccgatgaggagcagcttaaagaggtaatcaaaatccggctggctctgcgcctgggtggacgacgatgaagacgaagaatccataataacctcctcgtatgggatgacgaaggtggggggatgagatctgatctagggtttgatctggttgcggaggaggaggagaagaaaagctggaaaagggaaagaggaagacgaagacgaagacgaagagaaagaagatgtgcgtttgcggtttgcctctgcatccgcactcgactaccggacctagggtttgcctacaggggcccaattacgcacacccacttctatcataggaataagttcactttaggtacctcaaaatttatcgccaagtctgaaactaatcctgcctgcgttcctcaactcgcaaaaacagtgcagataaggccccataatggtttggacgtgatttcggctgacatggcgcctatgtaatatcaacgtggcacttaaagttagaaaaaaccatgggacccaacccctctctttcccctcttgtctcccttcctcctctctctcccttatatcacctatgactgtgccggggtgctagcccggcgcatccctccccccgccccacacaaacaccaacatcaccaggatgagcaccgctttcagattcatgttcgttggcagcaacaggaacaaaatgatgggagaggaggagggagggatcaacaacagatgcaagcggtggtagtggctacggcaagagaggtggttgtagaggttagggtcgaaacgaagctcgaataaggatcgccacaccaaggtggacggcaagggtcgctagatccgaatatcgacgtggattttccagcggacgagtaagctgggccacaagtctgacagcaagtccacccagtagctgctccagcaggtagagattgccattgttgtcatgaccaggatgtggaccatatcagcattgacgctggtctccgtcgtaccctccctcccttccctgaactttgccctctccaggtcacaccaccaccatatgtgggcagcgcccgcggcttccatcgggttcctcaactccaccaacgcgaatgaggtgcagcccttacacgagaagagaggggtgaagggaagagagaggatgaaaaaagcgctagtcattgacatgtgaggtccacgtggatcccgcacgctaacttagcttgccacgtcagccaaaaccatactatctacaatctcgagtgatatgattttataaaatgaacgacccgttatatttggtttttttggtttaaagacgaattttagactcaacgacaaattaagcgacctaaagtgtgcttattcctcttatatagttatatacttatatgccacaccacattcatcgcttcataaaaaaggggtccagtgaaaaatcagatgtaaggtttcattaattaattgcatctgcaacgtatgggtatggtcaaagatttgcgcatattacatttagtcgttggttttaagaatatttagctgtgccaacatttagtttgcaacatgttcaatctaggttcgttgcgaaaagtcaccatcgccgtctctctctaatctagcctaatagttgagctttgtactacgctgctgcgtaactcgctattgacgttagcatacatcagatgatcagacagaccgctcgtacaggtaaaacaggaaaaaagaagaggaaattcctactagctgcctaggagtactaatttggacggcagtaagcaccacacaagctcaggggatcaccaggaatgtaaggctgtccgctccagaatcaggcttccaacatctttttaaggacaagtgatccaacgtcgccaacgagttattcgtaccgatcccttattggtgacaaaatcttcttcgcaaactagggtaagcgaaatgtccatgaaccacgaattctcctgaattggcccaaactgaatcttcgcaaactagctgcaactcccaatctcataatctgagcgccttcctgtttgagctgtaaaatgcacttcaataaacaggaaacagaagaaccatgacatgcctcaagtaacagcgagcgaacgaacccccgtctggttcaggctataggtataggagccatacctatatataatagaggggattaaacatgcaaaacaacaatgagcgaacaacagagaaaaggacaatcatgagcttaaattaagaaacaacgaacaaacctgtgattcaggtcacatgatcaccaactgttgacgctgaacaggcagcattggatatggtagcattagtggtattgcagatgtcaacaagagacccctgctcaaacctggtctctaattctggatggttctgatcagatagattagttgtcagcagcaggttacatggatcaggatcatcggcaagagaaaaggacaagtcattcagctccaagtactgttcagttttaagtacttccagcgtaggaggaatcaagtcttcaccacatgagttacaatggttggaaatgctctcatctgattgggaatcaagttcatcaagttcattaaatattgcttcaccatcatcggacgatacttcattgtcattatcatagtcagcagttgagtcaggctgcattaaaccaccccccaaaaaatataattacacatcaatggcgtcaatgcatgttgaacagcagatacgacaaaagagagtgttgtaaaacaaattaccaatgaaccatctcgactaacggagttcaaaagatctgtcgagaaacaactgataatctcatctagctgctgggtatgtatggtatcaaaaggaacgctaggactagtcgtcccacagccaccaacagcgatcttgtcattagtttctgaacaatggtccaaagaagatccaatattatcactaacagccagctgctgaccagctgtgtttaacctgccattacttgattccagcgcacaagggggcacagaaaaggcaaaagaggatagctccccgttcgcttcattccaatcatcttcattgaatggagcaccatactgttccccaatcttgggacctggaccacttttttgaaagattttgcagagaacacaagcatcctg

SEQ ID NO: 62781 - DNA, 9684 bp, Oryza sativa
gtcaaataaccactttaagtgataatcttttctcagaaggaagaataaatatccttgctttctatattcttataattcagtttaaggatcaactatagcgatgctctggttgtgacattgtcttggtgtttctttcaatatttgctattcacgatgcagctcataaatataatctcgatataatataaatagagttacacatatgttgaagattaaaatggcaaaagaagttgatggatctcatcataagttgaagacagttgaactggtactgggaaaagagaggttacaggcattcagcaataggttgtttagaagccatacctatttatgtattcagttaactgtaaggcacagcaaagtaatctaacaaacattggaaggaccagaaaagaggacattagatcaaatggatatacataatatatgcttttttaaaaaaaaaagaaaaggaaagaatgcaaaacaaggcagcaaaaatggtgcacatatattcatgtatgtcttgtgttatccacgtaattttcacacgtgcattttatagtttttcacatgagtaaggaacaattgccatgtactaagtacgaaaatttgccaaaagaaatgcacaaggactacagcagcactttaagaaacttagttaaataccgaaaactagatttttgacatgtaacccacttcataagccagatactgaaactactacaaagtacaaccacatcaaggacatcataccagtttaacaccagaagcagacagttccttgtcctccagcctgtattcatacattacccaatcagttctatcaccccgaggtggcttgccaagatgaaacaccaaagttcgcttcatcccaacagtctgagaattatatattactggtctgtcttttccagtagctttccaatacccagcttcagttgatcggttcgttcttgacccactagaatatttcctatcacgtgggcaaaagaaataccattctcgatccttactctgcaacgaagatttctctgcaccaagttaaacaagacagaataaatcacaagagcagttcaaaggccagcgacctgcaaagcacaatgtttttacattcaaatgaaaacatgtggttgcccaaaactgagctaagcaaacagcaatgcatgcgtagaaagtcaaatggaagccattgctttgaggaaagacatgattctcagcagaatactaatgcaacagaaacaagtggatcaaaaaaggtcttgacttggaagggagtgaaatggtaaagcttggaaaacatttttcaagggagagtaaatttacctggaagatcccaaggggcaaatttgtatagatcaagctctgaaacagcattgcaccgtaagtgtttgcccaataattttctcttcaggtaatagacagtcaactcaacatctgttggatgaaaccggaatccaggaggaagagatgtcttggccatactaaggagaatggaacgttgtctatactagcataacgagatccaaatagaccttggcctaagaactaaagaaataaaaaaaaacggttgcagttagatagatagaatagtagtacatttggttgggggcaacaaagagagaagagcgagatgagttcaaatatggtaaagaccaactttggcatattattgagcatccacagcaaggaaaacagagataatccttcctgatgtcaagagtcatttgaagagcaagcggagccctgcatgaaatgatttagatattatccctcagctgggcgtagatctaaaagaaaagacccaacatataggaaaagaaaaccgagacacatgtgacatccggtcggcagtttgacacagagaagcatggcataaaaatgcgatagtgtaaaatgtaagcccccttgaagtgaagtagataaatgaagggatgatgtgcaacaacactagaacagtctatttattatcaggcgaagagcaaaggtaggaaaaatgatgtggtcgaaattaatcacgcggcgtgcgggcatatattgatacatgcatatctaggggagaagaatgaaccctaagtagcgaagtagtgcgggagagatccaaccaagaatcatcataagaagcaatgtagatgggcgacgagcgagcgagggaggaggagagacgagacatacgctggtggtggcggtcggcgagggaaggaaatgcggcgccgccgcggagaggagatggtggtgctgatgcggatgcggtacgacaagggagggatgagagattgagaggagaggagaggggaatgggacgcaggacgctggtgtgttggcgaggagaagcggcgaggtggaattggaaagaggcggcgcgcagcggagagaggcaggcggctcccgtcgccgtcgcccttcctcctcctcccccccaaatctctctcccccaaggccccttctacattcttcttcagcttggggccttgttgggcttttatgggccgcacctacggcctacttctttgttatatgggctggaagcaattcctttcatcatcaatgccttttcatttcacaagggagggcgggccggccggtacatcgcatcgatcattacttaacagtactacaagtttaacatctcaaaaattgcaattcaacatcctctatctcaaaaattgcattcaacatcctctatctaaaaaaattacttactactactactacaatccagtggaaagaaagaggacaagtcaagacgtacagagcagtaagggtggtggtggtcatggcagtgggacaggcgtcctccactcgtggaactcaaccaggtctctgttcacgattgacctgttatgaagccagaaggtttctgcggattgatggaatcgcctcaccttcctctgcagttcccacatgatagcgctcatagccgagcaccgctctgtatccgccgcatacacccataggcatcttatctcccgcccgcgaccaatcatttcctcaactcttccatctgcatgcatccgcttaccccgctcatgctaactgcttacatggcttgactcttctacagattacaaaatggaaaggagcctacctggtattgactcgagatattcaaggagccccgggccaatcttggacgcaggccattttatcgatacttcagtgtagtcaatcacattctggaaaggaagctcaacttcatctgataaaattaccggcacgcattcctgtagtcaacaatgtaaggagcactgtaggtatgcactgaaactaactatcatccttttgaggaagagctcaccacaaagaaggattcatagaagcgaagtgtccatgaagactcgccacgaggagctaggcaaaattttgcattcctcaagtgcttgaagtaatctatccttcccaatttgtctggtccagagagcttcagctccggagactccagctgttcataagaacaacccaaatacacatcagaaatgaacttttttttatcatcacttgattcacttaaagttaattacaccattaaaaagtttctgccataactacttctgatcatattcagaggaaggcttacaccatcataaaatgttaagttgcatttggagattagaaggaagccgaaccttgtcaggatactgctttgcaagcttcaccagttggagacggcctacttttccctgagcacgcccaaggaagtttgctaaatacttcctttttgttaatgggatcggtttgacagcaagcctgtcagacttcaccatagaatcatccacattcccaggtataataatatctttccatgtgttaaaagcgcttatacctcgtttatcagtgcggtcaccctaacaaaaaaaaattgaacatagaaccattcgttaagaagatgtcagaagttgcttgcatgtcgagttaacagaagactagaagaccactcatgaacccacttattactcgcaaacaaattgaggacatctgaagatacagaatttaattagaccaaggcatgcaactgctatcatctacgctaggatttgtgaaaaacactgccgtgttatattatagcaagctgactcatatacgctgcacatttggatgggatggactaaggatgcattacgggccttgatcctcccgcagttaaggatttgaagcgcggtaatatttaatggggatttaacaaaattgcagcaatcgttgtaacagttctgaataagggcatgtttttcgtagatataacaattaacaattatacagaaggcaaacccaataaaacttgtgtaagttatgcttggggatatatggagcattactttactctgtcttaagaaatgcgaagcaaataagaagatgaatgcaaaaatggctgtgtacctcaggagtaaggatgatagacctattcaggaaggttgcccatgagcgaaacaggtgagctccagcaccactacacaagcaagaaaacaagggcggtgccggttttaggtaattggaaggatttcagtggctattgtttgggtaaacatactaacaggaagtcaaataagaagaagaagaagaagaggtggaaccttgggaagacaaaaatgtggtcgcgtcctccggatctgcggaaataaggcatctgactgagaacctgcaagcagagaggggagatgggtaagaaatgaaggcgcgtgaggtgaaggtaaggttttaccaccttgacgtatgtctggttgatctccttgtcgttaagttttcccgtcatccgaacgcatttgacataggtgggaacgaagaagagatccgcttcgtccttgtcaaatgttcgaaatctcgagctgaggaggagctggtggatcttcacctgcacgacatcgaaacgcggtttgtacagtagctcgagcaattggttagggctagaactactagtagctgctacacctacctgagttccccactggcccttgatgcaggttgcagcggtgacgtcgtcgttgcggccgcggagcagcgcgcgcaggccgtcgacctcgtcctcggcgtagacgtagatgcggaggtcgcggtgcggccagggactgtatggtgcggcgcaggggggcggcggagcggagagtggggaccggtcgagcaggcgggtgaggaagaaggtggcggcgacgaggaggagggcggccgcttggtgggccctcgtgcagagaggctggtgcgagctccgcatggtcgctcgccggagacgacgtgcaggcagcggaggggatcaccggagccggcggcgaccggaccgaaccgaaccgacagagaggaatcgatgcagcgcgtgggcctttttacctgagagagctggattcgaccggaggcccattattagtagatgcctagatgggctaaaagccttcgtcacacgccctagcagcccatgcattcggtagaagaattttttttatttatacattttttattaaaatatttacaaaaataattttttgttttaaaaatttacaaatctaatcgcctgccgccctttgggagggtgatttttaaaaatcgcccttccagagagcggcaaggaacctaaatgcaaattttccatcacaattagggatggcaatttcccccgcggggacgggtcccctgcggggacccgcccctacgggggcggaggcgggtacaatttctcacccgcgggggaggcagggccggggccccgcatttttgcgggtaggggccgggggggggggaagttcacccgcggggccccgggggtgtatattaaacattcaaatgtagcccatacaaggcccaacccaataaaatagtgagggataaaaacaaaccctagcctccccagtccccaactccccatctcaacatctcccctccagtccgcatcggcatcacgcacccaggcagaggcggaggcgcagcggcacgccagggtgcacggcgaacttttggatctcgccgttgtcggttgccctctgcccctctcccctccaatcctgtcccctcctgctctccctccggctctcctctccggctgcgcggtcgagcggcgagggcggcggcggccggcgagggtgcggtcgtgcggcgcagaggcgcggcgtccggctgcccgtggcgagccgcgagcgcgaggggacaggtgcggggccggcaaggggacagccggacaagcgcggcagccagctctgggatttgattttgtgttgatttgattgagttgttactcattgcggggccccggtcgggttgcggggccccgcaggggccggggccggggccggggactgatttgcacccgcatgtccactcgaggccggggccgggtggagagttcgggggtcggggtcggggccgttccagcccaacccacacccgccccgccccgttgccatccctaagcacaacttgttagctctataaattacaatttaaaattatactataaagtcagatgaaataaaactttatatcaaaattgtagagctcaaggagatctacaactttgtagttaacaactttttcatttaagatgttttagatattcaaatattcgttacaaaatataaaacacattttaaaaaatctcagatctacatctcaaacgacattggatggagataaacattatataaaagttgtagatcttgatgagatctataactttgtagtttatcacttttccatttatgttaacgaccaaatttggtaatatcaacatcggaaaaggagattagatcaaggtggagtcgaaggcggagattgatccgagaacagagcaagaatcggctgaagtccagatcagctacgattaggatcggctgggtctgagtcggactaggtgagccgatgcagcagattctgtcagtataatttggtgtatgacattgggttgaattgaggtgcttcaagatgattgccgcacatggatagagtcctgagaaggcaattgtatctattaattaggatgttttatgtaacttccttagagatatgtttgggcaaaagtctgccgcaaagacttatggtatcttagagtttgttagagatagtggtcgtgtccggtatggacatatcttgtaattctcgggtataaatagaccccgagccctatgtaatttttaacacacacgttcaatacaatttcggcgcatcgccacctttttgctttagttttgtttcgacgagttcttgctttcgggttgagctgcatcggtttcgatcttcaacaagaggtaaaacttgttatgacgacttgtgttctcgagattagtgtttccatctttatgacactctaatcttgtctatataatccgtcaagttatcatatatcttacataatctttggcaatatcgttatctaacctacaatcggctaacatctgttaatagaaggcaaccgattaggttaaatagcgacgttgtcctaaattatataagatatctaccactttatgaaacacccagcggcttgattgtctagatattgttcttcttttcatacttaatgctacatcagttgagtttgatctattaagtcgtgcttagaatatcaatctctagcatgtcctctggttgccgattagggtagtatgggagtttcagccgatcttatctgatttaaccatattcgatctatatgcttcaatgtcatgttaaatttgccctttatgtcaagatcttattgcatttaagtatattaagcttttgtttggtatattatatttgttttgttatctttatataaagtagtatcggagtattagccgatacatgctagatctatctgatcggctatgctataaacatatataatcctgttattaatatatatttcgatctaagtgatttatactgtttcggcatggtgaccgatctatcccaatcacttgatttaagtatatattaatataagaactatatatcgttaatatctacagccgatcgaatagatttagttccttaccatctatttataaccgctgatcgattcatatatgacatcggctcaaagataaatgatatgttatcggcacctagccaatcggctatcatttatagatttaaccacgaattctttgtatctatttcttgttgattacaggatcaaatcaactggtacgctcatacattcgaaggcgagctttggacctacacaggagttaagcagatctcccaggcctcgtgttttctatcaacaatttaaaatcatttggagtatcgaataagcattattagtttttaagcaattaaaaccggtggaaagggtttgaacacaaataaaaattttgcatttaggtcccttgccgccctttgggagggcgatttttaaaaatcgcccttctagagggcgacaggcgattagatttgtaaattttcgaaacaaaaaattatttttgtaaatattttaataaaaaatgtataaataaaaaagtggaatggaataggaaagggcatagttttttcgcttatgcttatcaaccaagatttaaatttttcgactttaaatttagagttgatttgagaaagaatttgcaaactaataaaaccgggtggacaaattttccatctccaggggaaaagactatcatctcctaccagataaatttctaatacctttggggtaaaactcttgtctagtagggaattgcaaccagagagagttctagtgagtccatactctttctttcgttcatcaaagcgaagcatgggttttttaattgaagtttatttttcagcctttacttttagatcgctaagaatacgtatataaaagttttattcacaaattattttttgtttgcaaatatgtcatttcgcttattctccgaataagcgaaacgatgggtcgcccagtctgaaattcatccctgaaccgaaataacaggtactacgtatccctcaactctcaaaaccactacaaataaggtcccaaggtggttttagatgatggttttggctgacgtggcgcctacgtggatgatttgacttagtcatcatcccatgtggcgttgacgtgacattagaatcgagattaaaaaattaaaataatatagtgggatggtaggtcacacttcctccacctcaccccctccttttctctatctacttctcccaagttccaaacgagtgtgcagcgacggtggccggcatggaaggcagtggtgacgggaggtgctcggcgaggagggagccatgtgttccgcggcggatgaggagaggctgctgtggcagttggaggttggtgaggaggaggtcgcggacccgttcgtggcaagcggcagccgatgaggagaggacggaggcgtaggagaggggaggagagctggcgagctcgccatcttgcctccaaccaccacccgcggccacttgctccgccccgcctccgctgccaccccgacgctaagccatggcaccaccaagacaggcacaggccttgccgtgaggtacgacgatgaagactgcgtggccgccttgaccaccaccgcctctagcgtcttgcagtccctgaccacgccgccacctcctccctcaatggcagcctacagctgaagctgatgcggcgggtcgaatcccttaacttgtatcatcgaaggtcccttgtcttatcgtcgaatgacaaaatcgtcccttaaccgcaaaatcagatatatgtcatcccctatcttacaaaaccggatcactttgggtccttaggcagttttgactccagttttg

SEQ ID NO: 62782 - DNA, 6514 bp, Oryza sativa
tgcactccccgtgcactgtcgccatgctcctcgccatggccgtcattaccttcttcaccgacctcaacatcctctcataccttccccgccactgtccaattcttcccccgtcagttgcacccgacgcaccgtgcctagctgctctctgtcactgccgcccgtggaaatgggagaagagaggtggagagggaagggaataagaggctgacatgtggggcccacgctgactcaactgccacgtcggacaaaaccggagtcaaaatcgtctaaggacccaaagtgatcgattttataagataatggatgatatatatctgattttgtggttgtgggacgattttgtaatcttataataagatgagggatcttctatgtaccttttccgaattgatatgggtagaaagagagccagcgccagccctactcgtacggcggcagagatatgggacacacgacgcttcacctagtgctgcgataggcttagatgggccaaacaaatattcatccaacatcggggaaaaacttaacgaacatggaattaattagatctaacagcttagaagtgccgatggcatttccggctttccgccaccgtaatatactacgatgtaaccttgtagaatgtgtgcaatgatttcatctggtttagtgagcggaatgtaattacgtatagtaagtgtgttaactgaagactaattggccggtgggattcgcttccaaacagtagaagacgatgggacgagagcgcgcgtccaagatccaaccaacacacttgagtccgtgactgcccttttttctccatcatcataaaaccgatccgtcgtaagtcgaagcattttctgtcggtatgcatatgcacacatgcgcgtacacagcagctatatgcatcatcatcgatcacatgcatagatagtaggattattttatactcctatcgataatcagcgtgcatgcatatcaaccgaactgcaattatttaggattaatatatatataattcatgctattgattatatatacatttgctcttttttttaaaaaatattataattcatgtatttacgaacatactattacaattgaagtgatatccaattgtgcaactaattaccccctcaatgtattttttagattttcttttaccaaaatgccattctgtcgtccatcctctcttcttttgtccctacctctttttccacgacgggtagacccaacgagttcgtgacgctggcagcagcattggatatattacctccatattttaatatatgacaccgttgactttttaaccaaacgtttgaccatttattttatttaaaatttttgtataaatataaaaatatttatgtcatgcttaaagaatatttgatgatgaatcaagtcacaataaaataaataataattacataaattttttaaataagacgaatggttaaacattgaataaaaagtcaacggcgttatacataaaaaaaatggaggtagtatgacactgcacacacgggcctccgggcctctacccttgcgctggcctcttccctttcctacgacacgatcacgcaaactcctattggatcagggagggagaggccatatgcatggccgcgcgagcgagcacagacgcaacctggcttgtcgatcaacttgcgttggcctggtcctggacgtacaggaaggtggatcgatgcacgcccgtagccatcctggccctaagttcacgtacggtcattcttaatttgttgtgcactctagcaacgatctggaaaatgttgacctccacacccccggcctctcccgcgacgcatgcaggaagatggcggcaacagctccatacggcgatgggacaacgaatcagatctagcgcgttggggatagcagtggcacgcttgcactgctgaggccggcggtggccggcgcggggcagaggtggaggaggtggccaccgtggccatatagttcatcagaaatgggagagagggggaggacgaagggatatgaagaaagaaaatggcaaattggtccaaaaattcatcgaatggataagtggtggaatgtcaatcaaattagaatgacatgttttacatgatttgtaatgacctttttttttgaaaaaaaagatacatatataaaatttcatccccaaattttcatcgaccggcatttagcaaatcggtaaaataattaattgcaacgagcataaagatacatatataatgcctagtgtgatcaagtcggtcgattgatacatagctagtttggagtggatatatatattagctagtgggtggataggctattagctagtatgacagcaagaggagggagatgatgtcgaggacgacggtgcagaggcggcgcagaccctcctctcgcttggccaggtcggacgggtacgcgcgctgctgggacgacgctcgtcggaacagcgcccggcacatggttgggtactgggcggcggcgctgacgtgcacgaaggcatagtcgtaggcctcctccttgatggcctcctgcgcggagatgagagcctgtcgcgcgtcggcgtacctggcggcgcacgcgcggagcagcggcgcctgaggctgagattggtaagcagccgcgctggcgagtaacgaggctccggcggctgaggcgttggtggcggcggcagagacggcgatggcgcataggccgcggacatcggcggcggtggagatggaggggtcggcggcgagagcggcgacgcagacatcgtagtaggttgtggagttacaggtggactgcacaagctgctggggcttattgttagtagtagcaactgctgctgccgagttggcagcggcgcggccgccggcggcgataagtagtactaagaggagacaacaaccggcgggcgccattgatgaactggctggccctagctaatatacactgtatgaaggttatgtagtctttctggatggatatatatatatatatatatatatatatatatatatatatatatatatatatatatatatatatatatatatatatagcaagctcgatcccctgtacgacgtcgtggacctggaggctggaggtttgtcacactcacatgcatatgcactcgacaaatgcacgatggatggatttgtgatcgattctgaaatgttggttcacgtgacatgtggtatggatattcgctcgcatgcatgggcctcccagacctaagaacaatttgggccagctagcttagcgccttggcccatcccttcttgtggagtggaggtgtggtggctgggctgggctgggctatctgtcctgttcatcatcatcgtctcgctcaacaatggaatggaatggactgactgattgactaccacgaccaacagcaagtgtcggatccgctccgatcagcagaggtcgccgccggagccggagagggaggagatcgcgcgcgatctgcttcttcgttacttggcccttgtggatgtcatctatctagtccgtccgtccgtctccgtgcgcaagtaagataagatcccatttaatttccttgtttgctgcagctgcaaccgcaactgcaactgattccggccgggctttgagttcttctccccccctgttggctgttgcccctgatccgattccatctcatcccatgggctgtgtcggctccaagcaattccatggcgccaacctgcacaaatctgcccgccccccgtcctccacctccaatcattccgattcactcaggcacctcgccacctacgattcaaccaagggccaggaggaggaggagccagaggaggccgctgattccacagcggcaacaccattggcattacctgatcaagtactaatagtgactgataaggaggaggcacctggtgttgatgccaatgccgcgcctgagccaaaaccaaaactcagcctcgtggcccatgttcctaatggggtggattgggagcatgttgccgctggctggccccgttggctcacacaggtggccaccgaggctgtccgaggctggctgccacggaaatctgactcttttcacaagctgcacaaggttgtttctttctctacgctttctttgttttttttcctttcttgctctctgttattctttcttccttcctttacacttttggtgctagcttttcttctactagtagtttgatagtttttcaagactctaatctttttagttgataccaacatgtcgtaccggaccaccggcaaaatctttctattctttattataagtgtttactctgtgcaatagagatatcgaattgccatgctaggaggtactcctaattgataattgctgtacaaactacataattgcattgatatgactgttcaattccatattatctatctatgtgcttcctttctaaactatggattatatgctgctacacttcccttttatttattcagataggtgaaggtacctacagtagcgtgtataaagcccacgatctagagaacggcaaagttgttgcgcttaagaaagtgcggtttgccaatatggaccctgagagtgtccggttcatggcacgggaaattcatgtcttgaggagacttgatcatccgcatgttgtgaagcttgaaggattagtgacttcacacatgtctagtagcttgtatcttgtattcgaatacatggagcatgatcttgccggacttgcagctacacctggtataaaattcacagagcctcaggtttttttctctagacttgttcttgtgagcatgctgttccatctccatagtcctcatgttatccacttaagctgtttctttcaggtaaagtgttacatgcaacaattactttctggactggaccactgccatagccatggggtattacatcgggatataaagggtgcaaatcttcttcttgacaacaatggcaccctcaaaatagcagattttggtctggctacgttttttaacccaaatcaaaagcagcatttgacaagtcgtgtggtaacactgtggtaccgtcctcctgagctattgcttggtgctaccaattatggtgctgccgttgatctttggagtgccggttgtatccttgcagagttgttgtctggaaggcctatcatgcctggacgaaccgaggtattgcttggccctgaataaatgcccatatcatatacgcagtctttatattgtctattgataatatttgaccaatttaaacctaaataaaagctgaacaccaactatttaatctgaagaatgcccttttgtgacaactttggttgggtcataaagtttggagatggctgactgcaaatttagctttgttcagatacttgagctaggaaaccttcaatttcgagaaatgtagaacatgacgcatacagtaagcgtttgcagagaattgcatctagttgagtggaggctgttaccgcttttgtcttatgttagtaaattcctatgtctgcatgctatttttatttttgagatacttggataattaactggtgaatgctagatcattctgcttggtctttcactaagaatcatgggtccattttttattcttcaaatcttgtttcatttgaattgatggcaggttttgtgtagttcataacttgcagtatgttattaatcaacatatagatattttgatctttatagcacagtggccacgatcatatgctcaaccttatccctgcatattcttcttttttgttacaggacccttcataatattcttaccactagcagaagctatttttgagtacttttgctttccaacacctttcaggttgaacaattgcacaagatatttaaactttgtggttcaccatcagaggaattttgggctagtttgaaactttcacgagctacggtctttaaaccacaacatctgtatcatagatgtgttaacaatgtatacaagggcttctcgtcttcagctttggagcttttggatcagttgcttgctgtagatcctgcaagtagaggaactgctgcttctgccctcgaaagtgaagtaagttttacattgttattcttcattgctgctatctgccacttattggttaggattgccagctggctgctctcctttcacatagtttggtttgcttcctctctgtgccactggaaatacaaagttgggattcttttttcatatatttccctattttctgtgggtttttcttcttttttcatatatttccctattttctgtgggtttttctctgtatgtctgtgtgcggatgtccatgttgtgtggacttacattgctagctttgtcttagggacaaccttttgttttctctaggtcaaatacaagaaaatgtttattgaaggactagcagtacctgttttgctaccttatatagcttgcaatagaagctgaggctatccctttataaaacaaagtaaaaaagaaaaagagaaataaataaagaaaaggatctaacagtacctttcaggaacaacttgtgaggacgtcccaaagcctaggtggtgcaacgctccaaggcatgtcagcgcgaaatatctggatggatggggt

SEQ ID NO: 62783 - DNA, 679 bp, Oryza sativa
tgattttagccaactcgccagcaagtaagatctctttaaattcaggcacagcgcttttcagtcgctgtttaatcgcctcacctgcaaataaatagttcatcgtgcaaacacctttttactgcttttgataaatacaacctgattatcagtagtggcgtcatcacttttatcataaagccctagcgataatttacccgctgcaacatcagataattgtttaatccgatgtttatagcgtagataaacggtactatcctcatccacgctgttatataaataatagtgggcaatatcgcaggcgatgcgattaagagacttaagcacacttttaacgggtagtgcgtagcggtcagataaatacatatctatttccgcttgtgcatcatccagagctttttcagcctcttggtctgttgcaatcaagcgataaatttcatcctgcccaaatgacaaaattaagtcatctaacgtgcaatatttcatgattagctcttaactactggtacaagctctagataagggtcgttagcaagcgtaataatttgctcacctgttagcgcatcatgagcaatgttaattgcctcaagcttgttaaaacgataaccacaacgcccatagctctcctgtggatgtatcgcttttaagcggatggtatatgcacaggattaatctctcccaa

SEQ ID NO: 62784 - DNA, 23512 bp, Oryza sativa
gactagttgcccaggaatgcaacatagtcttacataaatcatctcaagcatgatatccaaataataagtggttctaagcaataagcataaataatcttaataaggttctaagtagtacttggcgacaagccataaatattggttcatgcggtaagcgtgctacccaaaagcccataggcaaaccgactagggtaaatccctagttagaaccatcctggaaatctgcaacatcacaagctgcatcaaactcctcatccaaacagtcattacctgcagcggggtctaagcataaacaagtaaaagaaagcaagaaatcagtacattaatcaaattaatgtactggcaagtcggaaacaatcctagcatactacatgttggccatattcaaggataagctgtgtataggttaatttgcataaaagccaattttagttcataacatgtttcgcaacggaattttataacaatagtatagagtaagtaaaacttgtaatgtgaatgaataaataacacacatctacccctcaaggtagatcatcaccactctccatcatctcatcaccattcaccgaactttacccaagttcacaaacaaaacattccaaccattttccaggttcacaagagtttatcaaaatcacaaattatactcatgacacttcaccatgccgctcatgaccgtgagcacggctaatcgattagttttagactctgcagagtttgtacaacttttaagcccacatgatatggatcgctctagtttttttcgatacccgtcggtatcaccacactctacacattgagtgtgatctagaggtcataacggaaccgttacattgtttattgtctagccttgcaccagcacgatgtgtgttttacccacgctactagcaaggtagcgccactaggtagcgggcccacgctttaacctagcgccgtaaggaacccagcccggaatccctcacgaggcacgacaccgttgtattggatagactacccgctaaaatcatcacataccacatatcattaatcaatttcatcatatcacaaaccataggaagttccgataaattaccaaaacccggtaacccatacccttcggcctaccaagatgcaaggctaaactctaaacaacttaataggttgaggccaacccatacttagcacatgtggtttgtactgttttcattagttggtgacatagagtggggtccttaatcgacccgggcgaacgctccccctatcggtgtacaactacaccatatgtacaccactcgccgcccaagtctaaaaacaagttatctccattttcagttcacgatactcacacatttaaatttctatccagcaacatcaaaataaccattttcacatataacatttagcaaaacgagtaatttgcaaggcggtaaccgaatataagcatatagcggcaatataagcatagtataatcccaaagaacacaataattgtattcaaaagcactctatggttacaaccagcaaggattcaatatttcaaggtggattatgcagcaattaggtcatatctaccattcccacatttatatatatatatttttaccaaaagtaatactagctaacgtatgcatgtttgcaatagaatcatttaccccaataaaacttaagatcaatgtgatcaaaggaggggcaaacttgccttcatctgcaaactcctgaacctggtcatcaacaaactcaccctcttcttcttcgacgtactcttcctctatacaaaatacgcatatacgataaatacaaaaatgcataaaaaccaaaatgcatgaaaatgcatgaaacttatgcagtgagtgtgtgctggtcttaggtggtctctggtgaaggaatttttattttgtcactttttatttacagagatatgcattttacaattaaaaaggtttaaaaagggctaagttttattaagcaacatttttgtacagaagtgaaggaattacttttacaaagttacagagcatgatttataaagttaacagaagtggtttcacaatttttatagctatattcaatttgttatggatttaacaagttctaggcaacattatggcaaaacaaaaataaaggaaaagtttgtacagaaagtacccagttttatatttttttaaaatagctcacagctttatggatctaataaaactggtttcacaatttttgaagttaaaatgaattttctacaaattttagaagttctgctcattctctgttttaaaccaaaatagaaatcaattttcgaaattgaattccagccgggtccacaggtcagtgaaaggagatttgcagagaggccctcggaagttgggggaatcaacccgcacttcttctgccacttggacagcaaactttattaagagtccctattcttttgtttatttccatcaaggttctgctatagtaatatgagtcatggcagttttcagattggaccctagtgtcgatcaaattcaagaaatgaagtccccagctagctcacatcgggagcagccatggctgagctcggtctacggctcaccggcggcgatcggtggatcgaatcggttcgagcacaaaagagaaaatgtagaggacgttcttgcgcatccgtgagtggtggtggtgagggaaatggtggtctgtagcccatggaacatgagctacaatggcggtgtgtctcggtatgcccatgcatgtgcatgcagaggcttggttagtgcaaagggttagtgcatgtgctctcatatggtaccagggtgctcaccaagcagagaaacggaggcagcgaggtccagggagcggcggaggtggtggttgttggccaacgacggcaaaactccggcgtcaacgtcgccgggtcgactcaaggcgcgaactgcaacttcgagagtacgggagtgttagagatgagccacagagggtgcatgcacgaggaatccggcggaaactcaccggagcttggtgttgcttcggtggtgaggaacggcggccggagcggcgtcggcagttcgggtggccggcggcgaggacggtgacgcccaccacgtgctcgacagattggtcctagggcaaaaggggtacgggtgagctcggtgtaatgcgtaggtcacgttccataggagggaagagagagggactcaccggggatgcacggcgacaacggctaagtcgccggagccgggtaagacggccgagctctgggcattctgtgcgtggggtgtgttttcttgtacttggaacgcgatgtggggagtgtgttgttgcttctggtgctttggcttgggatataaggaagagtggagtgggggagtgagagagagaggtggctggtgctttcattgtgttccttgggcatccattgggcatgggggacggtggatgctgtgaggggagagtgggaggctgtcatgtgggtcccagagggtgtggggcccactgtcagtgaaagaaattcgaaaatagccttggaggctaagtcaaagagggttgcctgccaaggatctttggaggggattcaaggtggattttgtgcagcaagaaatctgggctagatatcctcttggtcaggggtgatgtggagagtaaatgtgctgaagtggattgggttagaagtctctggtttaggtttgatggagtgatgaacatgtattgacagtgttggttagcagcagttgacagtgcagttagcagctgattggatttttggagggagagaagaaagggttagagagtgatccagggtgtgccactcctcagggtgttagaagaaagttagtagaagactttggctgaaaccaaacttcaaaaagaggttttgaaataaattttacagagagagcaagtttgaatctgctaagcagttcttttcaggattttggagagattaaaggagatcaacaagttagcaaaccttactgaaaaactctgaaaatttgtgggttgatttctgacatatcaaggttttttttttgagaatttttgtggaagttttggatgcatataattaccagattaattgtttttgtgactctaggcctatcaagatgcatatgatgagatgattaagatccaaaaacaattaaaatcactccacaaccacatgatgcatttaaattaaatttagttctcaggtttacaggcttgggtatgttacacaactactaaaggtatattttgtctaaactagcaaaatggccatatgttacggaattaaaaataccacgttggaacattgcaaagaagacacatctattttgaatttcagagcttaattttagaattatttagagatttatcatatttttgtattttagctgtaaaaagtttcaagcggactcgattgacttgtacttctggccctatacaactatttggaggggatagatagtggtcccacatatcaaaatttggggagtttggtggtggcagtagattcaccactcaccaccaccattactctcttttaaaggagtatagattttgaagtcagcgcttgataggcctcttgtgttttagtttgtccagtaagctgaagccctactgccttgtggaagccctacaaagctaaattaccagcttggaggctgggagcaatgccaaacagatgttggtgatttgtatggtcactggccgttgcggccaacatttcctgcctggaaccacacatcagttcttgctctgatgcattcttttaaaaaaaatatatactaatcaaattatatggttcagctcacttatttgtcttcatgtcatcagtgcttcactacaaagccaagataccatatgcttgtaatccatcaattcaacgaacatatacataaattttcttccaaatcatgtcttctgatttgacagatcatttatttttactcatatcatcagttcttcactacaaagccacatgcctgtgatccatcaagtctaccaaaatatcccccgagcaaggaatatgatgctaagctgcgagatgaggaaatcaggaggtaatctgcgctgcaagattttcattaacagggatttgtttttctagcatctgtaaagatgattgtacgatgctcattttcctgcatcaactttcatgattaaatctaagacttgctgacaggaaaaggatgattgcattgaaaggacaaaataatgaaactagacgaaggaaacaacctcagtctggaaatggagatttacaggtaccatgatatttcattacatgtacatctggatgttttatccaaagctgatgataaacctagcgaagtatatgtaagatctataatcctgactcctaagcataacttttaaagctggaccggcgatcaaactggtgagtctgtctgccggtttgaccactggttcaaaataaataataaattttgtgttttgtatgccttgcttcactcaaaaggcttaactaaatatatcttgctttcaaagtcacccaacaggccttagctgcagtgcctgcatagggggaggtggtgggtttgactccccacctgtccttttcccagcgaaagtccttacctggtccaaccacctatggttttctctggttctttgtgaaaccttcctgtctaaccggacttttgtggttcacatgcatgtccggtctttaagttaaaccagactggctctggtagtccggcttttggtttttctggttggtccggttatgataactaggctcctaaagcactatacttctgatactattgaacccacgacctatgtttgcatttgcaagatactgttttatgtatccttgtgaagaaacacagaaacacagtattctaggatgccatgtacctcatttgcctgggcttgtttgggcaccataaacgtgaggatgattgctttctcattcaagagtgcaacttctgtagaaattgatgtagcaactagcaggtgtatttttcagttttattatgtaacttctcatccacataagttattgcatatgccatatccactatttgaacggctgagtctgagtttgatgatatgtaaacccctcatttatgtgcataactacatctagcccaagttggtgatttagctccatgaacatagaacaaggagctagtgtgccatagtttttttgacatacgtttgccccaaccaaagcaagaatcagcaaagcaaaacaatcttgctaaaatggcatctaaaaaataaaaattatgttagatgtatagtgcctaactggtgttgcaacaatctattttgcacgttctctgttgtaggttgttagtctcaagtttttgcttctgttgtgcagcaacgacgggcacaggcaaatagaaaaggcactcggatggatgacggcattcgtggctttagaattgatcctccagcaagagtcggcgaaaatggcattgctcagcgtgttcctctgttgcatgctggccgttcatcgtctactctgggccgatcgaatgagactgatgaaaagacccaaagattttacacatctcagatgccgaacttgtcttgtgctgctgagccacgaggcggtgctactcggtcatctaaccatggggatggtgccaagaggccacatttgagagagcatccatctaggtcaaggtacaggcaattaactgctgttgattcctccggtagatctgaatggacacaccagtttcaagaaagaccgtcatcttcccatcggaaggaaggtggggcggctaacaaggagcatactgtggtgagtcagctatatactatataaactttctttttcatttgtgcgaaaaaaggacaggagaaaattaagaccgcatttcaccattcattgggtaattacccgcctctatacattaataaaaactagcgtggggcccgcgcagattgtgcggctagcatcattatattttctctcatataatagaatatatgttttctcattatattattcaaatatattaaaatgacaacataattttaaattttgcaataactttacaaaactactaatgtgtaatattcatattgtattttatatacgtgttagttattaattattttcaatatcaaattttagttatttgtaaattatatgtattcctatatggactctagactcgtcttttaatatttttttaaaaaaaattctgaattttctgtaaattgtatttttatatagactctatgctttttttccaatattatttatttttatttctgaatttttattatttctaattgtatttctatgtggactctaaacttatctttcaatattatttaatttttaatttcgaattttagttacttctaaattgtattcctgtattgactttaaattctacttcccatgtttttcttaatttcgaattttagttatttgtaaattgtctttttacttcccatgtttttcttaatttcgaattttagttatttgtaaattgtctttttatacggactctaaactctaattttaattttattatgtttattccaaattttagttagttttaaattcctatatggactctatactctacttataatattccttatttttttaattccgaatttcattttttttcttaaatgtatttctatatggactctatactctacttctaatatttcttatttttaattccgaatttcagttatttcctaattgtatttctatatggactctatactctacttctaatattccttatttttaattccgaatttcagttatttcctaattgtatttctatatggagtctatactctacttttagtcttttaatattccttatttttaattccgaatttcagttatttcctaattgtatttctatatagactctatactctacttttagtcttttaatattccttatttttaattccgaatttcagttatttcgtaattgtatttctatatggactctagtctcctcttctaatatttcttattttttaattccgaatttcaactatttctaaattatattttcatatggactctagtctcatattctaatattccttattttttaattccgaatttcagctatttctaaattgtatttctgtatgaattttgctttttctttttctccgattaatatgagaatttctaggtcatgagagcgaacgtggaggcatgtatggcgtatcatcaggtgaatggcagtaagaagaacaggatccactactctgggccgttgatgcctcacggaggtaacatggaggagattctcaaagaacacgagcgtcaaatccagcaggcggtacgaagggcgcgcatggacaaccaggcaagaggcacgcaggcgttacggacggatcgctgattgatctagttatgcaagggagctgagctgcctctggtccatccctgaattcctgatgatggacagagatttttggttggctactatatatatattgttggcatgcattgaattgttcattttttgtgttgcccgtccgtcttcacttgttacttgggcaacaccaaccaacaaaagagcggaagaagagatcgacagcgttgctggctgtacagatagatgatgtaattgtaaccacacgcacgaaacagatatatatgtagagatataactggaatggaaaggaaaggaatgatatatacactctgtcggatggaagttgttttttttgttctgttttgatacactgcactgtatgtctgtatgtagatgagagacatgaaagagtatatgaaaaattgttacaggcgaggcgatcgttgcaaggtgtacaattaagtcagttccactcaaactgcacgagttactgcaaattaaaaggcaacaagttaaggtcatgtacaattgttctttcttagcgttgctaattatgaatatttgttgacatggaaaagagaaatatgagagataaaatgttattgctacggtaacaatggcctaacaacgactcttaaactctatatggaaacatggttacatgagggtgaaaaatagaaaaaaaagttaataaaataaatattcttttagttaatggttagagcttttatcgtctcaactgttgtgataatgacatagtttttaaataatcttatattggctaagtacaactgttgtaaagatatactacctgtgtccaaattcatagctaaaaatgcttatattttgggacgggggaagtggtttttaaataatcttatactcttttaagtatgtcctttattgtcgatccgtgtctagttttaatcatctatcttatttaaatttttttaaaaaaaattaaataaaacataaatcacacataaagtactattaatgttttatcatcgaataacaataaaaatactaatcataaaaaattttaaataatacgtacgatcaaaattggataaaaaaactcatagctacgtttaaaatggaacgagagaagtatttgtttctatcattgaacctgttctaagggagagaagtattgtttctatcattgaacctgctctaagggtgtgtttggttgccctcacatagggtggctcgcatccagcgagatgtggtgcatgcgtttgccgtttggttgcctgtttgcacgcgcgaaccaggctgtgctgatgcaaaatctgcttcccagccaggctgagggggaacgcccgattccttcgtagctccttgtccaggctcaactcgtgcaacgcgtggggacgagcggatgcaggcgcgcccgagcgggtgcaggcaacgcgtaggggtcggtcgatccgctcaccccccatctctcatttgtttctattgcccatccgattgctcctcgccgctcttcgccctcgtctccatcgtcgtcgccgcccaccatcgaggtcctcaaccctcaccgacttctccacagcctccatctccgtctctacttcacgggctggaaccggcggcctcgagcacgtcgccactcgccattggatccaacggagggaggctcgacggaggacgctgccaccatatccaacaaagagaggcagagagaggcgtgaaggagctcgatggaggtttcgtcgactgcccctctctgcgccaccgcctccaacctcgccagccgccggattcctcctcgctggtcacagattccccatcgtggctgcttctcttcccttcatttactagtaatgtgcccgtgctaacgctacggtgatattagtaatgacgatacaggtataacatgacatatgtgtgggtgcacatgacaatcaaattctcacaaattggcatagaaggttctccactataagttattttatgagacaaccacaaatgataaaaaaatactgaacgtacataaaaatgatatgatgataatgaggtttattttaatcaccgatatcttcttatatagtcttaataatctactgaaatgctcacatttgctgaaaaaagggaattactaatgaaaaataaattaaaaatatattaaagagcttttacaaacacatggtcggtgggttgtaaatattccatccagatcaagcattttaagtgaaatatggtttgtgattttaaaaaaaatgtaacatgcatctatactgcacaacagactaaaatcatagtatacattaagtgttatctccaaacaagatggttagcggtctcagtggcagagtaagatgcagagcaaggttatagctccttcaaaaagactatctatacaaaaaagaatcacaaatttcagatatgcatattcatattgtccactaaattttgcttacaactatgattcttccgtcaccatcgcattggagcagaaaagaaagtgcagcatatgcctaaaaccttgttgtactacttcatcaaaagttattgttggtgacttcgataattcagagttcccatcttctccccttcttgtattgcattgcataatctcgcatagaccatagtagatatgttccgtcttcttccattcttgtgccaaactcctaaattttcaacaaaccttgctgtaacactttgctctagaagtccttctaaagactcatcttttttgtcactgggaacccacaacagctctttgattggcacactttactattatcactttctacctgcatacttacaacacccaactaattaccacttaccagaacagctggtaatagcagtgtactgttagtttattaaccaattatttttctgcaaatggtagcacagtgcttaaaatactgaaaatttagcatattgtgtatataggattaattagaagcacattagatttaatagacaatactggaacctgtagcaaaaaggagttaatttgacaaacccttttctttttatgtgcataaaagatatctgtgaaagacaatttgttctggtttgtcctcttactttatatcagattattactaatttgtctctgcaataatgtagtagccagattttagagatatacaggcagggtgctgaaatggcacaaatctctaaatagagcaatcaaattgtatacacctgataaatttgtcctcaatattatttacgtaaattttattcagtttcagggacatgttcaagttcagagaatcattaagagcttgttttcagccgtaaattcagatttcagacacatccaaaatgatctgattttattcttttacttaaaaattcactttggaagcatattttgtgctataaaaatcaattaaaaggttgaaggacaacgagcgaggacagctagcaaacctcagctcaattgaccctacttcaggcatcaacggccaagcaattactccctccgtcccacaatataagggatttttagtgtttgcttgcaacgtttgaccactcgtcttattcaaattttttttgcaaatataaaaaacgaaaagttgtgcttaaagtactatagataataaagtaagtcacaaataaaataattaataatttcaaaaaaaatttgaataagacaagtggtcaaacgttgcaagcaaaaactcaaaatcccttatattatgggacggagggagtaactctgtacatgaacctgcttgttctgatgaggagtaggctccatgaaagctgaacttgatgcccacctatctgagacctatccagcacatggatggtatcttgatcttcaccagatgacctgaaaatacaataatacaaccaaagcaacaaaagatcaggacaaatatgtattaggtaaagatggttagcaaagaaaccatgaaggatttattaaccagctgttcaagcacaacttcatacaaaattgtaatataaaaagcatgaacttcctaaataatcttctttgtaccaagcagtcctgaaagttccaaattgactggtctctatctaagagatggaagggcagagcttttttatggttttcatcttttcataagatcagctaaaaaagctcagtgttgcatagatatataaagataacctaaagagatacaaataattcttggtcatgagggcacgagtctaccatcataggcagtagtccatagagatgatcatttagataaataattcattggaataaataaaaatacaaaatcataaatcaagcctgctctccagggacaaataatctggtaaatttataagacgtaaagaagcatgtgcattgcacaaacttattgtgccatgcaaaccatatacttcctccgtcccaaaatgtagctacctagtacaggatgtgacattatccagtactacgaatctagacagcctcccaaaaataggaagtgcatttcataccaaccaagaaaatagttcgcctataataatgactcaactcatatattctatttatatacaaatcaaaaaaagaatttaaagaaaaagtatatatacaactcatatactctctaaatttctacatctcttctatgacaggacctgataggttaggggaaaaatgcaacatgctggataaataaatacatgctggattgaaaccatttaaaatcaagcaacttgttgatttttatcttattgcagcagctacattttacaactcgcgaatggaaaacctcaaaatcattagaaaaactatttttattgagaaaatgattacctaaataaccaacagaaatcaggaaatggacctaataaagtggatacccaggcagaatgtttccattcaaataaaaaaagaaatatcttgtacttatagagcataaaaaaacccaactattaccgagcaagcacctgaacagctccccttccatcagtcccagcacctccttttctcccctcctagcttctgtaaaaaacaattttgccaatcagaactgatgttagaacagcaaaagaaaaaaaactgagagaaggtcatggacccatccaaaaataataataatatatgattcgatgcttccaaatggttagccttggatcaatcataaggttgaaaccgtaatggtatggttgaaagcacaacaataggatcaaattattttaccgtaaccaaattgttgtgaggcatatccctacgaaatctggaagggaacgcaaattagctggtggactaacagaggtagatcaggctcgctaacatctaatagtttgctcttgtatcgtagtcaaaatcaaataggcacaagaaaaataatgaactgggatggagaagaatcaaacttgccgtagagctctagacaccggacgtctgggcccgaagaggaccgagcgcgctacagagacttgcgggaatagtggtcaggcggcgcggcggcgatttgatgaagtcccgatggagagcggtcggcgagacggcgctagggcgagttggcgcgatgggcagaggggccagatggggtggcgatgaatgcgcgagggcgagcatcgggtcggcggcggtgccgatctgtgcgacggcgagggcgagcgtggactggcggctgctggggataggcggcgacctggcggaggtgaatcggcgacggcgcgatggcaggggagagatgagggcgtcctgtgtcggggcgatggagagcatggcgaaccggcgcccttgatgatggaggattgaaggcctcggtggcggcggcggcgcacttgacgacggagcgggaggggagagagaggcgcggatgcggtacgggagggaggtgcgggggagtcggagagagatgcgtgcatgcgggagagggcacggatgcggagggatctggagacgtctgctcgatcctgacgcggaggggagggatgcggggagatgcgggagaggatgcgcggtcgagccgatgcggcgtcgattgcggcagagagagacagggggtgcgggagaggaggaggagcgacacgcgcgcatctgggacgtccgatctaactcatcagatgattttacaccgttggatgtgtgatatgatgttcaattatagagtagatcagccaaaataccaatggatccggcggccacgagctggacgtcgccagatccggcagcctcgggctcatggccaccggatcttgttgctctgatagctgcgaacagcagcgcgcacacgacggcgaacggcaggtcaaggcttcggcggagcggcaggcctagcgacatcaacgaagctccgctcctctcctctccgtttttttttctgtttttttttctttttcaccgactggcaaaccgtgaccatgaaatgtgggaataatgatgtttactgtatgcattgctaattatttcacttattttatattgccgtacagatgtgctggtgtatatatcctgctcatttgacgattcttaaaataatcgttgccacgaacttcaatatcaataattaatatagaagataaaatcaaatgtttagtacttagaaatttaggcccccatcgtttggcttttttcctgataagccaaaacggcttattagagaataaaaatgaatttgtaggtaaaacttttatatatgtgtgacttaaaagtcaatactgtaaaagaaactacgttgaaagcttaaaatttggctttttctttggctgtttaggccattcgatgggagccttacactcttcttgagttaaattttagctcaccgcagtccccaagttctatgtgataatctcaccctttaaaaaaagagatacctatccctatcgtccatgcaaccaaccaaacaaattctcttccaaaccgtaaaccaaccaaacaaattatctttcaaaccgtatctcttgtatgagtaattaaaaagagatatatggctagcctaatgcaaacaaccaaacaactgcatgtgtatcctctcaaccaggtcaagctcagcctggatgagagagatgggcaagactaaggggatacgagcaaccaaatgcaccctaggagtaaaaggagcggagttgaataagcggatctcctggactagctaggagtaactgttatcgatcgatttttagctaggaaactaactaaaacatatgcatgggtgatggatatatatggctggtgttggtcgttgcatccgctcttgtcgtacgaccatcgatctaaccggggggggggggggggggctggccatcgatcgctggagagcacagcggagggagatcgaacaagagacgaatagccagcaaaataattaaagaggtagctggagagaaggagagagagagagagagagatcgacgagctagctagatggcttctttcggcgtggcccccgttggaaacgcggcgagcggcaagaagatcttccggaccaagtgcgcgcagtgccacacggtggagcgcgggggcgcgcacaagcagggtcccaaccttcatggcctcttcggccgccagtccggcaccacccccggctacgcctactccaccgccaacaagaacatggccgtcgtctgggaggaaggcaccctctacgactacctgctcaaccctaagaaggtcaattatattaattatttctcttttatttactctagctaatttaattaattgttgttgtatatgtataattcctcaatcatcaacaccaagatcgagtacgtacgcaatttgctaataattaataacggctgaggctggctttgcagtacattccgggcaccaagatggtgttccccggcctgaagaagccgcaggagcgcaccgacctcatcgcctacctcaaggaatctaccgcctaacccatccatccatctatccatcatctgcttgctgcaaaatatatatatatatatcgtatcattatgtttgtgtacccctatgttatactccttccgtattttaatgtatgacaccgttgatttttcgaccaacgtttgaccattcgttttattcaatttttttttgcaaatatgaaaatatttatgtcatgcttaaagaacatttgatgacgaatcaagttataataaaataaatgataattacataaattttttgaataagacgaatggtcaaacgttggataaaaagtcaacggcgtgatatattaaaatatggagggagtagtatatagcatctatctcaataagcatgcatgcatgcatctgtttaattatcgttccaaccatgcgtgcgtgcgtatttgaaattaagaagcatcgtatttatcctcttctactgtaaaagcatgcatggatatcatatcgagatcaagttaattaatagtagcaatgcaaagcatgcaggatcagaaatgtgagaacgaaacatttgatgtttccgagcatatatgtacatttaaatgtgttcttcttcttgttcgtctttggcactatgtgtagtcgttctgtcacctaatgctcttgccatgctgcttcaagcttacgctccacaagtttgggatgagtgttccagagaagatgagattgccaaacgtcgtccttttcatcttctccgaagcccgaaggagatttcacccgatatatctttggaatacaaaagatgtcggtgctatcactgaaaatttgatacccgttctaaattatgctttaataagtaagacattttagtcttaatttaatcactattttttataaactcatagtttaacaacacaaaatttatatttttaaattcacggtgagaaaaactttcataatatacagttcacatgttgttacgtatttttaaagtcctatttgtttagctttacaagccagcttatgagccaaaaagtctaactctgaatgactttcgtacatatatttactaaaactagtgtgtcgacgggggatatccgtagaccggatatagagggtattggggtacgctggtacgagaatctacgtaatacgacatcaagcagacagaaaacagagattatactggtttaggccccttgataggtaatagccataatctagttgatatgggattatatgatggaaaatcacagattacaaagggagtagtggaactcgatggtactggcgagatcgtaatcgagctggtttgactagatctcccggtgacttggctcttgtaggctccgacttcgtagactgcggtggatgtgttggctatcagattcgatcccttaggtcctcccagggggtcccttttatatcgcaggtcaagcggttttcaagtaggactcagaaacatcggaccctgcacgatacattgacgacccaatcatgttcgagtaggactccttccatctgtgaaatccgtgatggattttcttaacgtatgcagagaacgtccatatacgcgtaggcatgccatatcgatatgtgacgcatatcgaagggtagagggtatactttacccgtaaccctgacatagtggaaatggttagtaatagactctatcactaagttttaatacaatattttatattccttatgcaggagttaacggttaaagtttgcacttaacaaccatcaacacacatctaccacttgtcctcgagctcgatccctatggctcgcttagggtagaagcaatgcattgacccaattaagccttacattcaatgcagggtgacatataccagcccagcatgctttcgggactacggacgataagacaacacatgccaacactaggacaggccatcgtcacccctcaaagggcacatgacgtggattgatcaggcgatgcggttgattaccatgctgcgctccgacccatagccatattgcactttcttccgatagctggcacgcggcctgatgactgggcccacttgccaagaagcaacaagactaaacacacctaacccttgtactggagcccatttgtaagagcggtcactgtgatatatcaccttgcaactataaaaggaggaccaaggccgaaaaagagtgggatgggccctcgccctagggggttcaacgagtccaaatagcttagctttcactacaacaagttaacttccagcctcgactccactcatggtaactcatttcgagcatccatagtccacacacaggagtagggtgttacaaactcgtgtggcctaaacttgtataatctcctgtgttcatctctcgcgcgattagcatatggacttgactcaccccctggatgaatctccaacgggagtactagcttcccccgctagaggagtttcacactccgacaccctcattgtcctgttgctcgctcaacggctcactaggggtaggaacggtggcggtggcatctcgctcggtgccacgctaatgcggcaatgcccacgttctgtatcacttgctgtcatgctacatcttgcgagcgatgacggtcctggctccggcaacctacttacaccgtcatcaccagcttcatgccgtactctgtggtgctcactaccgacttgatcatcttctcagtataggtcacgctggataccacgttcttaggtgccacgctttgcaccggaatttgcgccatcgggcatcacatccatgaccgcatcgatatccctccacagctccactcctcgctaccggtggttgcgtcgaagacgctcattgactcgaaggcgtgcatggcggtcgtcgtgctgatgtcccttggtgcatcgccatcctccacctcagcatggtatgtatgttggaattttcgctaagttgtacattgcaacaaaaccagaaaggctcaaatcttcacccttcggagcatacactgaaggcataataaggatgacgatgtggagagatcaatagagaatgagggaagggaagagagaggatagagggggaagagatggagtagatacattttttaaattttttttaatttccatgtgatcttgtgggtctttatttttttaaaagaaaattgttttatttttttcgctgattgtacatcatagttagaagagatgctgaagaatagcgtactgcggggtctggtgtacttgggccgaaaccggcccagaagcgaagaggcagaagaggcgcgtgagaggcggagaaggagaggagactagagagatctgagctctggtcagccgagccaagcctgccggtcgccggaggaggcaacgacgaccatgatggcgccgtccttgtccaccgccgtctcctctcttctcctcctcctcctcctagccgctgctatctccgtctcctcctcaccgccgatgccggaggacagcatccgggtcatctccgccgagaaaagggttcgtcagtccgatctctctcgtgtgatgtctaattttcatccacccgctgcacttgcaccttgattgtttgaggaccacaacttcaaaactatagcggctgaaagctcctctgtgactattaatccaaatcactccccttctttaatttatcgaccggtgtgtatgcatgcgtggatctataatttatttgtaatttgttgcactgtattaggatttggctcttgtttaattttcttttagcatggtctagttagtccttgcctgattcaccttgttcgccaggcactccgcacctttatcaaatgggaatatatacactgttatatacctatgctgctttgtactaccacttcattttttttccttttgattggtgaagcacagcaatacacttactcaaatgcaaactcctgcagatcgacctcaccagccccatagtcaaagttttcctcacactaaaggtaaattctgatatcgattcaaccaattgccatgtcagcaaggtctgcatttctagtcacacttgaacctcttccagctcgagaatgatgccactgcccctgaagcatctcaagttctactcgcattcacacccacagaggttgaacatcttgcgattgtcaaggcgaccagagcggaggggaagcgcaagaagaagatatatgtgcctctctctgtgaaagcctctgatcttgctgccgctccaaatggtgctcgcctgtactccattttgctgagcactccattgaaacctgctgaggtgacgacgctggaagtattttatgctttgacacactctttggagcccttcccagcagagatcacccagtcagatccccagctggtttactaccgtgacagtgctgtgcttctatctccgtaccatgttctggagcaggttacctacatcaaaatgccgagcaatagggtggagtcctttacaagggtggaccccaccagtcgagctggtaatgaagtgaaatacggcgcatacaacaaccagcttccaaactcgtatgtgcccatacttgtgcattatgaaaataatcgtccgtttgctgttgttgaggaatttgtgcgcaaggtggagatttctcattgggggaatgtccaaatcactgagcagtataagctgaaacatggtggtgctcagcacaaaggagtcttttcaaggttagctgtgagcctgcaagaatcttacaccttgattttcatcatatctagtattctgctcttggaatccagctgcttgaactatcttattctagcactatcaatgtctggtgcaaatcaaatttcaaaaaatgcgccagcaaacccatgattcatgacttaaaccctgaatcctttattgacatcgactatctgtcaaccttcttccaacaatataggtcctctagcatcggattcaaaattttttaaaaaatatagctgaatatttctttacttctgttctggttatgtcacacatgccatgacgaattcaaacaggtgcatgcatctatttatatgctaacaacatgccttacagatatcagatatgcaattgagtaaccttttgtttgaagatgtatgatatattaacaaatcagtccttccgtgtattgttttggctaatttagttcattgctttatggttactcatttgaaacctttcttgctaggcttgagtatcaatccaggccttctataagtggagtgtcatcatttaagaatcttcttgcaaggttgcctcctcgagttcattcagtatactatcgtgatgagatcggcaacatatcttcatcccatttgcgtagtgattcgcacaaggtacaagatacttcttcatgtggtgtaatgaatcatatgctaatgagtggaatataagatatcattttatcttaatgtaaaaaaaactgagactaatattttgatgtgattgtttttctttaatgcagtcagaacttgaaattgagcccagatatccattatttggtggttggcactgcacgttcaccattggctatggtttgccattgcaagattttctctttgaatcagatgatggtcgacgctacataaatcttacttttggatgccctctgttggatacggtggtagatgatcttaccatcaaagtaagaatacaatgttttaaattttctgatgagacatatttctcatttgattctaattgtagcttcattaaagaaaagcaatattaagtcatgtagcagatggtcatgtccacgaatgttgctagattcatacagaatatgctcatgagtgatcttcaacctaaattcaaccaatcattttatttttggccatacttgattagttatgttcatttgtatgtctcctatttcatctcttgtacaacaaagcaaaaatagattcttgaggaacagactggattgatgtttgtttggaaggaaagattataggatttctcggcatgtttacagtcctacagcatcatacctaaaccttttaatgttacaggtcgtgcttcctgagggatcgacaagtccacaagctgtagttcctttcctgatggaacaatatcttgaggtaatcccatatttttctgtattggcattcttttgttcatatatctgtgttctatgttttaatgctaagcggcaagtgtacaactacaaatttcataatggttattatcaatagatgattcagtctaagaacattggcaagattgcattgttaattcagtggaatcatctatcatctgctaaggcctatgcatgttagactacataatgccagcattatcaccagtggcgaagccaccgtgggggctggggagggcctggtgatcagcccgtataatctggccatcagttactagtgagattaactaactgatgttatatgtggttgcaagcctcaaattaaaatgatgaaatgacgtgacgttgaatcatccatatactaaatatattactgaatttaaaatagatgctatttattgatctaatttaaaattggtgatcatccatatattagtagacacatacgtctaaaaccacatcaacaatcatgatttccataattataaaaggagcgactagacatatcatacgcaattgcgcatattaatataaacaagagccgattgaatatatctttctcttttagctgattgccatgatatgcatgatgctgatcacacatccacactctacagcattgtccatcgagccgcaagtgagctctctcatcttatagatgacaccccgaatccctaaatcctggcttcacccctgattatcacttgagccttctccattatttatcaatatggttgtttgactactagtaagtaattatgtccacagctttcatggtttggtttctgtcgtgatccgtggatagttctgtaggaatgagtaggtaacaggacaccagtaactgttacaaggaaatttcaccataagcatttagtttgctccttcatagatggattttcctatcgtttctagtttgatattatcttgcccttttcggatttcagttcccgaagattattgtttgataataatgtatgctaccaatgcagactagttattcataccttgatgttgttggaaggacgacagttgtactaaagaagagaaacgtagttggagagcacaatgttcctttccaggtactctctgacagataggccttgatacatttttgaatttgattggtaattgtctgaatgttgctgttgtgagactctatctgataagcatgacatctcggctcaactgcaggtgtattacgaattcaatccgatcttcatgctcgcagaaccgttgatgctgatatcagccgtgttcctgttctttgtagcctgcattgcttatcttcacatggatctttccattgggaaatcataggctccttgaaatatttagaggcgctctccgcacttgcccttctaattatcacagttgaatcaaggctgccttttgtgttagtttgtacggttcgcgtggggga

SEQ ID NO: 62785 - DNA, 2956 bp, Oryza sativa
acataagtgctcacttttgtggagagggagacttgaagaattgcgccagaatcattgtggcctttttttttgcagattaaagttggggcgcactggcaaagaaagaaactctggaagtgtgggaaatcgccatgtaaacatataatcaaatcgaaatcagacatgcgagatactcgaatctactccctccgtttcaagttataaaatattttgactttgatcagagtcaaattatttcaagtttgaccaatttgatagaaaaagtagtaatatttttgatccaatataaatttattataaaaatatatttaattattaatttaataaagcttatttggtaatgttaatattactatatttgtatataaacttagtcaaccttgaagcagtttgactttgacaaaagtcaaaacatcttgtaacttgaaacagagggagtaacatacaaataagaaaatctcgcaacatattacgaaatgaatcaaatcgaaatctgccatgctagatactcgtatctaacatacaaataaggaaatctcgcaacatattacgattatgtatatatataaaatgaatcaaatcgaaatctgacatgctagatactcaaataacatataagtaagataatctcgcaacatattacgagtatctaacatacaagtaaggaaatctcgcaacatattacgattatatatgaaaaaaaagagtgaattgcactttgggccggttattattgcctgtgttttattttggactaggttatatctaacgttttcactttggtctaggttttcttgccttatattgcacattggaccacttttttgtttgccactccttgatttcattagcgagcttacctgcaacacaataaaccaatcattattccacatgaccttgatttctttactcattgatttagctgcttgacttctaccattttttcccttaatttatcatgtgagcttggaacaagtcactgtattgagcttgcaagcgacagctacagcagccagctaccaccaggcttgattttgctggttcctcaagctcgggaacagagcagagagagaaggaaccctggtgctttgcttgatcatccctcagatccatggcgcggctgcttaatagagaaaaggagggaagattgatggagaagaagggtggtctaatttaaaacttctgtaaatttatctaatccaaagtgatgaagataacttcaccccttgtccaaagtgaaactttggtaaaaattcctagcccaaagtgcaattaactcaaaaaaaatgatgttgaaatctgacatgctagatactcaaatctaacatataaataaggaaatcttgcaaaatattacgattatatatgaaaaaaatgaatcaaatcgaaatctgacgtgctagatactcaaatctaacatattacgattaaatatgaaaaaaatgatatgaaaaagatgttgaaatctgacatgctagatactcaaatctaacatataaataaggaaatctcgcaacatattacgattatatatgaaaaaaaatgaatcaaatcgaaatctgatactcaaatctaacatataaataaggaaatctcgcaacatattacggttatatatgaaaaaaaatgaatcaaatcgaaatctgacgtgctagatactcaaatctaacatattacgattaaatatgaaaaaaatgtgttgagagtgggatttgaacccacgccctttcggactagaaccttaatctggcgccttagaccaactcggccatctcaaccgttggtaggattatcggtgaaattaaattttataacaaaaaatctcctcctttctgaaaaaaaaacttgcgctgcgttccccactcccgactccccacccagtccccactcaccagcccgtccgttgagtagtcgaagaatcccaaaccctctcctccttccatggcgatttgacccccaaaccctagcaatgccctagactaggactagtaggtagcggaaggaagctggaatcggaaggaaggaaggaaggtgggagggatgggttcgaaatcgaacacggagagggcgaggaaggcgctggaggccatgaagcagctgggtttctccaagaaggaggccacccctgtcctcaagaacctcctcaggctcttcggcaacaactgggagcccatcgaggacgagtgctaccgcgccctcgccgacgccatcctcgaccgccaccaggtgtccttgtcgccaaagccctcctctttttttttggtttacatttcgattcgacttacttagccgctggggttcttcaggagaccgcagctgaccgcggctgcagcgcgacaaggccaacgccggacgatgatcatcacccccttaccctctgtggtgcttcgcgcgacgtggatactgagaccgacgaacctcgcaccaagaagcctagggccaccaactcagatcctcaatcgcctccatcccttacggacgaccaagatgttcctgcagctatctcacccccatcccatggtgcttctcctcaattccgtccacagaccagggcctctgcacgactgcgccaagcttctccttcttctgttacagcagcacacaagaggccaagacagatgatggatgaagatttccaagactctgcattcctcagggaacccaagcctgagcccgatatcgatatggacgccatacaaggcactgctgctacatcagactgcccaaatgcccaccttggcctcattgactatccgctcaatgccagctcctcaagggttgcacttcctctggcattgcttccacctgatcaaaatgttccacagatttcaggttcgcctacaaaattttaattgattcatccatttgttgtcatgccgtggataatagggtaccataggtgttcatcacttccattattagattacggcattttgctgtttgctggattggcatt

SEQ ID NO: 62786 - DNA, 1559 bp, Oryza sativa
ttttctttaaatatttttgatggagtgaaatatcaggttgtagaaaaattatctgagattagctagaaattaatagcgaggtttctatcttagctattatttatccgtaaatattctacctatttcgataggtgggatattttacgcctaactttaatatactattcgcattaaattatatatcgttgaaaatttcatcattcaaactactaaaaatattttccttgataatcttcagcctttaccacacctgcatttcatcaaaagttaaaaattttcaaaaaacacttgacaaaagaaagtgcttgacaacccccccctctctttattttacatttttgcccacagagaatagtcccctcattaggatttttactttttaagccataaaaggtttaaaaatttaagagttttaatgaggggatttttattttctatggcacagcatttttcgctatctgcagaggcacgccacttgtctatacaagtggacgagctttctgatgtcgaaattttgtcgttgctgaaaaccgctcgttggggcaatgctgataatataaatgatattgaatgtccgcattgtcacgttagacacgaagcctacttcattaaaactcgccaacaatggcaatgtaagcattgttgctatcgcttttcaattactgcaggcacaatatttcaccttgctaaattatcactgcgaaagatattaaaagccttacgttattttgcacttaaaagcaaaggattatctgccattgagctttctcacgaagtatcaacgttttaaacgattcacattatttaatcgcagcataacaattgaggtaacacaatgaaactacgtaatatggaaaattcaccgattaataccgatttagccgtaatggattatgaagaatttaagtgctttatgaaagaattagccacaatgtattccgatatatcagataatggctacccattactttatgatactttacgaaaaatcagtaaggcgatagccacacgtccttttgaataccatattatttatggagcgtatgaaatcgccaataaacaagtggtagtcgctatttttgaaatgcaatttaatgaaacaaatctcggtcgtacttccgtcagttttgccgaagataaactgcatttaaattgtccgtccaaagtccgaaaacaacttacccaacaggactatatcacttccgcagagagcgcctatccttgcattatggaagaaatgctatttgataaaattcgagaaagacgagaaaaggaaagaagaagtgtaacccctttaaccaaagaggaattagaagcacttagttaatattggcacttaattcattttagtgcttgaaataaaaataaagtaaaatacctttacctgtataaatgggtaaaggtattttttatgcggttaaagttaaatttgggttttgtgcaactgctacataataccgccgcaattttttgcaaaaatgaccgctttctctgctattcgaaattattgtgccattttttcggtgatcgttaaaaaaccctcagcgctattaaaaata

SEQ ID NO: 62787 - DNA, 523 bp, Oryza sativa
aaatcatatcaataatgcgttctttttcaatacgagtaatatttgatgaatacattgtttcaggtacatcaatcggcaaacttaatccgtttaacactaattgatttgcttcgtcccaagcattatctgaaccatgaccataataaatatctgaagcattaaaatagctataactccaacgcatcatatcttggattgtttttagatcttctttcgttgatgaatcaaatatttcttccaacaattctaaattatgttcaaacatatataacctctttataagtgaaagttgtcctattctatacccatatgcctttttgtgctagaattcgagtaaataatcaggagaataaaaatgaaagtaagtgagcttattgacctagatcagcaacatatttggcacccttactcttcaatgactgatcctatccccgtttaccccgttgaatcagctaacggcgtgaaaattcgcttaaaagatggtcgtgatttaattgatggaatgtcttcatggtgggctgca

SEQ ID NO: 62788 - DNA, 758 bp, Oryza sativa
  unsure (1)..(758): unsure at all n locations
cgtggcnatgaatgctnatacnatcgatcgaaaangccgaattcggctttgtacccctcttgcggttgtggttgttctggcgcttgcgtaacaacccgttctgcttcttttttatcttgtacttttgctacagaaagcggtttagtcacttcggtctgtattggcgtattttcaattgctggttcttcagttgtaattggttctacacgtacttttttgcgtaaatcacggcgttgtcgacactctgtgctttgttgatcgcgtgctacacggcgttcaaggtgcgcttcttgtacgcctgctacttcttctacaatttgacgacccgcgtttttcagttccgttcgctcttgacgtgtaagttttgcgtcctcttgcgtttggttttgtgtctcttgtttacgttctttgcgaaccttaccatttgagctaacactgcgattaccgctctctccttggtgcctgttttacggcttggctgggctttccacttttccttaatcttacccgcataacccttttttttccccagtaaacggtttattaataaacggttatggctgaagtttggcatagttcccagttgaaatttaactctgacgttctaaaactattggcgataataccaggttctttcgggcggtacaattcctggcctatagattcggtttcatcaacgggcttcttcactcccattgataaaattacctaacctaactaaggaaggtgatatattttcggtaacctatacccttacg

SEQ ID NO: 62789 - DNA, 586 bp, Oryza sativa
caatcaaatttctttttttaagcgcgtgtaaaagtgtcaacatgtgcatttattaaccataagaaacccatatttaaaattatctaattttcattatcgattgtccatttattctcatcaagcgtataattagcattcttttgaaaaacacatagtagaaaaatgaaaccagccatagcgactattagccgtcaggcacttcgccataatattcaattgatcaaaaaattagcgcctaagcaaaaactattggccatgattaaagcaaatgcttacgggcaaggtttattacccgctgctgcaacattagctgatttagtcgatggctttggtgttgcacgtttacacgaagcgcttgaagtgcaagaaacgggctatactggcaaaattttattagttgaaggtttttttgatcgagaagaattattaaaaacgctgtctcgtggctttgataccgttattcattgcctagaacagttagaattattagagcaagtcgcaaaagaatggcaaattgagcaacagaaaagattttggcaacgtaaaactaaaatttatttcccgatcaatatttggctaaagattg

SEQ ID NO: 62790 - DNA, 5050 bp, Oryza sativa
cgcgcgccgatagagggtctcttccaccagcacgtagcgcttggagatgcgctggacgcgttcactcccttcgcggtcctcgggtagagtcttatctgcgaggtacgcctggatctgagcgattccaagcaatcaatctaagggagctgggagcgctcccctcgggtcccgaggcttggactccgacgggcctcgggggccgttcaggcgcgtccgtctcccctagggggtcgggtcgcgccgacggctgggcaagcctttcttcaaagctgcccggtggggtctgggctcgcgaggaagcaagccttgagagttcgtcggcgaccgcgttatcccgtctgggcacgtgccgaagctctatcccgtcgaaatggcgctccatacgccgcacctggcgtacgtaagcgtccatctccgggtcagagcaccggtactccttacagacctggtttacgaccagctgggagtcgcctaacacaaggaggcggcggatccccagtccagctgccaccctgagtcctgcaaggagtccctcgtagtccgccatattgttggttgccctaaagtcgaggcgaaccaggtatctgaggacgtctccactcggcgaggtcaacgtgacccccgcaccggcgccctgaagagacagggagccgtcgaactacatcacccagcaggcggtgtgaggcagctgtgaggggcccaagctggcctcgagggcggagacgggctcgagagctggggtccactctgccacaaagtcggtgagggcctggctcttgatcgcgtggcatggttcaaagtgcaaatcaaattcagagagttcgattgcccatttcaccacccgtccagtaccctctcggttatgcaagatttggccgagggggtaagacgtaaccaccgagacccgatgcgcctgaaaataatggcgcaacttcctcgaagtcattagaatagcgtaaagcatcttctgggcctgagggtatcgggtcttggcgtcccggagggcctcgctaacgaagtagacgggccgctgcacctttcggcggggccgatcctcttcgctaagggccgcatctccagggcgctcttcgtccgagaggccgcacggggcgcacttggcttctgcgccgatgacctcggggtcagagggcgacaggcgcggccttcccgcagtggccccgaggccatcctgggggtcgggggcgcctggcaccgtcggacaagcgggcggagggccagctccggccgtcgggggcctcgggccgccgttcgactcgggggcctctcctccctgctctctcccgggtcgagtcgacacagggtggggacgcgcgaagtgagggttgtcctcgtcgcgctccacgaccaacgctgcgctgaccacctgcggggttgccgcgaggtagagtagcagcggctcatctggctccggggcgaccaggatcgggggagaactgaggtaatccttcaactgagtgaaggcccgctcagcctcctctgtccaggtaaacggcctggagcgtttgaggagcttaaataggagtagcgccttctctcccagcctcgatatgaaccgacttagggcggccatgcagccggtgatgcattgcacatccctaagctggctggggggcgcatccgctctatagctcgtatcttctcgaggttggcctcgatgcctcgggcagagaccaagaacccgagaagcttacccgcaggcacgccgaacacgcatttgtcggggttcagctttatgcgagcggagcggagactttcgaaagtttccgctaaatccaagagtaaggtctcttggttgtgcgtcttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcagtggagtcgacaatctgatctatgcgtggaagggggtaagggtccttaggacatgtcttgttaaggtcagtgtagtcgatgcacatccgaagcttgccgttcgacttgggaacgacgaccgggttcgccagccactccggatggatgacctctcggataaatccggcctccagaagtcgcgccacctcctcgcagatgaaggcttgacgttccggggcctgccgccgcactttctgccgaaccggccttgcgtccggccgcacggcgagacggtgctcaatcacctccctggggaccccgggcatgtccgccggtctccatgcgaagacgtcggcgtttgcccgcaggaaggagacgagcgcgtcttcctatttgtcgtccagaagatcaccgattcgagtggtcttggacgggccgtcgcccagggcaacctccttgaccgggaccttgtcgtacgtgatcatccgctgcctcggggcggctgggacggagggtctaagcctctcgtcgctgcccgcgggcttggacgccgcggcgaggtggtccgcgcgctgctccatacaagcaagcgcgactttgaggtcgccatggacggtgatggggccaccggggcccggcatcttcatctggaggtaggcatagtggaccgccaccatgaacttcaccaacgcgggcctccccaggaccgcgttgtagggcagactgaggtccgccacatcgaagctcacccgctccgtgcggaagttggcggaaccaccgaaagtgaccgggaggtcgatatgacctagcggccaagtgtgccccggcgtcacaccgatgatcggctgggacggtcggagcaccatccccgggaccttgatggcgtcgaaggccgcgggggaaaggatattgagggctgcgcccccatctatgaggactcgccccaacttcacattgcaaatggtgggggaaaccaccatcgcgatctgccctccccgggcaacgcacggcgggtggtcggtctggtcgaaggtgagggtaacctccgaccatcgtgcccgccgcgtcgcctcatgggtaggggcagcggccaaaagctctcgcttcatggccttgaggctccggcgagaagcgtgagtgcacgctcccccatcgacggtggcgatggtggccccaggtcgccatcgtcgatgtcctcggtgggtcccttttgcttggcctcacttcgccggttgccggagggagccgccggggccttgccctcacggcgctcctgcctcctctcctcttcccacttcctcgtccgctcagccaaacttttgaccgcgcggcagtccgcgaggtcgtggagggaggtgttgtgcacggtgcaccacttgccagtcgggcgctccctgctgggagcgccggcctccttctttttgtcgctcgcaggcctcccctttcgggtggcccgcgaagcaccctcgacggcgaggacatgaccctcgtcgtcggaatgggccgacctcttcttcctcctcctgtcccgccgccctgaccgagcagcggacccgggggcggccgaagctgccacaccggaaccggaggagttccaggtccaggcctcctccttgcgagccactcggtccgcgagctgaaaaagctccgcggtagtctggggctccttggaggcgatcttttcgagcatgcggttgtgccgcacgcccccctgaacgcgtagatcaccacgtgtgcagggatgcatggtatggtgttgcggacttgacagaaccgctgaatgtacgagcgaagtgactcatcatcccttcgctgtaccgcgtgcaagtccgcttcttcacctgggcgctgatatgtgccttggaagttcatggtgaactgctggcacaaatcctcccaagagtggaccgacgcgggtggcaagttcattagccaaccccgcgcctgtcccttcagggccatgggaaagaaattcgccatgaccctgtcgtcacccccggcgtcctcgatcccggtcgtgtagacctggagaaactcggcggggttgacgcttccgtcatatttttcggcgatggtgggccggaaccttgggggccaacggacgtttcgaaggctcgccacaaaggctctacagccaacaccaccaaccgggggcacggagggctggcccccgcgcccgtactgaagtggcgctccggacgaggaggcgccctccgttgcgtgggcagcacgacgaccattgcgccgacgctcgaaaccgaggcgggcatccggccccccacgcacatcttcctgggtcggaggcgttgacgagagaatggcagacgaacggcgggtaacagccgccgctcgccgcgccctccacctcgacgacacggagccggcggtagcagcgccagaggccttggtggcggaagaccgcccaccggcacctaggcgctgctgcgccgtcatgaccaagtcggccacgtcatccaaccaacgtcgggctagagtctctggatcggggacgacgggcgggtgacgcaagagcgcgcccgcagcttggagcacgccctggggcgtgctgccatcgccgtagacgaggaggcgacgctctccgtctcgccgtccttctccatcgctcgtgggcggcaaagttgcggatctttcgaccccctcgagcgcctcctcccgcctaagacttcggcgagaggggggcggtggagtacgagctcgacggcgcgggttctgctccccgtcgtcaccgctagcactcagagagaggttgtgcgcttttgctcgttcggccattgggttgaacgggagaagcttggcgcacacgaaagaggatgagagcttagaaaaacacacgcgccccctacatggcgcgccagatgacggagcgtggggctcctcaccgagagaccgcgcaggcccccctttgccggttcggcggggggcgctaagtgaggttctaagccctcggtctgtggaatattcgcgagagaggcaatgcacgagacatgggcg

SEQ ID NO: 62791 - DNA, 4658 bp, Oryza sativa
atggtcttgtagcaccatgtggtcatgcatatgtttgcaggagcggaggcatgcatgcaggcctaacatagctagtgctaaagtccttacgcttacctgttttagagtttaaacccctttaaatcatcatatgatatttggattaatgatctaaacatcatctctataacaaagcaaatacaaaaggcaggtttttttttatctcatggccgcacggaatcgtggagatgtccattaaactcataaattattaagtgtattggttatttggctacaaaagtgtgtcactacaaattagtcgccggctctctttttacataattgatagaaattcgatctttatatttataagtggatatatacaggtaaaagtttcacggctgcatatactcatatctcatgactgagatacatacaaatacaaacaaatcaaaaataaaatattagaagtctacctacaagattgttctcatcgctttcaactggaaggatagccctctccatgccgtctcactaccattgcagcaatcaaaagcttccccatttcgtcatgagcaaatacgaaggctagaactagtccgcctaattgttggctctcttatctcttcatctattttcattccacgtaagattatactaatatcaactaacttgtagctagtctatttattgactacttcctcgtttcacaatacaagactttcgactttgaataaattcatacatcaatccaaatatatgccttatatacgtgttaaagtttatatagatattagtgtatctaaccgagggatggagaagctataatatcttataacgtgaaacaagcatagtatcggagtatatcttattggccctgctgctaacaattagccgatcattgtcatcttattgccctgcttatttccaatagtcaatttgatccctaaaatgatgatgggtgggattgcctttctcgaatcctgttccaccacaggatcgaagagatctcagatcgccggtgcttccacggagaagacgaacaagcgccattgtccagatccctatggccgaactacccgtggattgtccagatccccatggccgaagcaccccgtggggcccacctgtcggaacccgccaagcgaaacacaccctcttctcttcgtcaagctggatcgcaacgcaagggcccgcgtcctcttccctttccagccaaaccgacgccgatgctgttccactgcagggcgggccccaccacctctttccgagccatgggtccacccgtcagtcacccaagaaaaaaactaattgctattgtgggtggggtccaccccctccacgtccacgtgggccacgcggcatccgggcccactttcagtgagcgaggggctcccttcttcttaacaccggaggagagatccttcccggccgtctcctccttcccctctccgctcgcctccgcgattcccttcccatttcgccgccgatgaagggcggcgggggcgcggcggcggcgtcggcggcgccgggggactacgtctacttcaagtccgtcgtcccgctccacaagatctcggtaagcaattttgcacggtggaggagctccccccctctctcgcgtgcgcctcgctagtgctgctggcggcgtggatttcggtcctcggcggtggaatttggtgcggttggttgtggggattgtggttgaggagggttcccatgcgggtttttggggttgattttgcggggaggatttagcatgcgggatctacgggatcacaatgtctgggttggatggataacggggtccaagtatgtgtatggtttagttctagttttagggagggaggaaatgggtttaggttgattggcatttccccgttctggatgatggcatttggtgcggtttttgtctagatcatgatcatcaattcgtcatgatcatgagtaattcgggcagcatcttttgctccgttggatgagatgccgacaatgattcgaagctccgatgtttatgtcgtcatttctctccagtgccttgattcatagtatctggttatgatcctctcttttttttagagagataaagagcgttaagctttagtattccttagttactttgccttaaatttcttaaaatctcgtcaactccaccgtctagcaagtgaacaaatcaagttatctagtagcaattaggggttggtttggttagatgtaacctgctgactaaatttggtacctatgggagttatccgtatatattttttatctttgccttcttgagtgtcatatgcagtgtgtcttggtgattctgtgcagaattgacactagtaatgtgatctgaattgcgatgtatgatgggattggcttatggtgtcccagagtccccatgtttttattgatcttcttttttcctgcaatttctttctttttttttattgcttttaccttgctattgaaatatgtgtgcttgactgcttgcttttcgctatgcataatagaatatcttagattaagctattttgctttgtctacttaacttattcatcgattataacagcagatatgcatattgcatcattctctgcttacgagtttcctcaatctgtacaaagtgaactgtaggatgtacaaattttgaatgtgaatatgcgttacatgccaacttcttctcaactttgtattattataatgtgtgatggatgccattctaataaaaaccaagctgctttcttcaattctttgcatgaatttctcaattttattcatatggttgaccagtttctctgctttgttcttcaacatggcagaattataatttgtgatgtatccctttttgaagaaaataaatttgctgccttcatttttttaagaactaattttttaatcattacatacgattggctagattctaatctgtttccttattggaggttttgtagattggaccgaaattatggaggtactatgattttggaccaaagactgttccacctcttgtctgcatcccaggaattgcaggaacggctgatgtgtactacaaacagatcatgtctctctctatgaaggttcctagtatctgctttgagactatttttttcatacctgatctggttttggttttcagtttcatgcatacctacaaacatataccgatatgtttattatttgcatttgtagtcttgtagtgctaagttttttttaaaaaaaaaactacaaaaaagtcatggtcaagtgttctgtacttggtccttggacctgttctcaatcattctaccaaacaataatttcgctctcaacataaacagtttttatcttgaactactaaaatttgaagtatcaatgaagatctgaagtaatttggaaatattagtacatgatgcatagtaagactgttaatatgatcaagaatccttgtattcttggtgcagctttagtacctttggatgtattcatctttaggttatatttagtgtgtcagttttgaatacgaacatctccatctacttgtaattaatttgaatgccactcatatatttctgaaaccttgttgatctctgttctataggcaattagttaatcgcaatttactacacccttcatttctcacttctctttcagggttatcgagtgatgtcaattgatgttcctcaagtttggaatcaccaggaatggattcattcatttgaaaaatttttggactccatgaatatccatcatgtaaggaagtcttcccttccttctgcatttcttttatgcattgcagtcttagaactgtccaaccattcatattttaagccatgtattcttcatttccactcttcttgtgcctcttgcaacctataaggctgtgttcgttttgttgttttgggggggggggacccttctccccagcacgcaaaacggagtggtggattagcgcatgattaattaatttttaactcaaaaacttggaaaatagattaatatgatttttttaaaagcaacgttcctatataaagtttttgtaaaaaatacaccgtttagtagtttaggaagcgtgcgcatggaaaacaagggaaatagaaattgggaaagtgtagtgtagaacgcagcaaagtatgtactccctctattccattatataagacacaaccacttttcttagatgtttcataatataaggcatgcatgcaagcatgaaattaactattacatcttctccattaaattattacttttttaaatactccattctcatgttatctaatcctattggatgcatgcattatatttattaggatgattcaaactagaagatgataataattatttcttggtctttgggttaagggtggttgtgccttatattttggaatggagggagtatacaggattgtcatagcagtgagaatataaatatgctatagtcagctctgaacaatgtgaaatcaatttgatgttacctactacttcgtgaaagactgcttttgcttattctttctgcaattcccagtttgcatgattcacttctttattaaggagtctatagtagagtgtgttagtttgttccttgtatgtcagcagaagtttttgtttcatttcgttgagttttgagttatttagtactaatttatttattttttcattggagaaaacaggttcatatttatggtacatctcttggtggatttcttgca

SEQ ID NO: 62792 - DNA, 4828 bp, Oryza sativa
tctctttttcttctcgtttcgttgggactactaggtgaggtagggcggatttcatagcctaccattttgatcctgaaggtgtttttccttcctccgtccattttccattgcactgtttgtaaaccaggtgaaattatttctatcttgatgcatgtccatagctaagatatgtgccgcttggttgcagtgcgccgtaccgaattgatattgaaatcttcaaaagcctcaccctttgttttttatttttattttttggccatcgtatgagtccccatgtatcaatcgttcaggaaaatcaacaatatatttcgtacctgtacactgtcagtttctaggattatttctgtactcctatttcttctgttagctggaaccagcatcttcgctagcgtagcatcgttgtgaagtacttcattccgttgattagtgcttaattaagaacttatagtacactggaggcaagtagaacagccgctccagtggcatatacagagtagttattgtataaccaatattgttctacttattagtctagtttcctctcatctctcacgaagtactgtcatcttaaagatataaattgtacgagcaataaggctaaagtcacatggctacagagaatatccatcttaaatctcatgtgtatcattttatcatacaaaattttccatagcaacaatcagggttacttgtacgaatgtacgattgtagtttcagatggggcttttgttattcatcatttgcctgaatttttctaatctagtaccatttttttttcacaacagctcacatcgcattgtgactcgtacaacttcaaaccatctttgtccccctacctgcggcgtcacacactgcacccaccactggcatcggccacctctcctcgtgtgctacctcccttcctcgccggtgtgcgaaactccaccgtctctgatagcttgtaccactaagatgccatcatcttccgcctcataaccaatgtatatctacactggtccgctgccctccttcattcttatggctttgacgccaccagcaacacaccacggcctatctatgtccatcgttcatggtcagtcttccaccaccccgcccatcactctaaagccaccatcaccgccttctgcctccatcccatcgtggccaaccctgaaaccctaatttgtattggagttcgtgggttgtaggcagaaagtttgtcgctgttatcactatcgttgtctacgtctatggtgagtcgtgttgaccaagagttatgaaaatataatgtggactaatcaatagtattccttccattttgaattacttatcgttataaatttctcctaagtcaaacattttaatctttggcatatagtttatctttataagatttacattattaaaaaaaaaggagatttggagggagagacgtccctctaaatattttaaagaagaaattatgagcatgttagagattgaacacgacacatcaggattgaaaccacataccacataccccttaccactgcactatcaacatctcataagatttacattattagattcactataagaaattttgatataattcacatgtaactaatggtcaaatatcaataagtttgactcgacggaataagagagatcaaatattgataagccattcccaattcgcccaaatcgtggcctttatgaacaatcctagcaatgcaagaaataatgacacattaatttgagtttttttcaattaaaaacgtatgtagttcactgatatggaaatgcattgaacttaaatgacacaattttttgttggagactagaagaacacgcacgccaagttaaagcagagacagcaagctcgtcacacgataatacttaagtcgaaccatgtagcttcgtccccgacgcctcctccggcgtcacctcgccgcggtgcccttccaccgccggcgccggcgccgccgccttgaacctcgcgtagatgtcccccctgtagaaccccctcgtcctccacaccagcaccagcgacacgatcacggcgaagaacgtcgccgccgtcacgatcaggaacgacgccctgaagcaccgcacgccggcgcacgccctgtgtccggcggcgccgccgccgccgttctgcctcgccgcctcggcgtcgtacagcgcgccggcgacgcgcacgttgaatatgtacgcgccgatggggctcgccaccatgcccaggttgtagagcgtggcgtagtacttgagcccgaacacctcggagacgatggagaagagcagcgtgtacagcccgccgaagctgaagccgacgacgacggacgccgcgtacaggccgtgcggcacgccgagcgcgatgaggaggtagccggcgctggagacgacgagcaccagcgtgagcatcagcggccgcggaaacctgtagcgcgacaggaggagctccgagagcgagccgacgccggcgcggccggcgtacatccagatgttgatgagcgaggcgaaggtgttcacgctcctcgccgggtaacccagcgactggctgatctgccccatgttgtcgatcgccgtcagcgagccgccggcgccgcagatgacgcacacgaacagcacaaccatgtccacgctcaacgccgcctgcgggatcgtgtagtcctccccgtgcgccggcgggttgaacgttcgcttcaggcacgagccgacgccgcatgtcgtcgccggtggtggtggtggtgtctcgacgacgggctgaggcggcggcgccgccgcggggagagtttcttggacatcggcctccctccggcttctgagctcctgtctgatgacgaccgcgagggggaggaggaggaggatgaggaggagcacgatggccgtcgcggcgtaggcggcgtgcgagaagctgatggttttctggagcacgatcatgacgaggaggtaggaggcgacggcgaaggagatgtagaggaaggagaagatggggccattgctgcctccgccgccgacgcggccgttcgtcggccggtgcggcatgacgcggacgacgcggaggaacacgagggagatggcggcggggagccaggcgatgagcagtatcagcgacccggcgtcgtggccgccgccgtagatggcgaggtagagctgcgggaggacggcgccgctgagcccggcgaaccccttgaggaggccgacgacgacgccgcggctctccgggaagctcttgacgcaggtgacgagcgcgccggtgttggcgaaggcctgcgagtcggcgccggcggagatgcaggcgcacatgagccagagcggcgggcgcgcgacgcggccggcgacggcgaggtagacgacgaggtagcccgcgaggctcatgcaggcgcccacggcgagcacggccgacggcggcgccacctcggcgacgaggccggagacgatgccggcgttggcgccgagctccttgaagaaggagagcgtgttgagcgtccgttggtcgtagcccagcgacgacttgagcgcgccggagtagatgctgaagatgttggtgccgcccgacgccgacatgatcaccatgcacgcgagcatcatgaaccaccgccccgtcaccacctgcttcgcgaacagcgccgccgccggcatcttccccagccgcggccacggtctcccgccgccgccggcgcccgcgccgaacaccatggcgcgcgacgcgacgcgacgcgcgcttacgtagctggcttgctctagctacgtactcgagcttgtcgcttgcagctgggatagcgtgagtgttgtacatgtatttatagagtgttgaaggaatacggtacgtacgtaacgtatctgaaattccacctgcataaattaggaaagtttattttcaaaataaaaattgcttcaagcttcttaaattagaagagtctaccacttcaaaaggaggggaaaaatacagagaaatgtgtgtattgctcgattataaattaaaattcgtgaaggtttctggttttaatgtaaaagactcaaccgtttgatacagctcctaggagaattaggagaatgaagcggagctgatgagtggtgagaatatccctccatcctcgtattgtaattttttagcaacggagcgatagcttcgttatatgttatctaagattttgaaagtgtttgatagagttatagctctatgggacaaaaacatcaaagtaaaagttgtatcaaacggtgttttgtttattctgaataaatatccgaaattcagagagagaatcttagtacaagcgatggatgcataaagaagtattgcatgagtagaatgagaggttggggagaataaatattgacatattctacctaaaagatagaaaatgaccatgtgtgacaacttagttagttatttgtacatcgtcaaggggttgaactccgtggctcattggtctttgcacgaactcgaccaccctagctcagccaccggtcctcactcctcgctcctcggttagtttgtgaagcaggggcaaaaaatttccagcgacactttcacaaaaatacattttagcattagaaaaaatattttgttgtccgcaccatactacctttaaaaaaaatcatttgatgctcaagatataaaactcttatccctccattcctttgtaactttttttttcacagaaaacttgttagtgcgccattcccaagtcctaacatgcgtttttttccaattttaccattaacggcacaaacaaagttttttttccttttttcccctaagactggagcgtttcccttgattggacaagtatcagtagctttttgctccatgtgcattttccaactagattgggagtactttaaaccaggagcatttagccat

SEQ ID NO: 62793 - DNA, 12192 bp, Oryza sativa
  unsure (1)..(12192): unsure at all n locations
cggagcacatgcgacacggtagttcaactacacacattaaaactaatacaaaatggcccaaaaaaattatataccgtagttgtagccctaccaacatcaacatgaactatccatgccaatccctaaatattcacaatgcatcccacctaccaatttcacccatgccaaaatattacaaaagttgcaaaatcaacgtgaatcgcccctaccaacatagagatggaagtataattcacagcgcatcccgagccacatttgacaaatgacaaaccacggttttaataaagaaaatagtcagcatacatgggcaaatatttggaaaattaggcttttcggaggatgtttaccttggatcaatctccaatgcaatgcccacgaaatccccttcgattttggggtgaatttgaggagatttgtgaaggggaggagagagtgccctaggctcgactatccctagccggagaaaggggtgggaaggaagaaaatagcggtttggcaagcacggccgtgctcagcctaggtgtcctagctcagtgctaacgggcatggtgctgaggttggggactcgccgtcaagacggttggcgatgaagtcctgccacgtcagcaagaggatcaacttcgatgaaatctgggcagcgggtcagcgtcaacggacctacgctgtcacgcccagaaattcactagtaatttccgaactaatttgtgcataaaatcctcgtccaggaatcagccgaggtacacaaattgacaatttaatatacaaattcatcgtaataatgacgttacatacttacaaaagaaaagagaaaacaacggcggaattacggtctagcgaagctccggctccactcccacaggcagctcaactggggtataagccaaacgtcttctcctgtgcgacttttcttcaaaagaggtttgattgattattgcaaggtgagtacatggaatactccgcaagccacacagcaaatatgcaagtgcacaaggataccaaagaatggcataatttagggctcatttgcaaaagcagcatttaacaaatatttgaaaattgtaaaacagtagagtaactaatcatcaatattaatcaacactgaacaacacacccatgctgcacaggcccaactatcctgaataaccatatctggctgtacagatctatctccaaaccaggaatgtaccattccaaactaggagctaaattaattactatcaattaccacattattattaatgagtagtgtgggactaatcacaaaagtcattgttagatcctcctataaccgcgggcacggctattcgaatagttttactctggccagatgtgtaccactgtacccacaagacacaactccacaatatgtcaccatatcatcatgtgcccatactgaacatgtcaccatttgtgtagttgtgacaagacccctcacatagctcaactcaaagcagcgcacctttcctggatcataatcaccccccccccccgtgggcttatctccgccacttctcagtatggcacaccataatgagccttgctatacaaagtgtccagccgttgcccattttggcttgtggttggcacggttaatgtttcacaaccgaagctcgtgaaccggtccttaattgtcatgagcacgaccatcaaaactatgtgctcacaacccaccattatcaagttttagttggcaaattaattaattaaccaatcacgattagccatcatgagctatgattaaatatccatcattaagtaatagtgaaacattagttatcccaattgtgtgctaatgtttctaagcatggctaagcaattatatctaatatatctagttgaaccaatatataaatccaactagtcaaattataacccgaggtaatcaagaaatagagtgatcaatgcaaattggccataacaaaggaacaggttcacaccacccggtgacattcaaaaataaatgcacagttgaaataaatagagaatttaaatataggatcaacatgctcaaaggaattgtgtttgggatatgtgtgacttgccttgcaataaagggtcttcaattaatcttcttgaatacttccggcgcactcgcgaacctttgaaacgacggaaacgacaagctaacacacaaaacgaggaaaaagactaataaaaaccaaataaacagtacacataaagtaaaaaaaaacatgtagatcatgattttagatgaattatgagacttgaacggcctcattccgacttcatatgaattgattaccaattttacaagattaaatctaattaaagcctatttaaaaaggattaaacaaatttaacacaatttatggataattttaatatatagatctttattttataaaacttttgcaacttgaaccacattaaaccgagttacaatgaattagttatgaatttctaaagattaaaccgcattaaagcatttatatgggttttaattgaattatgacgcaataaagaattattttgaaaataaaaagggatttattgcgtcatcaaagacggtccacagtaaaccgggttcacagaagcggcccacggaaccaacggccaagatctaattgacctaaacttgaccgaatcggacggccgagaacgatccggtctaccacgggtctacggctaacatcagcaatgacatcagcgatgatgtcatcgccggcggcggctcggcaaacaatgctcgtcggcaaacgacggtgcaaacggaggacaccaacgcgtagagctcggctcggcgaactcaccagcgatttggacgatgacagacggcgacgatcgacgacggcaaagaggtcgaggcggcggtggtcttcgggtcgtcgatggcggcggcgctccggcagtcttcggcagaaacggaggacaggacgaggacggcggcgacctagcgaacctggcgatggccttcctgagcgacggcggcgactggagcagcggcgacacttggctggactcgcggcggcgacggcggcgcacgggctgacgcggaggcggcgctacaagcgacggcgggctagggcgaaggtggcggcgaaaagaggaggtcccgggggtcctcttataggggctaagaggcggcaatggaggcccatggccggcggcaaggagatggaaggtctagggttagggaatccgaatcaaaatcgaatccgagctttttccaaacaaaattagccgaagtttccaaaagagaaaaggaagaggagatcccgaggatcatttcccttctatcaatttgatcggagatggaaagcggcggctggatttggaaggggcatcggcggctgcgtgacatggctggggcggctggaggttgaagacaaccctgacaggtgggtcccacctgccagcggctgagagagaggcgggaggagaggtgcggcggactgggccggcttgggccgaaaggagggagagagagagacttgggccgactttcggcccaaagccaaaagagatatttaaaacctttttctatttaaattattcatgaaatgatattccgtttattaaaaatacttcctttgctcaaataaatcctagaaaaatctagtaactatagaaacaagagaagtatttaagaaaattttatctatctcacttttatattgagatttattaaattaaaattagatcttctcttttaggcttttaagatcatttctaataatttcttttaaacaacaatttataatttaaggattttttaaataagaaagtcatttaacataattatgattagatcattaatgattaattattaattaactaattgctgaaatattctttgtattactaaacttaggaattgagctttgaaaaatccgagaagattccaaagagtataattaatcctggagaatttaataaaaattaaatccagccatgctttatatttaggaaattttatttcccacatttaaattcacttgtaaattaatgaacatttaatataaattctattaataatttattaaataatttataaatcctaaaacggaaaatcaggctgtgacatacgctgaccgtaggacctcagcgtgaggtagttaacgttgaggtcgcgaatcattttttgttaaagttttctttatatggtttagtttctaaataagtattcgaaaagtaccaatttatcaattttttggtgcaacgtacctcagcctcatagtttggcgacaaaagtgtgtgcctagtgacactgacacacctggggtatgcatacaaggacaattagcatataataaaccactatcaagtcgtagttaaacacgatgacgattcatcatgcatgcacctgtgttattactagtactttactttaaataattagtcgctctcttatctctaatcctctcttccactttaaaataattgtcgctttagtttttgttttgtttgctgctatgcaacctagatggcggcaacagtgctgctatgctgctattttctaacaccctttacagctgcttcgcgccccagcaaacgacacgaattcatcccaaaaactaaactaagattaatttcgagtcaaacgtacgttagctcgatcccaactcgaaatatatattgttgtgctgcgattgcaatcgatcacgttcatgtctcctgttaattgacaaatgcaacatatatcgatccacgttgcaaaagaggcttcgttttaaaacttaaatagcgtttattcgtacatgtcatacgatattaattacgggcttacgtcgtgagatctatgagagcctagctgtacatatatattagctggcgcgggagagatctccaagatcttttgatcgtatcttgcacggttttaaatatgttatcgcaacatatattcgcgatgtcactgatgttcgatttttattttttattttttgtttaaaagaaaacaagagttgcaatctctccagtctctcctatgattagctgatgataatcattacagtacagatctgcttcgagatcgaggttctcccaagatttggctaattaaatcgtgaaagtttgcgctttagacctacctcggataagttatggcaaattttgtgcacgcacgcaatcgtgatccctttctgcctggcacttttgattagtttaatttaccagcgatcgcatggtaataaggctacttttcaaagataattaagctctgttcaacatgtttttgtccacactactccaaataaagtgcgcacattacaaaattaacagtcgacacgtttactggctaaaagatgaaaaccaacgtattggccgggttaatatctagcttctagaactagctagcaatactgaagttagttagtatttttgtgtaaaatgagttggtaaactattttgttcttcatctcgcacaagagcgacacatgttaatatattttaaaaaaaataaaaaagaaaagaatataccacacgtgcggatcaaacttgatactgtataaatgatctttcagaaattaaactgtctcaattgcacgcaatttacgcagaagccagggttgggacaactagggcttaagctctggatttaagctctataactaatcctatcagaatcttgataaatttatatagagattttggagacgaggaaggacatattatacgacctatttggaggagttttcggtagctacagctcctcctgaaaccaaaaggtcctcaaacggtccagctttttatgcaaattgtacgaacgaagttatatttatagaataaaaactgagttagaaaccaaaagtctcaaggttataactggctaggttcccaccagctaaataagacaactcaaccctacacgcgcgtaccttaattaacttgctagagaggaggaaggaggggggatacataagcttaaaatttagggttaattgaatccatgcaactgtaaatatgccaattcggaaaaataccattactatttagcatatcggctacgtgttactgaaaattggagaaattgtaaccgtaccactccatcacatttttcatcaaaaatctccgttagcccccaactgcacgtgggccccacctcccttccatctcttctcttttgatgaggacatcttccactattacctgctggcaaagacgcaaaagtcgggcggcgaccgtgtgagcctctgaataatcccacattgcttagcttgggaggagaaagccaccttaaaagggagagccacccttcccctattggactagtcttttagagagattgggcctttccccgagtgggtgtgcctaagaactgttgggatccaggcaaccttaagttattgggtctcggccaaccccacctgggctggattgttatcatctttccccttcctctctctccaccaccgtagatgcggcaagaggtgtcgtctccatcgtcgtctcaaagagggaggtcaggccgggctactcctgcgttgttgtcgtcgttgagcgcctcgtctcggagccggcaagccacgcggtatcccttaccgtacaaggaaagaggaggtggtggtggtgaaggcatcggcgacgacaagtacccatccttgccaccgtcgccgaggacctccatgatgcccggcagccggaggggtgcgccaccggcgccagcagcaaggaccccctcctcaataaatccattgctagtatgtcgctctaatggctcgcttcgccgtcgtcgctgccatcgtcaccctcctcgccgtcacggctgctgtgcaggccccgggagcggccctcatcccggcgctcaagatggccctgctgcctgctcccccaacgaggtccctggccaccgcccccatgccggtcgccacctcacccaccgccacgtcaccttcccccatggtgcctcctccgactccgcccactgacgccccagatgccaatgctccctccaccctcgccccgtccgtggtcacctccaccgcctctgcaccgaccggtgcccccgtgagctcctccgcgttcaccaccaccgacgctcccatcgtggggatggaggaagagatggggaagaaaaaagagggacaatgtaggaagatagaactgacatgtgggtcccacgtccaggaggctgacaaaaaacgtgatggagtggcacggttcgaattttctaaatttccagtggcacgtagccgatatgctaaatagtagtggtattttttcgaattggtatatttgcagtggcgtagatccaattaactataaaatttatctccaataagtcttatctaatgaggaaatgaaaaaaaatcttcagaattgacatttagggcatgtttagagagcttaaaattttaagcagcagctggttggtagccaatttttaagaatcattagaccaaaagtagaactgttttagggagcttgtgattttgggagaaactgcagcggttaaaaactctcccaaacaggtccttagtatgattttcatgctaacctaccccagtactacaattccgtggggtactacaattccttgtaacgcgctccctccgtttcaggttataaggttataagacgttttgacttgtgtcaaagtcaaactatttcaaatttaactaagtttatcgataaatatgataatatttataatactaaaatagtttcatcaaatcaataattgaatatatttttataataaatttatcttaagttaaaaatattactatatttttctacaaacttggtcaaacttaaagcagtttgacttttaccgaagtcaaaacgtcttataacctgaaattgagggagtagatgtgaatggtacacgggcttctatatatatatatgttacatctatctctctctatatatagtgtaggctaggtatatactccaatatgcgagtaattttacaatctttaaaaaggtaccatgaagtaattttagtgtaaaattttgtatctcatagtttttaggtataaagagatatcaaatttacaatataaaaaattgataagctcatattatcttcttagggaccgtaaaattacttccaatatatatatatatagcacaggaataaaatattgtactagacacaacgctgaacggggctcgtgccgtgccgtacgcacacgctgcggtgtcgcactggtagtgtacccccggcgcgtgaagcgttgacgtgcaccatggccatgcatcttttgacgcccttgatgtttttaaaacatatttgatcgttcgttttattaaaaaatttaaataattatgagttcttattctatcatttgatttattgttaaatatactactactattcaagtttttaaataatatttataaaaatttttaaataagatgaacggtcaaatatgtttaaaaatatcaacggcgttaaatattttgtaacggagggagtataatctagctagcacaagttaaagtgcataatattgttgcatgcaggggcacggccgagctcaatgcaaagtctgaaattaaccccccagcagcagcatggagtactgtatatgatatacgtaggctgcctgctaacgtgttgcccggacagcggggcgacccgtcgctgtccctccctccgatcccctcgcctcgtctcgtgtgctactacacaaaagcaacatacattaattgatacggaatacgtatatccttcctacttatcatttaattcattgttaaatatatttttatatatacttatagttttaaatattttataaaattttttaataagacgaaaggtcaaacatgttaaaaaaagttaacgacgccaaatatttaagtacgaagaaagtttatagcataaaaaactgaaactttttacattttaaaccttttcaaaaacttatttcgcaaaagacaaaaaaaaaacttatcttgaaaaaacttatctgtctacgcaagcctttttcgagcggtacttccgctagcaccgcagccgtacgtgcccacgcagttaattgctgcaagtgcgccactcatcctggcgccgtgtagagagaaggtggcgccagcggtgccggcgccttcccaatgtcacgtcagctggagggggccacgtgatgccatggtggtaggacggtgccagcgactatgatgtctcaaaaatgactatttttgaaataagtttttttaagtctatttacgaaataagttttttaaaagaaccaaattgtgaaaaaaactccgctacgtggtggggctggcttacgcacgtccaaacggccggccggccggccaggtggatcgagttacgtacgctacgtcaccaacgtacgtacgccacaagtggaaacggggtcacggggccggaaggaccgggtgaacactagtgctgccctaattccactgtctaatctaaaacggccaggaaacggaaatttaatgcatggagatcgtgttggattaattgaccacctatgcatatgtgtgtactacccgtttttccggagataaaaaaagcctgcactagtactactataggagtagctcgttaacgggacacgtacgtactcaaaggtaactcaacgagcgatcgacatgatacaaatcaagaaaggttgttatgaatgttttacagcggaaatgtgctgaaacacgcttatttggatgctagtttttctttaccacgtgtctgtccgcagcttaattggctcgttgaaaatacaaatcagttcgttgtagcttttgctatattaaaattcgagtttacccattatccagtaaatatgtactattaaacataaatacagctcaccatttagttatctcaaataaacggtactaggctatctattacaccatttcaacaaaacatcgatattctctctccgctttcttgttcctagctccatgtcaaaacaaattatacctaacaacctaagattatctttggacaataaatctaaacacataggtacgttggttgctacatattgaaacggagatagtaccatattcttataaatgctattgttatactaatatttgtgtcttagctaaaccaaaaaacacgatagcctttagtccaacaagagaaaagtggggactagagggtccaaggaaggagaactaccggtatgaaatggaggacatggttacacatatactccctccgtttcaaaatgtttgacaccgttgactttttcgtacgtgtttgaccattcgtcttattcaaaaaatttaagtaattatttattattttcgtatcatttgattcattgttaaatatactttcatgtacacatatagttttatatatttcacaaatttttttaataagacgaacggtcaaacatgtgcttaaaaagtcaacggtgtcaaacattctgaaacggagggagtatattgtatccaagatggaggtggattgagatcatctgtagtcgtaactatatatggctgcaacgtaaaactatgtatgtatgtttagccgttcattttaatgaccagtggtccatatttacagatactgtaatcaaactaaataattaccataacaatatttgttatagtgttttgtctaatctgtgatgtttgattcacattaaacggtagctgctacgactggataagttgcaatcagtactcagtactacgacttatccgaatccgatcgaggttcctggctagtttgcactaccgcgagagtaggatcatctagtaggtgtcatggggacccggaaggaatagtgttgttgacttgtagagattgaaagcgttggcatgataagatgggaaacactatatatatgtatcatggttgaagaaggttaactggagatagttgaaggagacgtacgtgagaatatacggagagtctgtattttagataaaggaagtttgtatggttcttaattaaacgaacaattacagaaaggtgatacagtaattattataagatcacttccaatttctatgtaactagatgtacagaacatataatatattatcattcataaagaacagacaggattaaaatatcatgtcctgggtacgggagctacaatcatgcaaactatctttcattctcgtacactaccaagccaacatttggactgcaatgaataccctaaaaacaattaatgtctccaatgaaggaccnnnnnnnnnnnnnnnnnnnnnnnnnntggtctaagcaataaaggtcgttagagcataggtttccaccccaaagagcaaattcttcgaactctagccatatcttcaataaggaagcaaaaccactatattgctatgaacaaccagctaagctctgagtggagattaatcaaaactcgatgtctagaaaccggtactcgataagcactacctaatcgggaatttgattagttttatgtgtacccctacaatagttacatgcttctagctacatatattcaatttaattacatattgcaaaagtgagtgtaactaaacttagtattcttgtggtgaatctagctagtacgcgcgtccacctgaattcaaatcctaatcttgatataggtgctcgatttacgggctaatattattttaatggtaggccggtgatgcatccgtcgacagcgagatatccataatgactttgttaatctcaaaatatgtcggtccgatctttcaaaggtggttatatgggtatggtgtacacgtatgtttataaacacgagtatatgttatgagtagttgtgtttgtactgtgttttatcagaaaagaaaattaattaattgcgtactgtgtggacacatacgggcgccagaggggggtagttactgtacctgacggccgtgcgtattgccgtaagcagcaggacgcgtacccaacgcatgcgtgccgcttgtatatcctatcctagttaattagctatagcatatacagacactggccggcctacgcatgaaggccacaggttggccggtgaagcaaatcgatccagcgcgcgcggtcacggcccgggctggtaggacgaaagcgaaagtgccgtacgcccgcgccacgtatatatatacccatgcaacatccattatggcgaatgcatgagtaattaggttaattataacactcataatgagtcttaattagtgcctagtgttacttaagtactacttaaacataactaaggacttgtttggatccttcgggctattaaataactctccggaatcttgctatttaggattattaaacgtagattatcgacaaaaccgattccataacccctaggctat

SEQ ID NO: 62794 - DNA, 2116 bp, Oryza sativa
tttcataataaatttatcttgggttaaaaatgttactattttttctacaaacttggtcaaatttaaagcagtttgattttgaccaaagtcgaaacgtcttataacttgaaacggagggactacatttttgttttatgcttggccctttcttcatcgccgatctttttttctctatagcttgcaagtattttcgcattaaacttaaccactgtcaaaaaaaattagaaatgtttattgttggatggagccacggagggagtatatacgaacggaggaagtagagtttttttaaagcatgggttgtacacatttacattaattaaaaaaacatttagtcaactcatgagactgaaatcagagtattaattaagatgtgtccgctgtgtgtaaactactatcttaggtgatgcagtttcattttttagggaaaaaaaaacggtacacttaaatcgtgagatgctgaaaccctctatttcataaatgaactacttgtcactgtccaaagttcaaacttttacaagaattattttttctagaaatacggtataaacgcagatgctcacaatacgcgtattatcgtccctatgaacacgcatatatgcacacgtttttctcctatgtgcatctcttttctcctatatgcatctctgaaaaactaggccgatatatattaatatcgacaaggtcaccacgagcgacgcaacatattttaagatcgataaagtcaccgctaatgacacgatatatcttaaaattgacgaagtaactacgagcgacacgacgtatcttaagtttgacgaagtcaccacgaacggctcgctgtcgaagggtacgtcacctaccataaaaataaatagctataaatgtaaggtagcacacgtgtcaagtttagaatttaaactcaggtggtggtatcataaaaaactagttaaacctaactagttgagctatatctcattttgcttttacgagaaaattatgcataaaatttatttgtttgcagggaatgtgtaagtgtcatgtgtgcctctgttctgatcacgcgtacatctgttgttacgatgttatcacaggattatgctatcgaaatttcgttcaattttattaaggttcactcgtggcaatttttaatttttttatgcaatcaggatgtgctccatcggctcatgtccatcctaatcagggctctctgttacggtggctggggggttgctatcctagtgttgacaaaaatattaaaagaacagaaaaaaaggactattaaaccaatgattaggaccaatatgaacttagttaaattcatggcatgtgggatacacaacatatatgttcccactagaattaatagtgatattccatttgtatgttggatggtagttacttttctaaagtcgaagtcaatttccacaacccaattggtctgagcaggaagtgacttatgtttaaggaagcaatagttttagtacagaactacaggcactaccatggaatattatggaacacttacataaactaggacagttatagtgcattattagtatagagaatttaggacatttcccttcaaataaaagaatttaggacatttccatttataaaacgaatttaggacatgtttagttgttgccgaaaaaagcttatcaggatttggtaatatggaactctgcaacagaaaatttagtgttgcaacgtagtttagtgttggcagtgatatctaacattgcttaattatatctactgttttattgtattcaaattatgatttataaatgatgctttttgtgcaaatattttatagcctttcctttgtgaatatcttgcatcataccttccttttggtatgacttattgagtacagtggttggtactcagttttactttatttttccccaccccagaagcagagaattgttcagatggtgagttctttgaggattaagcttgttccggacgttgaggatgcctgtggattatggaggaagctatgtgtttggtcgtgaagattaagtttatattatttgtttatttccactacgtttgtaagaattatttattattttttgtaagacgtggatctgtttatcaatttgttgtttgtatactctggctgatcatg

SEQ ID NO: 62795 - DNA, 1813 bp, Oryza sativa
ttcagagtcaggaaaacgatgacgaagttcttgagcattttcccaagtgaccacatgcggatcatctacagaccaccgaaccagcaactgctccaccatcttggatcctttccgaatgaagcgacgatccagcacttgcgatggaacaactgacgtaccagcagtggactgaattctgggcaattgagaatacaccacctcacttggcaccaatgctttcttaagctgtgagacatggaccaccgggtgtataagactggtagctggtaaagccaatttgtaagccacttcaccaactcgagagagcacctgaaaaggaccataaaaacgaaaagccaacttgcgattagcacgagtgaccactgactgctgcacaaccggctgtaatttgagataaacccagtcgctgacaacaaatgttctttcagagcgatgttgatcagcctgaaatttcatacgagcttgagcacgcaacaaatgatcccgaatcaaactctgaatctgctccctttcatgtaaccagtcagctaactcagtcgactgacaagctgcatttgctgacaaaccaaaataccgtggcttatgtccatataatacttcaaatggagtggtccccaaggctgaatggaaggaagtattataccaatactccgctagagccagccatcgactccactgagaaggacaagcatgcacaaagcagcgaaggaaagtctcaagacattgattcacacgctccgtttgtccatcagtctgaggatgataagaagaactcaaccggagttgtgtaccagccaacttgaatagagtagcccacagggtgcttgtgaaaatcctatcacgatcagagatgagtgactaaggtaatccatgcaatttatgaataaactgcatataagcttcggccacatccatagctgtgaaagggtgagcaagaggaacaaaatggctatacttggaaaacttgtcgactacccccaggatacaattaaaggtagctgactttggtaagccttcaataaaatccaaagaaacaacttgccaagcatggtcaggtacaggcagtggttgcaacattcccggatacttgacatgttctgatttggcttgttgacaaacagagcaagcagtaacaaactgcataactgtagtgcgcaattgaggccaagcaaacagttgtttcaccctttggtaagtgacatgaatgcctgaatgacccccaactggtgcagtatgcaagttagccaaaatcttttgttgaactaaggtattgttacctatccacatccttttgagcaggtgtataacggtagggacgcacattgactggagtagctcctggcatgggtggaattgtatgatcaaaaaccctggacggtggtaatccagaaggttcttcaaacacctgtccaaattctgctagcacttgttgaatttccacaggaatttgctccttgtttgaagattctgacagagtgcacaactgaatcaggtgagagatggcctgtctatccttcaactccaaaaactgttgagaagagagttgagaacactgttcagtttctgacaaaattccctgtaatgtaatggattcctttctccaggaaactgtcaagagcttgttaacccaatcgacctgcataggactatgagccatcaaccagtccatgcctaaaatcatgtcataacttcccagatttaacacctttaagtcagtataaaacacccatccttgggtcatccattcacaccttggtactgaagtaagacaagtaagtatggaaccgtttgctactttcacttgtactggtgg

SEQ ID NO: 62796 - DNA, 3362 bp, Oryza sativa
agcagcgggctacagatctgtagccagctacagcatggactccaagacataatgtgtgtatgaaaggtgggaccagatattaatagtataataagcaactattgtatgaattggctattgatgttttggagctactccctccgtttcacaatgtaagttattctagcattttccatattcatgttgatgctaatgaatctagatataatatctatctagattcattagcatcaatatgaatgtgggaaatgctaaaacgatttacattgtgagacggagaaagtagcagttagctatactattaaacttgctctgaagagaatagaaggagctaggcaggcacggtggatgaaatgcaattaatgcgccagcatatatcacatgtaatccgtggaacgtgtgttcacgatacaaatatttgcattggtcccggtcggaaacgaagcaaattgagtaaattttacaaaactacaggtattttgaccaagttatcacaaaactacagatttaaggagttgtatcacaaaactacacatttagcaccaaatttatcacaaaactgcggattttaggttaagtatcacaaaaatgcatatttaatattgaacttatcacaaaactacaacttttggagtttaaatccctagcaccattgttatggtggagctataaacattattactttgtgattaaattggttctaaacctatagttttatgataatttagttactaaatatgtagttttgtgacacttcatcttaaatatatagttttgtgataaatttggtattaaatatgtagttttgtgatacaccaagttaaatctgtagttttatgatagtttggtcatagtatccgtatttttgtgaaatttactcaagcaaatttaaacgtacaggtccagattacgtacgccgccagccaatccatcgagacgacacggtggcatgcagctcggcgcgcgttttgttgcgcgcgcgcacgtccgcgtgtgcactaaccatacgaccacctgttttgcccgaaagaagatcgagttatcaatgattgcccaaaagggaaacccgtgtgcttcatctttttcttttttggggctctcgaattatttctagaacagtataacctacctaaattggtcaaagaccaacaccggcgtgcaacagttctcgatcagacgtctctcctgcttttctcaaccctttaggagaccatgcatggctaatccatatctgctgctgccaagatcgatcatatatatcttcttatttgggttaacttgctaattaaatatccgtacttttgctacagataaaataaaaatatattaatgtcttatatacccatttttttatagggaatatttatcttagtttaattttgtatacggatatccatttagattttttaaaaaatattaagagctcaaggagtaacgtaaaatttataatgggaatagatgccaccatgcgcaacactaccagagagtggaagactaccgtgtacctcagttggttaccgagagtgttatatggaacacggtaacatttaaagtatatcgtgtgtgaacaaggaaaaactcgggaagtggctaaaaatgccgtgtgacgaatcgagaaacacggtaaagcgtgggacccacggtttctgccgttacgcgtgcggaataattggtctggcgcgcgggatcgccgttggcgcaggcggatggcgcgccaagatttccgttggcgcggccggctggcgcgcctgattttcgttgccgcgcgagtaacaggagaatcccgcgcgagttacagccgaaggcccacatgtcagcccaaaatagagaccaacaaaaccctagcccttttaatcgatcccctcacttccccaccccctgccgcctcattctcctcgccacttttcccctttctgatttttcccctctcttcttcgcacatggcaggatagctgtgcaccccagcgtcagtccgccgcacggccgccgagcaacgctgtgcattcttggccgtacgaactccctgcatgtccacgtccatctgctaggctccccttcgttgtccagcttgagcacacctcatcttccatccagctggtggtatgtatatgttgagttttttcttgaatcgtatgtaaagttgggtcttggttctagaaaacccatccattttctcccaggatctagaaatagttcggtgtatgatttctaggaactgtatctcattttaatttcttgtaataccacaagtaccatatgaataagttgttgtgctttgtaaataaaaacaatattagactacaaaatgatgtgggtgagagtccttgcacagtcagaataatgtgttttcatatttgtgtacttgttgatggatacatattggttaggaaaaacttgccctcttttcagaagacataatggtgagtgtgagtgtttgccacagccctacttgtttagatcgttgttgaatggttgaatcgggttggaatgacagcaccatgttgtgtgatgatctgcaatgctatggtgtactacatctttgtatcgacattttataataggcattattataccatgttgctactatgtagtttttgacctgtttaatataatactgcatatcttaattttgtagcaatatgcggcgattgagcttgggctgcagggaggattccaatccttcagatcaggctgtgagcgctgctaccttgccgagatgtagaacaaggtcctcaggttcccaacaacttgataattcttctgatttggatgagatattggctgacgaagaaacagacgaggaaatgttttttcgtggtcccacacggatgccaccgcgacctacccgagatgaggacaaacctgtgctgactccaaaaggagataggtaaatagggtaattttggtatgtttcattagtcgaaatatgaaggcttgatctgtttgttcattgatttgcacatgcaatggcaagctgacggagctcgtggctcctcaccgggagaccgcgcaggcccccctttgccagttcggccgggggcttagggtgaaatctcaagctctctcggtatgtggaaagatcgcgagctaggaagaaacgcgagacacgggcgatgtatacaggttcgggccgctgagaagcgtaataccctactcctgtgttttggtggatctgtgtatgagggagctacaaagtgtgagccaacctctcacttgttctaagttccgaatctggaaaagatcatccccctttccctatgggcaaggtcctccttttatacttcaaggggataccacatgcaccccttctctttccaaactggacttttcttctcttcataaatggacagatatttgcacgg

SEQ ID NO: 62797 - DNA, 2580 bp, Oryza sativa
gtagattacacatgttccctgagttcgatatccttttgcggtcacccgaaggtgaagtgctacagcggtattccgtgcgcttgcggatttatctgtggtcgtaagaaataccaacacatacaaaacggaaccgtggcggcaaaggggttggtagatacgacgaaccgcgaacggggggagtgaaccgggaatggttcacgaccaaaggagggagaggaaagaattattaattcaactcctgacattttaacttgacagtattacttcctctactctgtatattcctctgaacgtcctgttaatgatttaaagcaaagctaataccaaaaaaattctccctgaccattccaattattaaatgcattattaattagggtttcctcctagttaacagagttatatagttaacagagttatagatgattcaacaatgatttagaaactacgaaaaatggaaaaactccaggtgtgatagccgccaagtcaaccatagctagatgcacttgtgtgattatgatgaatataaagcaacaccggcttcgaccaacaggagtatggctattacctatcagataaggggcccgagcgtgtataaaaattcttgtctccatcttttttacttcaatctcgcatataccttggtaccgacaatctccatatcatgcaaataccatagtcgtgactaaaaagtcaacaattaggaaaaagtatagtccattttattccttgaatttcgctcgaaggttatttttcacccccgaaagttggttgtcacacccaaacttttaaaacaagataaaataacaccgtaaatcatatttcattgtagttttatttggtaaaatgaacttcaagctgttaattttcatggttgtgtaattaattaacatctacattaacaaaaatatgcataataagagtatgggatagaaaactgccgcatttcagataaaaacatcaggaatatgttataggatgtcactagtctttgataactgaggatgaaaaacaacctgcttgtattgaaaaactgaattttgaacaaagttcaaggcccaaaaaagggctttacccttgaaaaaaaaattacaataggaatagttagcatatttttttaacgatcctagaccagtggcttgctcctggtagctccctaccagttgagctatccactgtttctagtcagcatatttcatatgatatagaacatattttttagaaaaaagaaatataatctaggatgttatttattttattttgaaagttaaggatgaaaaataaccggtttgtaatttagggtgaaaaatatggactgtgaacaaaattcaacagtaaaaaatggcccaagaaaacatcaaagttacaatctgaaaaatcagaatattcatatgttataaaaataatttttaacaaattaatattacaatttgagtaggaaatttcggaaaaagcacaaaccaaaaacacacacagagacgaagaaatagccaatagctcactctttctcgaaagtgaaaactgaaaacccaaaagcccaaaaccctagctctggtgcccggctcggctaccccgtcgccaccgccgttcgtttcccaaattcacacaagccatggtgctaggcctctacgccttcgccgacatcgccgccgacggcgccccccacctcaactccgccgccggggaggagctcgtccgcgtcgagcgcgccgctgccgtcgccctcggctcccgcgcgccggagccccccgggaccctgttcatcaccaccaggtagtaaccgcgcttctcttcgttctccacttcccccaagtagttgcctctccattgcctctgacgcggcggagcgtgcgcgtgtgcttgtgtgttgagctaggagggtgatttgggtcagtgaggtggagaagggcaaggcctacgcggtggatttcctcgccgtctcgctccacgccgtctctcgcgatccggaggcgtactcctccccctgcatctacacgcaggtaatttctttcaactgtagtttgagatagcttggggggcgaacatttgtttgattttagagtattcacagggattggctgatcagctgtagggttttattagtgacatatttgagaaatttgtgcagcttgggtaatatataggatacattccctgtaattactactaatttagtgtttgaattagacttataatatggattggccatcatggtcatgttgttattcaattttatttcttaagttcgggtatctgtaattctgcattgttagcttttggttggggcttatggttcatgtgatgttagatatttttttattttgtttttttaatcaccagctattggtttcaacaaaacaaaaaaagaaaggaactaagtagctctaggaaagaaaaagcttgtgcgcttggagtttcaagtgcttcgggtccaactgagctacttctctttggagtttggaatatggcttggtcatgttttacacaatgtattgtctatagcacttatgaataatctttcatgataagttttatatattcattttattgcttatgtcgtgtatagtttctttggattacatt

SEQ ID NO: 62798 - DNA, 4478 bp, Oryza sativa
attcccccccggagttcaccacgccccggggcacggatcggttctgggccccttttggcgattttagccgacccgagcccccgagagtaggattgagcacgggtgacctatttcaagtcaagattcttcaaaaggaaacaaaagcatagacacagcctttaggaaatcgaaaatgcttttattgaaatacggaagagaaaaaaaaagaaaagcccccggccaaccctgcacgcccgaggggggtgcggggttggcccgagccaaaacctgacactcgacccccccctcaggggtagaagcgacgaaggtgttcgatattccacgggttaggcagctccgtgccgtcgcccgtggccagccgaacggagcccggccgggggacgccgatcactcgatacggatcctcccacattggtgagagcttgctcaatccagcacgcgtttggacgcggcgtaggacgaggtcgtcgacgtagagtgatcgggcccggacgtggcgctgatggtagcgccgcaggctctgctggtagcgcgcggctcgaagggccgcgcgccgccttcgctcttccaagtagccgaggtcagggggcgtcggcttccttctttttgtcgctcgcaggcctcccctttcgggtggcccgcggagcgccctcgacggcgaggacatgaccctcgtcgtcggtatgggctgacctcttcttcctcctcctgtcacgccgccctgtctgagcggcggatccgggggcggccgaagctgccactccggaaccggaggagttccaggtccaggcctcctccttgcgagccactcggtccgcgagctgaaaaagctctgcggtagtctggggctctttggaggcgatcttttcgagcatgcggttgtgccgcacaccccccctgaacgcgtagatcaccgcgtgtgcagggatgcatggtatggtattgcggacttggcaaaaccgctgaatgtacgagcgaagtgactcatcatcccctcgctgtaccgcgtgcaagtccgcttcttcgcctgggcgcggataagtgccttgaaagttcatagtgaactgtggcataaatcctcccaagagtggaccgacgcaggtggcaggttcactagccaaccccgcgcctgtcccttcagggccatgggaaagaaattcgccatgaccctgtcatcacccccagcggcctcaatcccagtcgtatagacctggagaaactcggtggggttgacgctcccgtcatacttctcagtgatggtgggccggaaccttgggggccaacggacattccgaagactcgccacaaaggctctacagctgacaccaccagccgggggcacggagggctggtcctcacgtccatgtcgaggtgacactctggacgaagaggcgccctccgttgcgcggggagtacgccggctattacgccggcgctcgatgtcgaggcgagcatccggctctccatgctgatcctcccgagtcggaggtgccgacgagggagtggcagccgaatggcgtgcaacagccgccgctcgccgcgccctccgccttgacgacacggagccggtagtggcggcgccggaggtcttggtggtggcggaccgtccaccagcacccaggcgctgctgtgccgtcatgaccaagttggccacgtcgtctagccatcgctgggctggagactccgggtcagggacgacgggcgggtgacgtaggagcgcgccaacagcctgaagcgcgccctgaggcgtgctgccgtcgccgtagacgaggaggcgacgctccccatctcgccgttctcctgcatcacccgcgactggcgatgctgcggatttttcgaccctctcgagcgcctccccctgcttaggattttggtgtggaggaggtgggggagtacgagctcgacggcgtgggtttggctccccgtcgtcgccgctcacactcggagagaggtcgtgcacctttgcttgctcggccattaggctgaacaagaaaaacttggcgcacacggaggagtacgagagctcagaaaacacacgctgagccccctacctggcgcgccagatgacggagctcgtggctcctcaccgggagaccgcgcaggcccccctttgccagttcggccgggggcttagggtgaaatctcaagctctctcggtatgtggaaagatcgcgagctaggaagaaacgcgagacacgggcgatgtatacaggttcgggccgctgagaagcgtaataccctactcctgtgttttggtggatctgtgtatgagggagctacaaagtgtgagccaacctctcacttgttctaagttccgaatctggaaaagatcatccccctttccctatgggcaaggtcctccttttatacttcaaggggataccacatgcacccctctctttccaaactggacttttcttctcttcataaatggacggagatttgcacggttgtcctccgaacatccttctgacgggacggcacacacctacctccacttctgccgaaggcaggcgcgtcgtgggaacgtggctgtctgccgacgacatgaccagtgtcagaccggtcattcttgtcctccacgcgtcagttcaacaatctgcatgttcgcccttcttcatacaacatataggctgtaatggttgggatggagcctggtataaatctaaccagggctaacgtgccatctctaagagattacacgctagctctggcttgagacgagtgcctagaggctttcgtcttgacgggatggggcaaggcgtgcgtcagaccgccagtcgccacctaacccgtgatctgaccggtctgtgaccggtcacagaccggataaaggaacgcgctgcactgcgctgcatgcagcgtgacacgcttgaccagacttacaataaatgcggttaggtgagcactgccgtgttcacctatcccatatatgtggcgcaaacttcctcgaggggtcggggtgcctcggccctcggggccggggcaggagtaacccgaccccccctcgggggaaatcaggaggagggcggacacctcaccctcgggcccgacgtccccgaaggtgccaggccgcatgggcgattgtgtctgcctcaagcctctggtcacgatactcccggtcccatatcaccgacagtagcccccggcgttatgccagggcgatcgcccttctcaagggaagcggtcgggcgtgacgccactcctaaggcctggtgacaggtggggccggtctctacagttgccgtcgaactacatcacccagtgggcggtgtgaggcagctgcgatgggcccaagctggcctcgggggttgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaatcacagtgacccgatgcgcctggaaataatggcgcagtttcctcgaggccatcagaatagcgtaaagcatcctctgggcctgagggtatcgggtcttggcgtcccggagggcctcactaacaaagtagacaggccgctgcacctttcggcggggccgatcctcttcgccaggggccgcatccccggggcgttcttcgtccaagtggcctctcggggcgcactcgtcttctgtgccgatgacctcggggtcggaggatggcaggagcggccttcccacagtggcctcggggccgtcctgggggtcgggggctcctggcgtcgtcggacaagcgggcaaagggccaactccggtcgtcaggggccttaggccaccgttcggctcgggggcctcttctccctgctctctcccggacagaatcccagcggtcgcacattacgcgcatcggcaagagaaaaccaaccgaaaataatgagcggccgctgggctcgtgtttgccttcaactccgacgaggaatgcggtgacgatggtacggacgaccgcgacggctaggccggctacccgggcgcgtcagagtgagcccccaggcccccttcttgtatagactgatttaatctgcaatcaaaagaggaaatttctatgtcaaatctatttgttgtgtgtatgagacgaggatggtctgtgccgcggtccttctgtgtcttagcttgaagtagggctcgtgcccaggtcccagcctcagatggcgcgggtcgaggctagtgcctggggagatccacatgtcgagactggccaggccgggagcgtggtgaccgagggttatgggtgacccgattgtgggtttttgccgattcccccccggagttcaccacgccccggggcacggctcggttctgggccccttttggcgattttagccgacccgagcccccgagagtaggattgagcacgggtgacctatttcaagtcaagattcttcaaaaggaaacaa

SEQ ID NO: 62799 - DNA, 2460 bp, Oryza sativa
tgtttgatctttgttgggatgaagtgcggttgctcgatggatcgtctcgagccgatgcagcgagctattttttttgttcgtgtagcctcaaaggtaccggttcctaaaccggcgtctttgaggacacctcaaaggtgctgactaataggtgctggttgggaaaccggcacctatagcccttttttagtagtggtatgtcacgtataaaaatactaaattttgaacaattatttttatatctcacaaatgaaatcgagtaatttggacaatatttttcacaacaaacatctcatctttatatgcaattaatttgtttggtgaatttaaatgactttttcgttggggttcacatgagtttccatctatttaaattgagtatccaccacatatttaccactttttctaaatgtctcggcacctatatctcctcttaactttacaatgtaatactcaagccctatttctctttaaccgtctcttgcaagaattagctctatgtaaactatgaactaaaataattaatgatcattgaaattggactcaaccattaaacatgcctccatgtttccttggattatttgggaccagactacataacgtggaaatggggggagtacctagctcgttctgacgacgcttggatctaccgctctatgtgacactgaggtggtctcccttgaagtgcttgtgctggactgctggctgggtacaatgcatccacgcaaaactctcctattttgcatccacgaaaaactctcctataaagttagaaaattttgataacatagattaatacgtgatatgatatgtcaccctcataaatatgagcaagttcacatttattaacttctacgtgttgaaaaaaaaaaacagggcgagtgcacgtataattagagtttattttttttctacaacttgttgcgatcgaaattgaacttgtatggttgtgaatgtttcccaagttacaaatcacatgttaatttatcttattatgttagaaaaatcatagctcttcgtattcccctcgaacgattagaatcggtgtcctgacccatgcatgcatggttcagcgaagctgcgggaggacacagagaggcatttgctggacggcaagctcagggtggcggtcgcatccaaggccagttaacccggtgattattactaatataataacgaacttggcactaatctaatcagaaacggcaactgggttgagctatagctagctagctagcgagcagagttaacccaacttgcacgattagacccccagcatccccgaccgagaccacgtgaagtttcccgttgcaaactaacacatgcggtacgctatgtacacgagtaggggtagtgtggcaatattgttcttatcaagcctgacagtctgacaccgccgagttaaaaaaaacgcgaggaagatgacaacgcttggaacatgggtcttctgtatcctcttgtataatttagccggtctccgatccggtctctccaagcagatcatctcatagccgcctataaaacgtgtacacaaactccgaattaatcgatcaatcaatcagtgagccacaaacgcctataagctgtagctgaaatcttgatctgtgtagctccatggagtcggccatgaggaggaagatggccgtggtggtgatgtcggtgttgatgatggcggcggcggcggcggcgaactacgcggcggagccggaggaggactgcgcgacgcagacgacctacttcaccaactgcctgaggcgcgggatcagggaaggctgctgcggggtggtgaagaaccactggtgcctgtgccaggtgaagcgggaggcggaggtgaaatgcatccccgggcgccgctgcgacgtgcccaaggccctcaagatcgccgacatggacctcccctgcatgagaaacctcaggtgcagcaagcacgcctgatataaccaaatctgctacgctatatccaacttaattagatgcctactgcctccaagttatgttactctgtttgttactgcatcctatgttttttttctagatgattttgttgaagcaatcaatcccaacctgatgtatactgctcattgtcctatatattattattatggtcggctccggatctcatattcacgatatattctaaatttgtattatttaattatagtggtttagaattttaaattttatttaaaaaataatgatttatccaaatgttatcgacgaaatcgtagatctagatcaagaatttatggggctagaaatagccagctacaaataatcttggatcagttgtacaaaagagagcctcaatcgatcagttaaaaggagctaaccacagaccttaaccttcatggtgtattatatttgcttttccaaatccaatttaaatacccaggcaacgattgaagataactcacaacccctctagaactggaaagctagtggatgaagcagccgcagagtgat

SEQ ID NO: 62800 - DNA, 5897 bp, Oryza sativa
gggagtagtatttgttttcttgataggactggtcagaccggggtttgtgtactgttcagaccaaacaaaatattgtgaatagtgtttacaatgaacaggtttttttttgtcgtgtgaagctcttcagaccgaaatgcaacgtgcagtcagaccggctagcccaacggtctgaccggcataattatataattatgattagagtcggtttcgagttgtttattttgatactagtgattatctcgtggttatgacttctagataatttatatacgtgtgtaacattgttttgtgataatgttgagtcacgctatgaaaaaatttgtgctcggatattgtttcttgtttgattcatatgtaggtgtgtcttgatgcttcagaagagtattgccagtgatggattaggagtcaacttgagagaatatggcgttcagacgatcaagatatcatgcgggatgcttaggctaaagaacagtgcacgtgattagtgaagatttcatgtggcttacaagaggaggttgtgtgcatatggatgaggagttgaatttcgagggagtccaaatttttgacaattggagttagaagagttggatacttgtatgggaaggtttctgaatgcattagaagtactgctacgagttggaacgtggcattcgtacagccatctctggatataaatagaagaggggttgatgtctttgggtatcgattttggagtgagttgagttgagtgaatagttagggttttaagtttactcgaattttgagagagtgaagttgttgcactttgtgacacgaatagaagcaataaaggtatatctattttcaagagttctttaatttgtgtttgctcgtgttcagcagttacatcggcaagcatatagcggttagaccggcgactattcggcggttagaccggcggcttcctagcggtgtgactaacaacatcaggcgacatcaacgaaggcaaggaagttggaccggagatacaccatcggtcggactgatggtatcctggcggtcagatcaccgcatctacaccggtcaaaccgttctccatcaagtttgaaggtaacttttaattccgctaaaagtgttcttaattccgctaaaagtgttcggttctttatgttctactatttaatcctctttggtaggcttagttcttgttattcgatcctacgtaaacaaaaaagatataacgattggttgtcctagattacatgcaacattcactagtacaaaagtgatttttgcagatagcccaaaagaggttttcgcatgcagtagggcagcccgcatgctctggagagtctgcaaaaattgctatctttgcatattggggcattttcgcgtgtgagtgcttatgtcgtctgcatgcaaaaataaaaatcgcaaaaaaaaccaaaactctagcatcccagtggcggcgactacggcagcggatagccggattgagctgcctcctcctcctcccggccacctactcctcctccttgtcggcggcacacggcaggggacggggatggcgccactcccagtcgttgcctcgccggtggctgtggcgccgctgttggtatttcttaacaacattaatagaaatataattcccagcaatggcgtagaaatattcatggtatactatagttacatatcatatccacaagcgcatggatataccattgtagcatttcacctgagagtattccaagggtatcgtatttatttaatcccgagggaagatttataagagagaactatgctaataatttatatggtacttgtaatagtcagtccaaacaggagttaatttaattcatgggtatagtgacacgaagcagaagaactaaacactctcatacatactaatgctagactaagtggagaaataataataaaaggattcattcctatacctctattataaatacaactttagtctataatttctagtatacaatcatacagttaataccccctttacaatgccctcctggtgcttcgagaaaccacccctgattatcgagttcgttacaacaatccgtcatggccatccaactggtactaaatacggaggagtaccctccctaggaatataacttaggattatctactaatgtggaggaatacctgatgaggacatcaacaccaacgatacatccatgcctccacaagtacaacttcatggtcctactacacgcgctcatgcacgtcaaatcaactatcaagtacatttactcttaaattcatatgattcttatttatatcccggagacacgtacacttttgttttactcaggaaagtggagaggatcaaacggggagaggattcggggggatggattcggactgcagcacaacaccaacttctgacggccgccacaacttcatgcgaactccgatttgggtgtgcaagtacttcatggaaatcttgtcaagtatactttcaaatggatccagcctcatgtccatatcagttctggagcggccgcaatcttcgttttactaccgagtccttttctgtccacagtgctgcgtcacctctttgggtccaatgggccgtgtatcttgttgggtccattagagacgcgtcctagggttagagaacgaccccagcacccctgtggtcatcctcttcctcttcttacagctttctccgctgccaagaataatcgggttttgtttagatcaaagtgtagcatcgctactttgccgagttgatcccgtgatcgattagatcgccggattgcttgttactgaaccccacttgttactactgttgattcaatccaatatctttgattcgcaaattgagttgcttgttcatcttgttcttgctgattctcgattgcttgcaggaacaaataccctcgtggttgggttgatcgtgcatccgtcgagattcacggccgcctttggagttggtgtaacgattgctaaggcacaacatccttggatagttgtagtcggatcgccaacatcgcttcatccaatcgacttatccctctcatcgaaagatcgggacacactcgcgcacatcaatacccatactgagttgtcaccatcagcggtccacctttactgttccgcagcatataaacccaaataatgctattcaataatctaagaaccacgcttaaattactaaataatactctacaatcatcgtcacaacttagagtagtcattaacatgatcattatacccacaccaatgcatatcatgggtaggttagctgtacaattataacaagataaatatatcgtcaagtcggtacttgaatgattaggataaaataaagtaccacaattgtatatagaagaatattccataaatcgtacaatccttacaagagaaggaaaagctactagagccatacccaaactcttccgaaaactccgaggactaaggaaactattttattcctactccactagctctagaatactaactaaacttgagagagagctttgatcttcttgcttgagtatgtgttggagtggagaatgagctcctccttaaataggctgccaatgacggttgtgacggttagaaatgtcctaactgcgctgcaaccgtcattgaagagtgatctaaagcatccacgtggaaggccaggatgggtggcctcggctagggttcggccgaacctaagctggcccattcggccttcatttttagcaggtggattccttgttgggctttgttcccaatggcatgagagttgtgcttgtttgcacgtgttaactttgtgttgtcagcccatctattcagaagtctgccactcgacggacgacaattgattgtttgattattttccatcgatcttcctccattttatgtagcaaactctgcaagcaaataatatccaagtacaagtggaaatagattattctaaaacaaatatgtattgcaagcatagctagctctcctttattttagtaatattgactgtcgaaattggtctataacgaccgtcaatagccgccaccgccccctcccgtacgtcgcttgctcccagccgtgctcgtccttgtcggcagcggtgccaagctgccgccgtccgccgcccgccatcgtcacccgccacccccactgtcgttgtcgtcgtcgccgtaggatccgccgccggtcgctcccgctgtcgtgaggaagagagagagaggaggtgagaatgaaaggaggggaggaagtgagaagaagataagggagagagaaactcagagataaggtttcaattgtttttgaatatgatgaaaaggaaagaggatgtagctcagacttctgtgcggacctttaagaggcctgtctacgaaaatatattttcttgtgcagtcgcttaagaggcccgtctgaaaaaatagccctattttcctgtgcggctgcttaagagggccgtatgcgaaaatatattttcgtatatgggtctcttaaggagccgtatgcgaaaatgagggtcgatgtttgcagacacgtatacttacgttccgtctgcaacctattgaggtgctcgtccagataaataatttgcgtagtagtgattatgaagatggagcaatgggaaaggtagagttggatgtaatgcagcgcgcgttggatgtaattaacgtcaacgagattggatcagggaacaatgacgacagataaaatagttaattactgtttacttgctatatacgttcgttccaatgcccatccaaagggacatcttccatactgttttgtttctcggtcctctgtttaatttctccaaaatccttctttattcgtgtgtgatttttagatcctatgtttcaaagtgtcctacaagattgtagaccaaattggcataatcagataaattctgattcactcgcaacttcaggaagaaccacaatgctgattcaaggctctgaaaatcatagttgctcacgtgcactccgctgaactatgataatgatctgatgttgtgcatctcgcagcattattgctcacccacatcacatagacctttgacacatattgatattgtattgctctgcgccccatcgatcattactccaatagaacatattctcgtgaacatactagccgactaaggctcaaacataataatcaataagcattagccaggatcccaagataagtgccgtttcttaatgaaacatttgcatgtgcactcttaccagcctatagcacaatctcgcagatatgttccatggaacataggaaaatatacagtgaaaagtgaaaaccagaacttaggtttaaactcgtgtaaactccatttaaaaattcatctaatttcaccaaaagtaatcacacatgtagataattaagatgatgttagagaaaatcctgtccaaacactaaactctccacttcttaataaaactcatagagatcggcactataggtctcaaaacagttaagactaacacctatagtgtttgttcctcctccgtaggctgaaaacacataaaaccaacacctttaaacaactataggtgccggttctaaagaaaaaccagcacctatagtactataggtgtcggtttttttaaaaaagggtacctataatttattataggtgtcggttataggttttagttttctaaaaaaacggtacctataccgagctgagccagtgagccgatcaagcgccggccttatccatcgtatgcatgcctcccatccttatcttatcccttaatttgcaccccccccccctctccctctctctctcgctgtctctgattcaccgtctgtctctcgctctctttgtctctctcgctctctctatctctctctcacctctctctctctcccttgctctctctcgcttgtctcggcggcaatctggcggaggcagcaccggtggcgaccacgcccttccttctgctagatccggccagagggga

SEQ ID NO: 62801 - DNA, 9426 bp, Oryza sativa
  unsure (1)..(9426): unsure at all n locations
gaccccccctcgggggaaatcaggaggagggcggacacctcaccctcgggcccgacgtccccgaaggtgccaggccgcatgggcgattgtgtctgcctcaagcctctggtcacgatactcccggtcccatatcaccgacacaagctaatgattttgggggcaacattcgggtccccactggcatcctgaccgtgcttattaagcattttttccctggcattgtcaagtttaaaggaagagatgagccagcatggagttggaaacattacaggattgcaccagacgatccagaaagcgctgtactgaatcgcttgccaagccgtctccatcgtgttgaggaagatttctgggtttgttttagagcattaccttctccaatatgaagtacactatgcattttattgtgtcttcagttttcatagtttacggccaatttgtactgtacaatagtaaagtatcttaataccacacttttcaatgtcaagcaggctaactttttgtagttgcagctttactttaggtgggcagagggaatggaacaagctgctagaaaggttgtccgcaattgtatcaagcgccttttttcggacctgatttatgaaactcgtatcatggccgtgctcaattaccaaaggaagatcttaaaggtagaaacttctcgggatattgcttgcaggacatatctaatagaggaagagtacctacaggtgctatggttgttcattgataatttgttgtcatctactgatcatattagtaattaataaatctgtgcttctcctataggtagaaccatggtggttcctaaaggcaaaaaatgcgtggcgggagttgatacgattgaagtggtgtaatcctgaatggtaggctagctcacatgctcatangatacggagggagaaaatgacatggccatctcaccgccaaggcagtgctaacttgagtcgtttccaaaaaaatttggtatgtgcatctatgttgaaacatgtagcagatcatgcacagcagatcatggtataatatatatggtacccatgttctgttttaggagaagagaaaaggcaggtagtgtctcaaatggaggcctacacagaaggaaggggggaatatggagaggatggacgattcagatgtaacacacatgtaactgggaagcttgtaattgctgaatatttagtggtagtttatcatttgtgcatgagtactaatacactatttgatctgactgtaggaggcctataatgaagcttatgttcagctgcatggagcaggaagtgattggcgcaattctcccattgatccaatggctgtgcacatggctggtggtggaaagaaacatggtcgattcatgatcggtgatgggctcattgactcatcagcaatctttggtgacagttcacttgatgatccacgtcctcgcagaagactgcgaacaaatcttgacaacacaaaccaaattgaagaccttgagcggcaactacaagaggagcgcgaggcaagggaacgagagcgtgaagaaagggagcgtgagaaggagagggagcggcaggagcgggagcaggagaaagagcgtgagtgtgaagagagggcacgggagaaggagcaggatagaaaggagagggagctggagcgcaaggaaagggagttggaaaagatagcgtttgaacagaaatcatcgttctttgaagttgctttaagagtaagtggttatgggatccatctagtagtgttttcattatttgagggcttgaattctgtgatggtcgcactaactagtgtacatgtgaaatggattgcaggctatacaacttaagctgaacattgacttaccttcagcctcaggtcctcctcccttgcctgtcatgttgactaacccagtaagtatttgatacatggtagtgtaggtgtgcatgaagtaattgttccccatataacttatgaggactaatattaaccattttgtttgtaacataaaacaggctttgtccgtatcttcggctctgaatggaaactcattttgtgctgaccatggaggggctgctattgtttctggtgcaattttgatggttcagcttgacgcagcgagcgcaatctgaagataattatgactttgctactgctggaaagaatggactagttctacatgcctggaacatgtggatgtgttttgtaattaaactgacctagatggtcatggccatgaacctgagtagctgttggttgtggctgttgcctttagtcttttgttcttagttatatacgtttactttcctaaggggttgcatgaacctgagtccatattcggactctagtagctatttcggtgtgcatgttgccttaggtacttttggtcatagatgttactgtgctctggagtttgtgaactggaagtttggtacttttggttggaaatgttggcattcagtggaacttatcaacttggaacttatgtggtgtggcagtggccactgtccagatataactcacgcgttcagcaaaactgatgactgatattatttcatattttggagtgaatgtctggcaacttatggaagggtcgcacaaattagtaacaaactaattgtgtttgttcattgtcaaccaaattatcactcaacgatgtttatatattatgaatgctttcaaattaatgccatatgaaaattttttaaataggagtcccaatctcaacagcatgacaacaagctgatatcttttttagttgaaagttagaaatgttcattgtttaaaaacattttaagacataaagctgaacatttcctaagaaaaacaggtttgaatatttggatagcttttagaaaaattaaagataaacgaaagttttctcttgaaatgtacgcaaataaattctgagatagacctctgaacaacacttttaatcaaaattataaatttgaataaatttgattaaattaattgaagaaataaattcttattatatacaacaaaccaaagtttaattcttaacgaagttaaaaaggaaatagtttttgtttagcaaaggcacttaatgcaaggatcaatcaaaatttagttcaaaagttctacaaatcataacagaatcaaaggaattgttaactaattttaataacacgcactccctccgattcatattatatctcgctttgactattttgtagtcaattttttaggtgttgaataagtttgtagaaaaatttagctacatctacaaaaacaaatttgtttgataatatgttggttttatgtaaaaaaatgttgctatgttttttataatcttattcaaaacttaactactttttttaatcacctcatatttttctcattgtcacacgggtcgtcctgcgtgacgcggtccttacggtgcgccgggtggtgaaggcgaggacgggacgggcgtcagacaggtggacgaggtgccgcggcgagggagatgggttgcgcggcgagggcagagcttgcgtccacggcgtccacggcgaggaaccggatggtgttcaccgactgctccaccgccgccggctgctgcgcgtggagggcagtcggccgtcggcggccgacggcaaggcatttttgacatgaaacaatggcgacgttcgcattcccgactacgtccgttcctcttcttcttccttggttaaggccaagtaggcagaggacgagcgggcacgcggcatcaatctttagaatatgagtggaagcgaaaatcatggaatttagatgaaagcatgttcattttgctagtttaaaaaaattgaccaacaaaaagtcaagacgagtaatataaaacatagtgagtattttttttagctatttcacattgtattgggaccaaacgaaatttagtacaaaatttcagtttgcaatccacatgtaaatagttcagttcgaaatttagttcaaaattttggtttatcaaaggcaaatatatttagtttagaattccacaccaaatacagatttgtagagaaaaaaggacgaacagggtagtttgcattcctaatcttatcgtgtgttttggttagaaaacaatacagtaacgctcgtggtccacatgtcagaaatacatcgcggcaaaattctcgcaagcgcgcggcaaggtcgccaaaaatctggtgggtgtggctaggtcaccaaaatccccaatctctctatccacctctcatcccaatcaacccaccacatcgcgccgccgtccaaggccgccgccgccgcgccgcgtcccatccaaggccgccgccgccgcgccacgtcccgtcaaggcgaaaccgccgtgccgcagccagtccaggccgccgccaccgcgcaccctatccaagcccacgacgtcgccccgcgcccatccatttgctgtcggtcgagtacgagaccccagcccgcatgcgcaccaccgtgccggcgccaccagtcgccacgcacggcagaggattggctgctcttccagcaaccctccctaggactgattcgtctcaggtgctgttgtcttgctcccggaatcctcattcggccttcaagtttcatcatctttttgattagtgaccagttctagaatttactagtcaggttgcggttgtactaagggattgcagaactaggttgttatgccatgtgaaagtttgtgtgattgatgatctgaactaatgtttgatattttatttctcagtcatacaaactaaactaggcctttcttattcttgaacctttcatgaatagaaggacatttcctaacataaatttattctgtcactttgtcataactaagtacaatggaaactgatcgcagttggatgtacaagggccgttgaaagcgtggcgaggttaccgctgagtggatatcaaagactacataatttcttgacaaggcattcagcagggagacaggacgtgctggtgtgttgtgtccatgtaactactgcaacaacacacgtcctcaaacaagagatatgatgatgaaacacctttgcaaatttggtttcaggccagcatatactgtgtgggtgtatcatggtgagacatatcctgcacgtgaaagcgatatatgccaaagcactgaagatgaagatagggtggcagagattgatcggatggatgagatgatagatgatgtccatgatgattatgtctcagttgaggaggaagatccagagcctacagcgcaagctttttttcaaatgctgtctgcagcaactcaacctctccacgaacacacacaggtatcacaacttgatgctatcacacgactactagctgtcaagtctcaatatgctatatcaattgctggatttgatgcacttttaaatgtgatatgtgctctcctcccacaagggcacaaactaccagcaaacttgtatgaggcaaagaaagttcttagtgcattgaacatgccatatgagaagatagatgcatgccctaaaaattgcatgctctttaggaaagagaatacgcagaagacacactgtgataattgtggagagagtaggtatgtggaggttgaagacagtaatggtcacaagaaacaattaactgttgccaagaaggtacttcgttatcttccattcatcccaagaattcagcggctgtacatgtctgaatcgcaggccaagcaaatgacatggcacaagaatggtcatcggtaccatactgacaagattgtacacccagctgatggtgaagcctggaagaaatttgatagggacttcacaggcttttcaatggaagcccgcaatgttagaatagcaatagcaacagacgggttctgtccatttggtatgggttcttcttcgtacacttgctggcctatgtttgtcattcctttaaaccttccacctggtgtttgcatgcgccagcacatcatgttccttaccttgataattcctgggccaaattatcctagcaaacacattagtgtattcatggaatccttagttgatgaacttatacatgcttggcagcaaggtgtgttgacatatgatcgtgccaccaagacgaatttcatcatgcgagtctcatttctttattctatccatgaccttccagcatatggtatattttccggttggtgtgtgcatggaaagatgccatgcccaacatgtatggaggcactccaaggaaaaaggttgaagtttggtggaaagtactcattctttgattgtcatcgccagttcctcccaattgatcatagctttagaagtgattcaaattcttttctatcaaacactacagttagcaatgaaccacctcttcgtctctcaggtcaagagatccgtgcccggttagataaccttgtccctgctgctaatggagataagtttgtaggctatggcaaggatcaccattggacacatatatttagtttgtagagactcccgtactttcacaaactagtacttcctcataacatcgatgtcatgcacaatgaaaagaatgtcgctgaggcaattttcaatacttgctttgacattccagaccaaacgaaggacaatgtcaaggctcgccttgatcaagcagcactttgtaacagacctgaattgaacctcggccacatgcatgcgtgtagtgagtgggttaagccgagagctgactctcgcttgaatagagctcataagaaggaattatttcaatggcatcacatattgacattccctgctggctatggattgaacctagagagacgtgtgaattcgtacaccatgcggatcaatgggttaaaaggccatgattaccacattatgatggaacgtttctttccagtgctgttccgtggatacttgccaactcatgtgtgggaagtgttggcagaggtaagcttcttttatcgcaaactttgcgcaaaacagtttgatcctatatagatggcaaacatgcagtctcaagtaattgttttggtttgcaaattagaaaagatctttccacttggattttttaatccaatgcaacacttaatgatccacttaccatatgaagctagcatgggtggacctgtgcaatttagatggaattaccccattgaaagaggccaaaagtatcttaagagcaaggttagaaaccgagcacgtgttgaagcatccatagcagaggcttacatactagatgaaatctcaaacttcacatccatatactttgctaatcaagtgcagacaattcacaatcctgttcctcgatacaatgttgctactcagtctattgattgttccctaaatctattctttattaggggggattctactagccgtggagtccctcgacacctaactcgtgaagagtggaatgctgccatgttgtatgtgcttacaaaccttactgaagtggatgactacattgggtatgaactatgaaattgatatgagttacttctagttcatagctgcatataattttactttaaatcattgtgtgcatttttatcttgcaggaaattcatagatgaggaatggactagacgaggtatcccaacaaggcaacaacaagagaatatcttacggaatggtgctgggagagatcgtcctaatttcgtatcttggttctatcaacaagtaatttctttagcccagactttacttatattatacacttagctatgcatatcctttcagatcagattaggaaatctatctagcttagttcgatgtaatatcttgcatgtgtatacatactttcctaactgttgaacattaagttctttcatgaatgttcctgcaacctaggtaatccccatcaaaccaataaagtattactgctaaaactctaaatttggtgacttcttatatcagtgctataaatttggtcctacaacagtaaagcacatttggattagtgcaagttcctagtatgcatctgcctttttcatagtacaatccgagttaatttttttacaagcattatgaaaatagtactgaacatgtatgtacatgtcattaatatggagacacttctcaattgatcatctgttaggtcggaaatctggaaagaataaaatcattgccaatttctactaacaaaaagaacctagccaattaataacttgataacttcagttttgaaattcgatacctcaataatcaatagtgccttcttccattttctttttgttttcattagtttgcagtttaacacctgttaattgcatttgtgtcaataacctaataatacttgtgtttttctataacataaccttcaatattgccataatagaacattatgccacaatttattgacacattatttcctttcatttcactgctagagtatgtttagacgaaactatgagtgatgatttgagacaagtaactaaaggatgccacactcgagtcttgcaatataatatgtatgatgtgaatgggtatcgattccgaacacacaaatatgaacatgagaggccaaatgcaactacaataaatagtggtttggtgactataggatagggagaaaatagtgacacaactgagtattatggtacatcaaagaaatagtagaaatcagctttgatggcagaaaacctctcacacttgtgctcttcaattgccattggtttgacccaagcaaagtgaggatacaccaagatatggtctggttgaggttgctcatgcgtcaatccttccaaaattcgaaccatttgttttgtctcatcaagcgacacaggtgtattacatgccgacccatgtaaatttgtgcaagacctcactaattggtgggttgtgtataaggtgcagccaattggtagactacaagtacccaatgatcaagattacaattctgttcctaatagcaatgttgtccactatttccaagaagatggtctgtttggcagttttgtaatcgatcttggtcaagaactcaacaatgatcctgagcaagttgccatcagcagggatactgaagatatttgcaatgacaaggacttgaagcttctcaatggatcatctattcaagatgaagatgatgatgacgaggatgatgaatcttattgcacttcctcatctgctgaagatgatgaagttcccactagtagggatatcttatttgacgaatatttctaaggtacattattcttttttttatggagactataatgccaattttttatatcctgtgcctccccaaatgaatatttcctttgtcaactatgcacaagaattaatctttcataaactggttgcgtgctgtaataatatttggcagtcatcttactttcgtaaaatttcaggcatacaattggatcattgcaaaggattgcagttgattggtgctgtcaatacacaaatttggagttggttactcactagcctctaacatttctctattgcctccctaggagaggttgcaagaactgagactcaccttgttactattgcattatagccacttcagacaaccattgatattgggtttttgtatcattggattcaaaaattaatactgggataatat

SEQ ID NO: 62802 - DNA, 9506 bp, Oryza sativa
attcctgcagccctccgttccgtgcatgacgtgccgttaactggaaagttaccggcagggtgttttcacacggtaagctttcagcacatcctgagttcgcaagcagtttctcacgggtagagtgacacggtaaaggtgaaaggctgccgagtacaccttcccgagagtttgctcacaagaacgacgttaccgtgagttttagccctgttaccgagttgtttaggcacacggtagacttccgttccctggtagtgcaactaccttcttttaaatagatatataaaactctcgaataactcaatgcccatgtaatcgatcatgtatacgttgcttttttttgtggaaagaagatagtaccttatttagggagaagcgaattataccaactctaacgtcccaaattaatttatcttcttaaatatttcgcagataatttcagtgttaaatgaaaaatggctgcttccattgtgagaatcattaaagtgagtcgtatgctgtatgcatgggatgagccaaaatccctttcatgtgtccagccgactatgaatattatagagacccttcaattcaaattgcatgcctccttggtaacaagccgcaccacatgcatcgatatatcgtttttgcgtagttggccggggtgggaattgtagcatgccgactttttggggcattaatacaagatatatctagcttagttttaacaaaaaaaaacaatagcaaaattatcctagaaagtaatgtgcaaacaataatattcaagggacaatgagctgttgttgactttgttagggatcgatcattctggcgagtatattccagggatagttaattttgtcaaaaagattccatttaaatcttatgagaaattttacggactaaaaatattggtgcctcaaggtatacagtatctggataattttactttataaaatatcatatgttatttcacaacgttatcaaaatctttgtgatggtagccatgaaaataaacaagttaaattggatagagtgtttatttaccagcctcaggttcatgcgcaattttagtttacgtgcttttgcttatacgaacgttgcacccaccgtagtagttctgttcggcacgaccgagtttgcgaaaaatgctggaatgtacaattcaaccgtggtgttgttttgtggagttcctttttttttctaatcaatagtgcaatttttgttttaaaagaaatcagcactttatttaatactttctccgtcataaaatataaaggattttgattttgggttttggttttggtttacgctagtcttgtgtaactagttgctggaaaaatgctgatagccggtgcaacattttcgcaagggaaactggaaactttttgagttacggctgacacataagagtagtggagtgtcgttgactaactcgatggtcaccaagcagatggcatatgtcggagcaaggtctagcaaatctatccatagttgaagaacttcaccatctccttcgatctgcaaaaaaaggagaaaggaaagacatacaaggctacaacggaattcactcgactatgagacaaacccgtccagcctccagaccgcccttcccttgtctgtgaccaacggccatcgcagacaaagaggagatgggatttggcaagggaaaaaagaacacttggagttatctttcatagaagcactcacaaagagatagaaagaaagttgtcatgaatatagctaattaagaccggttaattttgggctacaatgactatacgatacgatagtggataagttgaagatctaaattgatattcatgtactccctctgttttaaattaaaaaacctaaagttttatctcagatatctaaattagtagtactagattaagttcaatccgaacatatattaatttattttagaatgaaaagattatagaaggacaatattgtaaagtaagatatttatactgtccttccatacttgtgacgtgagaaggaaccaaatttatactctgcaatccccaatactgagactgagcacacacccacacctgccacgtgtccctggttgggtgatcgaacactagcccaaactgccagaaatacacaaagtttctccccaaaaatagctgaaaagaaaaatcctggggccacatgtcgcggcgtcgcgcctcccacggcatcctcccgcgcactctacgtctctactggtgttcctatatataccgccacgtctcgtcttcccccgcctccaattccaacctagcaagcgatgcgacctgccttctcctccctttcggcctcgccttccttccttgcgactcaggtcattcttccgaacaccatccccgccttgaaaagctctcgaccaggatcgatcgatcgccatgggcagcggccacaggaagctcatccacttgctccgcgccgagcaggcggcggcggcggcctcggcggcgtcggcgtcgttctcgcccaagtctttctcgtcgtcctccgcctccgacgacgacgggtgtagctcgtcgtcgtggcagacgaacgacggcgccggtgggtacgggtccgcggcctcgtcgccgtcgcggtgcagcgcgtcgacgccgcccaagtcgccgtgggcggcgcacctgccggggcttggcggcggcggggtggggacgggcgccggcgccaccgggctcgtcgcgtcgctggtgaaggaggacgggcacgtgtactcgctggcggcggcgggggacgtgctctacaccggcacggactccgagaacgtgcgggtgtggcgcgaccgccgcgagctcgccgggtttaggaccgggagcgggctggtcaaggccatcgtcgtcgccgacgacgggcgcatcttcacggggcaccaggacggcaaggtccgggtgtggcgcgccgacgcgggggaccccgccgtgcaccgccgcgtcggctcgctcccgaggctcgccgactacgtccggagctccgtcaacccgtccagctacgtcgagacgccgcggcgccgccgcgggcggcgccgggaggtgtggctccggcactccgacgccgtgtcgtgcctcagcctcgacgagggcgccgggctgctctactccgcctcctgggacgggtccttcaaggtgtggcgcgtatcggactcgaggtgcctcgagtcggtgtgcgcccacgacgacgccatcaacaccgtcgccgccgccgggttcgacggcgtcgtgttcaccggctccgccgacggcaccgtcaaggtgtggcggcgggaggaggagccggcggcgagtggcggcgaggcgaagacgaggcacgtcctggagacggtgctgcgggaggacgagagcgcagtcaccgccatcgccgtctcggccgagggccgcgtcgtgtacgtcggttcgtcggacggggacgtgacctactggcactggatcgacggcgaggcgaggtacggcggcgcgctcagggcgcacgggacggcggtgatgtgcctcgccgtcgccgggaacgtcgtcgtgagcggctcggccgaccggacgctctgcgcgtggcggcgcggcggcggcgagcactcccggctcgccgtgctcgccggccacaccggccccgtcaagtgcgtggccgtggacgaggaggagacatcatcgtgcagctccgacggcgagcggcggttcgtggtgtacagcggcagcctcgacgggtcagtcaaggtgtggcgaatctccgacatcgaacctaccaatcctccgccgcggctgccgtcgccgcatgtatggaagagagaggatcagccggcggcggcgacggcggcggcggcgagggcgtggtcgccgtaccagacgtcggagatgaacagcgtggcagcggcgtgacggcgaggctagagctgatcactaacttgacacaaacgtgcgtgcatgcaagaacagtgtggggctcacacgtgtactgtagcagaagagtgtaaatatacgtagaatatacggtgcctgtacgtagattacgtatttgtcaaatgtatggatgcgaatgggtggcttggtcggagataccattttggtaggaggaatgggcggttagttgacagcgagaggtctaccagccacgtcaaaaaccaataatggaagggaaaaaaataaaagggagaaggttttgggaatggctttgttttgttgattttggtagtgatttaattaacgctctgtgtaagatgtacagatgtatataataatataaaagccaccatattaattttgatgtatgaatatattattaacagttcggttttggtggcaatcctcacctttaatctgttactacttctcttcagtcatctgtagtagcatcaaaggacagcagcatgcatgtattcttccctaaattaatcaggaatatatatggcggttcatcgtaattaaaagtcctaaaattacatttcccacaccaatggcgacatgagattgtgatttgtgtattctagtaggaatttgaccacacagaacaaaaattaccatgaacaggtctagtatccagatcattcctgatggacaacgtcaacaaatcaaggcatcaagtgtgaaggacatatatttccctccgcccaatcttacaagtcgcgaattgacttgacagttgacactaagtcgtagtactaattaattgtgcatataaaagaaaatttgccttattcttcaaatacttattttttttaatattcaaaatttctcacaaaatacttgacactctcaagtattacttgtctcatccattatctccgattcaaatttctctctattctacctctacttcactcgcaaagtctcaaccatatatcatttaatgggataatatggttttttttaaaaaaaactatacttaaactatctaaaataataagtattttaagaggtactctatccatttcaaagaaaaacaaacttagaactagatataacaaacatattctaatataaccaaatctggtcatagatctgtagggagtagggagtaagcaattaattaattttaacttaattgtgtaggactggacgactcggcaggtaaagagtgtaataagaccaaattgcggtacagaggtcgccatctttccctttccaatagctcgccgggggttcccctgaaacaggagttcccgtggccgccgaggattccctccccacgccgcaacgcaaccggagatggaatgtatagtatctggtgttcgcagcaccgctgttgcgctgctgcgccggccaacgcctcgttcgccgccgggcatcgtctcgcgaccacacccatccctttcccggccggcccaaccacggcgactcgatcggatattgcctgcctgccatgcatgcatggacgacaactcgcaaaggtttttgggctgatttcgagctgccgatgcaagcagattcggtgatgaccgttcgatgaagggtgtgattaggatgcaacaagccaaagctgtttattctaaatattaaggtctcgctgttcttttataattaagatataaattaatcttagtttttgttagctgttagcacgatttttaaactgtcatgaactttttatattgaagttgctataacatttgaccgaaatccattttttgaagtttgaaataattaaagctcaattaattatacgctaaagatttcatctgacccatgttcaaacgagacataagaaatgtacttaactattaactttcctctattccttcaggatgtgtttggcaagtgggatataggagatgggattgagaaaaggaaatagatgaatggctaggattaaatgaggtgtgaaatattgcccttttgagggtgggatattatttcccaattccatttgccaaacaagcctcatggtatgatcgtttcgaatttgttcaaagttattttttaaattttgattaaatttataaaaaaatttactctatttttgtatcaaaatatatttgattttacatttaaaaaaattaatttattgttgtggtagttactaagatttttttttatacatatggtcgaatttaaggaaatccattaagaaaaaaattaaaatgtcttataatataaaatattataatagagtgaaaaaaattgtatctttaatccaatattaatgtataaaaaatctaaccgctcaatttcatggagaaacactactagtacatatactaattagggacaattgcttatttgaccttgttttagagcctaactactaatatgaccctactttttcaactttgcttacttaaccatacttttcaaaatcagaactgccgtcttagcctattttactgtaccattagggtttaatctagggtgcaaaaaaaatattttatactcggaactggctaaaatgcctctgactaccaaatcaatcgtgtccctaaattgctcaccccacggtctactcatcccacgcggataggccttctaggcggcatgacgttagggggaggcggcgctcagtgcacgctgaggcggcggcgcgtggagaggtcatcagcgacggtggcggcagtaggagctgcggaggttgcgcacggagaagggatcggcggcgatggcacgcggaggctgcggcggctgcacgcgggtactgagtagtggatgaaactagcttatgacttagggattttagggatgaaatttgtgagattttaggtttatatatgttgatttttatatatgtggcttagtgaaatttatatgtttatgacttggtgatttgcccattagtgaattactacgataagtttagggtattttagggttttagtgcaaatgtatgaaatttgtgatgtggatctaagtggatttatttatttgtgacttccctttcttttctcaacaagagttggataaagattaagattttcgtggcacacttttcaaactttctatatgaaagttgctctaaaatatcatattaatctatttttcaagtttgtaataattaaaactcgatcaatcatatgttaataccaccttgttatgcgtaaaaaaacttaatcttcatcttcaggagaaaagaacaccaagagttattttagagatgcatgatggatgatggattttagtgtagatactacctaggttatcaaatcaacatagaatatgaggtgctgtccggagttggtttgatcgagttagtgcattcatataactgattaagataccttctgaccctaagcccctcgtattctgtcatttttagatattttagggtatttatgatatgtttgtggtaatttagagtattttaatgaatttttagggtaatttagatatacatgtgactagtgatatataatttagggtattttgtatacttttactgagatagtaatctttgtttttactttttatcgtacacaggttatttagaaaatgtctcagaaagacaaacccacgttagcgactaggagaaaaacggagtggattcagactgatagtggtcatactatatcctaaaccatatttattaagctaattcagagcgggtgcggatagtgtacggatgtcaaaaatggagcataattggttcgaaaacggattaaatttatcggatgttacgtgtgtatgcaatcaatacaacatcgagttggcaatgcaaggaacaataatacaatagtcaataaacgatccattgtaataattatgtgcttaagtgctaaacaatatgaatacatgatgtctataatataaaaatacaactacataagtatgacatgagacggtgaaagtctcagactaagaaatctagggtaattgatgaattagtacattggatggaccaacttatgttatatgcaataggtagagtcgttacatgtgttgatgatttcggattatccggcaaacggcctatcggataatccgacagaaatgtcggataatccgcagccgccggattttggagataccgtatcctcatccgcatctgcattatactatccacatccgcatccatatccgtcggatttctaaaagcccatactatatactcgtttcgaacggatttgaatcggattggatcggatcggatattattatccgatccgttttcaccactattggcgacaactagtgggaccacatcgacccggaaccataggacccgaaataggattcctaaggatcagaaataataagagcatcgctaaaagccaaacgagggctacctcaatttcttcaagacctaaaaatgtctgcccctatctacaaaaatttaaattcacaggtaatgacatatcctgcaagtgaaatatttaagatgccaaataatacatctacaagacatcactgcacaccattgtaaaattcacagggaaattcagttcccacaaccaaacacatatccaagtcatgaacattttatagaagttgataaacagttttgtcacaacatgtaacaaaaaaaaagaaaaagatgagtaaatttcacattgggccatatattttgaacatagttttataatggactaggggtaagccagagtgttcacttaacactacatatctttacactgatttgcgctttgggctagggatgagcaagaagtggagcagcgggggtctcaccagatctggacggccgcggtggcagtggcggatgtcgttggagatgctgcgggcgaggtcagggagggtggcagcagcggggatatcacgcacgacgtcggggagggcggcgctagaccagcgtggtagcgaggtcgggatgggcagtggacaatgtcggggagggtggcgatcagagcttctgccgccggccgtgaaggcggcggcctcagacgagacaacgcccggtcgcgtgctccaagaagaaatgaggccgcctctgggtcggtggggaattggccaattggggaaagagtaaatttcctatatccttgcaaactcactcaatccctttcgtaccccgtgaaatttacccgatctcctttataccccccaaaattttaacttgatcccttccatgcccctaccgttacattttccttcatttcactattacgtttggttgcaaatatttatgcccttaatgctttaggtttgaatataaacttgaaaaacgattaaaaaattttatttcgctgcacaatatgtgcattttatgaaactaattagactaaataattagtgcagaaaattttgacataaatttttaaaataaaacaaatgtaataaattaaattttttatttaaagttttaataggacaacgggtattttgatcgggagcattcataaaaaatattgtgagcgctggtagtcctatgcatactccttttttttatgactttcttttaaaaaatagatacatatttttttatttatttatctaaaaataaattttgtgataaataatgcattgcacaacaaactcataactataatagccttatgcgataaacttttacatttttaatactgtaattcatgaatttctatgttcatccaaagggtaaaatggtcaatttttatagaaattagacagtca

SEQ ID NO: 62803 - DNA, 3147 bp, Oryza sativa
acccctcggggagataaaaggcggggaggtctcgtcaccctcaggcccgacccaagggtgaccgcggctacccaaacctctagtcatgataccctcggccccatgtcatcgacaagtactacctttgtttcaggttataagactttctagcattgcgtactactaatctaaaatcccttttattaatctattcttgttctatatcctttataaacaaatattcctagagaataacctgacaataaactaataaaatcctacaaaagcataaaagatggccactttgaatctttgattatgttgcacctcaaaaaaatatatatcatatattaccctaaaaaaaccatacacttttccaatttcagacagccaaaagaagagagagtgagagtctgagagacagcccattcagaggttagttagagttgggccgagcccatatcatctcctatataaatggcccttccgagcgaacctccgccccctccgaaaccctaacgccacccgcgccgccatccccgagcaccaccaaccccaccccccgagcgagcggagcggagaacgcgaggcgaggcgaagcaaacatggcggcggctgcggtgtacggcgccggcggcgcgatgaagggcgggaagctcggcatggaggaggcgcgggagctgcagctcaaccgcatccgcatcaccctctcctccaagaacgtcaagaacctcgagaagggtaatccattctttctctttttcttctatagtttcagttcgttgtcgttcagagaggattagattagatcggatttttttttgctgagagcgcgaagctgattcgtgtgtttatggttgcagtttgcgctgatctggtgaagggcgccaaggacaagcagctgcgcgtcaagggccccgtcaggatccccaccaaggtgctccacatcaccacccgcaagtcgccgtgcggtgaaggtattgaccagttgcagccacctctaattgcaatgcttgattgggtttgaatccatttgtttttgtggtatgtttcgactcatgggtatagctttggtttaggtggttaggaaatggattggtggagacagatgccactgtatagatgccagtgtatagatgcttggttaagctagatcctggtctaaattagtgctcttggttggtgactagtgtggattgtgtgaccattggaatcatttagtcaaaactatttgatttttcaggcaatctctttgttgaaatttgccttagttagagtacttcactaagtgttattgttgtatggccatgttcttatagtgactttcggctatctaaaatctgcaataaagactaccagcaacaagttgccaccaaaatgtaatgaaggatgaatgtttaagttttcgagtgaaagcacatggtatagcaagttgagtagaagggttactattggaggtttgtggtgaataagtttggtttacctgttctttgtcgacccaaccatttcatcacccaaccatttcatgcatggagatggatgggcagcgggatagcaagcgatggacactgtcaagctacaacaaactaggatattcctatgttattcacttctagataagggaatgatctagaggcaagctcagaaaacttgccgttacccccacagtctcatattaagggggcagaatatacagacgtttcttcaattttagtgttattattctccacatgtcataattttaaagatagccaagccaagttctgaagtcaagaaggtttagtaagattttgtttagcagggatttggaaggcacatatgttggtattctattggaatgcaagtgggctggcttttgaacccatttatgggctattcaagtgggtaaaccataggttggtgcacttaaatggcctataagtgggtttgtgggctggccctcttgtatcctgatagtttagtatgattggtaataatagcaatgctacttttaaatttaaggtttgttatggactagtgataactgttatgggatcgagtaccagtggcacaagaaactactggctagtctcgtagcttgctaggtactccctctgtcccaaaataaacaaagctagtacggggatgtggcacttcctagtcctgtactaggtttgtttattttgggacggagggagtatcatagtttgttactcctctggttactatttatctttttggctcctaacctacaaaggtcgcagtgtagtaaaacctcctgcccaaaatgtagctctctttggctttgaatctggatatgaacttgtctagattcatagctagatatagttacaccttgggatggatgtagtattgtactccctctgtttttaaatgtatgacgctgttgacttttagatatatgttgacaattcgtcttattcaaaaaatcgagcaaatataaaaatataagtgaggcttaaggtatatttgatgataaaacaagtcatggcaaaattaatgatacctgtataacttttttgagtaagacgagtggtcaaacgtagatttaaaagtcaacggtgtcatatatttataaatggaggtagtattagagaaggaatccattgataaacaagattagtgctcttcccactattatagcaaccataggctcgaagcctgcattgcgcaagagacttggttgcaaaaagacatcactaaactaaaggatcaaactttacgcccatttaagtggacatgtgagtttgtttcatgggatttattattatgtgaattcattgatttgttaattggacaaagtacatgatatgtttaacttgtaatgtatatcctttttgtgtgccaatcatcctgtacccctgtttacctatgctcatgtagttgtagcatattgttctgatgattgacagtttttttactttcatgcttatctttcatcaatatatcttcaggtcagtttatgcttgcaacagttaaactggacgctctttgttagatgaaaccactttggatgctagttgcttaagctagggaaatttgctgacatcttgttggcttaacttcacattggttgggttttcttgtgctaattcaggactattttgcgttcttttctgaccaggaacaaacacatgggatcgtttcgagttccgcatccacaagcgg

SEQ ID NO: 62804 - DNA, 9899 bp, Oryza sativa
ctgtcactataaaaaatcattttttttcaacgcccgctctatctagacctgtttagatgggatatcacatcagatgtttggatactaattataaatattaagtatagactattaataaaacccatactataaccctggactaattcgcgagacaaatctattgagcctaattaatccatgattagcttatgtgatgctacaataaacatgtgctaattatggattaattagtcttaaaaaatttgtcacgcgaattagctctcatctatgtaattagttttataagtagtttatgtttaatactccaaattcatccgatatgacagggactaaagtttagtccctggatccaaacacccccttagtcacaggcgagctaagagcaggtacattagcaggctataagccagctataaacatatttttaaagagataaagaaaaagagagaagagcagcggactatagatttatagctagctgtagcacggactccaagacgtaatgtgtgtatgacaggtgggaccaggtattaatagtatattaagcaactattgtatgaattggctattacattggatatagatgatttgtagatagtagttgactatactattaaactaaataacatcggtaaataaaaggatttgggtgatgtttagttaaggattgtttgtgaaaatctatttttatagatgtacgctttaagcgagaatcctaattcgcgcgcacgcccggcctacacagcccagcacgcgcgcgcccgaatctttttttcgcgctgtttcttctcttttcttttttcactttctctttttttctttaatttttttccttttccttttttcaaatctggacttgaaagtttttaaatctcgagttgaaaattttcaaaattcaagttgaaagttttcaaatctcaagttgaaagtttcaaaaaaaatttaaatctgtacttgaaagttttcgaatctgagttgaaagttttcaaatctgagttgaaagtttttaaatatttcaaatctggacttgaaagttttcgaatctcgagttgaaagtttttaaatctcgagttgaaaattttcaaatctcaagttgaaagttttctattttttcaaatctggacttgaaagttttcgaatctcgagttgaaagttttcgaatctgagttaacagttttcaaatcttgagtcgaaagttttcaaatccgagtcaaaagttttcaaaatttgactttaaaatttaaatcttaaatcaaaagttttcaaatctgacttaaaaaaatttcaatctgttagtaaaaaattcttaagaatcttccataattacccatcattagtgttaagtgttaactaatatagagtagttatagagagggaagggaaggagatgtgctcgctgctggcacacacatgccagctagcaggccccgctttaagatacccatctgcgaaaatagcatatttttaggctggtttaatttcaggctgcctgaccaggcaacattggttgccttctcggatgctatatattcacgcatacaaatttctaaggcagggtgctcatggctccaaccaaacaggctcttcatccaggatattaagaagccaagatatcccatttgccgctggaggcggtgatctcaagtccagtattgggtttttattgcttcataaaaggaaaaagtacaccgaaggtccctcaacttgtcatcgagttacaaaatcatctcttaaccacaaaaccagatatatgacatccctcaacttataataccattcactttaaatttttaggtggctttgaccctggttttggttttatctgatgtggcggcttaatcagcgtgggtcccacaagtcagggcgtccacgacagccccctctctatccctttttctctcccttcgttctctctctcaccactgctggtcagcgggcggggagaacgccgacgggagaggagggcgtcggcggccgcgagcgcgcagcggacgagagctgcagcgagcgggcgggcggcggagcggagcggcggtggcaggcgagcgagcggtcgtccgacggggagctgctccggtcgctgcaccgcctggcacgcgacctgtccgccgtcgacacacccgcgccgttcctgcgcgccttgttcgcgtccatctcgaggcggtcgaagctactggcggccgcgttggatgacctgcggggcgccgccgaggagttgccgcagcccgcaggtttatctttcctttctggtctgtgttttcatgttcccttctatgttcaatttgattcttttttgggactgtctaacaatcattcgacagattttctttagaaaatcagtcgaattttcaagccatcaccatgtgctgctcaaatgaaaacgtatcaatgtacgtcagtcactggacattaatcacgtcagtgatgctgctaaaaagaaaaggaaaaacaagcaacttacatcaacttacgcatgtaatttttggggttacatatgtaattttgaaacttacgctataaatatattaaaattacatatgtaattttaaaacttacagcgtaaatatattaaaattacatatgtaattttgaagatttacgatgtaaatacgtaccgattatttttttatgaaaaatatgacggcatatatatagtccgaaaatatcaaatcacacctcaaacaattaggttaactacagtacaacaaaacaaccatgagtaaaaaaattaccatccatgtaaaacaaaaattacacctgtatctattaaaaattacactgtaaatgtagtgtacttaactatgaaactgcggtgaaagttttaaaaacgttaggtatagcagcaaagtaatcagtcgcttcttgcacagttggtacgatgcacgtcatgttatcccgacatcatgtggttgattccctgctctagcggcattttttttttcactcgaaggcacgcgcacaaatctcaaagtaaatcatacggtgaagaaatcgacagatttttaactgtcgacagatatacagcaattccgttttggttttcatggatcgatggtatatggtattatgtttttttttcctgtgttttgaatcgtcctctcttgctcctgttaaggttggggaaccaatatctccatggtgtcaccatctttgcaagaaggggatagatcgacgcgtcaagaaatcgtttctgttgccatggctcgagtaagcaatacgattgttgcttgcgtacaattttttctttttgcggggtgcgtacaattttttcttgatgcagactagtttcttttcttgtaccctgttttaaaaaaatctcactcctctgtttatatctgttctgttcatgcaccgtgctaaccccgggcttgtcggactggaatcctttgaagaatgaagccccaatgaggcaatgactgtgctagatccaccatgccattcagtgttgcaggtcatgatgctttgagctcgtgattgtgtctgtgtcagcgtaatggatacattcagctatcatatttcctctaaaatattcgtgttttcgttcattggatttactttgttagatttggcggtttggcaatgatgatacaaactttcagcttaccatgccagttctgcttctgagaattcatgacagataaagctgatatagatctgaactgaatgttttcttttgcattatgagtgtgcggcgccgccggggagctgatatagatatcgaggctgtgcggcgccgccgggagttgccgcggttggcgtcgctatgcctgcgggaggtgctcctggtgctgcagcggttcaacgccatcgtcgccgattgctcggtgcgaagccggatgtggctgctgctggagtcggacgagatggaggcggagctgcgggagctcaaccacgacctggccacgctgctcgacctcttgccggtcgtcgagctgggcgccttggcctcgccgacgacatgctcgacgtcctctccctcgtgtcgcgccagtgctggcggtgctcgccggcaccggaggcggtgcaggcgctgaacgcgagcgtgctgtcgctgatacaagaaatcgagcccccggcaccgccgtcggatttccggtgcccaatctctctcgatctaatgcgcgaccccatcgtcgtcgcaagcggccagacgtacgatcgcgactcgagcggccggtggagtggagcggagcggcggcggcatccagcgacgcccagggaaaaatgagagaggaagagagagaagaggggaaagggagaatgtgtgctgacgtggcattctgacatgtgggtctcacatgggtcccacgctgactcagcctccacgtaggacaaaaccggggtcaaatccacccaaggatctattgtgaccggttttaattagttaagggaatatcatatatctggttttacggttggggacgattttgtaacttgatgacaagttgagggaccttcggtgtactttatccttcataaaatctttttgaataagttcacattgactcccttaactagcggtcgaatttaattcatatccttgaaccacaatattactggatatatccaccgtcaactattaaaaccggtacaatttgatttcctcggtggttttggagggtggttttgccgacgtggtgcttacgtggcaatattgaccgagtcttcgttccatgtggtgttgaggtggcacttaggtggcattagaattaaaaaaatatgtgtaggccctatttatcattcacaaaaaaaaaggtgggacccacggacacgtgggctgtcacaccccgaagttttcctcccaagccaaaattgtaatttttataaatgaccctaagaaaataccggtgcaaatcaagagaaaaccctaagaaagtaatgcaaataataatcggatttgacatgtggaatttttcttgagttctacatgtcgaaattcattaacaggatttttagtggaattttcagagctctagaaataattttaaccaattaaaattgagcaagcaatacttttaattcctgggaaaatcctttttcctttttctttttctttttcctctctttttcctcctttttgtcaaatgggccgtcggcccatttctcctttcctccccctcctctctgctgggccggccgcaggccgaggcccagccaggccgcccgccgccctcctctctcggggtcgccgacaggtggggcccacctgtcgggtccttcccccacctcccgccgctcccggccgccgcgcccgcaaccgccgccttcggccatggtttccgatcgccgtggtccatctccctctctctaatccctctcttctccttccttagggcaccccgaagctcgtccgcccgccgacgtcgtcctcccgtggcttgccgtcaccgttcgccatcatcttcctccgcgccgggcaccctcggtgaggcaccccctcccctcttttcccctccctctccctcctagccgccgctttagcgccgccgcccgttagtcgtcgctttagcatcaccgcccttcggcgccgccttgcgccgccgtctccgccggcgttgccgtcgtcggcaacgcgcgtgcgcgtgcgcgcgccgtcgccgtgaccggtcggccggctttgtgccgagccgagcctagcctggccgccgccgcaccgtccgatcggccccgggccgatccgggccgtcgatcccgtatatcggcggtggatcacccgcgtggtcccggtccacggtagaccggccacccttgagtcgctgaccagtgggtcccgcgtgccgccgccccttcctctctctcccgggccgctgaccggtgggccccgcatgtcggcgccgcgccccaccttgatgacgtcagccctggaatatattgcgcaataaatgatttaaggtttttcttttatagtaataaagacagtgaatattctaaaattcataactaattcatccgagctccgtttaagcccattcaagtctcagtaaatcaagaaaaatgtgtagaatccattaaaaatggttttgttccctgttttagtagtcttatagcctgtttgcaatgtttgctttgtatgtcgctagattccgattcctctgacgctccggtgtacttcgagatagtcgccgaggttcctccagcagcagagcaaggcaagtcatgcttgtcacttgaacatgttaatcctatattgcaaatgccctattgttttctttcaaatattgcactgttttataacattactatgggatggttacctattgttacagccatgctttttggataccatgctcctttgttagcttggggttataacatgattagagtttggactaggaattgcttagccatgcttagttcaactagttcacatgggggaaaatcatattaatgtctagactgttggttctaatgataatgttggattagtaccaccgctctggtgttggttaaataaaatgaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagcttcctctagtcgacgcatccaggcaagggtgggcgtgatggagcggggtgggccctgcgacggcctctgtcgcttccggattcacttaggcacgagaggggactgcccgttgcccgctggggacgggggtgaaacctgagatgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcatcttagtgtaatcttttaatttggatagcttagtggatggttgggcctgtcgcaacgtgggttaacgttggacagcggatgattaatattaattcattattacaactgtttaaatctttcaatttctgtttataaatgctcgctttatgcaagtgaaccactttagctcttctttgatgattccctgcatcatacctctattccggtatgacttgctgagtacagtgggtagtactcagtcttgctctacttttcccaaccccagagttcgagttcgggtcagatgaaggtttctccgaggagtaggcttcgtccgtgccgtcgaggatgcctgtggagtggtgttcccgctgcagtttagtcaaggcttagctcctgttgtctttcttttcttccgctgcatttatgtaagacttttatgatgtttgtaagacgtggatctggatgtcaacattgtcgtttgtgtaccccggccggtcctggacggggattttaatacacattctgcttgaaattctattcgggaatttctgggcgtgacaagttggtatcagagccgaccttgaccgtaggacaagccaaacggaaaaaaaaacctaagagccctctgaatcctttctcattgcatatgttctttgcaattggatttattccgggaaaattgggatctgttcttgtggttcttgggaaaaatcttggtcgctcgtttaagtgagatttttcaaaacaagtcagtccagggttttagtaaaactattgggatttattcgtcagtcggttgggatttgatgggcgaaatgcattaggtcttagctcaggaacatgggttgcaaggtatttatgctttatttgttatcattagtatgtatctaatttctcattattttatcgttatgtgagtctgtcttatttattcgctctcatgcaaaatgatctatgcataaaatttcgctcttattcgattcccttatttgagtctttattgctttgtttaaatttggatttgagcatgcattgatcctactccttttgtcttctctagatggccggtcacccacccaaccaccgcggagaaggcatgatcgactttgtggcagagttggcacgcatgacactggtggtaggctaccccaacgcgccagagtacacgacgattccaccgctcagtggcgagcttcctcaccgtgttcgcttggaggtccacggctacgtgggtacttgcctagctaacatggtggtcgaggcagctggaggcacagcagatcacgcctgtcaggaggcagcatacctgatgatggccagactacgagagcgccacaactacatcttccacgacacggcataccggtttcaccctcgtcgagccagcaatgatgatgtcagttccttccgtccgacagctggcgagaacgacaccacctttggtcacatgtgtgctgtgatgaggggattggacaggatgcactcggacctgcacaaggcgaccaaggccttgaacgatgggaagctcatgaggatcgtcgctctgaaggacgagataacgcgcctgaagagggagaacgcccagttaaagggtcttcccgcgccaggaggagtctggatccgcactacgccccgcaagactacgacggcacccgtgcgcatccagcttgcgcccaggaacccacctccatcagcagctcccgcagcacctccagttccacccacagttcctgcagctccagctccagctcccgcgtccgctctctccttcgctccagcatcagccgccagaggtccagccagtggcaccggaggttggttgtctgctactcccagtggcagccgcgatctcagcagcagcagctccagtggctcagagtcaggcagcagcgagacttatctgccaggctccaggagtcgctcagagggacctggtgacgagcaggaggacgccttcgactccaccgaccgcagaagccgttccgagcattaggctcgttttttcccattagtttatcgactgtctagcttctgcttgttagtttgtgtgtttaggttgtttgtttggggtcagtcgacggtcgatatcatgtgcctatgatatggctgtcttaataaggatttttgcttgctttttaagtgttttaattcagatcagaacaattgcagttaatttcttatgtaataaagcttagtttctgagcatctgtttttcttcttttccccgtctgcttttccctccagatggtctacaccaggaatggtagccgcgcaacaggcgagggcagcaacggcgaagagcgcactgatggggcgcacccccacagcgattctggcaatggtccgccaccacttcccgagaatccgacccttgcccaagttatggcacatcagactcagatgatggcagccatgatgcagcagatgcagcagcagcaccagcagatgcaccagaggatgatgcagcacgtcgaacagcagcaccagcactttggtccccctccccctcagtccaagttgcctgagttcttacgtgtcaggccacccaccttctccagcaccaccaaccctatggaggcgaatgactggctccatgcaatagagaagaagctgaatctcctgcagtgcaatgatcaggagaaggtcgcttttgccacacaccagcttcaaggtcctgcgtcggcttggtgggacaaccacatggccacccgcccaccgggtactgaagtcacatgggcagagttctgccgtagcttcaggaaggcacaagtgccagatggggtcgtggcacaaaagaagagggaatttcgcgcactccatcagggcaacaggactgtgacagagtacctccacgagttcaatcgcctcacgcgatatgcaccagaggatgtccgtaccgacgccgagaaacaaggagaaggtcatggcgggtctggatgacgagctgaccaaccaactgatatctggggact

SEQ ID NO: 62805 - DNA, 1820 bp, Oryza sativa
cagctcactttctaccttagaaagacgggaaataatttcatctgaaggcacaacgggtatcttcagttctacggatgagggaaccctttcaatgatatactttctgatagcaacataagaacagtaagcctcccagtctgactttggataaaattctctcctaaaaaaatgtagaattctctctttgacaccaaaattattccaccattcttgataatcacgggttccagtgtcttgtgtgatgcacgccaccaagtccttcccaaaaccacgaattcggttgtccagtgtaaggcactgaagcgaagttgcgttctcaaggatataaaatatcagctccactagttcctgcttgtggcaaaaaccggttactgtcacatgcttgatgctctggtggctatgttctggtgacaaatgtatttttaggtatttaggattaaaaaccaatggatagggttctttagcagactcctccacctgcacagtaaaaaggaaaggaaaacgatatcattcattcttaatgataaaatgacaagggaaacaacttaaggatgaaagaagacaaaattttgctttgagagataaaatgtcatacgtgcaagataaaagtttccagcacaggagaagctctgaggaaagtaaccagataagcgtactgatagccaaagccataatcccttggtccaacaatcgcaagctccagatacttgaggtgcaggaatcttccatgcggttgaactatgagtggatagaaataaccaacctcattcgcagacatcaggaacagagtttcaacgtttggggcaactgttgggagctccttgcgagcatattcaaacaaattaaaccaagggtagattgatatgtttacatgcttcagttgcagtgaatctccaagtgacaactgtattaggggcccttcatagtaaaaggtggagagatttggagcatcactcattattaactgcagcaagttgcatcgtctgacccgcaagaaattaagcagctgcagtgtgcaaggtattttaaacaatctatctcatggcaaaacccaagttccagatgctctagactaagagaattataaagaaaggtccatagttcttctgtggtgatatgcaccaagctaaaataagctctcttcaagtttctgaaggaacaagctcctagatcagggcgaaaagcgcaggagtagagacacagagactgaattgagcatcccttttcaaacaagagtttacatgggaatctatatttcattttatcatcccggggcagctctagggtgagttcctcgatcccagggatagctgcatcaagccaatggttgatatgatgggcagacaactcatgaaaaaattgtagttcaaacctaaacctcttcacccaaccaccagtgtggttttgcagagcaatatcaatcctcttgatatatgaatccatttgaccttgtatacaattgtgttgtccatccatggataatgttttggcactgaatttgagctcaggataatgtctccaggaccgtaaaagttctcgtgaggcacaggcaggagagcaattatctgatgcaacacatcctgagcaagagatacataaaagacaacttcaacaacaggatggcaagaggacgaagttgagttggacaaagtgataatgcttataagagaaaaacaacagatagaaaggcatgtcataaagttgatagtgctataacattcctattctattattccagtagcattatttgtttacttatttgctgaagtagctatgccctgattcagaagagctgaaacaatgcctgaatgtatgcatat

SEQ ID NO: 62806 - DNA, 5503 bp, Oryza sativa
  unsure (1)..(5503): unsure at all n locations
agaaaaccagtgttacttggacagtgtccgaattgtttggccaaaccggacacctgtgtccgtgtccaggtaacaccggggaaaacactagactggctatataatataaggaagcaaaatcacacagaagtacagaaccatttgatttaactgttcaggttggtttgcgttttcatataatatatatgcaccaaccccaacagcaccagccgcagctcactctagcctacctgcctcctctgccaccacacatcctctcttcccctttcacaggcttctatattcgcacctgctgccaccccacccagctcagctttggcaacgcttcatgccaccacacatgactgccgcttgagctaactttttcgaagccgaaccctccattgcctgccccactctatggctgtgaaaaaagctcaaggctcgcaagctattcatactcgactcattataagctcggccccaggctacaacgaatcaagctcgagcttcaactaaggctcatatccattaacgaacagagctcaagtagctcaacaaaggctcgaggcttgagtgcgtgtttttgtctccgtggctactgctgtactactgcaggagtactagtactgctactatgctggccagccgcagcgtccatctttatttaaacaattaatattccaacgttcaaatctagaggctaatacctccgtcccatcctaggttgctatattatgggacggagggagtagctagttgcagtacttgtgcagccttttgtcagtgttagtgtttattctcttgatggtgaacgcatgtgcttgcatttgttgttcctcctgggcaagctcgagtagactcgaggctcgttcgagccaagcccgagcttaactgcaaactcgaggctgttcgagctcggctctgagttcataacgagctcgagcctaatcatataaactcgctcgagctcggctcgttgacagacctaccccactcaaccatccatcctcatcgcatggagggagcctccctgtcccgatcaccaattccaccactggcccatcaacctcccgaccatcaattcctccccaaatccagaaccctaaccctactggctcaattgctaatcgccgctgccacaaccgacccattgatctccctgaccactaatttatccctaattcctcccaaatcaagaagcctaatcctactggcttaactgcgagcgacagcaccggagtggaaccagagctgaaggggacgaggccggtgcacaggggtaagattcgcatgattttgtccccgagaatatcttttcttacactgtaaacagattacaagttgacggagaagagggcgataaaagtttgagctttctgtgcacagatcgatgacgatgccctttaacttgatgatttagctatataggtcagtggatctggttatagtagattaaagcagagaacaagctgaaaatttaaaagaggcataccggcctggattcgccgccgccgccgccggcggcggcgtttcatggacatgatcctcgccagacccagcatccccatcttgtaatagacgacacgacacgacacggagaagtttccaagtgttgtatagtactactctactctagtcctgacgccgactcgtaaagttgtactatctccgttttgaaatgtttgacgccgttgactttttagcacatatttaactgttcgtcttattaaaaaaaataagtaattattaattcttttcctatcatttgattcattgttaaatatatttttatgtaggcatataattttacatatttcacaaaagtttttaaataagacgaacggttaaatatgtgctaaaaagttaacggtgtcacgtattttgaaacggagggagtactgatcggaagcagcagcgactcctgtcctccccatcgtctcttggtgcaaggagctacggcggcggctggagcctggaggggaacggggcaagtaaatcgtgttcaggcacggccagggagacgagggatgtatagcccgcccggcccagcaagccacgggccctctggtggcacggcaactgtagcgggccgtgccaaggccttagcccaagcacggccaaaagagatgctgggccgtgccgggccagcacggctactgttgcgaatttttttcatttttaatttattttgttttaatatttacagaaatattataccgacgaaaatatttacagaaatagagggcgacagggtgacgtgtgtgattgaaggccgctgagcgggcatgcaaattttccatgcgacgaaaattgcatttaccgggcggcaagggacctaagcgcaaaatacacgcacggcgtcatcttgcatgtcattttgccgccctccacttgggcggtagggtctatttttgtaaatattttcgccggtataatatttctgtaaatattaaaaaaataaaaatgaaaaaaaaaaatcctactgttgcggcacgtgggccggcaccagcacacgtgacccataaaaatttgaaacttgaggggaaaaaaagaaagaaagggaaaaaataataatacgaaggaaaaaaggatgcatataggattaatgtgaggaaaatttagggaaaattggaaatataaccgaaaatatacagtaaaaatatgataaaatgtgaaaaaataaaaaatatgagaaatataaggggaaaataaaaaattgtagggaaaataattgggccggaccatcgataggcatgccgtgccgtgtcggccctaagatgctggcccaagcacgggacgggcaaacggatcgtgcccgcacggcccataggctggcatgtcgtgccatgcctgggccggctacaataaggccgtgcccgggccaacccagcatggctcagcctatttggatagctataatcggatgggaatgggatcatgaggagagagaccgcagtgggtcctattccctcctcacattcttggcatgttggtttttggaattgggtaaatttgatttaagccattagaaatttactatattggaaaacatcatcactattcatgtatttgaaaaattgttattacagttttatagttattcaatatatggcactacttacctcatcaatgcattttgttaaaaaaaaaagttagaccaaaataccattttttgggggaaatttaactatttgtcactattatgattgccaattatccaaatactcatcttagatttgccttttttttttttgcccctctaaggtgatgacttctttaactattttctacttttacccatgtggcatgccaacgtgaccacctagtgtaaaaatcgatgtgagacccacttgttaatctcacaaacacttcccttcctctctccctctgttccggctagccccgctggctgccagtgctgctccggctagccccgctgtcgtccctttcatagatcctcggtggttgatggctgcggtgttgctggaccatgggacgataactccggtgcttggtgggtcccactccacaccacgctccacgtgatcgtcgcccgcttcccgaccgtctccaagctcgccctcaagtgcgactatcgcgctgagggcgtcaccaaccccacgttcgtgctcctcgtcgaccgcctcgacccgacccttcaacgactcaagctccgctccctccgcctcgtcaccgattacggcgtcgtcgtgctcgctgtcgccgccactagcctccgcaagctctccatcgcctcatgcacctttggtgccaaggggatcgaggtcgtcctccgctcctacctccaactcaaggagctcttcgtcaatgctgcctcccacctccaggacaacggggctgattggagcagcgctgacagcaagtgaggctagccggaccggaggaagagaggaaggggagagttgtgagactgacaggtgggtcccacattgaatttttacactggggtgccacgttggtataccacataggcgaaagcggcaaatagttaagaagccaccaccttataggggaaaaaataaaagcaaatctaagcgtggtgtttggataagtggcaaatataatagtagcaaatagnaaaatttccctcctctttcatcccctcctctctcatgttcttctctaaacctcgcccgcccgtccttagcaagtcaggcatgttcatctggttctcgtcgtgggcgccgtcagccttcagtgcctctgtggctacggagatgccgactgcaactttgtctccagtagccatggggggtgtgtgtatagctgacgtagtgacgtggcgccggtgttgacagccgccgcgcctgtggttgaggggttgtcagttcgctgcgtttgtgatcgcggatatataattttatcacgtgtgtattattactgatttagggaatggcattataaacaaatagggtttctggtgtataaaactggggggccaacacatagctagaagttgctatatattggctgatagatagatgagggatattaaaggaataaatttttttttatctatggacagatgatatgtgagaaagtaagagtggatttattttgaaataaagttaaactaaccgcagaactcgatttgttttgggcagagagagtactaagcaattttgtttgcttggttatgccttgccgggcagaatgaaatgaaccacgtgattaggggcaaaagtgtaaatacaaagggaaactattatttccaaccctagattccttccttgtgctgctataaagcttttccagtgtgtgacaatatgcaactgcctctaccgccgccagctctgcgttagtctgcttcaatttctgtttctcccaggtttcttgattcttgctttgagttttcctctcttcttttggattatttttcttttgttctttatttggagagattttcctaatgatgatgcgaatatctattcaccgaaatcgaggcatttttctcagctctatcctcccccatatttcgtgtttttctttctttttctttttgtcttcacaactatggtttcttgatatgagtaattggagattggtgatacgtttacatgttgtaagagtttcttctctgatgaatgatgaagggtttcttagtttgttttcatggaggctgtgttatgggttctgatggtgcagtgatatggtcctttgttcaatttcgcaaccttttgaatcattttttgtttgtttatcaacagttacatagacatgcagcagtgatgataagcaaaaaggactcataacgtcatgaggtttggacaaaacatgattgctttcaagcactgttgagctgcatctgtctcgcattgcaaaatctattgttcaagaaatttttttccctcgtgttcgtaatttaagtccctcgtattcataatttaaggagccagtcatctggaatcaagggccagagtgactgaacgttcaagtcaaaagttgttgattgacagacaaaaggcgatctcaccgttatccactacactttagacaaccc

SEQ ID NO: 62807 - DNA, 2649 bp, Oryza sativa
aacagactcatgccaatgcaatgaatgacttaacataacgatagaaggtagatagacactacacatacacatagaagtatgtatacatttgcaaagtttgtaaattcattaaggcatgtaaattacataaataaaagtagcagttcagtactacagaaatgtttctaggcaataacctgtcatcaatgttgcgcattgtccattgtggaggggcaacactctgacttctaaggttatcaaacccctgcaatccagcccataacaacaagttagaagaggataagccattagcttttattaactattacagaaagacaatgcaaatgagggatcaaagtaagtaccaatacaaacgtgcaaccactaggatcattcgaaataacctcaacctttgtgagatgtttcaacttgtaaagcttggctggctgaaacaaaaggaagatattatgtttctaaagggagactaaagagaactgcagaaagtggtaagaagaaaaatacaaagtgtgatttgtttattgaagtagttgataatgaaggcaagttacaatagtaaacataagctagatgcagatgctcacatatagtaaagaaaacaaacctcaagtactgcgccggatgaatacttcaatactcggagaaaagctttggctgcctcaccttttgtcgattgtttaactgcgtgaagttgttactgtttagcagttgttacaagcatatgctttacatagaaacgaatactgtcttaaatctagcatgacaataattaagtcctatttatacgtcaaccaaaccagcttgcaaacagacatactagcaaatctccactgttaagtactaacaagtttaaaatatgtttataacatattggcaaacaacacttctaaagtataactatcatgtttatttgagataaccaaagattaactcttcacttcatttagaccatgccaaaacaatcagagtaatcaatatcaaaatgtcaaggtttccttgttctaataatcaagtatttatagagtgttgcccaccagatagagcagataactaaatccaacattccaactgcaaagaagtaggaagtcagtgcaatcgattcagcacagcaatgttcatcaatccacgctaactttgagaattccacaatccacactaacgtgcatcattacattgagagacatcaattccggtttcataagttttaaacatcttgattatcttatctgcctcccaaaaataaaagcaagcttcaagttaaaagtctgaagtggctatactggccaaggcttctgattcccttagccaatgaagcctttcaaaagaaaccagggataaagttttggtcttggacatgcaaggatttgacaactacttggcccaggtccatccatatgggagaaaaaataattagctcgtcggtcctagccccttttatgacaagtaatggcagatccttctgacaatgatgaacatttcatcctacaagttgtagtgttaatgagcatctctaacaactgtcatcaactccaggctccatctaatcacagttcacaaggacttgtccaatcagctccaacacctagtcgattccaacgattactggtctggtgagatgcttagacgttcctatcaatccatgcattaactcttgtgtaccggtattcgaaatttcggtctcaacaccgcatgatgaaagctctaaaagaaatgttccttgtacaagatgcttcaagtataggatcgaattgtagtgtaggctacttccagtataggatcagctccagcttccaaaactctgatgattctgtgtccttgcacagtatggcagattctcatttggagctccagtggcgcatgcacgaaaatttactaattttagcaatttacagctaaccgcatagaataagtaaaaaaaaaaaggatctctgcccaaaacaacaccttgtatagtcccctagtggtctaggctgtcaaccgaagtccaaccacaggccatcgctcgatccaagctccccagatcacgaaactcgaatcccaaatccgagcaaggatctcggcagcgaagatcagacaggattagggcagcgtgacattttctccctaaacatggtagcttttccccgagcaaccaaatcagctactactactacttctcgagtctcaccagagcgatccctctccgagcaaccaaatcagctaccgtggaccgaatcgaagcaggggaacaaaccagcaaagctgcagcagagcgagaagagaggaaagaaggaaggagggaggggggggaggcagtgaccggtgagcgcgaggacgcggggcttggcgaggcggccgagcttctcgaagatgcccctccccttggcgacgcggatggagaaggacacctcctcgccgcgcgcccccgaagccgccacggcctgcgcgcacgcgcgccgcagctcggcgtcgtccgcgctcgacttcgccatcgcccgtgcgccgccgccgccgctcgccgccgatctgaggagaggaggaggacgacgaggtgggccgcggttggggaagagggatgagttggtgtcgcctcagactcctcaaagagtcgagattaatcaatcaaaaaccaaatcattttcttttttaccgtttttactgcctgtttttctt

SEQ ID NO: 62808 - DNA, 3734 bp, Oryza sativa
gaaataccagcccttaattccccggtccttttcccccaaataacagtaattaagcggggacacacacacacctgacacgcggcgatcaaaaaaacccaacccctcctctcctcgccgccgccgcccatggccagcgaccgccgctactactacttcgaagaagacgatggcgatggcgaggaggaggtggagtggctggcgatggaggccgacgaggacgacgtcggcctgctcgaggaggacgaccttcacctgcggcttcccgacgaccgccccgcggattgctgggtgagcatgcgctactactacaccccccatcatcacttcatcaccacaccacaccacaccacgggagggggatagatagggggcgaactcaactcgctcgatggatgcgtgctaggccgcctcctgatcgtgcgcggcgcggtgctcgaatccatctagtaggaaaaaaaaagagtcgtcctctgatttttttttttaattttgtgccgtttgggttatcctgcctgcgtcatgggtggagtatagtaatgccgctgattgcacacaacaagatattatggagaagacgccgtctggtcgcttaccggatcgggatggggattggcttcttatcttgtactactagtagtaatgccgattgtttttggaattccggtgtgtgatttgagagaaaaaacaaagtattttaaattaattgctcttgtttgcaccctcataataactacattagttccaatctggttttacctctaagtattaggatttaggagtacaaaatcaattcaatccctcttttccctgcaagggtttgatcatctgcatcaaaaatcatccaattctcacaaactagttgtccttgtagctttgtattataattaatttgcctttattgcattctgttgattttttttttgcaattatcgtatcttagaacatgtaaatttggtttacaaatagaatggttgacatgcgcagctttgtttcttaaacttgtacattattactacatttattattgtgtacaacttcaagcagcgcatgagccatgtatgctgcattggatgcattcatttctttgtgctgattagcttaatatttacaaatcaccatttttttaatttagctgctaattagggtatcacgaatagatatctttcgcacaatttacctatgtttggttaagttcccgtctgtcaccaccaatgcattgatctttactgtaaaaactgtgctccaaataatttatcttgttgttctcacagaaaaaatattatcatctccacattgcctgggatttgtcatttatgcattcaaatcaagtgaatggaactgaagccttaatttgtttttttttctcctgagaagatctatttagttattttgacatgtataactgttgttgtaggccatcacacaagagtcacttcctgctgcccaggtaatgttgctctagtcattcttgccatttcgagattcagattatgttggtcctacctatacttgagatcaattgactgttttgtgtatctactctacccacagcaacaagacctgtctatggtaatgaacttgctcaacataaagcagcaccttgcacgcacactccttatccaccaccggtggaagatgcattgcatttatgatcaccttgacagaaaggggcgggaccgcatgctcagtgaggcatgcattattttgccgaagaatagcatgtcagcagctagctcaacaagtgttacctgcaatgtgtgttttgaggacttctcaatgactgatgtctcgaccatggactgtgggcattgcttctgcaatgactgtgagtccctacgaacccttcagtaacttccttctgatgtcctgatccttacagctattacattactataaacctttttattcggtggcattcgattttccttaagaatattcatcaacctaatgtatcaaatagtttctaggttttcataaaaatgaaaaacagtaggacatatttgttagcaaaacactgcacattttcttacctatctttttttttcttcaggttggacagagcacttctttgcatccattaatactggcaacaagcagattcggtgcatggaggttaagtgcaaggccatttgtgatgaggacattgtgcgccgcctcctcagtctgaagtaccctgctgcatctaagcgcttcgatctcctcctacttgagtcttaccttgaggacaatgactcagtgaagtggtgccccagtgccccacactgtggccgcgcaatccaggtaggcaccggcgagaggtactgcgaggtcgcttgcccctgtggtgtcagcttctgcttcaactgtgcagggcaggtgcactcgccttgcccatgtgccatatgggagaagtggaaagctaagggccatggagactcggatagcgtcaagtggattcttgccaacaccaagagctgccccaagtgctccaagcccatcgagaagaacggtggctgcaaccttgtccattgcaagtgcggccagtgtctatggtaagctgttgtcagttgttacacacatatccacgcagggtttagcggtgggagcttttcatcatttggtgagtgagcttgctctctatggtgatcggcaacctgggaataggcgatggtgtatctagcttaaaatcagtttttcatctccttgattactactctctctgtcccaaaataatttaacctagtactccctccgtactcgtaaaggaagtcgtttaggacagcgacacggtctccaaaacacaacttgaacttcttatttctataaaaatatttattgaaaagtgataaatgtatacttttatgaaagtattttttaagacaaatatattcatataatttttacattttcaaactcaacaacttgagagttattcatgatttatattcccaaggtttgacttaaacattgtcctaaacgacttcctttgtgagtatggagggagtacgagatatgacacatactaggactgtctagattcgtaaaattaagatgtgtcacattccgtactagattggtttatttttggacagaggggtactctagtatcttgaattgctgaccctactgaatgcatgcagctggctctgtggtgggcctaccgggagggagcacacttgggatagcatctccggccacagctgcaaccgctacaaggaggaaaacggcgacaaggtggacaccagcagacagcagatgcagcggtacacgcactactgggaccgttacaacatccacgccggctcgtacaaggtggagcagaaggatcttgggcctgccgtcgaggagcaggtgaagaagctggagtcgaacctaacaggtccgaagatgaactgggacggtagctggctcgccatggcgtaccaatccctgctcgcatcgcggcaggtgctgtcgcggtcgtacgccttcgcctactacatgtttggcggcggcgaggtgaagacgcacccgtcggagcgggcgagcctcgccgtggcgcagaacctcttcgaggaccggcaggagcagctggagcgccacgttgagcatctctccaaggagctcgccacggacttgctggggctgccggaggaggagatcgtcctgaagaaggtggagattgccaacctcgccaagatcgtccaggcaatctgcgggcagttgtacaggtgcatccaggacgaactcctgccactgctcgtccagcccatgaa

SEQ ID NO: 62809 - DNA, 1546 bp, Oryza sativa
tcatcgccagagattaattacgaccccgtagcgattgctatggggttttttgttgtttaggcgaataaaaaagaacaaagaataaataacaaacaataaacaacagatagcaagtaccaaacaacaaataaggtaattgggtactagatagctaaaaaagtcgcgggatagacataattctagttgtttttataggcgtgcaaaatgtaaatccattttagcgtacttatctttttttcttctcaaattgcctatttctcgctatgctgatatgattttagtattaattggtctatacggtttaagaattctttgcaattactattacctattcatcaaatcgatgatgaaacgcttgatagtttttattctgaaaatagcttgctgctattagattcattacgtcaaaatttcattgatgtgcaacaaccctttttttatatttggggcgctaaaagttgtgggaaaagccatcttttgaaagcggtaagtaatcaatatcttttaagtcaaaaaccggctagctatattcctttaactaaatcacattatttttcacctttggtattagataatattgagcaaatggatgttatttgtttagatgattcacaagcaatagcaaataatgaggaatgggaattagctatttttgctttgttcaataaaattcgtgagcaacacagtttatttaatcaagggcataaggcattattattgatcagtgcgaattgttcgcctcatcagttaaagattagatcacctgatttgaaatctcgcttaacttggggggaggtctatcagttatatgatttaacagatgatcagaagattgttattttgcaacgtaaggctaatcagaaaggtatagagttatctgaagaagtggctatttttttgttaaaacgcttggatcgtgatttgcctgtgttattagcggaactgaataaattagatcgtgcatccttacaagcaaaaagaaagttaacgatgccgtttgtaaaagaaattattggcttgtagcgatttgattcctatcaatatttactataaaaaaggtaaatttgcccgcttgttacctctaaagaagtagttgttttactatttgaaaatcaaggcttatggtaaactttgtcaatcagtttttatatattaatcgttatgcatttaaatcaacttgttatttctcatcttgcctgtgagcgaggtgaaaaccgtttatttgaaggttgccatttttctgtctctagtggggagtgggttcaaattgaggggcataatggtattggtaaaacgagtttattacgtattttagctggattggcgttgccggtagccggtgaggtgctttggaataatttatcaattcataagcaacgtgatgaatattatgctgaactcttttatttagggcattatgcggggataaaaccggaattatctgcttgggaaaacttgcgtttttaccagaaaatgcaaggtctgtcgttagatgatgaagcattatggtttgctttagataaggtttctttagttgaaagggctg

SEQ ID NO: 62810 - DNA, 852 bp, Oryza sativa
taaggatcataaaaattacgaaaaaacgtataacgagtcatttcatcatcataacggatattgttataaccaataatgcaagtattaggttgactaaattcgtgatgaatacgttgagcaaattctggttctgacaagcctttttcattacagagttgtggtgcaatgcctgttaccatcaccgcttcagctgaaggcaaataatcattagtttgtttacaataaaacattaccggttcaccaataatattaaattctctatccgtacgaatacccgcaaattgcgcaggtcgatcagttgctggatttatgccgaaactttcataatcataaaagaaaaaagtaaaatcgttgttcatcgccttactcaaataacaaatcaaatgattaatattataacatagacaagcaggcaaatttgcaggaaatttatgcttaatggatcaagctaatgtaattgccgtctgctaatagcgctgatagataaataaattgcataaaaaaaacccgacacaaaaaattctgtatcgggcgaggtcttacctaaggaaatgaaaaaaactgcttgagttccgtcaagttagcattaagtatgactgacgtgatctgataaagttcagttaatttgcaaaaaaagcggtatttttttatgatttttattttcatttgcataagctgtacaaaaacaatgcaaacaaggttacgccgattaaatttcaatctcacacaaattctgatgaaaatgccaaaaagtccaaaaaaaatggacaatttcctttatttcctaacatattcttgtaaaatatcgaatattattttaaacataaaactcacaataacgtttgaggtatt

SEQ ID NO: 62811 - DNA, 511 bp, Oryza sativa
tctcagcagcacagcgacgcggttttgtcgatcaacaaacctccacagactctacgaataatttagcggatatgtttatattggccggtttaggtgattttagtcgagccgttttaactgccgatcgattactcacattttaattatgaaaaaatataaattagccattctttttactcaatcccccttcgcttcttcagcaagtagagaaggattagacgccttgctcgcactaagtgcattttgtaatgaagacgaaattgctatctgttttataaatgatggcgtatttaatttagtcgctcaccaacagccagaactactactacaaaaagaccacatatctaccttcaaattaattgaattatatgatttaaatgaatgctttatttgccagcagtcaatagacattcgaggactacagcaaacagaatggatcttaaaaaaattacaattttgttcaagctcaacaatctatcatcatcttcaccaagctgagaaaggattaact

SEQ ID NO: 62812 - DNA, 523 bp, Oryza sativa
aataactttaccaaagatcaacagaatatgatgttgttgaaatcagatagcgaattttcccgctttatgaaagcaccaacaaaataaatttatcataagcccgattgagatcgggttttttcatctgtattttggtttatggctgtgtaacctatctttagagatcagctataatcagttcaaaattcaatgtaaattataattaagaaagaggcaattcctatgggtaaaagtgttgctattctcggtgctcaatggggcgatgaagggaagggtaaaattgtagatttattaactgaccgagtgaaatatgtggttcgttatcaaggtgggcataatgctggccatacattaattattaatggagagaaaacggttctacgtttaatccctagtggtattttacgtgaaaatgttacgtgtttaattggtaacggagttgtactttcccctgaagcattgatgaaagaaatgggtgagttggaagcatgtggtattaatgttcgtgagcggttaaaaattt

SEQ ID NO: 62813 - DNA, 691 bp, Oryza sativa
cagtttatttttccaatgtttttagagcgagcgtgggcgcatgtctatgagtcgttcagcctaggagtggtcacgtgcaagggagtggtctgaccaaaagtctgttgtctgtaccacgctgtgggatggcgcgcggcatcgtgtgcgtgtgggctgcgagaagataggatcatgcgggccgccatggtcatggttgtgggatggcaggactgaatttgcgtgcgtgtcgtacaaacaggagcagctgtttttgcttgtaatttttcttttcaatcaaacatcacaaaacactacaaattcacagcacaaaacactgatgcccgcgtgcgtggcgcgtccacgtgctccggtgagtgctcaccatccccacccccacaaaatgtacggtctcgcaccggagatgtcgcatgggcgaggttacatcgagcgtacgtgttgtcaaggaagctagtggctccatagtacccaacggtcacctgcatcaactgggctgtgtttgatagtaagggttcccaactcatctctcttgtttttcgcgcgcacgtttttcaaactattaaacggtgtgttttttaaaaaaattatatacaaaagttgcttaaaaaatcatattgatctattttttttaaaaaaatagcaaatacttaattactcacctgcaaatggaatgctccgttttccgtgcaaccca

SEQ ID NO: 62814 - DNA, 12473 bp, Oryza sativa
tccgcatccgcctcatactatccgcatccgcatccatatccgccgaattttaaaaggccataccatatcctcatttcggacggattcagagcagagtggatcggatattatccgatccgttttcacccctagtagtagacatttattcacattttctgcttgtactccctctcctgatgaatatattaccttagtccgaaaatataaggaagcacccaacgtcctagagaaaatggaacgctcatatctggtagcttaaggctgcattcagcctcactccctcgcacagaaaatgaagcaatgattagggggtgattaattaagtatttgctaattttttaagaaaaaaaggattaatatgattttttaagcaacttttatatatattttgttttgcaaaaaaacgtaccatttagcagtttgaaaaacgtacgcgctgaaaacaaggaagaaaagttgggaacaggaggttacgaacgcagcagcctaatagaggcaacgtactgtgtatagaagctgagcgatgggacctaaggtgagaagaaccaaacatgcatactcgaagagaagagagagctagctgcatgggcctctgtctttttttctaatgtatgtaacagtttcattagaaatattcaaatagtatttctttttcatgaactatttatctactttataaaccagatgtatctttatatttgttacaattaaatcttcatgagactatacatgattatatttttgatgaaaatatatatttagcacttttttgttataattaaatatttaataataagatatcacattatcatattttttttagtttttttcaacaaatatttctgaatgttgcacacgatgttatttggatgtttaaataagtattttcttatggtttatgaggtcatttgtaaatgttgcacatggtgtctttttcatgtttcattaagtattttgtgaagacttgatagttgcaactcgatgtttcacgcgtaaaaacgtttcaataaagtcaagtttttgcaaatatgttgatgtttcactaatgaggaccttaatgtataagatggtggttgtcggtgttgcagtcaatatttttgaatgcttcatatgtttgaagtattttatgaagtgagttggaacgtttgataaagtgatgaaacaatttcctatgacaggtgaaactatgtttcagctcaccctccacctttactcgtgttctgagttaaggatgcaacttgccaaatggaaaacccgacgagatgaagcctccttgcgatagccgtccatgaccttttattgaggaagaagtggctcataaacaaagagaagtaaggacatatttgtctttttgaagataacttaacagctcattcacgatattgatggcagtggcatacatgataaataaattcagtccagtggcatatacaagaataacatgtttttatgacatataaggaacgcaaaaatggttccatgccatctaaatttccccaatgtagttttaagccttgtttgattatgtttattgggcgtgtagccaactggcttaccggacaagacactcaattagcgcattatttagtggtttgagaagtgtgccgatgaatcaaagtagatagtacttctctagtacttaaaaaacgaaatctgcttgatttgtccgtccgtcggttttcctactatgtttgtatgtatgcgtgtccgtgcgaaccgtggacgcgcggcagggagagcgagtgttactgtgtggggagacgtgagagagtggtgaagagaagatggatggagaggagacacaggtaatgttgggatgagagggagaaggcacggggaggaagagtgccagaggaagaagtccagggtgggggtgggggggagaagcgttggtggcggcaagctgtagagggaggtggcagtggatcgaagatggcacggggaaggaagagatgagccgcccgggtggaggggggcggagggagaagccggtgatgacgcgttggaggggaagggggcagcgggtcgaagatggtgcaggggagtaattgtggttgatggtgctcatgttagggggatcgagagagagagagataggtggagtagcatgggaaggatataggatatcaaccgctagatctaaagtgaaacaaagaatcccgggaagaatctcagcccttgcagggaaaatcaccatccccactatgttctttttatataagaaaaaaaagtaaaaataaagataaagataaaaaaaattaacagggccacgaagtgtcaaataatttggtccatgtcccagtcaaagcaacagcctctgtgatgtcacccgtgtctcacttgagttctgtaactcggaggaggacgacctctcataaaccctaataagcaccttccgtaataatagtaggcttcttaattcctcgcgatcggccggtcgatcgatcgttcctctcgcctgccgccgccatacccacgccccgccccggccggcgccatgtcgagcgacgacgaggagtgcttctacgactacgaggaggaggaggaggaggaggaggagccgggctgggacgacggcggcggcggcgacaccatgctggtcgaggaggaagcggcgttgccggagcgccccgtcgattgctgggtgagtaaagccatcccgacgtacgtacgtatagcgatcgcatatcgattgagcaaaggggattgattaattatgtttgttaaatcttgatctgatccatccatgatgcatatcaagcataataaaggaaggaattagaaacgacattagatcagatttaatttgcgcgttcttttagttattctggggaaaaaatgagttacggttttacattacttctaatgcacatgcataatatgttagtatttctttatgctttgcatttgtgaaaccatcggtgaactttaaaaattcttgccaaatatgttttcaatggatttctccctctgatttcaaatatgtaccgttttaggcttttagcatatgttctcagataccccctccccccctaaaaaaattgtgtcctttaactggagttgtttatatgcaccttttcttttcttgctagttcgtctttacgaaataaatgctaattttgtgacaaataagtgaatcatccttttcaatgtactataaatgaagcgcaacaaagtgatttgaccaatttttcaaaatcttctgggcaagcttagaacatgtactcttggattcagatggagtatgctttagtgcacggcttaatgttgttcgagtttggaatacaactgggatacatatttttctgaaaggtatatgtgagttaatttgcagccataattagcatgttttttgtatgataaatggatagcatactcacaagcctaaaaaatcccatccacgctgatgttatgcataaaaacattcacaggtaaaccgagcaatttgaaatgtagccactatgtatgttgggttaaatttaacctactggccggattggtcgactcattctaacaaatctcacgtaaaaccaaggaagtgtggcaagattatattgttaccttcatcgaagtacatccaaattgtttttctatcactaagtataccccaattattttttcaaagcaatcattaacactgattatttgagatgggccaataaaaattgtggctgtattgatatgtgactgccatagggtagagggggaatgtcacctctagaaaatgctttcaaatgagagaacaagaagcattttgataaagaaaaaagttgaatactacaacgacaagtaatatgaaacgtataaagtctatagaaaaaaattggtgtgcagtagatgtatttatacaatgtgcgattgatagttaataaagtatgggaaacaataaaaagtatgtgtcgccaaatttcgcgaagcgagagccaggtggcctccttaatataggaaaaatgtaagccaaattaatttgtccaaaggctagctgctagtttctaagttgttcaagccccctcggccactttccagctgtaatctgacattttattccttctaatatattcggcaaatcttttgccacttttcgtttaaaaaaagtgtgagtgtttggagggggggttgaatgacttgattatgcagttttttttaaataacgtgctcacttttttatgtcaacagcttaaaattgggtcgacctttctctcattgtgagtggtgttgttgtctctttctatcttttttcttgtatattttgctatctttcaaacgtccaaacgaactcaccttagggagcttttatggattctccccccttttagatcgactagaatcttaattttagcactaagcattagcatacaactcaacataatattagcgttacaatatacttcctccgtcccataaaaaataaaatcctgtggatgaatccagatgtactgtactgattaacttttgatgtctgttgttgttgcaggccattacagaagagtctcttccggctgcacaggtaatgtgattcactccacctgacctgacattgttctctgcagcttgcagcttgtgctacagcaattagtactagtaacaaattacattgtgtttcttgacatgctcgatctacctgcgctgtatgtatgtacacagcaacaagacctgtccatggtgatgaacctgctctacataaagcagcaccaagctcgcgccctcctcatccaccaccgctggaagatggaatccatcctggaccacttcgacaggaagggccgagaccgcatgctcagggagaccggcgtcgtgatccagcagcaggcggaggagaagaacggtggcggcatggccatggcggcgtcgccgtcgccgccgccgcgccccagaagcagcgtgacctgctacgtgtgcttcgaggatgtctcatcggacgctgtctccaccatggattgcggacactgcttctgcaatgactgtaagttgcatgtttttctccattttattgtttctttgttttctttttgttctgtaaaactacatcagaagaactttataaattgtatttgtgaagaacttataactgtcttcatgaaaaagaagaattatagaatttggtttcttcctcacttgcattgccctgttcttttttcatgatcgggtgtatttgaatggttgagtaaataaatgattttatgctaattgttcaaggttaaacaaatgaattaaatattataaagttgaaaaagtaattcttccgctttaaattataagtcgttttcacttagtgaaaatcaaaccactccaagtttaattaaatttatagaaaaaagtagtaacatattcaacacaagacaaatatactataaaaagtattactatgttacagaaaatatctataaacttgatcaaacttaaagttgatgttgtcaaagtcaaaacaacttataatctaaaatggaggtagtatttttgaatcaatattataagaaattcatacatataaaggttttgcgaaaatcacatacccgttaatccattcctccataaagtagacaagtagaaaatctatccaaagtattgttttgatatcaattatcaaaatttaaaaatagatttttttaacataatttaaaattagatgctttgttggtactctctctgtccgaaaatatatacctttatctaatcttcctatattttaagacagagagttaattttccccggggaaatttcatcatcaattatatacttcacggttcacgcacaagttggaaaggttttttttgtgtttgcaaaaggtgtgtgattgtgatgtgttgaaatggttcaggttggacggagcacttcttcgcgtgcgtgaacggcgggcagaagcagatccggtgcatggcggtcgggtgcgcggccgtctgcgacgaggacgtggcgcagcgcctcctcggcggcaggtaccccggcgcggcgcggcggctgcgcggcgccctcctcgcgtcgtacgtggaggacaacgcggcggcgcggtggtgccccagcgcgccgcactgcgggcgcgccgtccgcgtggacggcggcggcgggcggtggtgctgcgaggtgtcgtgcccgtgcggcgccagcttctgcttcggctgcgccgcgccggcgcactcgccgtgcccgtgcgccatgtgggagcgctgggaggccaagtgccgcggcgaatccatgaacgtggactggatcctcgccaacaccaagagctgccccaagtgctccaagcccatcgagaagaacggcggctgcaaccatgtccgctgcaagtgcggccagtgtctctggtaataaacaataagatttaaaactcaattcatcctttaggggatatcacctcattttttatgtcacttaaaaattcatcaaaatatttaaaaaaattaggtgagatagattaatatgtgatatatcacttcacaaacatgcaaattcaaactcaacttatataagtagaaacaaaaataacaaatttaactatgaatagaacatgtaattcacagttaaatttgttatttttatttcgaattgtataagtcaaattttaactctcatgtttacaaaaagatatactctctccgtttcacaacgtaagactttctagcattgctcacatacatatagatgttaatgaatctaaacacatacatatgtctagattcattaatatctaattgaatgtgggcaatactgaaagtcttacattgttaaacggagaaagtatcatatattgatctatcttgacaatttttttaaatttttttaattaccttataaacgccatgtacaaaacgagatgatgccccctctgagggacaaaaatccacttccaagattcttaattcaccttggcaattcgatcgccattgatgcgacgaccatgcatgaatgttgtttgcagctggctgtgcggcgcggccaccgggctggcgcacaactggaccagcatcgacgggcacagctgcaaccgctacgacgacgcggcggagaagaggaaggtggacggcgcgaggcgcaaggtgctccggtacgcgcactactacgagcggtacaaggcccacggcgactcgcgcagggcggaggcggagaagctgggcccggccatcgaggcgcgggctcggcggctgcgcgaggaccccgacccggccacggcgccggccagcggcgacgccgccgaggcgctcgccgccgcgcaccgcgcgctgctcgcctcccgcgacgtcctctcgcggtcctacgccttcgcctaccacatgttcggcggcgaggagcggacgttgaaagcggcggcgccggagtcggaggtggcgacggcgcaggcgctgttcgaggaccaccaggagatggcggagaggcacgtggagaagctgtcggggctgctggcggcggacgcgcctccggcgccggccacggcgggggacgcggccctgcggcgggcgaagcaggacgccgtggcgctcaccgccgtggtggagaagcactgcggcgagatgcacaagtgcatccaggacgagctgctgcccatgctcgtggagcccatgtccatcgccgcctaccgccgcgacggccctatcaaggccaaggactttccaacctgtggtggcgcgtcgtgaattgaaaagtttcagggtgtttggtttatagccacactttatcacatcatacttgtggctgtcacagtttgttaggtatgtgtctggtgtactactacagttgtgacttgccacactttttcagtagcatgtcccacactttttcagtagcatgtcccaaatgtcatagacttaattttcttgctaactttgctatactttgtgactagcaatttgtccatcacttttttttggctgccataatttacctaatgttagttgtggtaaagtgtggccgacaaccaaacacacccgttcccaactatgttatgcttactaataatgattttttaatttggagcacatagatttctttttcccgatttctatacaagtttctgaaatgaggtctgaagtttgttgctcttatagcccatagaggtgtgcccacctgaatcatttgtttcctattttagatgaagcaaaattttaaaccactttaattaaacttgcatactctaaatcaaatgtggatctgggatcaaggactgccaaagaaaaggattattttctctaacctgactccgtgggagaggggggggttaacaaattttaaaaatcaaaaaggaaaaaaaaactaaagtgaagatattttcgcggtccgttatttgtgtttgagtcggttataaaattgaagatgttttcgcggtacgtcatccgtgtttgagtcggttataaaaattgaaaatgtttccacggttcgtcatccgtgtttgagtcggttttaattttattttggttttaatctatatttcttctctactattataaaaattgaatttgttttgccggtattttggtacgtcatccgtatatgagtcaatttttaatttcgtttgcttttagaaatacatatccgtatttgagtcggtttttacgatcgttcacttttgataatacataaggaatcacataagaaatctatttaaaaaactcgcatgctaacttgagacgatcggactcctaactgtagctcaagattttctatatatgtatatatatatatatatatatatatatatatatatatatatatatatatatatatatatatatatatatatagacacacacacactagaaaaaatactcgtgcgttgcaacaggtaaagacaattttcaatgatatattaagagccgagtaataaaatgaaatattgaaatcgctatacattataattaaaaaaagttaatgaaaatcctaatattggatcgctatattagattataattaaaaaagttaatgaaaatccttcctggtattaggccgaaagccttccttcctttttcagccataagccagtccgctacctctctccgtttggtttgcttccttcgacccaaccacgagtgaagtcgttttcagccctacccatttcgctaccttcctccgtttggcatgcctccttcgacctatcaaatccacccaaaattggttgagggtttttgatccactcaatcttctctttccgttttcccaaaaatcaaactcgaggtaaaaaagattggggaagatagtcgtcatcgtcggcaactattaggttaaatccagcgaaataaagccaggaaaatcatggagaaaataacgagaaaggagtgggaatcgatttttttaatcaaattggaatagaagacgcactatcgatatggcgcgttatcatcggcaactgttatattaaatccgatgaaataaagctgggaaaatcatggagaaatgatgagagaggagtgggaatagatttttttcaatcaaattgtagtagaaaacgtacaatcaatatggcgctgagattcaactcgggagacatgcgggaagcgtagtgaacggattcaaaaaaccagacgaaaaaaaccaatgcgcacaaaaaaaaattcatttgcgtgcaaaaacaagtcacaaaaataccggtgaaaaaaaccaaacagatttttattttttggttttttgttggcgagattttttttcctttttttttctagagtcggatgattttttttcactgacgtcacagaagctatttttatttttattgcttgttgagtcggactttttttccacctttttagttggacttttttttaccgcctatggaaatttcttgttctttttaagtagagaagattttgataagatattaaaaccgaaacataaaattaaaaccgatttaaatacggatgacgtaccaaaagtaccgacaaaaacatcttcaatttttataatagtagagatatatctaagtgaactctcacagtgaatttcatcttaactaaaccatataacaataataagattaaaataggctttacctgttgaaatgcacaattattttttccagtaatacataattacatatttgtatatataaatattgaatttatagatagaaatatatacatggaaaatttttacatagcagtattttgtaaaaattaaattcgaattgaaatcaaaatctggcccataaatttgcatacaaactttcggtgtataaatttttgaggtatagacttgtaggtgcaatgcaatatttcatatgaaaaaattgaattcgaactggaatgcaaatcatgcatataaaattctgatgtacaatttttcaatgtataatttttaggtgtgcaaaaaaattttcggtgcataaactttagatgggtagacttacctaaaagtgaaaaaaaaagaggtgagaaaaaaggaaacataggacgtgaggggagctaacgcgcaatagcattttcgctaacccactttccgttcccttccgttccaacattttaccgctacggccacatcttattgatgatctctctactttttatacaaacaaaggctaagttagaaacacctatttagaatcaaacgctagattagaaacacctttatcgctatcattttggctgttgctcttttttgggcaacgatgacttgtattatgagctgcagttgtgctgccacatttttagacccggttttgtctcaaaactaagataaatcttttcttcttacatgaaaatagatagatgctccctatcctctttttcagttttaccttttctaaaaaaagaaacatctaccgcgacctcttgtttttagagataacaatgccaaattataaacacaaatcgcggtttggataggtctactactaatacaactttgtcactccggatcttaaaccttatctgtggtcatgtggtggggtcgagccgaaccgaaccgagccgagcaagctccatcgatcggccgcctcgtcgcatcaaattccaaaaaccctccgcgagctccgacgacgcggccgccatggacggcagcgacgacgagtgctgctactactacgacgccgtcgacagcgatggggacgaggaggaggaggaggagataataatgctggacgaggacgacgtaggcttgctcgacggcgccgcgctgccgccgccggaggaggaggtggagcaccgcgcgatttgctgggtgagttctatctataataccctagcctatatatctcccgttctctctcgggtgggaattaaaaccctgcagttcttgtgattgaacttggcactatgatcgatcgagttccgatattgggggagggatcgcctactgggtttagttaattcctttggaattccaaccaatgtgaccaagttaattttcatcatatattaattattgataacagcagttgattgtatcgatttggttgagagaatttgcagccctttgctgggtctctttcaatctttgatttcagtagtaagaattatttgatacacttctgaaagaaaaatgttctaaacaaaatagttgattcacttctgaaagaaaaatgttctaaacaaaatagttgattgaatcaaattcgcatcttccactgcaagccatggtcttttgtgaaagtaaatggtccgtttatacaagaatattgcattgtttcaataattgttacttatgagagttagttttagctatattttatcctgttccaaaataattgttactggatatatcatatttaaactctgattacttgtattcttcaaaaataaatataaatgcttaaaaaatgtcgtattatcaaagtgtgttgtaccacaaacataagctttaagctttcgtccactgtagtctaatcatttaaaagttgttaatggtcaaaatttaataataagtactatttgggcatgaagtattatcttttctttttattaaagaaaatattcacctcgagaagaaggctgcactaatcaagtaccctgtttttgcaggccattacaaaagaatcccttgcagctgcgcaggtaatgatgaggttgagcaataatcagtcatttcaatatattcatagtttcagattctgtccaaaatctcaacacactgttcttaaattttgctgctatatcaatacatctacaggagcaagacctgtccatggtgatgaacctggtgaacgttgagcggcacaacgcgcgcgccctcctcgcccaccaccggtggaagatggagcgcatctacgaccgcctcgacatgatgggccgggacgccttgctcagggacgccggcgtcgttgtgctgccggagaagagcagcagcagcggcagcagcatggccatggcgaagacgaaccccccgggaagcgtggctgtcacctgcaacgtctgctttgaggagtacccactcggctctgtctccgccatggattgtggccactgcttctgcaatgactgtgagttgtgcccaatgttcatctcttgaatgatgcttcctccgtttcacaatgtaagtcattctagcattg

SEQ ID NO: 62815 - DNA, 3177 bp, Oryza sativa
cagagcttcaagccttcaatccagttagcccacaactgatccgggcggcttttttttcttaaaaaaaaaaagggacccgggggcctcgtgacgacgtggcttctcccaccaccgtaactcccgccccctcgcagtctccttcccaacaactggtccatacaccaccaacccccatacccccgccgtttcacctaccacactcccggctttcctgcaccgggcgcacccaattcacacccacaaacgcacgcccgcacgcgcgcgcgcgcgctcagagacctccgtcgccgcccgccgcacgccggcgacccaccgcgccgcacgatgccgccgacctcagtgagcccaccaagaacagcgccggggccggcgaacccgagcccggcacacccgtcccgcgtgcgggtgatccacccgggcggcgggaagcccggtgggccggtggtgtactggatgctgcgggaccagcggctcgccgacaactgggcgctcctccacgccgccggcctcgccgccggctccgcgttcccgctcgccgtcgcgttcgcgctgttcccgaggcccttcctcctttccgcccgccgccgccagctcgggttcctcctccgcggcctccgccgcctcgccgacgacgccgccgcccgccacctacccttttttctcttcaccggtacgcgcccttttctttttctttttctttttctttttcttttgtctccatccgtgacgatgacatgtgggccaccccgtcttgcgaaatgtgacgtggctttttctctggctcgctgacaggtgggcccgcggagatcccggcgctggtgcggcgccttggtgcgtcgacgctggtcgccgacttctcgccgctgcggccggtgagggaggcgctcgacgcggtggtcggcgacctgcggcgggaggcgcccggcgtggccgtgcaccaggtgagcgtggtggcattgctgtttgcatcaatcttccaagaaagttgggaatctttttggggatggataatgaattcgccggagaatttagagattcttgtggaattcttcgaatgcaggtggacgcgcacaacgtggtgcctgtgtggacggcgtcggcgaagatggagtattcagccaagaccttcagaggcaaggtgagcaaggtgatggatgagtaccttgtggagttccctgaattgccggcggtggtgccatgggacagggagcagccggagggggtcgactgggacgcactcatcgccagggtttgcaggtgcggatgataattctaaggtgtattgggtggtaattttgtttgtgtagatatggatgactattgattcttggttgtttgagcagtgaggcggagaatgtgccggagattgactggtgtgagcctggagaggaagcagccatagaggcgcttctcggcagcaaggatggattcctgacgaagaggatcaagagctatgaaactgaccggaatgatcccacgaaaccacgggcattgtctgggctttcaccataccttcattttgggcacatttcggcacagcggtgtgcgctcgaggcaaagaaatgccgacatcttagtcccaaggtgctgttctttaactgatttgttatgattaaaagagttatgatcctcttgcaatgtaataaattgttagatggcattgtttttctttaccgtgaactggctagaattcttagtgatgttgtttacctaatagatgtttgaagtaacatgtgttctgaaacagtccgtcgatgctttcttggaggaattggttgtaaggagggaattagctgacaacttctgctattaccaacctcaatatgattcgctgtctggtgcatgggaatgggcaaggaagacactgatggatcatgctgctgataaaagagagcatatctatacgtgagtaagttgccctttataatttattgtcacaattttaaccaaattatcttcctgacgatgttaaggtaaaagatcttcgctctaattggttatttgttaattgtcattttgttttggctaggagggaacagcttgagaatgccaaaacacatgatcctgtaagtgctattggacgtggtgtactctgttgctgatattgaagttactctaacacactgagttattttttttctaaatgattatcagttgtggaatgcatcgcagttggagatggttcaccatggaaaaatgcatggattcatgaggtaatatatcatgaccagactcttacaaaatcacgcaattataaaatgtttattgaacagttttttttttatgaaactgcttgttatatttcttctgtacccatggcacattctagttagttgcccataacctattggcccacttgttgacaacatatggttattttacccatcatactgatggtgtggtgctaacctaaaggcattggattgcccccaccccatctttgctgacataactgattagtttgctttgttggatagatgggaattttctgacgttgtggtttactttatcctatgtcagaaaatatgaagttatttgaaaaaaagcattccttaaaaaattagttttctgtagagtttgtgtagttccaataaatttatgatgatctatgtgatatgtctggtagcaagcctttggtgcacataattctctttgattctgggcaaaccttttacactatttttgttcaacttttgttttggatctggaaagaaagaaaagtaagttgttttggcgaacatcaaagaatgatgttatatctaattgattcttagttctgaaggtaacagtgcctgtaaggactttttcctttcctaatgtagtagttgtctgtagaatgtactgggccaaaaagattctagaatggactagtggaccagaagaagcactttcaactgcaatttatttaaatgacaaggtaagacctatacacatgtttgggaaatacagttgtgttattttgaatttgtcctttttatagttttgctagttgtagttaaaatagctatatttcaacacatggaacatgataaagaaacatggaacatgataaagaaactgctcacatgaaaaattgtaattgaatagcaacttggaagagtctgcccatgcttaaattagttcctgcgccgataaccgaaaagttggagtcacatttatcaaattaagaaatatata

SEQ ID NO: 62816 - DNA, 2669 bp, Oryza sativa
caatgacctacattgtgaaacggagagagtactatgttattttaaaaatgtatgacacgttagaattttccgcacaacgtttgatcatttgttttattcaataatttagtataaacatataaaactaatcgatgacaaaagaagtcagaacaaaataaatgatatttatataatttttaaataagatagatagtcaaatattatgtgaaaaattaaatccgtcgtatatatatttttgaacgaagcatttcatttttcgcataatgttttaccatctatcttatttgatttttcggatatatatttttgaaatgggggagtatttgttggtagtaaatgagaaagatttgatgatctttttttttttgcaattttgttcgatcaggttggacggagtacttcgctgcggcggtgagcgacggcagcaagcagatgaggtgcatggaggtgaagtgcacggcgatctgcgacgaggcggtggtgcggctgctgctgcacgggaagcaccccggcgcggcggcgcggctggaccgccgcctcctggaggcgtgcgtggaggccagcgacgcggtgcggtggtgccccagcgcgccgcactgcgggcgcgccatccgggtggacggcgggggcggcggcgaggagcggtacgccgaggtgtcgtgcccctgcggcgccgtcttctgcttccgctgcggcggcggcgcgcactcgccgtgcccgtgccccatgtgggacaagtggggcgccatgcgcggcggcggcgaggtcgacaacctcaagtggatcgtcgccaacaccaagagctgccccaagtgctccaagcccatcgagaagaacggcggctgcaaccatgtcacttgcacctgcggccagcatctctggtgagctcgacacgacatctatcgattctccatgagattgatgtcacgccattgttggatggatgcagctacgcgtgcggcgcggcgacggggacgttgtacatgcacatctgcaaccgctacaaggaggagggcggcggcggcggcgtgaaggtggagatgaccgccggtgggcggcagcggctgcggttcatgcactactacgagcggttcgagatccacaccgagtcgtacaaggaggagcaggggaagctgggtccggccatcgacgctctggcgcggcggctggaggcggacgccacgctgccgtggtcgggcaccagggacgcccggtggccgtcggcggcgcaccggcggctgctgcggtgccggcaggtgctcccgcggtcgtacgtgctcgcctactacatgttcggcggcggcgcggcgacgcggcgcgagcgggaggaggcggcggcgcaaaaccggttcgaggatttgcaggggcagctggagcaccacgtggaggtgctgtccaggacgctggcggcggcggcgcggccggccgacgcggcggaggtcgtgaaggcgaagcgcgacgccgacaacctcgcccgcgtcgtcgaggggctgtgcgccgggatgtaccggtgcgtccaggacgagctgctgccgctgctcgtcgagcccatgaacatcgccgcgtaccatccggacggcccggccatggccaaggagttcccgccggcgaccagcgtgaccggcggagcaccgccggcgacacgccactaagccacaacgtgtcgagttcattattactatacgaagcaaggttgtaaacggtcgatgggtgaagggaagcaggtggttttgggaaaaattctattgtccaaacatgtttgtggtttggcatggtggatttttggattaattactagctaagtagtataggaaatatcctatattgatacagaggaaatgatggattattttgtgctgattaattagtctaattgttcgacgttgtgcaacgtttctggataacttttcagtatacgaacacttcaaatgatcagacctctcaataatttgcagccaaccaaacgggtccaacttcatcttaaagaccctatcctatgttgtttgtggtctgtttataggaagtcggagctgctcttgagagcttggtttgtttataggaagtcggagctgctcttggtagcttggcaacgatgacctttgttttatcctccagttgtaccgtcgcaagtttttagttttttctccgtgtgggttttgctcggtttcccccttcaaaccgtgcttaagtgagttttttgggtccggtttcccttaaaaaactgggccaagtctcttattcttaattgaaaacaggctctccctatcctcttttgaggtttttccaaaaaaaaacaattgtcggtgacacataaatttggagatatgaaaacaaagtgcacgaatggtaattaacacacgtagattttgagatatcaatgtaaacttttttttaagaaaaaaagaggaacaactacagatgacacaaatacatttggggatgtgaacgtaaactgaaaaaagaaatagcacaaacatggtgagaaaagttaggaaaattgacaaccacgatgagaaaaatgtaagtaaataggaagaacatggaggtttggagatatgaacataaaccggaaaaaatagcataaacatgatgagaaaaggtaagtaaatagaaataagatgaatctagagatttgatggatgatgacaacaatcaagaactaggccacc

SEQ ID NO: 62817 - DNA, 928 bp, Oryza sativa
  unsure (1)..(928): unsure at all n locations
gtcgtaaagaagtggtcctcgttaggtcgctaggtcatcattggtgagagtcgttaagtcgttaagtcgtcgttcgtaaaattcgttaagtcgttaagtcgctaagacgtcgttctcgctaagtcgttaagtcgctaagtcgtcgttcgctaaaacgttctcgttcaaacgttccaccatgaagtcgncggtgaagtcggcgcncgncgncgaaggncagttatgtcgncgncggtggtgcgnncgncggtgaaggtgnaggtgnagttggcgcncancggtgnaggtgaagtcagcgcncggcggcgncgncggcggtgaagtcgncggtgncggtgncgncggcggtgaaggtgaaggtgnacttggcgcacgccggcggcggtgaaggtgaagtcggcgcacggcggcggtggtgtcggcgcccggcgacaacgacggccggcggtggagtcagcgacgacgatggcggcgaggtccggtcggccgacgcgtgtcaagatcgatcgagagagagagaatgcgagatcggaggcgcaagatttgcgcccctcaccttgagggaggcaatgctgccgatggcgttggcaagggcggatgagcgcggtgagcatggcgacgacgacggcggaggcggcggcgatgtctggggcggtaatggcgcgagaggaagaagatcgatcgtggagaagtctaagtgtggcgcggggaagccgatgcagtggatatttatacccggtaatcttttgtcctggttcgtggcttcaaccgggactaaagatatctttagtcctggttggtagtaacaactgggagtaaagaacaaatgtttactcctaaagatggttgttactactaaagatgtgtacacaaaacccatttatggccttcttaaattgtctaacaagtcgaaataaataccaataat

SEQ ID NO: 62818 - DNA, 4898 bp, Oryza sativa
caaacaccacatgtagcaggcccaaggaacaagacaatgtgctaacaagatggggcttgacatcttgataagttggccaattatccaatagttttattttatactgttgaagattttccccctaaaacttttgcatttttagatcgttcgaatgtactttgagattcatacggggagggaaaaaaatctacgctatgagcgaggcgggattggagcagctgatctcatgggcgaaagaggagtgcaactagctaacctagctacatgtgtttcatatctatcttatatgttatatatacgtcgcattgtaaccacactagagttgcattgtaattatactagaattacattaaagttacatttgaaagatttggtagatttttatgttgaaagttgtataagtaatccttatctaaatagcacacgaccaacttatccatataacatcatttttttgcaagggaaaaaaaatcatattttcatccaaattccgtactaattattaacatatgccaaattttaaagaaaacatataccaaatctttatccaatcaaatttacgaatttacaattgaagcaaactaacaacatccgatcagttttcgtccctacttctatattactataatataagatgacaaagtagtagttgtattctcaatttatacatggcataggcttgtaatttcttacaaactcctagggcaaaggctatgaaagatgcagaagcggggcctttgcccaacttaaattgatgggactgggcctagctaactgactaggcctagttgggctttccgaaagcgccccacatatcgggcccatcaagcaacgttggcccatcacatcacgtatttcaattcgtatttcttcagggactcggatgtaaaaaccgacccagccaagcctcctcacccccacctgtcgtcccgtccccaagagagattcgtctcgtcgccgtctagggttttagccgccgccgccgccgccgcgaaaccctcgccgcctcgcctcgcctcgcagcggagtcaggatgttcctcggcgcgatcccgcggcggccgagcaaggaggtggcgtacaagcagctgcgctcccacctcatcgtcatggcctcctgcgttgccgccatccgcgccgccccctacatcctccacttcctcaaccgcgacgcggaccgcctcgagctcaccctggagctctaggccgtaaccatcccccgtcccccgctaggtgagacacccgcttctccctcctctcctcctctttgattggtttaattcgggattggtttagttgggggtgaaactcctctttgattcgggacggaactcgcgatcccgttggagaaaccgtgcggagatcctgtgcatgcttatgctattagatatttacccttgccctaatgatctatttcgaatgagttttgcacggttaggttcatgcttatttattgcacaaacgatttttaactatggttgatgcacctcgtataaatcttgtatggtgggtattcagggttatggtactgtaatgctgggttgcttacttgctttaaacaccactgttttgaagaagctttctaattgttgaatgctgtggagaggatctggtagagttaaatggattggtattgcattggaaataataggatccagtatgctgatctatattcttgtagtattaaatttgtgcaccttgtttagataataattcctgtttagatttggttttttaaagaatatttgggttctgtgagtcattgggctatcgttggtgattcgttttctttcttcatggtactatctgccatctttagatgccaattcttttttcaattggataatttattattttttctgcacataacccttgctggatttgatgcactcgaaaacggatggcctaccagtgtgctgtaaatcagtagcatcttccatctattgacaacttcagagttcatatgcatttgttcatattatcgcgcaaactagactcatgtctcagccaaacactgtattggtcaaaagctgttttcaaatttcttgtcaaaacaaagttcatatatgatgtaacagaagaataactttaaattttgttttcctaaaaaaatcccacccaaaacatattatgtgacaagtcattaacaatccttgcaaaccgacttgactgaaaggattaagctatcttttgataatgttagcgcttctgtttctataggaatttctcttggtatggtcctcaaagttgaactttgacgatagacttacggaaatgcatttctaatactacagaaccgtgatttcacaaaattactttcgattttcgaatggatctaattgttccacttttatatcactagttgtttaatctatatatgtaataagacttaactattggtaaaaatatgcattaattgaatattgagatatgtgcatgcttattagtattttttacctttagttgatttacattcttattgtgccacggattcttatgtttatgatcaattagtgtgcagtttgattgataattatagtagtctttatgtatcggcatcagctttgggtcacatttgtaatgttaatgtaatgcactcctggttttgcagtgttcctgttctatttggtgtgttgtttttcccccaattgatttagaattaatatcgatatattcagtatgttttcaaatttcaccaattatctttgctgaataacgataggctatatcttgtggttttatggatttaatatgttctaaattttaatttttctagctggtcaatgtgtaaacccgtgcaatatgttcgtaatggtacttctactcctgtttggctactatggcagcagattacatacaaaaacatatcagtcttttaagtaggaagaaactagagtatttttaagttggaactggaatacgtgttccaacttccaagcgtgtctagtttgcacccggctactaactaagcctactatatgcctgctgaactttttaaacagtgaggttcattattcagtcacaagtcatcataacctaatgggccttgttgaaactgtttctctgttcactagcaactcaatcaatagttgaaccgttgatgtgctcagtgagtttgttcttgtatctggcattggaatccatcattcgacccagtttttttttataaatgatctgttaaaataaactaccctatattaaatctgcattattttttggttccattgtgggaacttttgtggctaaatgggttgatagcatgttgctattttttcacctaattacaaatgagcctcacactgatttgtttctgattcttgttaggtgctgcagcgatggacgaatcatcttcgccttagtgttccatggatggttgcaaagctatgtttggataggatttttgcagaccttataaaacttaatcctattatttttgcttgagaggcatttagctttctgtacgataactcaatggcagcactcctcgacttatctgttctttaagtttgcagtctttgcaataggcattgtgtttcctattgtgcttatattttaactggctatggagtgatttctgctattttacttgaggatagtttagaaaaacaagactgagccatggttaaacaagcaagttaagatacatggttcggaaaagctttctaagcaatttcataattgttttgagggaagttcactaaacgttttggaaattacggtgagcgtaaaatgcatgtgctggcaatatgtttgtcctctaatctgatctggaccctcggttgattgaaaccatcttgcatgtcgtggatacgaggctttgttaccaacagttaaaatagcaacaagagttcaagatcatgaatgaaccttttcccttctcttcttgtgcttgtttttatcgtccctggcagcacggcttctaccggaaatgcttaccatgcaaggtggtttataagcatgcaatgctgtttcaaaattaaaacatttttttattaaattatttatccaaattctaaactaattatatttttggatttcgttacaactaaatctttataacaatatatcacatgactatattatgacaatttttttttaactttttaaatgttgcatatgtaacgtttcaatttattgatgtttcactaatgcatttgcaatgttgcatgttatctttttatttgtttcagaaaatattttttttatgtctcaataattacagtttgatgtttcaagctaaatgtaaatttgttaacaaaatcaaatattccaaaatgcttatagtcatacatacgacgcaatcacataaatcggacgcctccactccatgctactagtatattaaatagatgctcatagccatagcctcatgtatgatgatgcatatgcttaaaatgatgttttctttaaatgatgttttcttttatgttacatatcaatgatctaattatatcattatattcgttataattaaatctttatcacaaggatcttacttattatattctaattattttttaacataatttttaatgttgcgtatatttttatttagatgtttcaataagcatttttttaatgtttcactattcatttataaatgttgcacacaaacttttttttgtttcgtactgtctacaaaatgttttagcaaaattaattattgttgtgaatatattgtatgtttgacatgccttttttaaaatgctttactagttgggactaaatgtttcatgagtgattattgatgttgcattgtatatctttgaaacacatctgatcaaatgatgaaacaattcttttataagcggtgaaacaacactcaaaaatttcattcaaaatataaccatatgatatcttattgccaagatttaattgtaactaatataacaatgtaat

SEQ ID NO: 62819 - DNA, 9079 bp, Oryza sativa
  unsure (1)..(9079): unsure at all n locations
aggggcggtgccatggggcaatcgcgcgggattgatgtggtctcccggattggtcgcacgacaccggcgcggtgccacggtctgctggcgcagcaccaacactattttagacataatcggttccacgtaacgatgccgtgggaccgtctcggtgctatgtggtctcgctggccaccacgctgccacactcttggtccgtgagaccatggcggttccgctcgtctgctcagcgggaacggctcgagcggcgctcccacgtattcgatctgtgggatgcgtatatttgtgccatttcttcctatgaagatatataaactcaaattattaaaaaaatgggtatattctcaattttttttctctatcttttctgattgtatatttgttccttgtacttcacgctgttttaacttggagaatgattagtttatgatgagaaaaatgctaattgtatattaagcaagaacagacagcactctgttgaggaaattctcagcttggagttaattagacttgaggacacctcaatgttgtaaatgtcccacaattacttccaattcctgtacaccacattttttacgaactgttccttgttattcaatttttgcacattagtctaacgtactgctatgtttctctttggccttcttaaaatattaaacgaaaatgcccaggataaattgtaccaacattatgccactccaagctaatcgtataattaaccgtgtgaacaatttaaacttgcaaagtgttctgttataataatgcaaagagctccaacagaagaagaacaatacatttgttttgagcaataacattagaggcttaagtagcggcttaagggtgttttacactttcccaacttttattttctcgttttctatataaaaaatgttttattacctccgttttatattataagtcgtttgatttttttcgaagtcaaacttggttatgtttgaccacgtttatagaaaactttcgtaacatatataaagtatcaaattgtttttattaaatctatcattgaatatattttaacaatacgtttattttgtgttaaaaaaccactatatttttctataaatctggtcaaacttaaaaaaaattcgagtagaaaaaaagtcaaatgatttataatatgaaactgagagatcactaattatttacgcatcaattcgtcatttctttttattggtcggtgaggaaaaactcgagcatgtgagcatatgcaaacaaaatttaagcatcgggtttttccctgtgtgctattaagaaagatggtgtctacctccgtgccactaaaaagttcaagcctccttctctatcatcgttgaactttatcgagccctccacactactctctcttctccctcgattcccctctctccgcaacatccgcgtctgcctcactcctggccagcgcctagctgagcgtggccgagccgctggacgcctgcaccgccatgctggcctccccttccctcgttgccgccgtctccgccgtctctgccgagccaagcggacagcgctgctggccacccctccaaccggcgttcgacctcctcctttgcccggcgctgctttggctcgtgcaccccgacggcttccgtcgccgccgtgccggccttcccctatcctcctcgatgccgcagggccaccttcatgccgcagccgcgcagggccgatcggcgcctggccgccacccagccggggcaccgcgccgccatcgcctcgacccggtcgctggctgcgccgccgcccctagcctcgccgctgcactgggccgcccccgaatggttgccctccgaatggcacacaaggaaacaaacttcattaaatgtcctctcaagcctaagggcaactaagttatttggctgcgccgttacccaccgttacgactaaaaatggacgaaataatgtggagggcgtgataaaatttgatgatagtagagagagaggctcaacttttttttaatggcacaccatctcaccatctgccctttcttaatggcaaacaagggaaaaacctccaactctgtgctgtacaacggctaaatattcgagaaaacccctcatattattatgaactgaaacacaaacttcgtcggcagctgaggcgcgatgcgtggcggcgcgccacaactggagcggccctcccctgagcctgaggggcagaggtgggctagctggagcctggaggtggcagcggccgccgcgcactcgcaactactcacaagccgcctcggccccctaatcttccgcgagaagaacgcggagtagcagcagcagaggcgtgcggggtcggtggactcggtgctaacggagcaacctttctgctgggtaatactaagttcttgccaactctaatatcgcctgcaaccgttcttagctatgggttgccgccgcaacggcctaaatcggttagatcaaaataatccatctttagcgatgaggcagatttattattttaacacattgaaatcacatcacatggtactgtactagtattattgattgatacacttgtgatgtcatgccagtaataatgctgtaatggtaaaacagagggatctaaaagcatttgactgaacaagaacagtaggatcaatctttgtgcatgccttctgggatcagtactgattgatgctgaacctttctgctgtttcttgtgctatgtatgccttgatgcagtgataagagcataagacctcttctcctgtgagcagaagcaaagcaccggggattgattctggcacaggcatataatgcagtaatatgcctcaagacagatcatctcctttcggtgctttgaaattttttcgccaaccagcaggtgcgtgcaaataccgatttgcttctcctgctagtctgcaagcagacagccattaaacaattgcacatgcctaaatcagaagcaagccatttgattgggaactccatcaaaacaatgacaagaagattctggtcctcacatcatgggagcactaagctatgtcactgtcactattctggaaatttctcaaggtatttgatagctatcgcgatttctgtaggccttccagactctgttggaggagttttatcaggacctgtgtcaaatgtggcaacaaggtggtactttggtatttggtagaaatttatattgaaatgatgggggaggatcggcattctaatttgggctgtgtttagttcgtgtgccaaattttttttgaagtatacggacacacatttgaagtattaaacgtagactaataacaaaacaaattacagattccgcctgtaaactgcgagacgaatctattaagcctaattaatccgtcattagcaaatgtttactgtagcaccaccttgtcaaatgaggctaaaaaaatttgtctcgtgatttacatgcaaactgtgcaatcggttttttttttcgtccacatttaatgctccatgcatgtgtccaaacatttgatgtgacggaaaagttggaagtttgaatctaaacaaggcctttggttcaaatgtgaaacttcaggaagaaattgagacccgtgcattccccaaaggtgcttctccattacagcacatggtcaacaacattacttgctgtaggaaatgaccttatcatcatgcacactggtggtcctattcatatatctagtctctttcgcagttcccctaatttttggactgaagttatagccttgtaatgatgtgatgaacaatgagattgcgctgtcacatcaagggaaccccagtccctactaatgtaatccacataggtcaaatggtggttaatttggcactcttcttgtaccttccgagccatgttgaaagttccacagaaatattgggccatccaagtagtttctgaaagcaacatgaagaccagaagcatctatattagaacttgatcacttctcttcagcctgctctgggttgctgaaagaagttcttgtttcttagagaactttgaattttctgaagataacagtaaagaaagggctcctttcgcaatcttcacataaggggagggttcagtaacaagttgagatatgggaaactgcgccagctttactccaaaatggtatacatctgatctcgctaaaggtttcctgtcatactattgcctcgcatcttttgatatgcttacttctgtttatctctgtgtttctcaggggattaagtgatcttcactgtaagggtatggttccaattgatgaggatgaaactcacgaaggcataaagacaattaggattcagaaagcctgtgaattcaccaccagttcagttctttgcgtctgcattatcacctggaacatgaacggcaaggtgcatataatttacttcatttcattcttctagatgatgactgcgccattttctttgatctgatattcattgtttgtgaagatgtctgtggaggatgtaacaaagttagtgagctccaacaggaagtttgatttgctagttttcgggttgcaagaggtaccaaaatgtgatgttgcacaggttctgcaagaaaccatggctgagacacacatgtgaggacctttccgtttcaactcctcaattgaatacttggaaggctttcattgtattttaatatagtttaatggttgtcaaattttagtctattatgccagaaaaccatgcagtctcttcagatgtttctttttggagcaaagagttcagagaaatacatcagaggtgattccatatttgttcagcacttgaacctgtacatacatacatatggccagatgctgttcatgtaaaagtatctttttctttgagtgactaaaatttgtttaatttcctaattttgcatagagttgaaggtggacaaacatgcagttggaggttgtggaggtataattggaagaaagaaaggagctgtagccatgtacatcaatttcagtggatccgtatgtttttgtatcctgccatcttgcaggtttccttttcagctttggataatttcattttctcagtgtcacttatactactaaatatgtgccaatgctgatgtcctttttgttatcgcttaaccattcaactgtgccattgctacacagtatcaaatggaactaaagtagaactgttttacaattccctttgctgaatcacttggatcaaaagatatttgatgatcaaaggatatcttgacaccataaactaccatctgcttatactgatgacaagttgttgctaatttgccatgaatcaaatgccattacaaacaactaacaggatcttgctgaagtgtagctcatgaaaataaggtggagaagaggaactcagaatgccagcacatttcacactcactgttctccaagaatgatatacagtatactaaatctgcagacataacggtgtggcttggtgacttgaattacagactacagggaataagctcaataccagcaaggaagttgattgaagagaatcgtcaaagtgtaagtgtatgctgaaattacatatttttgcaccaggacgcctcatatattatatgtattaattatttcagaagctaagaggcaaagaccagcttctgcaagaagctgaaaagggtgaagtattcaatgggtactgcgaaggaccttgttgtttaagccaacgtacaagtataacatagggagtagcaactacgatacaagttataaggtatctctagttatatcatttgtgaatctaaaatggcaagctgcagatctctttcaattgtggatattttccacaatatctaatggtttgatcttcacttgcacagatcagagttccttcttggacagataggatattattcaaagttgaccacacttctggcttggatgcggtcttaaactcatacgaagcacttgattgcattaagagttctgatcacaagcctgtgagagcccatctttgtctgaaagtacatggtgacagtgcatagatagacatttccagattaaaaaaaaggagaaatataatttaaaatgattaatttgtacaattgtgtataacccggtgatgataataaagtatggtggtgtatctgactatctgctatgctgagcaagaccaactgaccacatgaggcatggttaagcttaagcagtactgactactgaactatttctttcctagttgcaatagccaacatatgcagctcatgtaaaacctgtcgacatgcatgtttctgatactgttctttcctccttccgtacgtctgatgtagaagacttctgcaagttgcaatgcataattgtgctgtaaatatgcagcatagagagtctccataacgtatggaggttactgaagtgtgtttcaagttacagttgtgatggagtatagtgaagtagtatttggagagtggagaatggggttgacttgtggagcaaaataatgcagttccagagttcacttctaggatggtacagagggaaattgtatctgaaaaaagagaagcataaatgtttcagaaacaccatgccttaattcttgcatgatgttaatacatattcttgctaaaatcagtgtttcctttgctgattggttcaaggacagtatggttaataatggtttaacactcaaaaaatggaatcatccctactatagacagtcttggtgttcctttcagcaagtgcttgtcacagttgcgtcggttaggatgcatcttctcaagctagggtgcgtgatccttcaattttggcagcttgtctactactagaaagaggttatacatcttttgtctggcctctggccttatctttcattcactgtttttctgtacttcttttcttgagatgaattgatcttttttttttggtaaaacttgatgaggtgatacttattgatggagatgaagagaaaacatagtagaaaattgtcagatgccaagagcccaagagaatagaacacatggtgatttggctaggattatgtccatatggagcacttcatgataattctagtcatcatcatcatatattgaaaatgatagttttaattgaatattgtgggtgaaaatgtgaaccataggcccatagctaactaacgaaatgcgttgtgtatgtgagcacttgtgattaagctaattaattaggcattgcatctcccgtccatttgacgccttcaaatctactttcgcaaatagcaccttacaacttgtaacatatttgcatcgtcgtagctgttcgtcagttccagtcttgcagaatccaaattcaaagtttgtacagataaacctttttgcaattgtttccctgccatgaggagaacctgctggcatctggtaagagccattttaaatccagctgataaaagtttgtaagttgtttgattaatagatttttaagtctggttataagtatactaatcctttcagcttgtaatatttgacattattaacttttagacatagtttgattattcattttattcaaaaatgtgtgcaattatgtaatagtacaagtcatgcttagattattggtaatgataaaataaatcacatcaaataatagttgtgtagtaatttattaaagcttggccaacccacaacaacaaactgccaacataatccaaatcggtgatgtggcgtttccaactctttgctaatcatcgatgagcctagcagctgccaagtgcaaccaggctcgagcgccggtggtgtttagctaacactatctatttcaaaagggaagactagatagtatcggtagagccaggaacattaaaaaaaatgttaggcgccgatagtattgatattgttttaagaattttctttgttctagtaaatacaacaaaaaatttcaaaccatgggacaggccaagctcatggtcgcctctccttgtctttgccgatgctaggtagcaagtgagttggcttagttacaaacatccattgatggcttgttttgcaaatgagattatgaactaaagggtaaggttcaataatatccatccattatttttattgggcttcccctaatacatgagtgatcgtgcacatcaagatacgtgattaggaaacgacaaaaaacagcccaccctagcctatgtcactggcctaactcatatgctctctctttctcttttcctatcctcttcttctccgccacaaaaggaaggcgagcttacgacgatacaacaaggaggttgatcaaggcaacgcggcgacgaccttccttgccccttcattttccctccagcaaactctagatctaggtnagctccactctcccacctcctccgccgccctaccatccttctccgtctcacttttgcccccgccacaaactctagtctactgcccgctaccaacccagtggctcgcggccgcccacccttgttcgtcacccaccgtcggtctgctgcctcctaggtaatccctcttaagcttgatccccacttccttcctcctcaaatctcacccataaaactctaatcctaatccaacctagctgcttctcgccacacagtcgaaaagtgatcgtgtgcgcgactgatcgcgaggtaacattttaacttttagctcatatataataatccactcattcacattttccaatcccatcccttataagttataacccattgccaaagagggcctaaatagatttctttagccatttaaaaaattctcaaatttccaggactgtgagcccctttctgtaaaatcaccgagaaggcctcgatgaagaagaaaaagggaagaaagagagcgacctctcaccgtcgctccaaaaaaccacatcactattcacaacagccgcgggaaggtattaaaatcgagagcgcccaaccaccgctgctctctccctctctctgctgcatccgcccacgaggtgttcgacggaatgcgtgagagagacgccgcagcgggcgccacccctccccccatgtgggcctcctccctactccctcttccccctggccacgcgcgggaggggacggggggttgacgtcccgcgacagcgacccgggcggtgggcgagggggagtgtggtgtgtggcgtgggagagagagagagatgtcaccttcaaccccagtttttcctctttccttctcttttcttcttgacttggcctactgccggtcgtccctccc

SEQ ID NO: 62820 - DNA, 1463 bp, Oryza sativa
gcgtccatgtcacgctttcccttcgttctgtttctctctcctcctcctcctcctcctcctcttcttcttcttgttcgtcgggttcttgcgtgaggcctgcttggggggatcctcgggcttcttgtcgcaagaaaccaaggaggaggctttagccgaattacagggctacttggtgagtcttttggtgatcctcaggcaaattatggtgatccttagttgttttctgtagaacttggggggataatgatggcgttttgcggtgaattggtgaattgtgtactttgtaccagctggttgctgtgtggggactggcataatgacttttgtttctgttaaaaagtacaggagttcaggcttgaaagtggtggccaggtggggttgccctgatgccttcaatgatctgattgtttctatgcggtccctgtggttctgaactcgaggtatttttttttcctccagtgatatttgcttttccttttttttttccttcgatactgcttgcatctgtgttgttaaaagttccatttttcatactctttattgtccgttttgtcttcgttagtatctgctcattggcatcatctgtgttcaatgattgtttgactcatgactcttttatgtgctttaccatgatttcaagatcctctctagcttttcgaggcctcctcatggaacaaatgtttacattgatcattcaatttatctattgtctttgctaatttgttactactaacaagagcaatattgacgcatcatactgtaatggcatcacaaaaatgtaaaattgctaccagcgggtaccacatagcctgagcaactgtttttttgcaggacccgggtctggattttgtggaatttgctgttgtcagaggttcgtgtgtattgcttgtgttggtccttttcctttattggctcggaggaataccaatcatagggagatatgccaaagagactggacatgtaatgtgattggttgctggtcattttagttcatataagagcattccacattacattttcatttccatctgtatttttctgacttctcacatacctggccttttcaaggcaagaaagcaattttatttttaactggatcctgtcatggataatttattccttaccgccaatgtccaccaatttatagaggtttatatcttcactatgtgcttgcatgccaacaattttacctttttaccagtttggaggcacaccaagccaatatctaatcagataaatgaatatttgatatcctgttctgtatgtagttgatattctgtttcaaaacaaaagagcacatgcttgaagcacccagtaaattatacatgtgatgggcagatggggcagacactgtagggatttttatctacatattgtctcttaccaaatacatgctattgcagtcttcttatttatgagtactatatacatgttattgcacaatttcaatatgtatttacaga

SEQ ID NO: 62821 - DNA, 532 bp, Oryza sativa
  unsure (1)..(532): unsure at all n locations
gcgaatnctagctcggtacccttcacttaaacaaatatcttctcgccataatatttgtttaaaaataatagtcgctttttttaactcagtaacaattgtttcaacattaagcaaatcatctaagcgtgcagccattttataatcaatatataaattctttactacaaatgcgtgtgaatctgctaataatcgctgctgcgaaaaacctactttacgcaaaaattccgtacgtgctcgctcaaaaaagcagagatagttagcatgataaacaacgccgcccgcatctgtatcttcataataaactctaattgggaaattcatctttatacctagccactaaattacttataacgatttaaaattaagcaaaataaagcactattgtagaaagagaaaaattgttgtgcaatagcaaaataaaaaatattttctataaaaaaatgggaactttttcgaattattttaataatattagaaatattaatgtactaataacaattaaatatacccataattggtaaaaaaagtaatt

SEQ ID NO: 62822 - DNA, 8293 bp, Oryza sativa
tttcgtgcatccttgccgaagtctttaaatgttctgtcgatatttcgccactgcgacccgtcagcggggtgtctcagcatctcatcctgtttacgttcttctgcgtgccaccgcatcattctagcatgtgatttgttcctgaaaaaccgcttcagccttggtattatagggaaataccacatcaccttagcaggaattctcttcttcaaaggctgtccgtcaacttcacctggatcatctcgtcttatcttgtatcgtagtgctttgcaaacagggcatgcttccaggttttcgtactcaccgcgatacaggatacagtcgttcggacacgcgtaaatcttctgtacttccagacctagagggcagactgtcttcttagcttcgtacgtactttcgggcaattcgttcccctccggaagaatgttctttacgagtttcaataactcgccgaatgccttgtcactcacaccatttttagccttccattgcaagaattctaggatggtactcaactttttgtagcccttctcgcaacctgggtacaacgctgttctgtggtccgctaacatgcgctccagtttctgcacctccttttcactttcgcagtcctcctgtaagtcccgcaatattcgaccaagttcatcagcaccatcattcccttcaacatccagctccgcctcgcccattgtgttttcttcaaatccgccatactgagccgagtccggaatgttctcatcttctacttcatcttcttccattgcaaccccaacctctccgtgcgaggtccaacatttgtagctacgcatgaacccccattgaaacaggtgggcatgaatagtttgtgtggtggaatacttcttctggtttttgtacttatcgcatggacagcttataaaaccgttacgcttgttatcattggccacacccaaaaaataatgcacgccgtcaataaactctttcgaccaccgatccgcgtatatccattgccgattcatctatatgaaatacatataaatcgtaattatacaaaatccaagatttacaaggtaattacataataatacaataattgaatataattattcatacaattaatcattactattaaattcattgtacatatttttcatgttttaattacattataaacaaatatttaatatgtttttcttattttaatattaaattagcttagttttataatttcatacaaaattatatttaattattcaaacaagtatttataatcttctttattccctacacacactttctctctcatcatcttccatcacattttctagagggaaaaatatgtaaaaaaatagctccaaatgtagatgctaagcaaaacaaagaataggatgaagttactaaccttttgaagacctcaaatttgtatattaccacaaaaaaaatttgcttaaaattttgacggtacctccctccctcaaagcttaattttgaagcaatggctcgggctggaggaggaagaaggagtatataaagctgtgcaactttagtcccagttggtaacaccaaccgggcataaagatctcaaatcacattagtcccggtttgtattaccaaccgggactaaagatataatctttagtcccggttggtaacacgaacagggactaaagatcccaagccccccgacagaggtctgacatgccctgtcaggaggcgaaccgggactaaagatccctttgtcccgttgaagtaataaaccgggactaataagccactttagtcccggttcgttttggaaccgggactattgtggaaatcggctgaccctccaaagacttcttctctagtagtgaggcactccgcaattccgcatggcggcgttgatggacacgaaccggtgggggaaatagcattattagggatttgatggaccgttggtcatgaagggttgacagatcggttggctgattgattgttcttcggttctcatcggtattttcggtttaacaaagatccaaaccgagctgtgtaacgagtaccgaaatgcgtgaaaataaaaaccattcgcaccaccgaacacctgaacaaaccgctactttatatctcggttcggttcggtcttattgatgcacaagatcgacaatgacaattactcactgaaattgacttcagctatttcttgtgccctcaccaaatatattgtcaagtggatggatttaccattgtacgatttcctctgagatagaaatatccaaatcggtaattatctacatactatcaactattttaaatacatataaaagatataacatcaatgatcacgatcacacagataaacaatgccttaagaaatacggaaaaggtaaaactagccagaagaacaatgagcagagaaaacgtttcatagaaagaaaatcaagctgaacacttgtcccaagtggtgcaactgtaaacattggttgcgtgggtagattaactcaagatatgccattattttgtgttggtttccggagttcaaaaagattgaaaagtcaaacccgaaaatatgttttgttcacttctgaacacaacatattatcacagaagaggacaagaacatgattgaaaccaattgcctccgcctcgcctactaactagacctgacgtggctgactacaagggatggacaggactgtcatcacctaccacctatcgtcccctgttgatctagataccttcctagattacataggaattaggaaccgcaccgatggtcgatcttactactctaacttagttgatcgaagcagagcaaccacactagaagcctacgagttagaaatatattcattaaaactgcccgataaagataatatctaaaagataaatacttgaagtaaagtaaaatgtatattaaatggattcggcatttggctattgcgaccatgatattattgatgacgttgttcagcaccgagatcttgcagtacgtgaagccttgcggcacctcgagctgtgacatggacaccgccgactagcttgtgaaccaccggcgtcataagccgtacgtggagccgatgacgcccatctttgtgctgaaaagctccatcacacactggtggtaagcaaccttggccggccggatgtactgcctctactagaaaaaccatttttttgcagacgttaggtttttttttttcagacgggtatcacccttggagacaaatggctgcctacaaaaatgacatctgtgggggtgagattgttgtccgcctgcgaaaatacctctttttgacgatattaaaaacgccgctacccatcaccaaaatctctaagtcctctcctctcggcaccaaacgcctctccctctccgcctctctctctctctctccgtttctcccacctctcctctcccgggagctgtggcggtgacggcgcggagggcggtggcggcgcggaggtggcggttactagcgggaggcggagggtgtatggacagcggcgtctcccctccctcctccaagatccggtggaggcgccagagcggagggcaatggcggtggcggcgcggatgttgtagctaccggtgggaggcggagggtgcatgggcgacggcgtctcccctccatcctcccagatccggtggaggaggaggcgaagggaggtggcggcagcggctaccggtggtgatgacgaggagggtagaggcggcggcgtcggcggcagccctcccctctggatctggcgtggcgacagtgaccctcccctccgaatctagccggtggcggcgacctcccctccggcgacgactgtgatgctatgtatttgttttgattatgaactattttgtttctatgttaatttgtgatgtttatgtgaatttggtttgactggatttgatgggaaataggaaccgaattggatggggaatgggaactggatttggaaacatgaagctgcagccggccgaaacggcgtggctgccatttttttaacgctagaaactctttttgcaggcggaccaatcactatttttacaggcgttgcgttgcacgtggaccagttgtccgcctgtgaaaactgtttagcccgcgtgaaaaaatactttttctagtagtgtgctgtattagctagctgcgatgtcatatacaccgagatcgactacacacttcatcaccatcgacaaggcatagcccagtgcatgcatggtcatggaacttgctgtcgttgcagctagaaaatccccaaccaaacttgctaatctccaggagctgcattccttacagatgcgtgagccccactacctcaggactggaagtttatgccatttaattatgagagcctgacgatcacttatcaatatcctattctgcttttattctccgaagatccgaaacatgccagtcttaacacgtcgcagtcatatgttgatatgcattatatattcggaactttaattcacgtggccactcagtcgattgtgagatcaggggtgattgtgcagagaactaagttaattaactatctcaatgatctctattaacagctagagagtctcaagctaaatatgaaaaaaggtatgatgtaagattggatcgattgatatcgaattatatattacgatatgtcatctctccacagcacgagttgatgcatatttattgggtcgttgattctcctgaaactcatttgatagtgaagatcatgttcaatgcatgagtgcggtgattgttcagaaaaaaataatttaacaaccacaagactatatatgtttggacaaaataggacgaaaatatttcgattttaagttccccagggaacatgtgatgattttttgagaatttctccaagtcattaaataatgcagacagagttggggctagctagagccagatagtcgatgtaatagtataaatccacatagccagcaccaagagtttccatccatagacgcatcacataatcatctctctctggcaactaatttcacaagcacacattcttccatttccatcgaccatgcctggagcagctaccaccgccgttgttgacagccgccggggcacacagcacgcggaaggccccgccaccatcctcgccatcggtactgcaaacccgacaaacattgtgcctcaggatgagtttactgattactacttcggtgtaaccaagagcgagcaccttaccgagctcaaggacaagatgaagaggatatgtaagcagatcgatcaatctacttattatcactatcattaattagttttcattaacttcaatgaaaaaaaaatatgaaggcccttacatttcaaggactaccatgcaatggtttgtccgaaactgcacatatatgtccaaagaaagtagacagtatatatgtatccttctatatagagaggttatatccaccgtctcgaaatcacaaatgaacagcgttatatcatatattttagtttttaattttttttataataaatgtccaatgatatgttttaccgttgtacctcaggaatattaattactaactaatagagatcttccttattcattccaggtctgaaatcgggcatagagaagcgctacatccatcttgatgaagagatcatctgtgcccacccaaacataatcgataaacagcagccctcccttgaaactcgcgtagaaatagccgccaccgaggtccccaagctcgctgagtctgccgcgaggaaggccattgccgagtggggccgtccagccactgacatcacccacctcatcttcagcacctactctggttgtcgtgcccccagcgccgacctctagcttgcatcgttgctcggccttcgccattctgtctcccgcacaatccttagcctccacggctgctccggaggaggcagggcgctccagctcgccaaggagattgctgagaacaaccatggtgcgcgtgtccttgtagctctctccgagctaaccctggtatgtttttccacccctaatgaaagcaaaattgttggccatggactatttggagatggcgctggcgctatcattgtcggtgcgggctccttggccgatggtgagcgcccgctattcaagatggtagctgcctcgcagaccacaataccaggaaccgggcacgcacttggcatgcaggccactgatagcggcatagatttccacctgtccatccaggtgccgacattgatcaaggataacatccaacagactttgctcgatacctttcgatcggtcggaaataacaatcctaactggaacgacctcttctgggcagtgcaccccggcggccgcgcaatcctcgacaacatagagggtaagctccagctgcaaccatggaagcttgcggcaagccgtcaagtgttgcacgattacgggaacatgagtggtgcgacaatcgcgttcgtgcttgatgaactacgccgccgtcgggagaaagaagaacacgagctacaacagcatgaatggggagtgatgctagcgtttggaccagggatcacgattgaggcaattgtcatgcgtaacccccagctaagtggtcttaaagaaaactaattaccactatcaagaaaataatgcaaagggaatcatctgatgttccggaatttcacgccatgatgtttatttaacgggtgacattgaatcagttgttcacgcttaagtgttgtcaactctactagatgttgtaaataaaattttatcatgttcatgtctcctcttattcttaaactttcatgatttgtaacgaaatttggaataccctgtcacctgtcatctgtatgtataattaaattattacctctgtcaatgtcctgtaataaaactatggttaagtggatcttatcattgcaaatataccatattagaaaaatgttaccgttattcgagatattggctatgtcccattggaatttggagaaattaaaaccatgccactcccatccaatttagtcaacctccgtctaaccccaccgaaaagcgtcgtcacccgcattgagtggagttggatccattgtcgttggctccaggataagttcgccgtccccgagtcccgttgaccacgcagaggccaaccagtgagctctaggaaggtcagtcgcggcgatcggttggttggaggcatagttattaagaccggaccggaccggcggtcggactggaaaaaaccggaaccagagcctccaccggtccggtccaggtaaaagaccggcttacaatcaacccggttagaccgcccggttttaggtaaaaacagctattaaaccggcatgtggctgctgtacacgcgagcaagggtgtgttggaaatttggtcataattcagcatattttaatccaaaataacaagataataaacatgatatttacaatgggatttgatccagtgatagtggtgaatgtaatcaacatgagcatgcttaatgtagaataagcatcaacaatcacataataacacaatattgacattgcgatgaacattaacagtaaaacttctaattgaaataatgtaagaaggttataccccaagaatggtcctccgttggagtttgaggcagtgttgcctccgttggtattaacgggagcctccttctccttgtctccagtgttcgacatgttggtgaaggtgaagtagatgttgacgaacagtgagtagtcgtgtcgtgcgctccccaaaaacctgatcgcccgctcgtccatgcaaacgttgcagcagcgcgtggtttcagaggcctactctcccaacgcgtgtgcacacactcgtcgggataggattaccgtagcagcaacaatgcatccttcactacacaaccatcaaccaattaggaataattgatataagatttaaataatttaaatggatcaattacccaattaaatctaacagggtgttggtgggggaaaattcgcaaaaatatggctgtggctgctgtacacgcgagcaaggtgttggtgggggaaaattcgcgaaaatatggcttcggtgggctttgaacccaggaccatatgggagttagtaaactctccaaccactaggctacctagttccttgtgtttgcaattaataattaatatatttaaacggttattgaaccggattagaccaccgattcaatcggttgaaccagtgaatcatcgaaccgagagcctcaccggttcgattactagtccggtctcaataactatggttggaggggcagcacggtgggtgatgatctggatctcttccaccgccgccgcagccatagacaacgccagcagccctcctcgctagatctgggccagaccctttgtcttacacagctgtggaccaagaccgggtaccgagctcgaatatcaaacat

SEQ ID NO: 62823 - DNA, 1970 bp, Oryza sativa
  unsure (1)..(1970): unsure at all n locations
gtcggaggtaagcatgcatcatctcatgagccagaatggagccagttaacagtctgcatgtaatcaaaataatggaaatgaaaatctatgcattcaggacaaataacttctcntaagttggtaggccagttgcataatcaacgccaataacaaggggaaaaacgaaaaataatagtaaatgcagtataatagtactcattagttagatcgataaaacatgaaaataattcaatataccttggaaggccatataggataagaattgcagtcacttcacagcgtctaaccagtttgtatggtcctgtaatcatgtctacaatcttgtttcctggtccaattactggtcttcttagtatctgcatatattatgttatttagccataagccaggtatcaagttcacatattcaatagataactaaagcaaggcattatttttaagaacgtacagttcggacaatttgctcttcagataggcagagacctctggtttcagcaaggtgatgtccctattaaggaggtcaaaggaacaataagttaaataatgtacattactgttagaatattataaaatgatcatttcacttacagttttctcggcctccatggcttcatttaaagcttgtcgctcaaccaacagcaagggaatttgttgttccactttcatgttcaaaccctcatagaattcttgaatatcaatatatagtggttggcattcgtctgtgtccattattgaagtattcaggcattccaaacagagtttccggccatcatctaatgttatgtacttactatcctttggctagcattgagattaaacaaaagaaaagaagggaagtcattagattcaccaattcataattaaaatacgttttcactacgaatggacattgctatgaaatcatcaaatgcatgtgcataggcacatattgaaaacaaacacatttaaattgtaagggtgatttcgaaaaaaaatttgtaagggtggtaacagaagctacatgccaaacttctattttttttgttgagggaacatgccgaagtgttagttacatcctgacacttccatttgaatcactacatgtataacttttttataggatagcacaaacctccattcgttcacaactgcagcacctaggagtacgatcagtttcatgggcaggacaatacttctgcatccagaaaggatgggcccgatattcaatgtggccatctttgtttgttggaatctgatcatcaaatgtcattagcacaactcaacagataaagttaaaaagtagctattactaaattctcatgctcatccaacatgaattcttacaaagttcttgcagacatcacattttggatggaaaagctccttatagcaggatcgatggtatgggttaccttcatgaactgcaaacttcccaaatgaatggataatgtcagttatctcatttacttaaagcatgttatgttgaaatatgctaggtctctttacctcatattctgatattggcctatcacaagcaaaacacctgaagcactgggggtgccaaacagaatccatgcaactaagaaaccgtccttgaccgattggagttttacatccagcacaaaccctacaccgtcaatgtggtacatgagaatcagagaaccctaagggttccaccgcatgcactagaacagggtgagaacccaagtagaacagacatgaagaagataccagttaaaactatgaatgcgtttataattttcatacccataccctacccaatcaagatgattataagatagtacatatattcagtgctaataatttgggttcacaattccacaacgtaatttttgaatttcaggtctactagcaggtcttccagtaggacatttttccggtcgagaatttcgaattttgttgggaatttagaaaaaacaatcgatcatattcagcaagaaattgttcaaaattctagattgctaactcaa

SEQ ID NO: 62824 - DNA, 2766 bp, Oryza sativa
  unsure (1)..(2766): unsure at all n locations
cctacagatctatattttgcaagcgtgaagggtgagtagattggtggcaacagactggtcaggtcaaatatagaattatctggtagaaacatgatatatctagaactcggtgatgaggagttgagatatatggagttggaccagaaatgaagaggaagagcaagcattatggtggtaattttttcgagtgattagaggcaacggtgaacttctaaagttatcatcgagctcggtctaaggatgtggaaagcgtggatgttagatttgttagctcatttcataagactacaaggaagaaagggttgttcatcggtatggcgagtttgatttgtctatttggtaatgacacgagttgtctagccatgagttagataaaaccaaatttaagacataagatgaaggtgaacatggtctttaaggagtttagtatgtggcaactagagaggtgtccaatttcgcatggcaagatgactgcgatgataagagataaggttgaacaatgttgcaggaggagtccagtgaaagatgttatagggatagcggagtctcttgatagtggcgggtctagcgcagacttgtcgggcggcttgcagtgaagctgtaaagaagataacccttgtctggaggaccggtggatcagcatggtgattctactacttttgcttggcatatatttttcaaggtggagtttgttagaatatgtgtcgaatatactagtactatttgattacagttagacttggagttgtaataagtggtaggaggtggagttagagttggactctgtaactcggaaactctcgtaaatagaggcgagcactacaatgtaatcaatgcgactatgatgtagtgtagacacgcaggaagatgatattggttagggaggagcacccataatcagagcctcggagatgtaggcttcggctgaagttagttaataattatcgtgtgttgctatattgtcatctgacgtgtcttggctgatcaatgactgaagtaatcgataaggttagtcgttgttcctctatatcgaccaaacttttataacattgtgagtgatgagtccatgtagtttgaatgtgtgattgagatccattgtattttggttattttttgtctttatattttcttctgagttctgaatgaggtggcaactaggaagagtaaacattttttttatttcaccagtgatgggtggtgttgagtgcacccgtttcccattatccagacttacaacgggcatcaaaccaaccaatcgcaggtgactcacatgtgatggatggtaataacactcttcatacgtgccaacctcatcaatgaccgatctttttctactgcccatcagagatagtgttccatcatagatgaggctgagttatcactgaccattcatctatgacgagaggggtctacccgtcacaaacgactttatcgagcgtagtagtttgcgccattggccatcatcaacgttgaccatcgaactcgacccaccaatggcgcaaacctcaactgtggggcgtagcccagcgcatggtcatcgaacttggcaaggacagcgagcaaagtcctgcaggactcactttggccaacggtgtttcctttgccttgcctaccatggcttttacagaggatacggtgtgattagaagcttaattaattaggaaaactagagacgtcgctcatgcccattcccaggcaaacttgccaatataatctccacgacctgcattcttagagatgcgtgagccccactacctcaggagtgggaagtttatgactgcatgtcattgatcgatatcctccgaagatccaaaacataccagtcttaacacgtctcactcatatgttgctatgtactacggagtattatttattcggaactttattctcgtggccactcagtcgattatcagatcaaggtaattgtgcaaaaaaactaaattaattatctcaatgatctacattaacagctagatggtctcaagctaaatataaaaaaagaatactgccggattggatcgattaatatcgagttatatattatgctatgtaatctccacagcacgagacttgatccatatttaccaagttgtttgattcttctgaaactcatgtgattgtgaagtttaagttcaatggagtgcggtgtttgtgcagataaataaattcaacaacaccaagactaagttttaacaacatatatagaaacaatatatttcggttttaagtaccccatggaagagttggggctagctagtgccagatagttgatgcactagtataaatccagaggcagcaacacgagttaatttccatccatccatagacgcatcacataatcatctatctctccctcagggcaactaatttcacaagcacacgttcttccatttccattgaccatgcctggagcagctaccaccgccgttgttggcagccgccgtggcacacagcacgcggaaggcccggccactatcatcgccatcggcactgcaaacccagctaacattgtgccccaggatgagtttgccgactactactttggtctaaccaagagcgagcaccttaccgagcttaaagacaagatgaagaggatatgtaagcagattgatcaatctacttattatcactattatttaatttttattcattaactctagtgagaaacaatgcanattatgcaagcccttacatttncagtactatcatgcaatggttttgtctaaaccacatatatattattctatctccaaagaaagctaagtg

SEQ ID NO: 62825 - DNA, 2665 bp, Oryza sativa
ggaaaaaattgctcttgtctctttctgtgatgtttctgtggatgtttctgtgatctatcatctgcttagaatacctgtgcatcatcttgtgaagattggcttagtctcctgtttcgaaatttgaatttcatcctttgttacgttacccagaagttcctgtcctaaaacaccggaagttccgggcctggcagaccggaagttccggtgttccttaccaggaagttccgggtctatttgaattttaccgctgcgatttgttttcaagttttcagggacagcctattcacccctcctctaggcttcgtcagcacgttcaattagtattagagcaaggtactcttgattcaagcttcaccgcttggagtgatccacaatgtcgcatctagagggaaccgaagggttggatgacaagggagacgcttctagcaccaaggatactggacccaagggagctactattcactttgattacaacaaacttaatgttcctcctcacaactttgtctccgtgccttccgggcgtgctcctcaatttgatgggacacattacgccgcttggaagcacaagatgaagttgcatttaatctcgttgcatccaagtatttggaaagttgtttgtacaggtattgatgtaccccatgatgacatggagctcacctcggagcaagagcaactcatccactgcaatgctcaagcttccaatgcaattctctctgccttgagtctggaggagttcaacaaggttgatggacttgaggaggccaaggagatatgggatattttgcaattggctcatgagggatcacccgccgttcgtgaggccaagattgaattgttggaaggaaggcttggaagatttgtgatggatgacaagaagacacctcaagagatgtatgatagaatgatgatccttgtcaacaagatcaaaggacttgggagtaaggacatgacaaatcactttgtggtcaagagacttctccgtgcttttgatccaagaaatcccactcttgtatcaatgatacgggaaaagaaaaactttaagaggctcaccccaagtgatattcttggaagaattgtgtctcatgagatgcaagaagaggaagctcgtgaagtaaggcaaatggtgaagaatgccgccatgatcaaaaatcaagaagtggctttgaaggcaaaacaagaagaagagtcaagttgtgaagaaagtgaagatgaagagatggcttttattgtcaagagattcaagcactttcttcgcaagagtggctatggcaaagggaggaaggatgatgacaagggaaagaggcaatcaaagagagcttgcttcaattgtggcgaatatggccacttcattgccgattgtcctaagtcaaatgaagctaaggctaagggaggcaagaagaagccggagcgtgctcatgtgacagaggtaaacatggcggaggtgtggtactccagagatgaagaagatcccgaggtcaagcccaagcccaagctaaaagacaaggttgaaggagaaggtggtgatgctaccgtcgccttcaagtcatcctcttcaagcaagcagcgtctcttcaacaacttgagcgatgacgagacgactcctaccactactcatgtttcatggcccaaggccgcaaggagatgactcaaaagccctctcacacttctcttgatgttgattctagtgatgaggaaagtgataatgaattagatgatgtgcttaagagctttagcaaacccgctatgcaacatttggctaagttaatgagagctttggatagtaaagaacaatcactcgaaaggcaagaagaattgcttattcttgagaagaaaagaaaccttgccttagaggagagcttagctaaagaatgtgctaaaaatgaacaactagctaatgagcttaatttggctaatggttctctagctagccttagggatgtcaatgaaactcttcaagagaaatttgctaatttagacaaaagtcataaagatcttgacgttcaatttgacactctttggaatagcacttctcaaccaaatgtggtttctaattcttccaacccatctactagcaatggttgtgctaggtgctacaacattgatttgaactcttgtactactaatgttgatgctatgcaagctcttaagaaagagaatgagaggttgggcacattggtgaaatatggatgcataaagacgtaccattcaaaagatgccctttacaagaccatcaccgctcatcctaacaaggatggacacggactcgggttttcaggtggaagtcctgtgtctaagcgtgtgatggtaaatggaaaagaatgcttgatgtttgtgagagaaggtaaaactccacaagcaagtgaggagactcgtcccttcagtggtcaacacccggaagttccggacaaaatgatcggaagttcctgccctgtaagacaggaagttccggacattttgacaggaagttccgggcttctgataggccgaaggggctgaccagaagttccgggtataataccaggaagttccggccagagggtctttactatgattcatatgtaatttccaataattcagagggcaaggtggttgcttactttaacgggaattacaatgatgagtaccacacttgtgtgtgggtgcctaaggctttggtaactaacat

SEQ ID NO: 62826 - DNA, 3557 bp, Oryza sativa
cacgacatccagagtaggtgctgaagatgaggtgggtaatgtcggtggctggacggccccacttggcaatggccttccttgcagcagactcggcgagctttgggacctcggcggcggcgatttcaacacgagcttcaagggagggctggtgtttgtcaatgatctctggatgggcacggatgatctcctcatcaaggtggatgtatcgcttctctatgcctgattttttacctataattaaaaggaagacccaatgcctctattaattaggttgtacctagtagtcttgaggatagaaaaaatatatagaacatatcattgcagatttatatctctgttgcaaataattacaaaactaaaatatatgttataatgctctttccagaacaaaatcacgcaatttgttttcgtatgtattctccaaatatttagaaagctgtacatgtttaaaatttggaaagattgacttggcacatggttttgttgaagtaccaatggtctcatgatgtagtatttaaatcctagtcccggccagcaataataaacaatttagtgagatttcaataaaaatttagtaagacccagagattattgttgtgactccctctgttgagatctaattaaaagtgggaactcctcactcataggtaagtgcttgtggtgtgcgtgcctgatttttaacgtgacaaagaccattaatttggtttttacctgcatttatcacttagattgcaaaatggcaaaaacacttatgaagcgtgtctaaagtcgagtattatcatactcttcatttctgattactagatagtgcggcatatatatctaacctctatataggacacgtagagcctacattcttttcaacatagaataaatatatgtgtggtttaggaaccatggcatgatattgctagaaatgtaagagcttgcataacttgtttctgattgaagtaaatggaaaataattaataatagtcatatgataagtagattgaacgatcttcttacatatcctcttcatcttgtccttaagttcagtaagatgctcgctcttggttaggccgaagtagtagtcggcaaagttatcctgaggaacaatattagctgggtttgcagtgccgatggcgatgatggtggcggggccttccgcgcgctgtgcgctacggcggctgtcaacaacggcggcggtggtagctgctccaggcatggtgatggaaatggaagatgtgtgcttatgaaattagttagcctgagagagatagaagattatgtgatgcgtctatggatggagcctcttgctgctgtctctgtgtttttatactaagcatatcagctacctagcactaggtagccacgaactctatctgcattagtaaatggcttagagaaattctcaaaaaatcgtcacatgttccgtgggtttaatgaaatgaaatagaaatatttttcttctatagaccacatataatatatatatataactcaataccataatatatgtagtaacaccctgatcacatggccatgaacaaaatcatacattaagagaactataaaagacatatcttccaaactctaaatttacaattaaagttgggtctgccattcaatccacagctactgtggtctggatcaaggaccctttttccacttcatgtcctctaacatcgtgcaaagtatcaaatgagcaaaatctttacacgagctttattatattagaaggagctgctacgtacctggctgctatcatgattaattccattgcatcgcgcgttattatttttagataacaggaaaaatatccctgccatgttcaatatatatagtatcttattttcacgatagactatagattagagtatgtaattaataaatactaacatataatattgtagagcaaactagtttagaatgcgataccgtacccaaatatttcagcattaattcgtattttcatatgcagcttgcgatcgtcgagctatcattgtagtccaaacatagctggcttggggttgttaaattattttttctgcacaatcactgcactcctgcattgagcttaatcttccctttcaaattaatgagtttcaggagaatcaactagtgctgtggagtttacatatcttaatactccctccatctcaaaatatttgacgccgttgactttttaaaaaatatttgaccgttcatcttattcaaaaaatttaggtaattattaattcttttcctatcatttgatttattgttaagtatacttttacgtatacatatagttttacacatttcacaaaagtttttgaataagacgaacagtcaaacatgtttaaaaagtcaatggcgttaaacatttaggaaaggagggagtatataactcgatattgatcgatccaatcctacagcataccttttttttatatatttagcttgtgattgtccagctgttaatctagatcactgagatagtcaattaacttagttttccgcacaatcacccctcatctcataatcgacagagtggtcactagaatcatgtaccgaataaaataatatgtatcactcatgactgcgacattggttaagactggtaatgtttcggatattcggcgattaaaagaaaaatatgatatcgattgttgaaacatgaattcagcaataataaaaggggtagcacacgagacctaaaagtggatggatgcggagacaaaggatttagacaggttcaggccctctcgatgagaagtaataccctactcctgtttagggatttgaatccgccaggtgtagtatagatctgacgatcatatgtgctcatgccccctagagggcctcctgcccaccttatataggatggagggcaggattacaagatagaaaccttaaccaatacggtatcggtttccaatattatcaaaccaggactttaggccgttccgtaatatacaaggaaacgtaatacccaagtcatgatctggtacatattccatagatataagttatcccctataactagtcagataaccatgccgtgtgggtatggggtacccataatctccacatcgataaatggtcgtcattctctcataattaaatgtcataaacatgggtaccgggtatcccacgacctgcaaagatgattcttgcaggcggcgtcttatgtgctccgcctgccataacctatcttcacagacggaccgctaactcctccccggtactcattttcgccggcggagtttttctccgatgaccatacctgcctacgaaaaaaatacccaacaacggcaaaaatgctttttctagtagtgattcttcatgcatcgttctttagcctgagcatcccacataacatcgttgattgtctagaccccaactcccactaggttcaattctaattccatcaccgacattgctccttcagccttaatcaatgcctgcacattaacagcaatgaaattgttgtcgaaaaacaaccacttctgccgaaaggcaggcttcacttgaagagtggaaaaggaaaatagtggttgtgtattaatttcttcaaaattagctcccccact

SEQ ID NO: 62827 - DNA, 25903 bp, Oryza sativa
tttggcatctcttctaaaaggacaacacattcttggtttatctaatgtttcttttgagaaggatcgtgtgtgtagtgcttgccaagtcgggaagcaagttgggagtccgcatcctatcaaaaacatcatgactacaacaagaccactcgagcttcttcatatggacttatttgggcccgtggcctacataatcattggaggtaacaagtatggttttgtcattgttaatgatttttctcgcttcacttgggtgtactttctccatgacaaaagcaaagctcaagatgtcttcaagcgtttcgcaaagcaagcccaaaacctctatgatctcactatcaagagggtgcaaagcgacagtggaggagaattcaagaacactcaagtggaggaatttcttgatgaagaaggaatcaagtacgagttctccaccccctatgatcctctccaaaaaggcattgttgaaaggaagaaccgaaccctcattgaagccgcaagggcaatgcttgatgagtacaagacttcggatgtcttttgggcgaaggccgtgagtaccgcatgtcatgccatcaaccgcttgtatctccacaagatcctaaagaaaacttcatatgagctcttgagttgtaagaagcctaatgtttcatattttcgtgtctttgggagcaaatgctttattttgagtaagaggcctcgctcatctaagttctcatctaaggtggatgagggattcttacttggctatgaatcaaatgcacatgcctatcgtgtcttcaacaaaacctccggtattgttgaagtcactagggatgtgacatttgatgaatctaatggctcccaaggagagcaagttgttgtacatgttgtaagtgatgtggatccaagtcaagctataagtattaaggctattggagacatacgaccagtcgagacgcaggatgaccaagaagatagggatcaacctccgtcatcaacatccaatagccctacaagtgttgtgtctgctgagccggaagttccgggtcctattgactggaacatccggacatctccaggcccggaagttccgggttctctagtccagaacctccggaccagtggcagtgaagacgtgccaacggcgcaagtgaataggatcgatgctgcgggcactttagagcatactgattaggctcaggtccatgattatgtccaaagagatcatcccgtcgacaacatacttggtgacataagaaaagggtaactactcgctctcgtgtcgcaagtttttgtcaacactactcgtttgtctcttctttggaaccaaccagggtggaagatgcgcttggtgatccggattgggtgatggctatgcaagaggagttcaataacttcactcgcaaccaagtatggactttgatggagagacccaagaaaaatgtcatcggcaccaagtggatctttcgcaacaagcaagatgaacatggggtgattgtaaggaacaaagcccggttagttgtgcaagggttcacccaagtcgagggtctcgattttggtgaaaccttcaaacctgtcgctcgccttgagtcaattagaattcttttagcctatgccgctcaccatgatttcaggttatttcaaatggatgtcaatagtgcctttctcaatggacctatctcggagttggtctatgtggagcaaccaccggggttcgaggatctaaagttgccaaaccatgtgtacaagctccacaaggcgctctacgggctcaaacaagcccctagagcttggtatgaatgtctccgagattttcttttaacaaatggttttgaaattggaaaggcggatactactctcttcacaaaaaaatttaagagtgatttattcatatgccaaatttatatcgatgacataatatttggttctactaatgcctctttttgtgaagaatttagtagtatcatgactaaaaggttcgagatgtctatgatgggcgagttgaccttcttcctcgggctacaagtgaagcaagcacaagagggcaccttcatctcttaaaccaagtacatgaaagacatactcaagaagtttgggatggcggatgccaaacctatcaagacacccatgcctactaatggacacctagacctcgacgataatggtaaatgtgtggaccaaaaggtatatcgctccatgattggatctttgcttcacttatgtgcatctcgtcctgacatcatgcttagtgtttccatgtgtgcccgttttcaagcggagcctaaagagtgccatttgattgccgtcaagagaattctaagatatttagttcatactcctaatcttggcttgtggtatcctaagggttgtgactttaagcttttgggctattccgattcggattatgccggatgtaaggttgatagaaaaagcacaaccgggacttgtcaattccttgggtggtcccttgtttcttggtcctccaagaagcaaaattctattgcattatccaccgccgaagccgaatatgttgccgccggttcttgttgtgcccaattccattggatgaaacaaaccctaaaagattttggctacaacttctccaagattccactcctatgtgacaatgagagtgccatcaaaatagccaacaatcccgttcaacactcaagaaccaagcacatagatattcaccaccacttcttgagagatcatgaaactaaaagagacatatgccttacccatgtgagaaccgagagccaattagccgacattttcaccaagcctttagatgagaaaagattttgcgagcttaggagtgagctcaatatcttagactgtcgtaacattaggtgatgggtggttggctaattcatagccaaacatgtatcactaaaatgtaaattaaaaaaaatgagcttttgtgtcttgagatcacttcttgtgtagaagatagtcttgataccaggaataaagctcaaacatttcccctcttatccaaaaacccttttgtgaaaatttgcgaaaatttttgtgtgtgtttttattgcgaaaatttggtttttatcactttcttgtgatgtattttgaccattgttatgaaatgttgattgttggctagtcgtatgcatcataagtctttgcttgtccttagttctccaattccattcgttgttttctcgtctattcctttgaacttgggcctgactgccctctgttctgtcaggccggaagttccagccaccctagtctggaacttccgagggacgggggtataaatacccagggggagcccaagcctgtcatctctctcctcacttcttctcctccccgattcccaaatcctagccgccgctacagtgctcctctcggcgatttccacttccaaccgtggaaatttgattcctctccgtggaatcaaccacattggtggctaggaggttcatcccgcgatcgatttatgatttcctctctcaaagtagcacttttgatcttcccttttggttcatcatgtttttgccccgatctctaaatatgtgaacccagggagaaaaccttttggatagaattgttcctgctaccttgtagattgccgatctataggattttatcacatgcactgacattctcttggacctctgttcttcctgcttgtaggccggaagttccggtgttcttggcccggaacttccggtctctgtccagccagcccgcaatccttgattcttcaaatttttcatttaaccattgcactccaattttgttgattcttgttgcagtggtcagtatgcctcgtgagaagagacagaagctgtcacaggatgttccctctgactcgagtcccctggttcgtggtcctagggggagattgggcaaagaaaaagtgggagatttttacagtgggagtcagattctgattcattccaggagggctggtagcattgtcattcgtgatgctccccgctctccctctccagttgcatctgagtcagacaatggtggaaatgaggatgagcctggttctgagagcaatcctttaaggctttacaagacgagggctgttgatcctgatcctagacatccaagggtgaactatctgaagaatttgctaaggtgtgcaaaggatagaatggtgagtcctgatacaatgactgctgactctcaggatgacagattcaggaccttggtgcagattgattggtacaactctatgatcatgcgaagatcttatccagtggtagagatgaagtggctagactggcagtacatgtcctcaaagaacaacttggttttcaatgaggtgcgcaaggtgtgtgagcgcaagcatgtggcagatctgttggccttgcagtattcctagaatgaggaagttattggtcagttctactccaccgctttcttcggcaccaccaagaagggaattgattttgtgaagtggaccattcaggggcaatagtatagggtctctatggcacagtttgctgcagctttggggttagatgatgatgaccttagtcgtccacatatctttgtagagaatgctttgtcagtgacgagcactactttcttgtatgagaaggatgctcccaaggattgtttggggactactcgtgggttgcatccatactatagagtgctttattctatcttcaggtggtctttgctccccaaagtgaatgatgctacagctcttccaagtcggcatgcgctccttctcagtcgcatgcgctacaacaagccagatttcagcatcatgaagcttatctggagtgagatctatgagacagtgtgagccaaagaggggctgcatctatgctccttatatcatgaagatgattgaggcaaagactgggatttgttatttcaaggacaaccagcacaggtcttttcgtcctcatgctcccactacttcagctacttcttctgccagggcgactcgtgcttctacctcagctgctccttcgtcctctgctgctccacagcgctctgagtcttcctcccccataaagaaggctctccgggctatcttttgcatgtgttctaagacagcaaagaaggtgaagaagatagagagacgtcagaaggaaagattggattgcagcaggcaaggaggtctctgatatttctgatgatgaggagttcgttgatccttttgctgcttatgaggctgctcgagacattgctaatggtgagggtccctctggcactactcatttcttcaatgaggagtcctcctactccgaggagaacagcgatgatgaggagtccgatgcacctactgagaatgtgcctacagatctagatgaggcagtggacgccgctgggcaagacattgactctcctgactccggcgacaccgagatcatttcttctgatggagatgatgatgaggcttgatcctcttcttcccttgtgattttatctctttttggtgccttgatgccaaagggggagaaaattgcaatcgaagggggtcaaaattttgttcttgctgcttgctgcctgatctgtctgttcatccggaagttccggacctggcaactccctcgctatatattcctgtcagcttgtccggaagtttcgggtattttatctggaagttccagacctagcagtcctttggcctctactcatatggacttgtggacatgtaataattctcgatttgtgtttggtcctttgtaatgactgttagatgctcttagctgctctttatatatattgcacttcatttatgctatgagtgtcttatttgtttgttttttgtgatgtgatgttgattttatccttttgagtgctcaccatgtcatatcatttgcatatcatatctatttttcttactgcttatttgcatcccacgaatgagcagggatgaaggaaactctcctcggttgctcccttatatatatgcatatgagtttcactcatatcttccatatgcatacactaagggggagtttcattcacctctaaccattcaaaacaaaatttatatcaatattttgtaagctttaaccatgttgtcatcaatcaccaaaaagggggagattgaaagtgcattaatcccatagtgggttttggtgattaatgacaaatgtggttaatggaataatgagttcattgagttactttaacgtgtattagtccaaggtgtggaagatggatgccttgagaccccccaaaagtataaaatcaaagcggaccggaactcgggaagtgcataggatagtttatttatcgcaatcgagtttttagaaaaaatcgtactattaagaggggttccaggtgatgctctgagatatgtcatgtgctcttagtatgaaccaagtgtcaagtttccctaggagtcattcttgccaatactccatctgtccaaaattgcaagtccggaacttcctgtcttccaggtccggaagttccggtcttgtgaaaaagatttttctaaatgtagtctggaagttcctgtcttccaagtccagaacttcctgtctagtttccagttcaaaattgtgagtaacggcaagatgatgtcacctagccgttatacataaccagctcgttcttttggccattccactttcagttttcgaacatagagctgttgctagcctctcccaagtgtttcttgccttctccactcaatctagagtctaattcttgtgagaaagggagattgagagggagagaagaagatttgaagatgtgtgaagactaggatcttgggtgagcacttggaatatctcgtgggctgtcatctcggtgcttattactcttggagatgatctcctagacggttaggtgttgtccgcgaggatccgttgcatattgtggatgtcccgggtaagtttgtgaaggatctcctctcctccgaaagggaacgagataagttaatgaagttcttgtgctgagattctagaggctttccaagtagagcaacccacacttgtggcggatttctagaagtaggttgagttggatcttggtggtcactcaattctagaaattcacctaggggtgtttagggttgaaggctgtggattttctctggggtttttgcacaagtgaggcaaggggttaatcgagacccagctctttggagctcctcaacggacagtaggatcgcaagatccgaactttgggaaaaaattgctcttgtctctttctgtgatgtttttgtggatgtttctgtgatctatcctctgcttagaatacatgtgcaccatcttgtgaagattgtcttagcctcctgttttgcaatttgaatttcatcctttgttctgttactcagaagttcctgtcctagaacaccggaagttccgagcctggcagaccggaagttccagtgttccttaccagaaagatcctggtctgtttgaattttaccgctgcgatttgtttttaagttttcagggacagcctgttcacccccccccccctctagacttcatcagcgcattcactttgtagggaaaggcgggcaattcactttatacactccaacataacgtactcgcaaaaggaggttattggttcactaagaaataagtattgaaactctattttttttaagtaggaaatcaaacttcactcactgtagcagacgtgtgtagctagcaaaattgatagtggcgtgacagccaagtgaaataaatcaattacttgcaacacagtcaaaacagctgcactagtactgaatcttggctataacatcagatcaggagtccggacgtgcacttaataaaaatagaaatcaatctatggatgcgatggtttacaggctatgcaaaggaatacagacaagcaactgaaacaaagttctaatggatcaaaaaataacaagactcacgagagaacaggttgaaacaagaggcttggttagggatgatttttttgtgtggtaattttctggttatagaaagataaattacctaacgggcaatcgtgctctgataccaactgacgagggatgctaggtcccgatcttccgataggtattaataaacagtcgatttgggtggagtcgcgacacaactcgatccggcttctgaacgaacacgctactgagccccgcaatcgcagcaccacgtctactctggttatcaaccgtgccgaaactcggttgacctcgccgagaaggctaatccctacatgcgaatcgaagaacacaagcaagaagaagatagattgcaaccaaattgcatatgaatgattaagcactcggatttggggttccacaaaccgctctagcagtgaaactgttcttgacagaataatctaagcaaaaccccactctaaacgatgacggctacagaattaatatgattaagaacgtcctagggttgccctagggcgcataccccattgggctaacccacgacacaattacagggcccaaaactcaaaatcagattcggactggatgagctatgtggcttgttttgcagattcccggcagctcggtaggaattttgacatgggaccaaaaccatccgaaagtagactccataagctttccaacaagtactcatgggccccaaaactccttctagattaacagctaggtccgtttgaagttgatcctgttaggaggcccgaatccgaatccaaaacgtgtagaactttatctcttgtcttctatggaccaaaagtgatgtggtgagatgaaagaagacttggaaaaagtcttggtttggtccctaatcaacttcttcaatcatccatgcattctttacgctcggtctcttttctttcgcccaagcaagtacctctgcaaacaaaaacacacgaaactcattgtgtagcaacgtttgttcaaatatataacaagtaaatctaatgtagaacatatgcacctttggttgattcatacataaggtagtcatggtaatatccgagctaggtgtgtcctcatttccgtagctgggccggccgcccaaccccgcctaatgggtggtaccgcccctgagtggcacgccaggtagaaagatttttggtgcttcaaggtttcgacgagatggattcaagagatgaattcttcaacaacaagttactcgacgacttcggctgtgagaagatctaacctgaccggatccaatgagatcggaaccatcatcaccaataattcaatctgtcaagatcgcgcaagttacgggacatcgccgtcgcggaggacattaattcaatgttttttgccacgacatcctcaccaaacttttctgccgtattaccgccagctgagttcgattgctttgaggccaagtgctggagtgttccgtctcagacacaaagtgctactgacaaacagaatgctattacatgtcgcctgtattgtcttgccgtggtcagattggatcgatctcaagtacagcagcaggacagccaagcaagaagatggccgactacttcacgcgttgacacatatgttagcatgcatgcggtgggacccatgtacggtattgcatggtgtgtaccgaaggctatgttagccataggtatgcacacataggtatataggcaggccatccacacgtgctaatcgctaaggataatttagtttggctaaaaggtaattagtggattgatttattaaattaatttattaatttcgtagcggcatgtatctacaaaggtacgcaatattttatatatacaatttatcgtacctatttttcagatatataaaatattgtcaggtcaataatttattatgtttatttagagcgtgtttttatacaatatctattgtgcgagagttttcaatgttaagccaactacggtttaatactaggggcttgctctattttcttcaatataaatcatatttgtttacgattttcataatgactgatatttaatttgctcattatatcctgataatactagaagattcatgcagttttttgagtacatgctctatattctctgctatatatcttgtcttctagaaaatatttttcaggaacaattgagcactcgagtaggatgtggtcgagtacaccccattatcgaaaacgttctcgaaaaatgctgagttgtcgcacccaacctatcaacaaaaactgacgacttatcttatgtatagcgccagctacggctagactatttgagagaaaattgttaacggataattcctcacgagcgttgtcagcttgatcacccgacatgattatgaacaagtatccggacatactataagttggatatgtgagtcatgttgggcacatgagatgcacgtataataaccaactctagcacccttataggtgattgagagatgccgctgctggttatcgaccagatagttatagcgacttctcgccgcctatcaatttaaatccacttgtggaccgttggactccatctatcattgtcgaaaactccatgtctctacggtcttacaccaggatcgaccaagtgagtatggcaaatattgataaggggagtcgcggataacaagagatgctttcgcgaatacgttttgtttccgtatgccaatcagttccctataggtgatcaagatacgcctacacctggtcctcgaccagtagattgtagcgatctctcaccacctaaaaattcatcttcaggtgatcgagatacgcctactcatggtcctcgaccagtcggttacaacaatctctcgacatctaacacgataatcaacatgatcgtgatagcgacaaccaagaccgactagatcgctgttgtcaccaggacgacaacgtccaggactaacgacatcaggacgacaacggacaaggttaacgacttcacgacatcacacgacgacgacgacgaaactcgagatccctagactcctagagggcccaaggacgaggccgtaggtccaggagccgaacctctgactacgataattcctcattgtcttcgtcgtcattaggaggcagttctcgcaggtcacatgaatgccgtccatctattactctggattccctttaagtggtcgagatacgactacgactggtcttctactagcaaagtagcgatcctcgcaccacgacttttaacagtcgaggtacgactacgactggtcttctaccagcaacgtagcgatcctcgtaccacgacttctaacggtcgaggtacgactacgactggtcttctaccagcaatgtagcgatcctcgcaccacgacttttaacggtcgagctacgactacaactggttttcgaccagcaacgtagtgatcctcgcaccaggacttctaatggtcgaggtacgactacgactggtcttcaaccagcaacatagcgatcctcgcaccacaacttctaatggtcgaggtacaactatgactggtcttcagccagcaacgtagcgatcctcgtacctcaacctcaaaacagtcgagagactcctccttgttctcaaaccagtaagtcatagcgatctctcgtacctccacttcaagtggtcaagttatagctacaactggtcttcgatcagcagtgtagtgattctcccactacttctgcgatttgttgagtacaactatacacctagtctttgcccggtgtggtggtcatctcatcatctacatcaatttctgtaagtgtttatctgtacaatatttatctgttgatctcctcttcttatatcacctcatcttgaaggcagtcctattgtccctttacgctattctgacaaggctccgagtaagctaagggaatttcagcgggggacgcctagagcagataaggtcttgtcagattctaagagccaaacgaccatgtaaaacatggttatgtaagagtgctcaatagatgcgtattaaccaagctgtgtaatcgaaaattgatttttccaacttcacggctgggggctaggatctatcagtttcagcatggtttgttataagatttaagctgcctttgtggaaaatggcttttccataaaaacagctgggggctaggaagaataccaaacttcgtttgttgagggcaactctagcgagcgtactcttttattgtcacatgcaaatacaatttattttcaatttttccatacatagtatagcatgttacccttgcgcgttcgctcgggggctatttctatctaacaatttgttctgagtattgatttcagaaaaatcatatatcggaacaatcaaggaatatggaatgaagcgatagtgtacccgccgagacgaaatttattgacttcaatccaaattctcgagtacagcaagacgggagacttagtcgcatgctccataccttctcggtctgcagagtatgtaatagctaactagtatacttttcctgacgtaaccaagcggatccaaattaagaagctgttttccacatcgaattaatgatacagccacggtcacagtgatttttgccatcgaagtcgaagcgccgtaatcgcacaaatgtgtggcagatatagaattgtgtcagcaagaaaaataagggatttatagctggttatataatcagttagagcacgacagacacaggtgaaaaattattgactctcatacaaaagccaaatttacacacgtggttcaagagatgaaataattatatagagagcagataaaacttgagacacaccttttatactaaactactccctccgttttaaaatgtttgacaccgttgactttttaatacgtgtttgaccatttattttattcaaaaactttaagtaattatttattcttttcatatcatttgattcattgttaaatatactttcatgtacatatatagttttacatatttcataatttttttaataagacgaacggtcaaacatgtgctaaaaagtcaacggtgtcaaacattttgaaacggagggagtattatactaccgttcacaattataagaatattcaagctttatatacacatagctagacaaatagtactcacttagatgtataaactttaattccttatttgtgcacgggtaactctaatagtatttgctagctctaacacccatatttaaatagccttatataacaagttaaatagtagagccaactattagacatggagtataaattatatcggtgttatccaaaatttgtaggagttagctattacattgtattagctactcaataatcgatttttacatgcggtcaaaattgattttcgtagacagctaggtgactcgcttgcacccatgtgtctgcgaaaataaatttttgcatgtgggtagttcaaccgttttcgaaaatacaatttttgcaagcaaaaccgtctgtctgcaaaaataattttggcaaaaaaaatccaaaaataaaaaatctagaaaccccggaatctaccgccgccatcaccctcggatccgctgccatcatcgtcgtgccaaagccgccaccatcgtcgcattgggatccaccatcatcatcgcttgaagccaccgtcatcgtcatcgctcgaagtcaccggatccgtccctcccatcgcaccgttatcgctcaaagtcacaagatccacccctcccgttggtggatccgcgtgagaggggcggagagacgacgggcgagggggaggagacgtcgaatccgcccctcccatcacacccgccggtggatccgcgtgcatggggtgcgtaggggtgacgggatccacacgggaggggaggggctgcctataggatcaagatgttgaccaaagggggtgaatagacgatataaaaaaataaatgacacctaatcaaaactaacctaaattgctaggcttgatgagagaaaatactaactaagcaactatattaagttttgcaatcctagaatgataagggctcaaatagtccctataaaacaaattgcataaatgtaagtgcgataagtaaatgagatatgagacatggaaattttcacccgagattcacaaaattgacaatttcctaatctccattgagacgagctcaacttcaccactcaaaccacgatgccaccgaaccccttcatcaaggggtgggcaaggtgggagccagtcttgaagtaaactacccaagcctcgatcagtattgtagtcatttcttcactctgaaggtggttaactacaaaccaatcacaaccaacaccgggactcctccacataccttcttagagaggtcaccgagcaactcctccaagccgtctacgaggtagcaaagtagcaacctggctcggagatgatcatgtggcatactagctcaatcaatgatgcaatgcacttgtcttggctcaatctaccgtcaaacacccgcaatgaatggacaagtgctcaagtggtgtggaagtggatacaaggggtttatgcaaaatgaatagagtgacaagagaactcgcttgctgcttgtgggggagtatttatacccctaaccaccaaaacaaaccgttggggctaaaacaccaactcatatgactatacataccagcctccagtgatgaaccctgaggtcctctcgacactcaaggctgttgttggcccgatcttttggtgagttatgataactacgatttgggagaaacgttgacgatccgactacaaccgtacgagacgttgtgttgcgcccttagcgatcgatacacctctccgtgagttattgatcttgtcggtgcagatcaaccctattcctgcaagcaaatcgaagaaacaagcaagaacaagataaaagcaatctgatattgcaaataggaatttaatacgaatgataagttggggttccgaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttggggcgcaccccacatgggccccacctggaccggggtcccaaatgaagttacaagcccataggcccattataggtgatgcaacaccttgttcctgtgattctggccacacgagatagaattcagagaagaggctggatccgttagaaagagggctccgagagctttccattaagtactcacgggccgaaaacggaggtcgtatgcagattcggtggccgtttgaagtcagcagtatagtaggtggccgaatcggattccagcacttggagtacttgatctcgatatcttcttgttcatccatgatgtgagcaatggttgcatccgtggtagccatggtcacatcatcctccccttcttcacggaaaaccgtccttggtttttccatatggtgctctttgcgtagtccatttacaacaatctgtttcttccaatcaaaacaaggcaaactcgagacaatttggttagcaataacatttttctctagcttgcatattttatccacatgtacaggaggttctaaatccgagcagatgtaaactctatgcacaaaatatattccaagatcattatattcaccaaagatgtgaaatataacattggttggatatggcaaatcagacttagcaaataatttctccttgaaattatcgagctcacaaaaatcatcaaactgaacatagcccaaagtatttaaagaagatctcaattcacgctcctctacttcattagcaatgtgaacaacatgcttaaaatcagtgcagtatgaattaacagtaggaatagcatgttcattcacaagttgtggcatggatataagtgaagcattatcgcataactcttctttatcacaaggaacagcaaacaaatcaatttgtgacaaaggaatctcagcagttggttccactaatggttgctctgctatagcatgaaaagtggacaaattcaattcattaacaacacactcacctttattaatttcagcaccattaagtttacctttgatgccctcttcagataatggaggtgcctcgactttgagtgtgatcaatgggactggcggctctttcatgtctctctcctccttttcatgattatgcacttcctgcaaatggttagtaatagaagacaaaaacatagcatgttgcttcttcatgtcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagttctggtatcttgttttaaacattgcagtttgttgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtctccctcgaaataaggcagtgcagatttgatcttacctagaacatcatcacttacctcataatggtcatgttgatccctcctcatgtctcgacgaagatgtcgatgttgagcgcagctatccccaattatcttgcgtatccctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtagagctgtaatcaaatatgtggagctctgggtaggcttaaatatgtagcaaaggaatagcaaatgctcaaatcagataatgcaaagttgaataattgttcaaagtcaagtaccgtgctggtcctaggctagacgtactagagacgcgagcctagacacaaacgataccacaagatagcactaggaacaactcatgcacaactctgatatatgaagttcagctcaaacataacagtattttctcttttctttctttcttctttcttcttttctttttttttctttccttttcttttctgttttttttttgtgcggctttttttttctttttttttttttgcacctttctgcctttttttcactttttttcttgatttttttttaacaaaaactgactcaaggaccttaatgtaagattacagggactcaaacataaatataaaatttatagggactcaaatgtaaaagtctaaacccaaaattaaaattatacaaaaaatggaatgctgaatttatgccgattccgtttttccaaacagatctcgaaaccgacaccaaacaaaaattcgccaaggtgtttgacacaactcggaaccgtggaagagagggagggagtcggactcggccaaaggggcgagtgggactcggccaggaggtggagtggctggcagccgaatttggtgtatgggataaaaaggaaactgatttttaaccaatccaatctactatatctttccaaaacaatcttgactacttccaaaatcagatatggtaattcaccttcctcctctcgtgcacgacacaggcacggccaaaacaaacacacacaaggatcggcaaactctagatgcaactcaagaactccaaaactaaccgacagaaacttctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaattttttttgtatggctattttctggttataggaagataaaaactcaccgagcaacgaaagctctgataccacctgatgaaccctgagttcctctcaacactcaaggttgttgttggcctgatctttcggtgagttgtgataactacgatttgggagaaacgttgacgatccgactacaaccgtacgagacgttgtgttgcgccttagcgatcgatacacctctccgtgagttgttgatcttgtcggtgcagatcaaccctattcctgcaagcaaatcgaagaaacaagcaagaacaagataaaagcaatctgatattgcaaataggaatttaatacgaatgataagttggggttccgaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttggggcgcaccccacatgggccccacctgggccggggtcccaaatgaagttacaagcccataggcccattataggtgatgcaacaccttgttcctgtgattctggccacacgagatagaattcagagaagaggctggatccgttagaaagagggctccgagagctttccatcaagtactcacgggccgaaaacggaggtcgtatgcagattcggtggccgtttgaagtcagcagtgtagtaagtggccgaatcggattccagcacttggagtacttgatctcgatatcttcttgttcatccatgatgtgagcaatggttgcatccgtggtagccatggtcacatcatccagtcactcagaccaaccttggcttgctcagaccggtatcggctctggtggctctagattgccaagtcatttatggccgcccaactgactcgctaggcgcccaattagaccgagtcgggctcaatcagactggcccagacactacgattagaccggtcagattctccgataagacctaccggggacataaaagatagatgaatgaaaaacgaaccaagcaccctcatgcatatgtcctaatgtggtattttgatcacttcgaagttactacccatcttgagagtacgtcaaaactagaaataaaacctagcaaattcaatccctcaacatctcgatcaataaaaacgaaaagcaagattaatcaacaccacaaatggctctccgttgacgatttgtgtttgaagcccgacactgatggctattgtcagtgacggcatgaagtactagcccgttacggaggtgttttgcccaaactaatggcctgtttggggagctttagattctgagaagtagctgtttggtagccagcttctgagaatctggaaaagctctaaaacccagcttctaacttcttagtttatttttcagaatctataactacatattctcagaagctgtggactgtttgaggcagcttctagcggaagcatcttttgggaaaagctgcagctgggacaagctcccccaaacaggattgcatcattcactattcagatatagccattggctgtgtttgcaaccccacgttcccaacccctctcgctcatttttcacgcgcacacttttcaaactactaaacggtgtattttttgcaaaaattttctatatgaaagttgctttaaaaaatcaaattaatccatttttaaaaaaaatagccaatatttaattaatcatgtgttaaaaggctgctccgttttgcgtgcaggagggatgggccatcttgcacttgcgaacacaccatcgtcctccagccgacgccctcgccacccccgcttcgttctccaccgagttcggcgacgtggcctcgtcctccactgagcccgaccgccgctaccatgttctccctcgagctagcccctgccacctcgttctccaccgagcccggtccccgccaggtagtttccaccgagcctcaagtcaatgtgccacgtgggtgcctttagcttaaaccgtcatccaaaaccatcttgggactatatttgcactggttttaataaatgagggatgcattatacccagttttgtggttgagggatgagatccaatctcgagacttagacgagagggacctcaagtggacttattccttgtgcagatgattacctatcctggactgctgggctagacatggtaacttcatatggaccggttacttgggccaccactcatcacagcggattgttgtaatccagcaactttcactaacgtgtaatccaatttatgcgcgcacgttttctcctaaccagcgatcaattaccagtcgtccgatgcacacatatatgttgcttccggaaatctaacttaattagtgcacagtccatcaagcaagcaaaatatatatttctaccacctaagcttcaaaaaaaaatttctcttaacctacttatctaatctacgatccgattacatcattgtgttagctacaggtaatttttaataacaaaatttagatgattatattttaatcaaagattagagattacttttataatatatttaaattactttttttgacatataaaagtaaattcaataaagtctaaaagtaatttagatatataataaaaataacttaaaacaaaatgagagtacattcttacggtatttaaagtaaatctattgtgggggctaaaaacatgtatctaaaacttaaatttaattaacaaattgtattacttaccaataaagtaaactattcacaacattatcaatgtcgaaaaagtaatttaatcaaataaaaaagtaatattttgtttcttttattagaatataatcatgttatatctttttataaagacttatttatactgaatatgatgatgtaattggattgttcatttgataagtaattcatggacattttgcttgaaatcctaggtgttaagaatcttttccttattatatgaatgtatactctcacttaggaatgtaagaacgagatacatgttaactttattatatatcaattgttaggatagtagttggttaacactaattagtgcacatacaacctgtcacttcactaatgaattaattaccaatctaagtaaaagcaaaaaaggagaaggagaaattgcaaaatactcacttgtaatttgatattctatcccataagtcattttgttgcaaatactcgctagtccctactctgttttgttgttaaaaaaaacatcctagtgcgcgcgtgcttaactgaataagctcggtgtcactgagatagaataggctaagctaaccaagtcaatcttatcgaagtacttgtattagatttattcttcatgtttcgttgaactttttttttggatatagcgaaactcagtttgacagcatttaagctctcgtcagcatttatatgtgagtaatctcttaaaaagtggcaagactatgttgcagaagtattaaatttttacaaagaacatattgactgctcataacttatgaaaacatgttgatggtttttgcacaaaatgaaataggtgggtgggcatttgtaataaaattacttatgggtgaaataccaaactttaagtgacttatgggatgattttttgcaatttttacaaacgagaaagaaaaagaaaagaaaagagcatgcaaatcatgcgggcaatgaaaattaaccttcggaggggccaccacgagcaatttgcacggcatattttgccgactgcgcaggacagaattaggacagccgtacaggtgcaattaagcatctttatcgctgtccattttaccgtacctcgtacaattttaatgccaaattatgtatacctgcccacgacctaaaagctgatacaactgatgcttcttgttaacaagaaaatctagcgattgcatcagtgagcaagaaaaactatacttgcttcttgttcaagatctgtaagcattggtgtatccctcttttattttttttcctttagttttggggaaaaaggaagccgtctaattaagcggttatacaagagtacatattaaaaagaccaagagaataaaagaggaaaagataaagaggaattagaggagttcgaagaaccacttggacagaagctgaaattaataaggggatatatatttcatccttgacaagtataaaacttcctccgtttcataatgtaagtcattctagtatttcgtatattcatattgatattaatgaatctagatagatatatatgtagattcattaacatcaatataaatgtggaaaatgctagaatgacttacattgtaaaacggagggagtagcaaattctccctgaaattacacctccaaggatcaccatgtggctgatgaatatactaatatgaaattaagagccctgcttccaaataacgccaggaagttattaagaagattttcctaaaccgtttcactttggatcttattttttgtaggtcgcttttgatcttcttttttattaagtttggtattctttcgctaaataaagatataagaggtgtttttttatgctatcacaaaataggcacacgcatgcacacgactacacacccactcacactcgcgcacccgcaaatgcacctacaacacacactcaaaaacagattggaaatagtgtgatttaattactctggtggcatgttgtgatactatatacaagatgtgagctgaacatctggtgaattctttcactgtaggattgcttaaagagaattcatattgttggacaatcgccatcatatagtatgctagttaaccatagctaagggaatgtcatgtgtacttttcccacagcactattagcaggcaccaatagtgcaactgtaattactccaaattaaaggccatgtgctaagtacaacggtacaaggtcctccgtaagttaaacgagatccgacatgctagaatcactgaattgaatcgtgtctgtcgctcgacaaaattgctatgcaaccatcagctgctttatgatcaatgtgtatcgtacagtcctctaagtatttagattttacaataaaaattttacctcaggtatccgaaggtaccaagttttacactatactcttggtatatctgtattttctaaaggatggcaaaattacctatttgattaactgaaaattgtattgacaaaatcaaatcaaaggagttatcaggctgttacagtgcaagactaatcacttaggacttgttcggattataagataggaaaaacatacgatatgaaaaatataggaataggaaaggaatctagatgtaaaatagaggaatgaaaaacaaaggaatacaaaaattgagagcatttggatcacagaaaattgattgccaaggatttacatacaggaagtgaaaaaaagagcttgaggtggatggatttttcctgtgaaatcagtatcaaaggaaactttcctttggatttcctatgaaaactaaacaaaggaatacaaaaattgagatggatttcctatgaaaactaaacaaagaaatacaaaaattgagagcattcggatcacgggaaattgattgccaaagatttgcatgcagaaagtgaaaaaaagagcttgaggtggatggatttttcctgtacttttcctgtgaaatcagtatcaaaggaaactttcctttggatttcctataaccagttttcatgatccgaatgacaggaaatgaaaaaattcctatgcacagtattcctccaaaaatcctatgaagatcctctaatccgaataagcccttaatttcgttattaatacatcattgacatcgttgaacacagtttattttgatgaacccccaaaaggaccaactatgattgtccatctctctgattgttatatatgcaaatccatttggcatctactgatataaaaaagaaaaaaaactgattttgtaatacaaccatttctcgtttcatctcggttgagggatcaataaaagttactttgacacagcattatctttacatgtgacaaaaatgatcatacaaactatgacatgcaaatattgtttgactcaacatgaggccaggatgaagaaattcatttcatcttcttattttttaacaaggaagaaactcattctacttcttaacaagtaagggccccacattatcacccgttgctttgttgtgcttcacatggcttccatcacaaaggggaaatgtgcctgatctccagcacctgtaacgtgacaacaaaatcaatctatatcagtaattcagtataataccagttggaacttggaactgaaatgcaaatgaagttcctcagactcaagagaaatataaggtttgtattctgaatcactatcgccatgcagaattttcacaaatgcataaagcatgcatccacagaaagagcattgcaaagtgttctctctatcactctgtgtatgtgaaaccataaacagggcaaaactcatacattcataatagtacgattcagtaaaactattggtacgcgtgattatggttgctggcagttacaaactccaagggaaacatcatgatctgaggttcttaccatcctaagatcgaaaggatcattcatatgaatgcaataattcctttagagatctaaggccttctcggctggctgtgctgtggctgcacccctaacataccagagcatagaaatgtcttgtactatactggcggaaaaaaataacacctcatacagtcacagattcacagtagatgaagtgacaaaaaaagatggtctactttactttactttgattattataacttctataagatataaacgtatatacatagaagatggccaatgtatttcttgcagagaaaaagtgttgggacttgtgagtgaaagtaaaactagaaatatctctaatataacaaataagagtatcatacatgagtacatgactatcttctgaatctgtttttttagaaaaaggtttttttttacccggcctctacatccaatcgagatatatgcagccattttaaattagcaacttagccatcaaataacccaatctaaaattcgctcctatggagatttaaactcaggaccttagatgctactcagattactacaaccactaggctacatgctctttcactaatctgtttatttttaagggtcaatctcaaagtaaactgaaacaaaaaaattgcttctgttttatcctaaaaataaagctatctatgttcgagtactgggatcgcactcggttcaagtcgcactgaaaacaaacgcctacaaactctgattatcttacgagccagcaatttgctacgagtaccctctatctttgaattctcgattaatttaccaagcgcgctgatttagtcattttaaagaggtaaaaagcagagcttagagattagattatacaactggctcatgttgaatggttggtgattttaacgagagcgaaatcactccgatcgacgaactgaaattcaccgaacccttcccgattggtgcaccaaagagagcgaggagggtggggtggggagggccgtaccggcagtacggggtgagcggcttggagagctcgccggcgaggacagtgtcgaccaccttctcctcctccttccggatggacgggtttatcccgccgacccccgcctccgcgcgcaccgccaccaccaggccacgccgggcgagggcgcgggcgcggccgggcgccgacggcgccgcgttgggcggggagatggagaggcggcacgcggcggcgcagaacggggtcgccatggttgttgggtttggctcgcgcaggggggtttcttggggttggtggatggatggagtgatcggtggggggagacgaaacgtggatgggttttgtgagtaggcgtggccgcgcggaggatttggggtgtgtggcgagcacgggccgcgggagaggcacagagccagatgggatggattggcgtcggcttcgtctccgatcacca

SEQ ID NO: 62828 - DNA, 3517 bp, Oryza sativa
ttggtggagtgggtttgaggctttgatttgcttgctctcctctagatcatgcaaaactcacaagtttctacccagtttcgggcctccctgaggataacaatcctactcctacatttcctttttttggattgaataaactagggatatacaaacccaaatcatttttcctacataactcgagagtctgtcttcaaatgttttcaaccccttcatggggaaccctcggccctttatatagtatgatagagggacaaaaccaagagaaccgtgcaaacacccatgatggtctaagccctagttgctgtgctactaccacattgttgagtagatcagatgctagctaatcctgtcagcgggcaggatccactatgtcccccccccctagggatttctaggctgccatccgctcatagcccttgggaacgccgtgcgttcggcctaatccacctctgggcagtggtgtaacagacggcctaggtttaccaatctggggggtggtcccggtgggaccacacaaaaaataaggcaaccgacccaactatatatagaaaaaataatagaaaaaaagcgcatgaacctggaattggaaaccgaaacgtcgcgcgcagcatcacacgattgctacgcgtcctcttctcacttgactactcgtttttcgcgctgcctcctgccacccgcatttgcacaagcaagtccatgtggagaggagcagaggacggaggactgcgactccacgagcgcgggctgccgccgccacccgcctatcaccggccacggctcgcaaagcagagtggctagcgtgacgagactacgagtccactctccgctatattgtagatcgctaattgttgaaacatgcagcaaagaaaaatagttttaaattgctttcttccccagttgtggtataggagcacactcaggaccaagacgttgagaagatgtctcaccacccccgccgcgggtttatgacattgacagccttccacatgatcaagaggaaagactacccattgtaagttatcttgtcaatgatcaagatgcagttcggagagcatatgttcttaaaggcccatttaaaccttatccacatgattttaagaaaagaaaaattggaaatagagatcggcaataacaaaagggagcagcgcacgagatctaaaagtggatgaataaagaagataaggatttagacatgttcaggcactctcaatgaggtaataccctactcctatttgaggattgtatccgccggatgttgtattgatttggcgatcgagttatggttatgtcctcggagagctccttgctcacttgtataggttcggggtagatttacagagaagaaacctatttgaacacggcatcagttttctaatctattatatgataacctaacaaaacctatgggctatgccgcatgatacaagccaacattattctcaagcccaagaccattacataatgctatgggtccaacccacctcctatttccaattggatacgtaggctgagtggatatgtggtacccatgatctccacagttcagcctgaggaggtaccttcaaatctaagagtccaggatagcattacaaaagcctagcaaataaataccacagataagaaagataagcaaaataaaagaaaattggcttaggatagagttaaaacaagtaatttgaaatggaggaagtaatgtttttcattctaaagacaaaatagacggagacattcatgtccaagtccgaaatctacatgattctgagttgtttatgacaattaagtcacaataatatagttgtttctgacaatcaaatcgcaaaaatattctgatgatacacctaacggatagaacagggagtcttgaaaacaaaaccccaacattattcagaacacagcatcaatgtaagccccattagccaagtgaaatcgcgacttgtgcgtggtcatttgaagctccactctcccatttctgtttccgctgcaattgccgtgattcacaaccttggttacctccacaccggtcaagattacaaaatcctgccaagtcaatttattgtcaaaatcgccacccaactccagtttttcaatgaaccttgcgatgcagaacctgcctgagcccaggttaacaagttgaggatcctgtgttacctgccataccctgttttgttcaagttccttccaactgctaactagctctggctgggaatccatggctgacagatcagcagcagccaacagctggtcctcggcagagaggccaaaccagagcttgagctcgggaacatactcgaccttgcccaagaagggtagcgtccactcgcccactcgactccacatgttgctggccacgtccaaacagtaggttcctgcgtcctcagccgatacgaggatgcgccacgaaccgtcgtcatcgccggcaaccacggcataggatgtgattcgatggcgtctctggctgtaggcgtaatcgcggacgtatggcggtggcgggagcagctggcagtaccacgacatgaacgacgctgtcaccgtgggcttgcggtagacaaaggcctcgaactgatcgatgcaccgcgcgctacaccccgcctctgatttggggcttttctccatgatgtagagactgttgccttcaccatcgccgccgtcgttgtccgtgccggggacgaagagggagaagggcctccacttgggtttgttgaggcttggcattgtcaccacctggtctgtgtcggcgtcgaagaggaatgcgcggccagactggtccacgcagacaaccttgcgatctgcaagcgggaagcagtcgatattccacccgtaatcaggatcagccgcttgagctttgaagctgaagattgggtcgggaagctggaacttctcctgcaccataaacgctgccccatccgcatgtttgttcttcgtattgaaggcatcagcagtctgttgttgctgcgaaataatgctgctgctgctgcacgcttccattgttgttgccgttggtaacggtgggtgaaagagtgggtagcgtgtcaagtcgatgcagctaagtgatctgatgccaggatccgccccgttctccacgatcagattcagaaaccgccgcgggaggctcatcgtctttcaatcaaccgaaactcaaactttggatcggaaacaattgtgactttgtgaggaaggaaggaggagtacctcgtcctgcggtcgaatcgcccaagatggcatcataaaaacccaagcaaataaatacctcagataagataataaagataaagcaaaagaagagtaaattattggctctcgatcaaaaaagaagaagatgatgaggcggacctgatcagctgaggcgggtgcaaggtcggagaagtgagaagaaatctcatactttgggggagtatgagattgctgaacgtctagggtttaagaaatctcagccacaggcgggcgcttgggccgttctgtacgggcctcggccacagcccacagccacactagtaaaatgttttttttttcgaaacaa

SEQ ID NO: 62829 - DNA, 997 bp, Oryza sativa
ctttttttctccgtgaaagcgttttctttttttttccagtgattatctcgtcgcatacgatgtttttcacgaaattttttattgtattttataaattgaatctgtcagggttatggataccacatacctaatagtagttgactaaatctcggcaggacccaccgcataccatgtcttatacggaaacaaccttcgcatataggaggagttccgcataaggaaggatgactagagttctacatggaaacgacaaggactactcggattgtatccatattggttttcctagttctacttggacaaggggatacccatgggtataaatacaaaaccccctaggaggaaaggggacacaatcaacatacagggacaacatagacgccacaaagccataagccaatacaagccaacatacgccaagacaagacgccggatatcgacttcagggataagcacggctagtcccctacagtgtctccggatactgtcaggagagacgaaagcgctatctctgatctcgtcgggcacagattcgaggaggaagactaccctgttgtcgactacgagtcggaacttcagacctccatgtcgacaacaattagataggctaccccaaatattgtactggtgtgattatggtgaataaagtggaacttcggcttcggccaacaggatgtagggctattacctgacaattcaggggcccgaatgtcacaccccgaagttctcctcccaagcctaaaatttaatttataaatgaccctaagaaaataccagtgcaaagcaagagtaaacccttttaaatcaatgcagataataatcggaattgacatgtggaatttttcttgagttctacatgtcgaaattcactaacaggatttttagtggaattttcagagctctagaaataattttaaccaattaaaattgagcaagcaatattttaattccagggaaaatcctttttcctttttctttttctttttcctcctttttt

SEQ ID NO: 62830 - DNA, 1368 bp, Oryza sativa
  unsure (1)..(1368): unsure at all n locations
aggaaaccatcacctcgctatggaactgttcgagagggaggcaaaatcatggtggtgctagctggctttgtggcttcctgggatagagctgtcgatggagaaagtaaggggcattttgatttatagaaaaaatgtagaaattttggaggatttcaattctatgaaaaaaaaatcctacgaaggtctttgaaacaaaagattgtatcctatctaatcctttaaaatttttatggaatgggtaatcctatgtatattttggaggaaagttagcaagagatctaacctcttggaacattttctctgagtctatctctcttatcttattcctgcgtttttcctgtgatccaatcaaacggccattttctctgagtctatctctcttatcttattcctgcgtttttcctgtggtccaatcaaacggccattcctgtgttttttctgtattttgcaatcctctgttttataattgtattcatgtcagaatcctgtgttttttctattcctgtgttttttcattcatacgattcaaagggccctaaaagggaaaaggataaggcctttcacagtgcaagcgtggggaatagagagactgagaagattggaataaacgagagatttcttctgctttccttttttccacttcccgtcggctcagcttttatttttttttatgtattttttttcttccggtctgtttggcttccatttttccccaagtataaaaattaccctatatttattgatatttcacttcaaatgaaatttacaaataaaacacaatactacctaagaaaaaaaaggaaaagtttgaattacacccctgaacttttgggtgagtacgacttacctctctagacctaaaatccagacatcttttacccttaactatcaatactagatgaaaaaccaccacgggtagctttgtaagcggttttgatcctacgtggtagtctagtcaataattcttttattaaaaagtcgatagggcccacctttagatctctctcctcattatctatttcgctcctcattatctatttcgcccctcagacccctcttttttttgtcagatgccaaggaagaaacgcgtcaacggctgcgtgcgtcccccggcggagggccaaggcagtggccaaccacaattaagaagccggaattaccaaaccaagccaagtgcattgttttaattcaaccctgtccccaggtaagcgttaagccaaattgtgcctccaggggggcggttaaccacggcatccccccgattcccattagttaaacgtgcaggttggtggtcggccggcccccatcgccccccaaaaaatatgaagttaagggtacgagctagctaatcaanttttcaagcccacg

SEQ ID NO: 62831 - DNA, 42615 bp, Oryza sativa
  unsure (1)..(42615): unsure at all n locations
tattctgttaagaacatgtaacggtgttaactgaagctcaaccacaaaatgtctctttatgcccttgcttttttaaccctattatacgtgggacccacccgtcacttctctattctctcttctcttctcttctcttctattctccactccactccactcgcccgagcaccgccgccactcctcgtcgccgcttgccacagcccgagcaccgccaccactcatcgttgtcacctgccacagcccgagcaccgttgccgatgaggaagccatcgtctgtcacgcccagaaatttagcccaaatttccagactattttgtgtattaaatctctgtccaggaccagccagggtacacaaaacgacaagtaatacacagttccaaacgtaaataaagcgtaaaatacttacagaagaggcacttagtcctcacaccgaaacaaaagcagcagcagcggaaaaaaaacgatcctagcgggccttcagctccactccacaggcaaaactcaactggggtctgagccttggtcctctaactccatcttcagctcagaagcactacacttctgaaaagggggaataatagcaaggctgagtacaaccaccgtactcagcaagccacaccaatgatgcagacgtgcaaagggatacaaggatggtttgtggctatttgcataaaggcggttgtaaaacattttatttagcaaacagtaaaactgttgaataattaaagtaacattaaaatctccactgatcaacgctacaccacgttgaacaggcccaaccaacccacctgtactacagtgcattgggtcgatttattaagtgtgagactaatcacggtgaatctggtcgatcgcccataaccacgggcacggctattcgaatagttttactctggccagaggtgcacaactgtacccataagacacaacccaccaacatgtcaccgcgtcatcatgtgcccatgatgcacacgtcaccgtgtcgagtgattgtgatgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggcaagcgctgtaagtcttccagggtttcccgtgaaccggtccttaattgccatgggtgcgactcacaaaaccatgcacccacagcccaccattcagtcgcattttagttggataattacgaccataaaacatggccagatgtctcgagcacgcggctcaacaagatactagaatgtctaatactgcaattatcccatcgactgagctagtggtaattaagcatggctaagcatatagttctagctaggtcacataagtaacacgagctagtcaatttattacccaaggttgacaaagaacagatatcaagtaaacatggcacaagcgagcagataggtaaaccctgaccccgtgtaattagcaaaacatgcatatttatttgtaaacggtaaaacatttataaattgggatcaacatgctcaaggagaatgtgtgacttgccttgcttcttcactttgatcttctaaactcttttcctcgcgaccgcggacttccgaaacgacggaaactacacgctggcacgcaaaacgaggaaaaactctaataaaaaccaagaaaacagtacataaaaagtaaacaaacatgtagagcttaattttagatgaattttgcaagttgaatggctcaatttggagttcgaatgaattagatatgaattttagaaggttttgagccattttaatgaatttctagaattattaccgatttattgcgcaatttaaatcaattatgacgtcatccgacgggggagaggtggcgccggcaagtgggccccacctgtcggtgactcacgggtggcgggcgcaccgtggaccgagtccacgcacgcgctggtccgcgggcgcaccacgtggcagacacgtggcggccacgacggacggctagcggaggtggcgccgacgtggcgccacagaggcaccgacgcgggcggcacgggaaggccacgtggacggcccagatcgccccgaaggaggatcgggcggccacgggcgagctggagccggctcaccggtcggccggccgggagcgacggcgcacggcccgatggtcgccggcgacgaccaccggcgcgaaggcacgcgcgggaggcggcgaaaagagggaaaagggagaggagacggagggggtcctcaccgaggagcgccggcgacgggacgaccatggggaggcgaccggcggcggaaaggatggcggcggccggcacgggaggcgacgggaacggcgttccgacgacgcccgaccatggcggagccgcggccgagggccagcaagacctggggaaattattagagcagttagggagggaaataggcgaccggagcggcgagaatacctcgccggagaggagaggaatggtggggctcaccggcgaccgagagataccacgttccggtgggtttccggcgatgaacaatggtgaccgaggtgctgcacggcgctgcaaggcgagaggtgaagacggagcgacgcggcggcggctaaggcgacggtggcacacggctggaggcggcgtatggtggaggtggctcgggatgcacggtggaagggtggttgcggtggtggaatggggaaacggagcggaggccggggtagatcttggcacggcgttgccgacggcgcaagcggcgaggtgcggcgacgactaacgcggcggcagcggccggctgaaggcggtgtgtggcggtagtggctcggcctcgtgatgggaaggtggttccggcggtggaggagggagatggagtggatgccggggtgcggcgaggcgctgtgatgctattggtggcggcggcgcagcgcggcagcgacgggagcggcggtggcgggcggctggagatcgccggcgagcggcggcgaaggggatcggcgtggagagctcggtagagagcgtgggggactcgggaaaacggggaaaaaggaagaggagtccacggggattgattctatagctcaagggggcgatgatagggccggggagcggcggatttcgaggggaagcggggcggcgtcgcgggggagagagacgcgggaggcggcgacgtggccggattttgcggggagagtggggggaaacggcgcggacgtgggcggcgaggtcccacggacaaacgcgcgcgcgcggggtggaggaggtgggcggaaacggcggcgacgttggacggctcgggcggccatggcggttgctggcccgggccggaggttgggggtgaccccgacaggtggggcccacctgtctgcggctcggggagaggagggaggatgagggaggcgaagcggacttgcgcgaaggagggggcaagccgggccgacggcccaaagagaagggagtaggggaaaaggagggcggccgggcccgagaggatggagagggagaagatcttgagccgaaagcggcccaaagacaaagaggggaaattttatttgttttctttttattttaattgatgcaatgatctttgtgctattaaaactatttctcgagctccgaaaattcacggaaaattccggagagtacattagggcacaaagaatattacaaaatattcccggccaatgatttttaagggaaaattttaattctcccaataattcacttgattaaattgcttaactttttttatttatattctaggaaatgcattatttaatgatttttaaacccgaacgaaaatcggggcgttacattgtcgccccttccccatcagatccagtggtcctagctcgagctctaccgccgagcccaccgccgcagttcctcctcatcgtcgctgagctgtcatcgccccttccccgccggatccagccgtcctagctcgatctccaccgacgggcccatcgccaccgctccttgtcgtcgctgaaccgccgtcgcccctccttcaccggatccaccggtcgcagcccgagctccgcccgggcctgccactgccgctcctcctcctcgtcactaagacgtcgtcgaccctccctcccccgccgcctcacgaacccgagcctcggccccactctccctccctccaagccctaccgccgccaccctacctccacgagccagcgctggcgcagatcccctcaatccgggccctaccaccgtcgccgctccctccacgagccgccactggcgccggatccactcccttcgcgccccccgcgacggcccctccttccacatgccggtgcaccttgttctcctccatgcgccgccgccgctggtacgagagagagagggagagagaaacgggagtacggaactattctgatagggttagacagggatagggttttctcgagggtattttggtctttacgaataataattgtatttctttattatttttaattcaaaccataacgatgaaatggaaacagggtcagacggtaggttcgttttagaaaagcagggtcaaaaacgcaaagtacaaaaagaagggtcagattgaaagaagggtcagattggtataggcatcgaaacggagtcaaataagcaattgtcccatactaaaaatgtttgtaggatagtaaagaaaaaagaaaaaaaactcgaatctataaaaaacatggtttcacaagtggtagtatactgcttggaagtggacgtagctcaactggttaggtttcttattgtggaatcggttcatccaggtttaagctctagattttatacatatactcgtatttacgattattattctttcagtggtagatagtgaggcatctgttgtgactttgttagtctcgagatatgtcggtccagtctatgtgttcatagcagtgactgtgtgcatgttatgaacgtctactttgtactccctccgcccctaaaaaatcaatctattatcaaacgtgacacattctagtactaagaatatggacatatctttgtccaaatttgttacagaaaccaagttaaacttgtatttttgagttttatctatactaaagtaaaaaacagagccgtcatcctcctctcctccctaaccatcacactttccccacactacaaacataaataactggaagggtcaattaggcctggagtagggtgaattggtgattaattccgaaaatcagagataaagaaaaaacataaagtcaactagatatagctaggcactagtaaagtaggaatgcacaaacagagtctacaagcggtagaagggagaaaagctagaggagtaagagaaggatttcaccgagattgttgcaagaccatgtgttcccgaatttcgaatccttgaggggattctactattcattgaggatctcacaaagagtagggccttctccaaccttttcctagaggttgcacaaatgcattcctcttccactactcgtatcccttttcctttcggagatgagatccggcctttacaaacttctgtgaccaaccacaagtagatcggtggctcaaaggcaacacctagccatctaggagtcctcaacctccaagagtaaaagatgaagcaaagatctcgtcgagatgaatcaagtgcttaacaaatcttcatgaagtcaataccaagcactcacacaatctctgatgatgctctctctcgtggcccgatcttctggtgagggggataactcttgctttgattgagtgcgacgtttgcgacatggctaccaaccagaacaagtccaggacgtcgtgcaatcgctacaccacaaatgatgtcgtaccaaccgtgacgcgcggttgatgatccctgcaatgcaaacgagagaacactgcaagaacaagataagatgcaatctaaatattgtgaataggtgattaagtacaaagaaatagttgcgattgaagtgatagatctaatcgacccagcaaatcaacacaccaactattggggactctgaatcaatagtcgctgactaatcaagcgaggactagagacaaagtgaatggcacttggcaaaattcaactaaacaaaacccaattgtttttgatgatgtacaaagctatttatagaggaaaataaagctagggtttagtgctaattcgtggaggtgggagacacttccgagatgggcctagtctattacaaggcccaaggcccaagatcggtttcaacaacagcactgtcttgttttggagattcccgttgactcgagatgaatttggacatgagaccagatgcgtttgaaaggtagcgagacaagctttccatgaagtccaagatcacccaaatcggagtttgcatgaaagcgctaggtccatttaaagttagtgctgtctccggaggccgaactggacttggacttggaattatcattggaacgtgtgaagttatgagtgtatccgacgaagtgatgtcctcatcaatctcaaatcaatcactctctctctctctctctctcacacacacacacaaaaccaaaatgagaaaacaaggctcaaaatgaatctcaaagcaaagcaagccaagggaaaaaagttttcaacggagcaataaccctagcttggaggtggagggggctatttataaaccgtaccctcgtatctgcctattttgaaggggggagtgattccctttttagaaattccgaacaatataaagtcacaaaacctagacaaatcaacattgcgaaagttccaaaaatattttcggaagatttgaaaatcaccagaagcaaaactgcactttcgaaaattacgaaatgaattttccatttgaaaaatcaccggagagcaagttgttggccacgacactttcagaaattccaaaacaaacttccaaaaatcaccaaagagcgaattcggagcttttgaaaatcacttttggaattttcaaaaattaccagaagcaaaatttcaagaatgagaaatacttcaacaaaggttttgagcaccaaactcattcatagacatcaaggcaacatccctcttaataatacgactttgctattgattgtatgaaaaaaaattatattttaccatttgaatctttgccttttttcatatccttgcaacacaaacagttatggccttgaacatcgactcatagaggactcctctgtaattgcttcacatatacttaaataaaaagttagtcattactaatcgcattgtcattaaccaccaaaatgattaggaacctaggtgcactttcaataaccaatctaccaagaaaactggtgatcctagtaaaaatcgatccaccgaaaaatttggatagaaaaaatgaacacccttaagatcatttattcatctttcccccgaccccattgttacacacgaaaaattgaacacccttaagatcacttgttcgtctttcctccgactccgttgttacacacatgcatggcactagggatgaaaaacagatggaaaaacagctctctaccattttcgtttcatttttttaatcagaatagttatcaagaaccccggataaaggttggaatcaactattatcgaatacagatacgaagcgaatgcaataaagattatttattggaacataactctaactggccttctcaaatcaacgatgagatgtagctcttttttttaaaaaataatatatcaacatttctattttttttatcaattcatgatacaactagttgtacatttcactttacataagaactacaataagcaagaattatattcataagtatggcctggctaattaaaaaaaagtcaatgcgtaaaagaaaaacatattaaagcaccggattagaaaaaaatatttccattcaactaaccacctcaatactcactacagttcgaaaactttccgaaccattttcatccctacatggcactagtttttatactacatatatcccaaaataattataattctaggttatttagcatatattgaggtttgaaagaaaagaaaagactatggtgccactcataaaatggtgtataggtaagaatagaagggtaattgagggtaaaatcaaaataaatttgaaggagaagtggttgttggggtaattagtagtctagtgtgacaactgttttggaataaatttaaattctagaaatataattattatcagagtaaggtagtaatggattagaagcgtcttgggtctgctactttgtaactccagaactagagcatgccattccacccttttttttatgaatattccttccataaaaaaagaatctagggctaaatgcgacacgttgtagtataacgtatgtctagattcgtagtactagaatatgccacatacaatactagattggtttttttagagacggatgaagtaggtatatacaccctttatgccaattgggttttatttatcaaaaaattagcgaaatgatgtccatattatctcctgtccttagttgtttagtccgcgactatattcaaagcatccaatagtgtatactgatttgtagggttaattagatgtaaatttcaatatccattattatcctcatgtttaattagctatttgcggtattgagattttatctgacctatggtttatacgatattgcttatggtgtggcattgtataacgtgctatacttgttctgtccacttcgtcgacgccgaattcgatagagcaaaagttatcccctcatgaaaggttaaggccacgtctgtttcaaattattataatctaaatcattaaaaataatatgaaataaataggtaaattattatgatagattattataatatataagctggattagtataatctggtaatatattctaaacgtgtgttttttcagattattgggtggctaagtacccaccacccttaaaaattttatgtaaattaccaaccaccgctatgaacccaacagatgaagcgtatctacttcctctctcccttggccgtgcgtgcatccgcttcccctctctctctagtcgtgcgttaatccttccccaagcccccaccctgtgcgtgaatccttccccaagccccacattgcgccccggcttcttccccaagccgtgtgccaccgtcgtcgtcgcgtcgtctcatcctcctcccactccgcaatagccgcgggcatccaaaatagctaagagcattaggacatcaccaatatatatagcaaaagtggtctatatagattggacccacataaatgaactttaactatgtcaatcctcacaatgtatatggatacaaagtaatattagaagaagagagaaatatagatagataatattatttatttcatatgggtagtccatatgcatatgggtacctttagttattttctttatatggactagttaaacaatgttattaggtaactgaatgaaatagtttatttcctatggactacttgtgtgctatattgtggatgcccttataaatattagacttttaaaccaaataatctatgcctcccacaatttagagaaacgaataactcgtaacttattctactgtagcttattacaatctagtttatagtaagctgacttaataatttagattataatagtcttaagttggaacaaagtgggcctaagccacaacagtgagcgcgtcatcgctaaaaaggagaacgagagggcttgagccggactagcttttgctgaattttactattgttgtttgatctgtatttgtaggtgtttccagcgctgcccgtccatgtgtatacttacagcgttggtagacgtgcgtgtcgagaaaaagaaaaccaaaagcagtagtactacattacagcgttggtggctttggtgcaccgctctctcaggccgtttgcgccactctccaaaccgctcagcagaggcaccgatcgagcgagcaaagtcgacacgtacaactcctcctcgggctcgcctagctgttgatgcgaatcacaggcgtcacggacgctaacggagagcctctctgcccgtgcccgtgccgctcagcgtgggcgccccacaccatcaacaggaaggcgcaccgggcctccaccagtggatcgccaggcacgggcgacgcccccgcgcgcagggcaaccggcaaccaattaaccagacgcgcggcctgggcggacgtggtggtggtactgtggtggtggactgactggcaacggggcgctgcagcgtgcgcgtggcttggctgacggcgcggaccccgttgcgcagcgagacagcctggctgcctggcagcttgcctcggtcgcgtcgcagcaggtggcgtttcccgcgccctagaaatgcgtcgccacacgtgtgtcactggcaggtcggctctgttgaccggacctcttcctccttcagggcaagttttttagttgggtggctatcacatctaataaacatctatgtgagatacgaggtaatatatataatacatcacatccacactacctctagcatactaacccaaatgatttttttatttgtttgtccaatcaactcttcccttcatctctttttttttgggatttgtgtagaggttgccccttacatgaggggtggctcacattctctttcctcacttatttcttccacctcaccatcaaatcctatgtggcatatttaggggcaacatatctatcattatagtacttaccctgactagacggacacgtacacgaattcgttaggagtttattcctactttcttgatgaatgatgatgggaaaagtttaaattaaacccctaaattattgggtgagtacgagttacccctaaatccgaaaaccaaacatgtttcacccttttcaccattaactgtcaacaccggatgccccccacagccaccacatagctttgcaagcggttttggtcctatatggcagtccaatcagcaattcttttattaaaaaacgatgggggttcacatgtcagatctctcttctctctatctctttcctctctcaccctcccccctcatgcgtcagatgccgaggatgagtcgtgcgccacgcaccggcgaaagccgaggacaagccgtgcgtcggtggaagccaaggacaagccgtgcatcgacagctacaagcgtcgtcgagcggctgtggaggaggggcgtgcaccggcagaggccgaggaggagctgtctccgccgctcgccgtccccactatgcggcaccacctccgtcgctcgccgtccgaaccgattgacagaaggggacggaaaagagagggggcgcctccgcctccgttgcttgccatgagatggaggtgccgctgcttgtcccgagctccgccttccgcccatccccttcgccgccccgagctccgcccaccgccatcctcgactccccctccgccgctgcttctcggtgacagagagatggatgtgccgctgcttgtctcgagctccgcctgccgcccatcccctctgccggccaccgtccttgacagagagatggaggtgaaggagggagaggagagagagagagagagaggattttggaagaaagagatagagaggtgaggggaaagagggagggtgagagacggataggtggggcccgctgattaaaaaagaattgatgactggactgctacgtagtaccaaaaccactccggattgagttagggggggtaattcgttcagtattaatagttgagggtgaaagatatctggtttttgggtttaggaaggtaattcatattcacttaatagtttgggtgtaattcagatcttttttttccaatgatgattgatgaatgcgttaagaaacaagcacagagtacagattggaccaaatcctacgattatagcgtcatcttctaccgagcacaattactactgcataatcctatatttgtaattgatcatctgtaacggctcgggtagcatccttcatgacgaatgtcataatttgatggttcgaaccgacaactacaaaatctaacctattttgttttttttatggcaaaatgatatcaaacccacgtacaattcagtatgtgagcatatggcgtataccatatatgggttatgtatgtgtgaagcatggcatggcatatagcgccggtattggaaatatgaacgtgcgctaagaggaggcatgttcctgaacatttgcttatatgtctatatgcctatgcaggtaagtttgaccggcagagacgttaggttctttgataggattatgtgacatcatgacctaattagggtgtgacctataagtgatgtgtgcattttattagtaccacattactagttgagtaagagtaaaccaacttatataatgtcttatccctccaatcatatcattttttttgttaaccttcttacacaaagcgaaaacaaaagtataagtatgttgttatgtgtcagtggatctaaatgttagatgggttggactgtgtggtactgaattgcgggctattacaatccatgtctaacaacccaagaatcaggggggccttgggattcataatttggaaatacaaaataaatgtcttttgagtaagtggttgtataagttaataaatgaggaaggggtttggcaggacttattgaagaggaagtatctttataataagtctataacccaagttgataagaaacaaggtgatttccattttttatcggggctcatcaaagtcaaaagtactttcttaaatatgggttcttggattgtgaatgatgggggacaaataagatttttggaagataaatggctagataacttggctttcaaggataaatatccatctttatatgctatattccgaaggaaatcatcctctattgccactatcatgggatctgttccgcttaatgtttcttttagaagaggtttagttggtcagaatcttgtatactggcatgaattgtgtacttctattgtacatattcaattgaatctttcttctgattgttttagatggaattatcattagaatggtaggttctcagtaaagtgtcaatgtatctagctttaattaataatggttatgttgagaagaataagtgtatttggaagcttaaggtgccgcttaagattaaaatctttatgtggtacttgcttaaggggttgtgttaattaagaataatttggcgagacggaattggaatggtagcttgaggtgttatttttgtttgaaaaatgagtctatccaacatctctttatggattgtcattatgcaaagttcatatggagagcagttcagttttcttttggttttaaccttccaactagtatatctcatatttttttatgggtgacttttgcgggttgacaagaaaaagagtaaactgatacttgttggagcttctgccatttattgggctctatggttgagtagaaatgatatggtttttgacaaatcaccatctatttcctatatgcaggtaattttcagggcaacacactggctttggttttaggcacaactacaaaggtgtgatgatgatggggagattctaaaagttgtatgtcgcaagttagagacgatggtcatgtaactttttgtcaattatggatggaggttcacaaatagacttgaataaatgtgttctccttattttggcttggtttcctctgctttttgtttggtgtgttctattttatctgaactacgcttttttctggagtgttactttataataattggttgtagctctttttaagtaaaggccgggatattatattacattatctaaaaaaatgtctaacaattcataatttctgaaccgttatatggtcttaaaccattatagacgactgactggccaactgttataggcttttcactgcaacccaactaacctggatatgctaccacaaccaaaaccaaatatttcgttgcagtcatcatacattttgatgttagtacgtcagtcacaatgtttatggtaaactacttgtcaaaacacacatataattgcacatttaaatgtaaccgggtgtctaaatagtatcgcatcgatattgtaatcacacgtggctgagtttgaatcagtttttcgatttgactactatctcattatccgtaagcatgtttttcgaaccatgaaacgatacgccttttacaaaaactttttacatataaaattagtttaaaaattaaataattttttaagtttgtaactgttattactcaattaatatatgttaatgactcttaaagtttcttctagttttgcatgccatcggaaagatcggcccaatcccctaattgaacacagccaagatcatgaccctgcattgcaaaatattcttagagtatagtatatgataagcctagctcggttgatgattacttaaccctatatgaataacagagatgagagaaaaggaagtaagcttgtatgagcgtctaggcacacaaaaggcaaaggcttgcccatgtaccgatctatggcaaggtaaggtgaaggacagagagtgagagagattctgtgaaatgacataagatactagcaagggaagagaaatgttgccaatctgaatatgctaaaatgaacatcaccataaaccaatagtgaaggagaaaaaggtggtgatgataaatggggtgcgagaaacaatggtagagagagtgtgtgacaatgatggtcaaaatagggaagagggatgatgtggcagctgatgaggggaaatggcatggcaactaattgacgtgtgtaaagagggggatacgacattagccgaagaatctcctttctccttcatttccgttgtctctagttgtcgatggggaaggagggttgaaaaagcagccgtgttggtcccatggtcgggttaatcccgatgttcctcaccatctttgttaatcccaattcttgtgcagatcaaagtagtggttgtcatccatgatctttgtcctagcggtgcctggttgtcacaatggagtagctagaggcccttttgcacatatcaaccagctggaggtctccggatctaccaacgcaagccaacctttatagatttttggtcaatgatgtggagccccattgcctctccccctcttcatgccagcttaacctcggagcaaccatcaccattgtggctgctcatgccactttcctcatgtcgctttcacgtcgtacctccctctcatcacggcagcttgatatctaagcagccatcgcttttgtggccgctccatgttgtgattgtcacgtagcttttcctgttgcccctccccttcttcatgctggctcgagctcatagcagacggatccgacaggcccaaactcagcaccaacagttcttcggagaaggaaggtgaggcaagacaatgtggcaggatggcttgggccttggggatgccatatgcttcagctgctttgctgcatggatgatgatgatgaaggcagaaacaattgagagaagaaagaggcggacatggccacccgatccgctgcctcggcgcccgttcatcacctctgcgtgtatcttcattgtggcaagcgtgggagggggaggagaaagggatggtgacgctcaatgctggtctctgaggatcaagaagactagggctatgggagagacagaggtaaaaggagttgggggacatcaaatgagatgaagaggtagtaatactatgtggatattatttataacgattaaaagtaaaagatatggaaccagatatctataacaactcataacaaagaactgttgcaaataaccttctatatacagtgactcttcgttatgagctgttatagatgaatagctccatatttgtaacagctccacacattaagagccatcacagatgtgtggtcatcactaatgagtattagcgcctaccattatcttcagcattcagtatatgcatccgttgcagattagttaagtaatatgtaacaagttttattgatccgttacagataaagggatctatagtagtgactggtttagacatcaactatccaactatatggatattatcagatgatagtttaaaaaatggcgggaagataatactcaccatttgatcgctaacttgagcataacagtatgctaaatgtttataataagagagtaacttgggacacaacgcctactacacaactttatcccatgagaggtactccctccgtcccacaatgtaagagattttgagtttttgtttgcaacgtttgaccactcgtcttattcaaattctttttgtaaatataaaaaatgaaaagttgtgcttaaagtactatagataataaagtaagtcacaaataaaataaataataatttcaaaaaaaatcgagtaagacgagtggtcaaacgttgcaagaaaaactcaaaatcccttatattatgggacagaggaagtatattaaggaggttggtacacacactcgtaactcatcgtgtttgttgattattaaccgcaaaaataaattaaattttaaagcttaatggcagagttgttttgggtctttttttcatcatattctatttttccgtattagcttttaaataatgcataaccgtatacaaaagttttaacataaaatatttttgttattcattcatgtttttaccgcttatcaaccgtagcttaactagtcaaacagaaaatgaacacgtgtagcctcttaaggctgtgttcgttccttcatgttcccaactcactctccctcgtttcccgcacgcacactttccaaattgttaaacaatgtgttttttaaaaattctgtacatgaaagttgcttttaaaaaaatcatactaatccattttttttaaaaaaaagttaatacttaattaattatgtgctaataggtcaccccgttttatatgcactgcacgttagtcctaactaagaagaatgaatacggcctaaaatggcatacctatgtgcagcctttactcttggaatggcatacctagccagtagccatccggctatgcacctgccatcttaccaaatactacctcccttctaaaatacaaaggatttggattaatttatattttgagatggaagtcatatttgtttgtaataaaatatttaaaatattgcatgacatgtagtaaaaaaatatacaccagggctaatgcaggccctaattaattttgttgagctcagtgtagaatttagaaacaattgtgtaactagaaaaagaacaggaactagtacaatctctgaaaggtagggcggggcaccgggcaccggttgttgctttctctccttttctttatcgggttcggggctggccatgaatgtgtgttgctaaggctgacatgtgaggccaaaattcgcagagacccaaccaaagctctataaaaacagttcgagtttgactacgctcacaccgagtagctaggaggggaaagggatgtcactcttgtgaaatcaaacctaactttgcttgtcctaaaaaaaagacctaactttggtagcttctgatcacggatgttttcagtttatgataacagaacattcactaaaagtacttctttttagatggtttgactgatcctagctatatagaactagaactgtagtagtttctttttttttctttctttgaaaaatctgaagtcactctaaaattcaacatggattgtagttttgttctgcaactgtcttgtaggtgtaggcatcatcactctaaaagtcctataaggttttctttgataatttatgtactatatagattaccaaaaagatgcaaagtagaaattgcttatgtcagcataccatattgacaaaaggatggtttatgtatgtatctttcatggtttgatttgatctacagattccccacacacaaacattagatagaatagcggtgcatcggccgaaccattgacaatctagccagtggcgaagctaggatttgaggttaggggggtgtggtggaggaagccataagaccgattaaccaatatggatactaaatgagccaaatagtcactaccgacaataatcaatgtgtatataaatatagcttcgttgtagctagattacaaaaccatcatatgttatgtttttttaaaaaaaggttcaaatgttcaatataacaaggcatcatatgttatgcctaaaaaacttgaattcagttctttaataatattattgaaagtttagaactagtccgtgttgctaaattctttcaatgtaaactaccaaatagtctcataaataagcattttctgttttactttgaaaagatgaaaattataagactaagtactaagagtatgactataatctaacgtgctaatggcctaacagtggatgctgcctaattgcctaaccatgtaatatactactagcagccaccgagggggggggggggtgttcgggatagggggggtgctgaccccctccggcacccccggtagcttcgccactgaatctagccaaaaagcattatgaaaggcttgaacttacaataaagcagcataatgaatcaagcagtagtctccattattaacgtcacagtaggtgcgagatgatatatgtaatacaaaccatcgcatgcatgacgtacacgatgccagtattaagattgtctacttgtctgccctaaggtgtaatattttcatgatatttatcgacaatactaattcttttaaaaattataacataattaacatctccctagaattcgacgtgagctactgtattactttgttctttatcattatgttgtaggtatgatttttcttattatctttatttttttatatatgaccccctatagggttcgtttgagaaattacatattactccctctgtcctaaaaagaatcaaattctggctatgaacctggataaatacttgtctaggttcatatagctaggatttgagtttttttaggacggagggagtatatgatacttccttcgttttatattataagttgttttaatttttctttaagtcaaactttttcaagtttgactaagtctatagaaaaatatagcaacaattacaataccaaattagtttcagtaaatctaatattggctatacttttaatagtataatagtatatttgtagtgtcgaaatattgctacgtttatttataaacttagtcaaaacttatagaagttttacttaagaaaaagtcaaaatgaactataatatgaaatgaagggggtataatttaacacccccacccctcccccaataaagtaatccagttctagcttacatcaacataccatattgaacaaatgatttatatatgttttttaatcaccagattctcagtatgcaaacattagatataatagcaacgcatcgttctgataatcagacaaatattcgaaaagcattctaaaaagcttgagactactataaagcaacataatcagttaagcggtagtctcccatattgatgtcatggtaggtggcagacgttgcatgttttgatatgtaacgcaaccacttgcatgagtgtacgcgtggtgcaatgctacgttttgtcttctctaaggtgtcaaatagagctagttttgcaaaaaaatttatctacatacgtaaatcttgaaagaactaagaaaatgtaacaattaaaattgatgatgtttgttagttttattagcactatctgatctgaagcaaaaatattgagtactaaatagaaatgagaatccttcaccatatataatacaattttagctaagtaatactcttatatcacttgtgagtgaaatataaaaaattaaacaaaacttactataaaaaaatcttacataattatacaacacaatatcaaaacaattttctaaatcacatgaaaagaatattaaaatttacacgggtccttaagcaaaacacatgattgattttatggagcttcacgccatatatgtgtcatcaatactatcttatttttactctcacactccggatataataataaaaaaagtgttttaagtactactaaacacgataccgcgccgatctattttatcctgaaacacattattacatataaaccatgcctaaaacctaccatattcaaaacacacatactaccaattagaccggctcacaccaaccattaaaagaggacattcaatataatcccacaaaaatattcctccatcccctctcccaaaagtagcaacttctaaaccctggtgtcaagtgtcaaccaaagcacaaccccccatcaacccccaaatccagcacctcctatatacacacaccccccaccccagggggggggggttgtgcacataccaatttcgcctgcacccacacctgatgccacaccaccactccccccatcttttttttttggttcctcttttggcccccaaaaaaaaccaccacgctcttcgcctcctccctccctcccccacccccgtcaaagcgagagctcggtatcaccgccctctttcccttcccttcccctccgatccaatccccccttctcctcctcggggcgctcgctgagcatgtcggcggagggggaggccaaaaaggacagcgccagcaaccctcccggggtagaagtcgacggaggtggagggnagnagnagtagaatagcagcctggctgtcggggagccggcggtcggggtggccgaggctggtgtaggaggaggagaagggtagaaggcggatctataggagcaggagggaaaggagaatgtgtaggagggcggcgtgtgtaaggatctggtgctcgtcgagaacgccgtccccgtcgaggatccggaggaaggtacccgcgccttgcgcttctgctctcctctttgcgggatttcttggtcgcggtcgggaaaatctcgcggaaaatcgagtgaactagtattggtctttcatcttgtgtgacgtcgtggagcaggaaatagttgcagtacaagcagaatagcagcagaagcaggaggaggggggagggtttggtttggttgatgctagggttggtgctagcttttgttcttgcgaattaattgtgcgaatgcgtttttttttccctctcgcgaggctgaagaaaaaactgtctgttctgcagtgcgagtgctgttttgttagctacagatttataagtgtacttcggagtccactagtatggggggatttaggcatttagtgattctttttttgttcgttaatactagcttttttttccctgctgctaaatgctaacgagtcattcaaagattgtggatactgtctatccaaaataaaagatttggggatcctgtcagtccacatatcagttttggagcaagtcttttttgaactttttctcctttgttaactgtggttgacttgtaatcctggaagacaccaaattgaaaccaaatgtctcctctctcttttttctgcctttaccttttgttgttttgctaatttttattaatacttgccatgcaaaaaggagtagatttggactttgtttttttttctatcttaattttgtcagtacttgcaatgtcaagctgctttactattcattagaattaagtactcatgcctgcatctacttatttcagggcttatgcttgattgactgtgcaaagttcttagctgaaaaaagtttgtgtttgtttggttcacagccgcagcaactgcagcacttcaggaagaaatgaaagcgctcgttgaatccgtcccagttggtgctggggcggcattcaccgcgatgcaactacaggagcttgagcagcaatctcgtgtctaccagtatatggctgcccgtgtgcctgtgcctactcatctcgtcttcccaatatggaagagtgttactggtgcatcttctgaaggcgcccagaagtacccgacatgtaggctcttctaacttgtacaataatctatgttccttttgcaaaaactcagatacatttttttttgtatgttcaaccatgcatttctcagtaaatatgctagctatgtgcagtttttagggcgagtttttaatgtaatttcaagcccgtgattttacagcagaaatttaattttatacatgcagtaatattaaggtattaaagaacttattgaagcagacctttacaacgtcatgttagatgcatataagattcaaattcttccatgtgctgtttagagttatttgaggcatttctaattgatttacaatgctgaattgagcagtgatggggttggcaacactctgcttggactttggaaagaacccagaaccagaacctgggaggtgccggcgaactgatggaaagaagtggcggtgctggagaaatgcaattgcaaatgagaaatattgcgaacgccatatgcaccgtggccgcaagcgtcctgtacagcttgttgtcgaggatgacgagcctgattctacctcagggtcgaaaccagcatctggcaaggccaccgaaggtggcaagaagactgatgacaagagctcaagtagcaagaagcttgcagtggcagcaccagctgctgtggagtctacatgattgatgcagcatttaggagctgcataaagagcataactgtgctggcaattagagttcgcttcttattgtaatcctgaaaagactgtagtctggtctagctataacctcatcaagcaagaaaagtgtctgtggaaagaagccacaaaaactttcatttagctgtcactgaaattttcagtttaggtgtatagtttgatttagctttgccgtgccctctgccttcaggcagatgagcggcattattggataaatcctctctgactgacaatatcgcattgtgactcaagaagccgatggaaggatctgcgagactagatacgaagctatttgttgtgtatcattttatatggcctgcacaattgtgtgattttgtcagttgcataacatgtggaagatccataattttatgcactatggagattcaattaccttcctgaatgtctgagcttcgacatgttattggttattgtaacttaaaagcaacctgagattcaatgtgaaagggttttagattccagcttctgaggtgtgatttcactttatgttgatctcattcttagatgagtagtgcttcaacagtttcaggtatgatatttccagtgtttgatctccatatatgatatgattgattggtgtgtgagatccatcatggttactggatgaaattctgaaaatcaaaccaattaaggtcgaatcatttggatttcactccccatgattggatcctcttggatgcatttgctcatacaacaaacacaaatgtctccattgagcatttattttgttagttctgtactggaatcgagttcaatgcttttggttgcatgggattctaaggtcactcttgaatagtagattgtttgcagacaagtcagttaatttggcagaggaagtctggtgcttttgcagcatcatttaccactgtggctgccaaagtgaaacctgtaatttgctttgtttggagaggtactacagaatcaatggaagcaagggagatttatttctgtacctggtacttgttttcttggaggttaatggtgcctgatttcaaataataataataactgatccacacataggacgctaataagctgcctagaatggatgaattttgtcagggaactgacgtccaatctgtttggatttttgaagaaaaacaacggccaggattgagtaagatggctatgtatttaagtgttataatcaattgtttcttgataatggaaatcaaataaagcctctacattttcttttaaaaaaaacaatgctctacatagaaattgtatccggccaaaggttttttttttttagaagccaaggatgttatagtcattgcgaactccatatctattgacttccttcacctttaaaacattgagatgacacttgaaatcaaggccaatggcgcttgatgattgcttcattgatccgaagttcagttttgagattttgtactccatgtttaaagcacccgtcacaaaacaagaacagtagggtaaattattgcaaaagtttagtcgtagccagtaacttgattttgaattgaacttattccttttataatggtagtgtaaattttgctgtctacagtctacaccaaccaaaaatgtacaacttggtatggattcatgcgtccaaaactctatcaccacattccagacagaacttgaaagacttcaaacctaccttgagatttgattagtcatttcacttctttacttacctaaagatgccgatgtggcagtccataaatttaattgggtagttaattacatgaaatgcattttatgacattctactacgagatgccattgcccctgcctcctgaatcacaatgccagagcggaagaactagggttatgttccactactacctaaaactaggagggcaagttgcattgcacccttggcctacttgcgatttgcattagtagaagtcctatcaccaaagttaataaatcagttatttgccactaaaaaagctaaattattcataatgtgtactccctacgtcctaaaaaaagacaaaccctgggtttccgtgtctaactttaactgtctgtcttatatgaaatttttttataattcgtattttcattgttgttagatgataaaatatgattagtattttatccgtgacttgtctttttaatttttttcataatttttttaaataagacggacggtcaaacgttggccacggaaacaagggtttgtctttttttgagacgaagggagtaggtatcgatgatatttcccttcacccttcttcctcatggctggaatgtcagatcaatgcgcatttccactcattttggtgaaagatcagggaagaaattgcagcacatctgtctttgctgtatctagtgcttgttgcctgctgctaacattattcatttattatttatggtgtccgttctgagtgcctgaatttatgtttgcacttctgagcagttcacaagtactgcacagcgaggagtaaaccaaaaatgaagtgacagctacttgtcctgcaatatcctcatttgattttactcgtgagacatggaaataccagactgtcatttcgaccaagtgatcctgataagaacatatggatgcattaagagccatgttggcaacttggatcacgtattgaacagtatgcaaggagatgctgcctgtcaatattgatgctagtactttcttctgataagtgcattttctgttctgatgaggatcacaatcaagaaacagagtggatgaagttacattacacggaccacggttcaataaattgatggaagttgatagttgtagcagcgttatctacaaacatttatgttctaattaggatcacaatcaagaaacagtaacagatgtttccactcgagaaagcagcagattacgaatttacattgcaccacagaccacggttcaatacattgatgaaattgatagttgtggcagcactttctctacaagttaaaaacaaaaacaaaaagagaaaaaaaaaagggggagtgtttttctggttctctattttctctttacagttgttgcagtaccctctctcagatcaaatgtagtcaggtagcagacactagaaaccagattagtagcacctctgtatatatatagtacattttaaggaaaaactagcaccaaggtctgatccggagtaggatctcctgtgctcatcaagagtcaacacagctcatcatctgcttggagtttttgaagtgctttcttcgcataaatagttattgcagcggtagaaactgcagcaactgagaagccaaggccgttgtaaattatctgatctaccgacaagaatgaaccttgggtagtagctacggctaggctttggagaagtttcccactgttatcacaaaattgaacaggttaacactagataataattcagtaataattaacaaagtgcgtcatatctgaataacagaacagggtgcaatgcaagaggtacaaacctgtatattgcaaggaaggtttcatgtaccgttccagccattgaaccagcaatatatggcccatacttgacatttgtagccacagaggcatagttaaaaactagatatggaaatggagagatcctaagtaaggcaactgctctaaattgatggaaccaatccccttcaccagcaagtctaacaaaagctgctttcttcggccacttctccaaccacctctgcagaacaaataccattacaattttgtagaaaaaaagaaactcttgaacttatatgtgtaaaatgtgaaggaggttaagatactcacgtgtattttagaatggaatgcggaccctataaagaatggcaacgacatgcctatgctcattgctgctgtaattatcaaaaagccatagaaatatccaaaggacatccccgccatccacataaaaggagaagaaggtagcaacacacttgggaaaaaagcgattgcgccgaaacatatcagagcaatgactggcctgctgaaagttcttgactcccattcaataaccggagcaatcacctgccaacgacagcaacatgcagaacaaggtcagcaagacaacaataggagacttgcaaaataaatatcacagcatcacaatcaacataagcataagtaacaaggcaatcataagagttcaaatattcattggattggacctagtaaaaatgataggcctttctggtttccagtcagatcatgcaacaatatcttgataacataatatcaagaaccagcagcaatttcagactattcctatcagttccactttcagcgaaagcacacagagcatcaaccaacacagaccacttgttagcccatgtcaaaatgccatccacaagcaccgactggcatttaactgaacatcttggctcattctgcccatttaacagacatcgccatccaacatcctgatattcctttctgctacgagtgatatccttgaatacaaatgaatagttatctaacgagccagctatatcaccaaacagaaaactcgtcatccagcaccagtgcgatatataggagccataaaatacatctcatttactctcctcctcctacaatagccaaaaacatgaccatggaaacagaccaggggaaatattttccttgtaactacttctgggcaacaggctggccccaagagattgctttcaagtaacaccaacctgcgggtccagcccccaaacaccagcacatactgaacttgcttgttgtgtccattccatgtgctcttgtaggtatgcttttggaagaggtgggctgatataatttccatgttattgagactaacgaacagttcacttcctgacagccaaaaatatcaggaaccaattgctttgtgatattattcctacccatccacctagtagtgaaagctccctaggccaccaaagcaccaaaagcttgcagaccccacatatagagccactgtgcaggcccagcataccaattgacaggctctggccagtattagctgattgatatttgatacctccgttccttgcaaagaatatttactatatattacgcatggcacagtgtatataatccatatccccaattgcgacgttcccatttgatccagccgtccccataactttatgagaaaatctatgaacattccatattccactagtaataattcagatcctgcaggccgctataacttatttacttttgtaaaactatgtggaactaatcgtccagcaccaccaccattaatcacttcctccaatccatacggtggtaaaattgaattaaacatctataaattattcatttcgaactagacagaactgggctaggataacaatccaggcaaaaaaaaaacagaatcaatcctaaagtagttcaaggaaagaatagcgcgaaatcaacaaaacatgtgcaaacatcaacgagcgagaagcaaagtaaactaggaggggggtaaatttgcgaacgttttgctagcacaaatcaaatcgattctacagcaaacatcctgagcagaatttgaagaatagaggagagatctgaaacatcggtgaagaacccctctagtcggcaaggaacctttccccaaccaaaaggggaaggaaggaaggggggaggggagaaggcggaaaaggcaagctcgcacgcacctttttaatgacgaggggtccgaggaagacgacggcggcggcggccgcaccggcgaggaggatcccgagggcggcgacctgcgcccaccaccggatcgcgcgccaccgcagcacggcggggcactccccctccccctcccccttccccgcctccttccccaacccggcctccacgtcctccgggatcctgatgtactcgccggcgccgcagccattggtggcccccgacatccccatcgtcggctcgtcggtgcggacaaggtgagccgatcaggcggcggcggcgacgaccatgccccggaggaaaaaaaaacgcgcagctcgctccccgccgccggatccccgctgccccgccggtgtgggtgggtggggaggcgaatccggctcgagctggcggattccgatggggctgggaggctagggtttgggtcgcggaggcgagggcgaggcgaggctcgcacgcgcttatgagggggagggggagggggaggagagaggcaacggcattggagcggagtcggagaaagaatacagtacagcctttttttttctttatttgttttcttttatttcttctgtggatattttaatggcgtttcggttggaaattcggaaaggggaaggggaaggggaaagggcaagggattagagctctggattgaccagtttgccctttaggtgttgtatttctacccgtgttcgtcccaaattaaaggggaaattctaaaaaaatcaaaataccattgtgagtttgagattctgactcgtatgactcctaaatttagtttcagaaattggatctggagtaaagttgtggagtagtctaaactcagctgcatatctctagtttattttgaaagcgatccacccagctccgctcctattttacatggagctgaaactgtttggctgggctccagctccaggagagatagatttagagttggagctacaagcccctaattcatcttggcttgagatttctttgtatttggtgttgctcgtgtattttttttcctttgttccgcatgtgttatatgaattagtatatctcttgatggacatgactctaaacacatctgacccatgtgaccatggctactcgccaattagtatccacacgatccatgtgtggggtttgtagctccgagaatagccgagcaacggtaattgagagaatctcaaataaagattaattagaaggggctatttgcaacaaatactcttgtaaagaagaatctcaaactcatgataacactcaaggtggttttgtaattttctccaaataaatcttttttaagtttaaactttgtttcaaaatttatttcccacctaattatttttgaaagagggagtatgtccgaggtccattcgaatttaataaatattttactcgattatacagataaattaaatattactaatattataaaccaaacaaataacttagataagtgtctaaacaatgtaatataggaaagatcttttgagaaaatatatatttgtaatacatttgagcaaaggtatactaatgctcaaatgtattataaatggtccattacttttacaaatgttttacagatatatatcgtcaaatttgtgtgggaaaagatgagaaaaacacttatataaatattctatatatgttgatgtgttacaatgggattgactcttattttcttatatatatatatatatatagcttccaccaaatcaaatcaaacggctaaaaagtatatatttcttagtatgagttttgtactaatgttttaattacgtagaacactgctttattcgtcgctagatattgttcatccttgaatttgatcactttctttgattattacttcccctgtttcacaatataagtcattctaacatttcccacatttcatatttatgttaatgaatctagacatttcccacatttcccacagtcagtctagattcattaacatcaatatgaatataggatatggtagaatgacttacattgtgaaacggagggagttctaagtttatattgttgaggtgatatgtttcgaatttttaccgtctaactcaagttgtgtgagttgtgacacaaaatatctatatattgtgttaggtagtatccctccgtttttttatatttgacaccgttttttctttacaaaagtttgtctaattattattattattattatgatttgttttatcattacaattactttaaccctgacttatatttccacacatctgtatgattttttttaactaaaacgaatgatcaaatgtaaatttaaagagtcaacaatgtcaaaaaaaaaacatgggggaatgtatgttttgatgcgaaagagaaacataaagataaatacagatctgccaacctaatttacctatcgaataaaagcctagctcatttttggaattgtcacacgtgtatagtgcaaaccccacgagtacttatatagtttagttcgtggtgaccgttccattgacacagccagggtgccagcatgaagtttgcatgacttgcacacatgagttatggacgtcacatgctttttttttccaggtgaaaatacagggcagacttgaccaagaaaaggccatggccagttccgtaatttcgcacgattaattaccagccattttcccattaattaaacaatcaccatatatcctactactactaccactgactgggaacgccccccggtcatgaggtgggcccacgagtccagcgacgaggacctcctacccgtgggcccacctgtcagtggcggtgggcagctgtccgcccgcgtgaacgaagctcgtttggcccggtcggccgaaagcgaccgcccacgagccgcgccgggttggtcacggaggcggactggcggagtcaggctcagaccacccatccgttggctattttcacttggagtctagcgctgagtggatgacatgtgggtccggatagggcgggcccgctgttgtcagtggcgctgggtcgttgcgttgcgttgcgttacctcgcgggatacggcgcggtcaaaagtcggattcgtttcacttcgccggctcgctcgtgcggccgtccaaaaaagtgaatgaaacaaaatatatttaaatttttctcattaatttcactcggtttttttttcttctttacttttgagattcgattctatggcggtagggtagaagccaacacgaaatgcaccgccgcgatacacacggctggtttattttatcgcaaaatctaaaccgagaagcctctcggtttagtcttacagcgcgacaccgctgaagctattactctactcaaaatatattagtccatcaagcaaatagtaataatctatgcttcaaataaaattttctcttaaactactcatccgatctacgatccgattacaccattgtgttcgtaacaattaaatatttataacaagatctcacatgattatattttgatgaaaaaacttgctctaatatggcatctcttcttccttttctcctgcaagcaaatggtgataacttttgtactcccgtgcccctatgaattgtatgaatagaaaaaatagaggaatagaaaaaatataagatttttaacataaatataagtgtaaaatagaggattacaaaacacaaaaaaatactaaatgatcgtttgattgaaccgtatgataaagaaaaaaaatgaggagagataaaaactcaaaggaaatatttcatgaggttctgcctcatgaaatatcctccgaaacttacctggaatgagacatttcataggatgtcatatgatttattcctagtaaaaaaataaaatcctccaaaattcgggacatttaacttattgccacttttaagatgtggcaattaattatttatcactcgctgtctataacatgtggaccctcatgtgtctatgatatgtgggtccagtggcaaataatttagcaccgctcgtaagagtggcaaatagttaattattccccgaaattcctataatttttctttgaatcgaagggggcctaaaaggaaactttccttgagattttacctcgtgttaaatttctctcaaaacttacatggaaagaggcatcatagaaaattcataggattacatacagttattcctttgattcaatggttttatagaaaaaatttctataagaataaaatcctctaaaattttagcctaaaggtacgaagcactgtgcacatcaagtgcaggctgtgcacacaatttttccacaagtccttttcaagctaagaatcaatgtcaaactccacctgataaaactccaccaaaagcatcgggtacatccttgcttggaagcaagataatttcgtctttaaaaagaaggaagcaatcggatttcatattgaaaaaaaagaagcgacctaattaattctgatccactttttcgctggatctgaaactgaaacggatggttggaacctaatttcctctgcgcctaactcgtttttttttttatttttcctaccagttgaagcagcaagtgccaactccatcaggctacgtgtgatgtgagatggcatggcttaaaactacaggaaaatttgggtcctgaaaaaaaaatgtaatactaataatgaaaagggacgacaccaaatcatgccctggctgatcaattgattgaacgtgctacagatcattgtttcagtcttcatgacgccaatccattgttaatttatttattgatcaatatcctctcatataaaaagggacagtattcattgtacaacctagtttcgatgatgacaccatgtggcttccaatgatatggaactaacaaaaagaatgttggctttcatggcaaaataatgaccgaactgaacttgaggactgagcttaattacttgcaacttgactagttatatgaattagaatttcagtcatcaagtgcaactccctttgtaaatatttaacatgtaagacaaaaaatagaaaaaaaagttaaaactcttctcaaacgattagttaaaaaagaacatatatacacatttatcttaaaatactaggtgaaaccccgcgcattgctgcgggaatttagtatgataacaataaaaaaataacgtgtaagatagctagataacatcaaattaagtaaattaatgtggtttatgataattcaaatttaaatagtatgtagaatggtgattcaaacgtaaaaagtaaggtgttatgactttatggaagaagaaaagtagagagatagtttggaccgtagattaatcatctaaaggctaaaaacaattgatgtgatatgacttaattagaggaaaaaaggaaaaagataattcggaccatagattaatcatttaagcactaactaagtgaggatgaactatataagtatataggatatcataaaacataataaagatatacattgaaaaattatgtgaattatgttggatgataatttaatttaacatgtttgtatttgaaaagctcttaaattataaaaactataaatatatagcatgtttgcatgatgtttaaatatgatgattgttagtggatgatgatgtggcatcttgttaattagtggatgatgatgtggcatcttgttagtggatgataatgtgacatctttacatgttaagtttaaggagttagtgggggataactttacagtaaaataggattctatcaggataacataaatttatctcaataatcaacttatattttttttattaaccatcttggttggtttgtaattgttttctgtgtatttgagcgattctgattctttcgctgttagctcatacttaaggcctcatttgatttgcatgaaaattatagaagcatatagtagtagaaattatttgggccaatggtttgtatagatacatcagtattttgctaatttattgttaggggtaattttattttctttaatcatactgttaacaaccaaatttgatacctagattcgagatatgaaaacattgctaaaatttacaaaggaccgggtttcctttatgaagccagtctaaccgccgcctatgggctgatctgaccgatgatatgggtctagtttgactgtcggtatgtggccgatctgaccggctaagtctgaggccaagttgaattttgtcgggtctcaggttttcttgcttttgaaggtatttttcgagttataattggtctctaccccgagtttaacatggaggagatcctgtaggagacaagaccaacctcttttataaaggctatggacggttcaattggacacacaatctactttcaacacaattagccaattgaatcgttttttcaatatcacatctacttttgcctagttctagcgtagtttcattcatctttatcgatttacaccgtaaatcgtccgccttcgctacgagagtgcgaaatccttttgtagctttgtcccgtaaaccttgtttatccttgtttatccctgtccgcccacgaaactggtgtttatccttgtttcatctaaattggctttgctagccggtttagttttaaaaagccatcttgatttagtttttgttagattgaggtgattggcggctccatattatcgcaagacgtttaggtgttccgattatgattgtcaacttgccaaaaaagttaccaacacgtaacgtaagtcacccgtatagcagcgatggcgactcttcattctcacgtcgcctcctccatccgtcgctgccattgctgttgccatttgatctccctgtctagacgacccgagcgcccaatccctgcataggaaccatgactggcgtcttcgtatggcttaagtttggatttgcatgcttaagtagttttgccctgttggtccatcccaaattcgtgatggcttcatgttagggttgtggtcaatttcaggtagcacatctacaatttggttcatctctcaaacttgtttgcactcatgtgatctgttaatcttctaaatggttgaaaaaaaatgttatttctatcttagcccttgtctaaagtctgaacttgttttagaacaaatcatattgtttctaaggcttctgcatgggttttgctctagtatgacttaatttggcctttgttgatgattctatacctatatgtggcactataaattgcttcaccattaccgccatagattggcgttataaagggggcagtaattcaggattaacgtcttgttaagatggttgctgcaacactacttaatttcatgctcaaagtcagagataaatgagacgctaacttctttggaaagtacggcctaacttagggtttccaactgaactaagacatgtaaaatcactttacccctccaagtcagcatttctacgggtgattctatcctcctatgtttctatcagcattaattaaggtagtagtataaatggatctgaaactttcgataagaaatgatcaacggcttagatttaacttataataccagtagagagcaccgtagcaggcttttgaaataaataattgaatcctatctatttatttaaatatttatggaatgtataatcctataaaaattttgagagaaaattagcaagagcttagatctctttaaaaaaaatcttttgagtatctcttaaaaaaatttctttgcgtccatttctctctatcatattctgtatttttttatgtgggctaatcaaacaattatttctgtaatttttttcgtggtttgtaattcattgttttacacattctatgtttttttatatatttgtttttaatcttgtgtttggaaggagctgcccttgaaggaaattccggtgatcccagtagtgcgagcatagcggatttcccaggttgcaacgggtcaacggcaccacaaagtggacactggacagtgacacagtggagatctgtcagcatacgtgcataaccattactacgtccattctgtacggtgatcgatcgagaatgtacagtacaccggacagcgagccacatgatcgagcagatgtagcgtacaatccacgtaccgtcatatccggctccaggtcccctgggcctccgttacagttggcgatcaaaggaagttttccacttaaaaaagaaaagaaaaggaaagaaaacgatcagacaaggaatcactcatcggcaaccaaaaccagacgcaaacgccaaccccggccacaacgaacgagcgagcgagacagctgctatcttcgtcaatctcgtcatacgcctggtgagtgcgcgtcgttgccgtttttgccccccaaaatccgcacgcaagcaagcaaagcaaagcaaagctagcgtgcgtgacgtcggggctcggctgaacggccaccacgagcacgagcgaaggtggcaaggcaagagagcacgatcgcgtgggcaacttggccgcgccggcgccgtagccgcaggacgcatgattggtttgcgcgtttcgttcctcctcgtcaagccaggctgtggccgcgccgtaggttggcgaggccgcgagatccaccggggctcgtgtcgtcctggcgtggttggttggggggttccggtgccggtttgtgacccaccgacagggacgcgttgccgatccaatggcatatcccccgcccccggtgcggttttagggaccactcggatgctatactaaatttgtcaccattcaccatacttttatgccacacttatcaccttagctactaaaataggattatgccacactctattgagttgatgacatgtggggccataatagatgggtagaaatcttaccacaaatatggctatgaaccaaacaatatgctaacttggtcaaacttgcataacatgaggtgtggtaatctttgtcaaacttagggagcaaaccaaacaaccccttagaccggtctaccatctcatgtatagtacgacgatcaaccgggccgggtcggtctgtctgcttcgcacatgtaaggagcgtgctactccatccgtcctagaactggatgtgacacattctactataacaaatcttgacatatgtatattcaaattcatagtactaggaattgtcacatctaggactaggttgattttttatgcgacggacagagtactagtatagtacataaaatgggccatgattgattgaaacacggtacaaacataggcgttcacgatacgtgtacgctcacctctataaacgtatatacgtacaccctatctctgcgggtagttgtagtatgcaactgttacatttactttgctaggccaaatgatgaagcaaggtatatatgttctgaaatgaacaaaagcacgtgtgttagatgctcgagggagagcggtcaaaggtatcaacgcgagattaaaagccaaaatttttggcgccggacaaattcattttgtaaatgcagttaacgtttctcaaatttggtgaatacctctgtattaacattcgtccgagtctactgaagcatatcactaatttacgactcaatgttaaacctcgtaatagctactaaatctgtagaggctgctggagggattgtcgacaggtcaggcaatgtgcacatctcaaaaggtccttggtgcagtcatcgttgtatttgccctggttccccatgatttcatcctccagtaatgtgttatcaaaattgcatgtttgtgttctttatatatctttaattacatcaagatcaatcctaatgagatgtgtaccggggaatttcgattcctcctatatatacattgtgctcaacctttaatattcttgaaaataagttccactatcctttagaatttttcacacttcatgttttatccattgcttatgtattctttgtggtagaatgaaagtactcaagatcgtggtgtttttttgtacttgatagtaaaatagaagggatttcccatactacttaatttaaaaatttactgctaagagatgagtggacagagtagaaaagtcactcatttttcatgtgtacgtgtttgaagcctttaggcccccggtgttaattttggtaattaatgacaagcactaattgtggactaaccgttgtctttgagctatacattttaagttaggtccacgtcatatgtgcgcatggatgattatcgatggattaaaattgacggcgcaaagcaaaggggaagaagacggtaaaactagcgctttaatttagaattgatcgaggtgtagggcgatcaaatttgctagtttaattttagtttcgccgtactattaagaggggtaatgacctagcaaagagatgattttaattgccacattaggtcattgcattttcatttgtgctctctttttcattacacacatattcacttgcaaattcactgggttcggcctgaccaggggcggtcagaccggccacatagtggcggtctgaccggcgtgccctgcccggtcagaccggctacatagtggcggtctgaccggcggcactttcccggtcagaccggccccctagaggccgagatggtgctgctcgggatggccgatacagagccgatggagccgtattcggtcagactgagccgaggccggtctgaccggccaccccatgccggtctgaccggccaggccgatggggccctctgacagggctacaacggctagttttctagccgttgcaaagtagcacggtctgatcggccacatacctccggttagaccggcagagcacagagttgggggatttcgcccccaacggctagttttggtgggtgggagtataaatactcccccaccagcagcaagggggctctcttggcacccaattcaattgcatacaccccttgcacctctctcacactcacttgagctttgtgttcatccatctagtgtgttagagagttgtttagccaagagtcaagtgcatttgtttccattgtagagctagtgtggcacttaatcatctccacaccgggtcattgcttgttactcttggaggttgccgcctcctagacggcttgtggaggagttgcccagtgacctctacgagaagattatggaggaggcccggcgccggtttgtgagtggtttggagttcaccaccttcggagtgaaggaagaactaccccgagtgattgaggcttgggtagtcctctccgtgggccggctcccaccttgcccaccccttgacgaagggggcgtgcggtggcttcgtggttgagcggtggagttgggctcgcctcaacggggagtaggaaaccggcgagtttctgaacctcggtgaaaaatctcttgtctcattgtctcatttgattgtcgcatttacatttgtgcaatttacatttctagagacacacttgagatcatatcaccctaggattgcaaaacattgacatatgagcgtgatttactttcctagagatataattgagccactatcaccctaggtttgcaaaacataacttagttgcttagttagagttcaccctcaccaagcccagcaaattaggttagatttgattaggtgttatttagttttaaatcgcctattcacccccccctctagtcgacatctcaatcctacagtgttccaaactactaaacggtaccatttgcaaaaaaattttataagaaacttcttttaaaaatcatattaatctaatttttcatacacaatcaatcatacactaatagtatatatatctcgttttacgtatcttctcgatcttctttttcccactcctatcaaacttagccttagggcctctttgattcgtatgaaaaatcatagaaatcttctaggattcaaatcctataggaaaatttcctatgaaagcattgtaaaatcaaaggtgtttttaattattattctgtgatgaacaattgggcattgaagattattggttttgttatttggaatttatttacgaagtggttttggagaagattggatttcacaggtgaatcacaggtttgttatttcatatgaccggtcagaccgggcagtgtgtgccggtcaaaccggcggtgatcgagcggtcggaccggccgacgctgagtcggtttcggtttcgggttgtttgtttggatatccgtgattatttcatgattatggcttctagatggatactatacgtatgtaatactgttgtttgctactaataagtcaagttggagatagcttggtctcggaatatggtttctttgtttatttcatgtgtaggtgactcgatgcctcaggagagtatttgcggtgatggaccgggagtcggcttggggataagatgacgtccgtagtggtcagagatcatgcgggatacttaggctagagttgatgcacgtggttgatggagatttcatatggcatacgatggaggtattgtgtgcgtatgggatgcggagtcgattttggaaggagtccaaatttggtacgattggttatgtaaagtttctttcttgtactagagagtttcctaaggtgtttaggactcttagtatgagtttggttcgtggttttaggctgcctacctcatgtataaatagagggggagcgtgaggcttcccagtattgcttttgagagcaatagagttgagttttgagttagggtttcaagtttagtcaaaatttttgtaaggagttctgttggtgcactttgtaaacacagagagaatcaataaagttgtcatccactttaagagttcttcgatttgtgtttcaccgggtttcggcgatctaaccagcaactcaccggcggtcagaccggcggcaagcggcggtcagaccggcggcggcttcaggcgcggcaggcgacatcggcggtcagaccggtggcatccacacggtcagaccggcagatcaatctcggtcagaccgatctctgtcgatttcaagggtaacttttatttccgctaaaagttttcggtttttgggtataccaaccattcacccccctctggttggcttagttattgtgattcgatcctacaattggtatcagaaccttgttttcttctttggatttttatcgatctagagtttttgccatggctactcttgctaggttttcaactaagcctcatgttttcgatggaacggatttttctcattggtgtagtaggatgcattcttacattatggctgaagattatgatatttggagaaaagtttctcatctttatgtgattgctgaagctattaatactgctgctgaaaaaactgcttttgaacaaaattgcaaagctcgcaacattcttttgagtggtatttctcgttctgattatgattgtgttgcgcactttcgaactgctcatgaaatttggaatgctttgagtaactttcatcaaggaacaaataacattaaagaacttcgatgtgatattttcaaaaaggagtacattaaatttgagatgaaacctgtagaagctttggatgactatctttctaggtttaataaaattttgagtgatactagatctgttgattctttttatgatactaattatccacaatctaagatttctcgtcactttttgaatggtcttgatatgtctatttgggagatgaaaggtacatctattcaggagtctgttttaacatgtctactttgactttggattcactttatacaaaattgaaaacacatgagatgaatgttctttctcgaaaagttgattctaagtcgagtgctttggtttcttcttcttcttctttggatgttgatgcttcttcatctaagccttcttttcttgttgtttttaatgccacatccgatgatcaactcgaacagatcgaggaggaggatttggctttggttgctaacagaattgctcgagctatgaataatgccaggaacaggaaaagaggtggtccaaatcgttactttgaatgtggttcaattgatcatcttcgttcacattgttctaagcttagaagaggcaaaagagaagacaaagatggtgagaagaccaacaataacaagccaaagggttcatcccaaggaaggaagctagacaatctcaggaaggcttttcaacaagtttgcgccgccttcgagccactaagtgatgtagatggtgaaagtggagatgatgataagggaaagaacatcaccgatgtttgcttcatggcgcgtggtgaatctgacatagagtatgaagataatgaggctttggtggcaaggaaggagaatgtgtggatcgtggattccggttgttcgcggcacatgaccggtgataaaaattggttctcctcactcaaaaaggcatccaagactgaatcgattatctttggtgatgcttctacaagtgccgttcttgctacatgttttgttaaggtaaatgaaaaatttgaattgaagaatgtagctttggttgaggacttaaagtacaatttgctttcagtttcacaaattgttgatgaaaattttgagattcactttaagaaaactgcaagtaaagtttttgattcttgtggtgattctatattgaatatttctcgctatggaagagtgtttaaagctgattttgaaaatcatgtttcacctgtgataacatgtttggttgctaagtttgataaagatgtgatgttttggcatcgtagacttggacatgttggttttgatc

SEQ ID NO: 62832 - DNA, 1129 bp, Oryza sativa
accatcgctggaatacctaacgccacaaccatacggacgccccaatctaatgtttgcttaaatgctattgcacgttgttcttcatttaatgcttttttcttcgtaatacgtgaaagattaggcaatacgaccgtcgaaatggcaatcccaaataatcctaatggaaattcaattagacgatcagagtaataaagccaagtaattgatccggtcactaagaaactggcgatcacttggtttaatagtaagttaatctgagtgacggatacaccaaacaatgcgggaatcatcaaacggcgtacttttgtcacaccttcatctttccaagcccacttgggtttaaccaataacctttcttttatcataaacggaatttgaaataaaaattgcaataaaccgcctagaaaaattccccaagctaatgcaatatctggctgttcaaaataatctgcgccaaataatgccatgctgatcatagccacattgagtaatactggtgaaaatgccattacaccaaacttccctattgtatttaacacggctcctgaaagggcaatgaaagtgataaaccacaaataaggaaaagtaatcttaagtagcaatgacgcttgcgtaaatttttgtgcatctgggccatcattaaaccaatcaataaaccaaccggtcccaaataacgcagcaattattggtgaaatcaacatggcaactaaagtaaccaccgttactaaaagccctaaggttcttgaaactttcgcaataaattctcgagtcttatctaaatcattatcagcattatattctgctaacactggcacaaatgcttttgaaaaagcgccttcagcaaataatcgccgcaggaaattaggaatccgattagcaaatagaaaaacatcagacattgcccccgcacttaataagcttgcaataacaacatcacgtactaaccctaatatacgtgagataagcgtcatagtactgacaattatgctggattttaaaagtttcttactcataatttatgactaacagaaaaatagaggcaaagtgtaacaaatatttgcctgtaacagggaagaagttatagcgcgatttataattaatataataatcaataaccgcgatcatctag

SEQ ID NO: 62833 - DNA, 834 bp, Oryza sativa
gaatctcaaagtccataatttcagcatcagaaatcccgataatatgtttggcaagtgcgcgtaatgaattaccgtgggccgttactaaaacgcgtttgccagataataatgccggggcaatttgatcttcccaaaatggcagaacacgttctaaagtgacttttaaattctcgccatttggcacaacttctttgggtaggtgcgcataacggcgatcattatgggctgaatttggatctgatggtgctaatagtggtggtagggtatcataagaacggcgccaaatatgtacttgttcatcgccatatttttctgccgtggcttttttatctaagccttgtaattcaccataatgacgctcatttaaacgccaatgtttcacctgtggaatccataattgattagattcttctaatacaatattacacgttttgattgcacgagtcagtacggaagtgaatgcgatatcaaattcatatcccgcagctaagagtttttggcctgcggcttttgcttcttcaacgcctcgttcggttagattcacatcgcgccaaccagtaaataagtttttcgcattccattcactaaatccgtgacgaataaatactaattccataaacactcctttgtgttaatattgatttgaaaatggtacatttataacaaaaatcaatatactttgaaacagttatattatttctttttataaaagcaacagaaaagctgattttcctcaaagatttaattaaaatagtaagtttaataatagtttatggatgattggtgtaggtgatattcttgtgaaagtgtttttttctttttcttcaattgtgg

SEQ ID NO: 62834 - DNA, 1809 bp, Oryza sativa
ggtaataatcactaacgtattcattaataaattatgttgctgtaacgcgtaccaaatttgattaaattgtgcatcaacatgttcaagtggtgctagactattgtgagtccttggcatagcgagatccaagtaactgaaaaaaggtttagctaaacgttgattgagccaagcagtccatttttcaatcgcttgtgcattgccttttattttaggtaatgaaaaacccgcaaaaatactttgttggtaaataggtgcggcgaaactattatgagaaaataaaccaaattgataatttgcttgtttaaatgcggttaataatggtgaagtttgcttattagcgagcattgagtctaaatattgaccgcttaagctataaaatattcccaataagttagccgcgttagaatcgccactgccataatgattcataaagcggtatgttttttcacttatttgtgttaaatgaggcattttttccgccacaatcatttcatttgctaagccagacatatttactattaaaacattagtatatggtttgcggttaaaagttaaatgttgttttggataattgaggtagaaactatcaagccggccattttctgcaatgtttaactgtaatttcgtacgattgatcaccccgtgtttaaacaaggaaattccgagcggtcattgggtgtgataatggatagttggctttttgtgatgtaattgggcgatataagcgcatatctgcccaagcataaattaaatgtgttgcagtaaagcaagctacaaagaatagcgcgacaaatttaccccatttttgccggctaaaactacgtaatttctgccaacaccaacgagagtaaagcatttgtgctagcaagataatcggcataggcacaaataataattgccattgatgagagagctcactattatcatctggagtaactaataaatcccaaactaatggtgataaatgcaaataaaactgtttaaatacttcagtatcaaccaataaaacagtttgcccaatcgtggcgataataacggataaaccacgaaaggtgcgttcatttttaatgataaaagaaagtggaaataaaagaagtaggtaagcagcaaaaacaataaagctaaaatgcccaaataaactagtaaagaaatacagtttaccggacagtgtatttggccaatcagcgttaaacgcgtaacgagttgagatacataatgctaatactacattaaaaagtgtaaaccaatgtccccaggtgatgcgttgggatatttcttccttatattggcgagaataagtcggtagcaattgacgcaagggctaaacattattagcgcgcttttaaagaatttttaagtgcagtggaaaacgtatcagctaataccatacgttgagtttctgtttgaatattctctaataaaatattgctaactagattgcctaatgccatgattgaaagatcaacgggcgccttatgtttttcaagtattgtaattaaatcgtaagaaagttgttcgaattgcttactttgatattttgatcgtgtcgccataataacgatcagagttatgttaaaaacatgtattatatagtagcatacaacatgtcaataacagagtgataagagagtgataagtcctagtatttttaaatttttgtaaaagccataccagttgaataagttagtgctacaatactcaattaatttttatagatgaattaatcgattttattcttaataaagcattttgaaatcataaaataaaaaaaagaatagatggtaaaaaatagccgggcaatggactaaa

SEQ ID NO: 62835 - DNA, 55796 bp, Oryza sativa
tatatgaatgtgggaaatgctagaatgacttacattgtggaacggagggagtaattattaattttcaagtttggaactaaatgaatacgatataaaattgagggtccagaacacattcaacttcgtattattaattttaaatttccaatttctgtgaaaactataactaaaaacatccatggtattttcaatggcatgttttatttaatataaattcttattaagatcttcaatcatgataatatgacccatctaattattaatggcaaaatctttctagcatacaggatcatatatatgaggagacaaacataaatgcatgttatatcagcatgagtttgtctatgatgcatgttcatccattttagcttttatgagtgctccaagaatattaggtcttttgaccactccaactaaaaggaagccataggcaggacaccggcactccaatgcaatagacgtagacatatagtgatgactatattattctgcaaaggttttcactctttcatcaaattggatggatatgaagaattaagaaaaggaaaaagtacgaattaccccccctgaactatcgtggtcgaacgaattaccgccataaactcaaataccagatattttacaccctcaattattcataccggacgaatttaccccctaacactgttttaagttgttttgaccaggagtttgcacatgtggcatcaacgtgtcaatccagtccgcaaaaataataacaaaaaaaattgtagggcccacctgtcatctatttcttctctccctcaatctctcctctccccgtctgtttcccactctattcagctcggatgggcggcggccggacggaggaagcgggagaggtggggctcaggatgggggcggtggccagtggcggaggcaaagaggcggcactcgggatcggggcggcggtcggtggcggaggcagagctcgggatgagggtggcggctagtggcagaggcgggcggaggcagctagaggtgggactcgggatgggggtggaggcggtaggaggtgggatgggggcgggcggtggggctcgtgtccctctctttcctctcggttcaaccccctctcttcggcggttggaaaaggggcgacgaccggtggtggaggcgggtatcgggatgagagcggcggctggggtgaggctaggaacagggtggcttcgagctcgctatggaggcggcgaggtcaacggcgagctccatgacctaagctccgccgcccctactgtccccgccttgccgagccgagcaacgcgaggcgcgagtaagaagaggagcgagagggagattgaagaagaagaggtgtgaggacctccgccgccggctacccaagcgagctccgtccgcctccgtctgagcttctcgcgaaaggccaaaggggagaagaaggcatcagcgaccggatttgagggaagcggctcgctccgcctccgcctctaccgccagccacccaagctcctctcccctgctctctcatccttctctcctcgaggtatgaagacgccctcccatcatcgacaacagtggagcagcgccctcccagcgactccaccgcctccagcatcattctcggtgtactcctccgccaaccgcagacgccgccgccagtcggccgcccgagctctttcctcctccgcttccaccgccggccgcccgagttctctcccatctccaccgccagctgcccaagcaagctctacctttgctgtcggccgctcaagcgagagagagagagagagagagagcagggggattggggagggatttggttgagggagagggatggcaggtgggtctagagagtttttttattttctttgctgaccggattgccacgttggtgccacgtgtgcaagctcaagttaaaaaccgcttaaaacagtgctcaggggggttatttgttcggtttgcataattgggggtgaaggatgtctggttttatagttcaggggggtaattcgatcgaccacgatagttcggggggggggaggggtaattcgtaccttttccttaatgtgttcatgtgttttttccttgatgacaagatctattcatttagaagccaacaactacatcgactctagattgttactttgaatttcattgtttgtttactttctacgttgtctaaacctaacaaggatcagttcattataacatatgcttgcataacattagataagtcagatggaccattggatcttttcatcttaaccttgttgttcgcttgcaatgatcagtcaggtttcctacaatgttaaaacaaaatagttcaacacttgttcttgctatgttcaaaattatgaggtagaggctactgatcacagatataaacattactttgcgtcaatttcagtctattactcaagatgcacaagcatgtctaaacaaactctctttgtaccataattttcaaaatcaactggaacaaaaagcgagaggtgagagcatgcatagcttaggagagagggtggtaatggttgaagatctcatccatgcacgtccatccattttacctttggtggccgctccaagaaacttcgggcagcatgcaacacaccatgcttaccatctctatgcaataggtgtaggtagtagtcaacacaacttaatttggcagatactatatctacgatacggttcatctaccttgttctcacctgaatatgattgatgacatattttgtttttttttttgccaagcttttgaaagtctagtgacacactacacgcgtgacttggtcgatactaataataactgaggtacgcaatcatgcatatatatatatttcttggtttggaactaaaaacaagtggagtactagagacaagcctttagtggcctcatcatctatcgtttagtgattgaagtggtctctttatcactgtacataatggcagcaagcttaagcatatatatactctcgtaaccatggtgcccatgaaagaaaatggcttaaagaaagaatggaagaaaaatggctcctagatggctagccatttcaagcgaacaattgaacatacacaaagccagcacaacaaactttttaaatttcaagttttgtatgcatgacttccatattgtgttggacttatgagtgatcagtgcaacctgctcgtgtggaagcatctttattgaatgttgatccttaatgaagtttaggttcaatttagaacgaaaaacacttacgagttgtgtattcttaggttcattatgggactctatgcagataagtatttagggagtagacacatactcacatcacaaaatagtaagcacgttactagatgcatacacaccatcatactctagttatgtgaagcaagcaatcaaacgttcataaaccaaagtaatcaaggctcgaatttagatgtcatatgtgccattgggttgtattcttttcttaagggttcaaatttggaaacacgtacgttcaatgcatatgcgttgtttcgattttagttcaaattgcagggaaacaaaatgtgtgccaactgtcttcttggttgattatgttatgccactcttttcttggttgtgcatggacaactaagcaattacttaaatcaaactatatgtgtcatacttttgttgttatgtaattaatgagcaaatatattattttaattattcaattccaagcatcacacctataaatgtccattcttaattcaaaatccagactcataaataatgatggaagacactattactttaacgagtagaatgcactgctctatgtggaaaccttaggtgtaatcaataaatcactaaacaatactaacgcattgtttttttacacacaactaaactcccaattcatgttgaatagtccactaactttgtgtagaaaagtctaaaaatatagggaaataacaaaagtcaaatcccacatgaaagtaacgcatagagcaataaaactaaaacttgggtcaagcattgaagagggagccaaaaaaaaggggaaaccgcccactttccctcttcccaaagccaagcgaaccatgctatttaatccactacactatttgtgagccttttacaactatgctcccactccgctccactccactggttttttccattccctttgtccccttttcagatctccctttccctctccaagaaaagaaaccatcaaagaagacacaacgagataggggggagtggctactatcaatctccatgggcgcctatgaggccaccaaggtggtttttgcccggttgcaagcgcttgagcccaatcttgctccaaacatcattggcatgctcctcaccaaggataacaatgagatggacatgattcgtctcgcatgtggccctgacaacctcctccaatctatcattgccaaggtgcgcaccgacctcacaaacaagccttcccctcctatggcctcctggggcttcccgtccgatataggtgaggaagcatctttctccgttgacaaggtggggtgtgatggaggtgaagagttctcctctaaggagtatgattggaggttacccatcggtggcaatcaccatcggagctttttgtcaagcaccgtcgacacccttgggtggaagccatgtctatactcccaaaggttccatcttcaaccctataatatcacatttcttagatccacacactaatctctattgtaccagcggagtgaccacccatcttggtagcgacgacatgcaagagtactcttctcgaccacctcagatagaccaaagtgacctaaccaacaactgcagtgcacgacagatctacttgaccttcccgcctgattccatttttagcaaagaggacgtctgcaactactttaggtatcacatgttccaccatagtgcccctattgatgtgtcttgtttcaatattggagcatttcataatttaatgaatgcaatctgttttggcttgtttgtgtcatgtggggacaaccagcatgtatgggatggtgcaagatgtgcgtatcccataccaggagaagtgcatgtttggtttcgtcaccttcgcctaccaaaagacagtgaagctaattcttgccaagggcaacccacattacatctgtgatgcacgtgttcttgtcaagccatacaaggagaaggacaaggtccccaacaagttcaggcatgttaatcattgcctaattccacttcgtatttttgcacatatattaccttttgtgagtacttctattgattttcttaaaaattgcataaagtctattgattttattaaaattgcagaaagtttcagcaaagtgactcttctagctacatgaatcacaatagattgctttattctagggggccctttgacctgcgacgacaccaaataggtgaacagtgatatctatgtggtgcttgtgttttgatctcttttttttaacaatttacaaggagtgttacattgtgttagggccgagaattttgtatagggacattgctagtcatgaggcatcttttaggatgaagcaagatgaacaacaacatgcgaccgagctgcaacgctgttgcttaatgaggcttccgcttctcaatcttcaggattggggccatcatctcagctctcccatgggttcacatgtgcttctaggacaagttgataacaaatataatattaatgagaatgacaatcccactcatttggaggatgtcacatttcgaggtctagttcttggtcgttgtaatgtcttgtctattaattatgttttttcggaaagtttattaattatgttgtactaaggttgtgacttcttgttttatttatagacaataagctgaagaatgagtttgctatgagggaaattgcctctactgcaatctccacagcagccaagcgcacggtcatctctacggaagaggggaagagagaatatggtcccaaggcagcaacacctaatgatgcttgtggattcctggaaaggtaagatgatgatagaaaaaggtttgctagatggacactaaaacgtaggatatttattttggaaaaaggacagaatataccattaaacttgttacctcttttatttgctatatttttccttttttttcacatgtatgttatataattctctctgacttaaacaattcttgctttagaagcaaatacaaaagaagataaggagtagacaattaataatgttgatcaaatgtttttcttgattagaaggaaccaatgggaaaagaaatgcaaaggcgaggataggataaagcagttaagaaactaattagcacaataaatgcctattattaagtagtttttgtgcaagtcatgctagttgccgaaggactttctggtattgatatgtttgttgatgtttgtttttctggtattgacatgtttgttgatgtttgttttgtagtggaatggagtacaatttgcctcatagccccttctcatctcccaccaaggcttccaatgttgcagcaacagctcacactagtaacatcagcagcagtagtagccctcataaggtggcctcatctctattccccccaacatgcacccttgagctgccccctacaactcatgcttccttcaagcgccaaggtaaaatcccaaaccaaatctcttccctaaatcactgtacatttgcaattccatgttagcatgtaattccatgttgcatttgcaattactgcagttatataagatagactattttgttgtatgtcttcagattctccccttgctgaggagtagttggtctatgagactacacatagtaaaggagagggggcttcatctttgctgagtaagtatcagtaattccaacctttttggagtgaaacaggaatcaactagtcaatattatgtactatatataatctgcctcctgtcaagtcttgatgatcgtgttattggtttctttgtgttgtgtacagggaaagcattaacagatcatacataacgagaggaatgccgacaaagaaaggaaataaatttagcttgttttagctctagttcttgggtatatggtattactatagtaccagtcttttagctcagtgtcaagacaaagtatcaacttgtatgctcttttaaagtatgagtcaatataataaaaatatatcgtagctcatgtagtagtaacaaatactagcagtctagcagtgtgaagtggaactgctacatatacaaacattgaagagagcagtatatcagcatctgctactaaccaactgcttctatttagataaaaatgcttcgcgaattgcttgatacctgggccgtagcttgtccagaggcagcagatgttccttcacgagtggcaagcccagaaaaccctccatccatgcagacagccaagggaacttgtcgctggtgatcagcctgacaccggtgatgtcctcatatatcggaatcacatacgacagggagcccagagacaagtcgacgaacccgatcctctctccaccaaagaatttcttctcatcgagcaccttttccagaaccagcagctgctccatggcagcttcgtatgcatcctcctgctccttgccttgtgtggtgaaccacttccaaattggaggtgacagctgcaattgtggataaatgattacttaaaagtttagacttgagaaaataaacaaaaaaaattgctgaccttgtccagcccaaatttggaccagaaacgtgccatggcacattcatagggatcttcaggcaagatacggtatctcaaatccttccagacatcatcgatgaactccagtatgacgtctgattcagcaatcggcttgccttgatagatcagcacggggaccttcttatgcacggggttgcactccagaagcaagttgctcttgttcctcagatcctcctcgatgtagtcatactccacgcctttgatccttagtgcccacatcactttgacaccttaagggcttgaccatatgcctaacagcttcaccttctcagctccatcttctagttcttggtgatccatggttgggactgcagagcaatgttgtgagtgagggtttcagtttgaacaatttggtactagataccttcactggtagtttggtactagtggttttcttgtggaggagatctgattagtttcagagtgtagcaatcagtcaactttggtggcttgacttactctgtctgcatcctgtttagttccattccatcaaaacctgaataagacaataggtgtaaattccatcacaaccttcagatatttatttagaaatctagaatgaataaacttcagttctttacagggagcagtgatatagtgcacttcgaagtggatgttcagttcagttcgttgctttccccacatgaatatgatgtcgtcaatccaaccatctagttgagatttccaacctttcaatcgatcaaagctccactcaattactagtacatctcaacaaattggatttatggaccaagaacattacataaaaagtcatatacatgaatgctccagcgaaatgctaaattcccatgtgcacagtaataatgcctaataaaattacacactacaccgaacaagaggttactactcgtgtgcgctgatgcgaggcagattagctgcaagtaagcacaggcacagctgcgaaattaatttatgcaagctaatcgattggtttggttttctactaattacctcgagcgagctcgaggtggaagatgtcgtcgtcgcgcgggcgcgtgcttgcccacgctggcggcctagctccctggactccttcggttgagcgcagcgtcgcctcccttcccccagtcgtgcgccgccgccgccgtctccgcaaccaccaccaggcgccggcgccgatgccgatggatatcttgggccaatcaatcccgaccatcgcctccctctttgggcttactttacatgggctttgtgatgggcctggcccacaaaattacccccatcactatcagtctctccttccccttcctcacacgaatcgaatcggactcgggagcccttccgccgccgccgccgccccgatgttgggacacctccggcgatcctcccaacgactgcccgtagccaacctcgccgtatactcgtaagagctatcctttgcccaaaccactttctcttttttataccccctctttctccttccaactcaagtcacccttgctactactggactgctgcttgattgcttgtgttcttgcgccatttaccaacccagataatgtcaggatgcagccttgttttgactgtaggcacaccccaagtcggctcaacattctattcgttttagtgttgtgcactagcagtgagcaatatttagtcttttgtttttaattttgtctttccatgtaattcttgaagctgtgtgaagactttaagcaaccaacctactgattggagattgctagcactagtttaaaagtgtatgatagataacaaaacttgttattgatccaacatgcattcttaaatcaggagcttttagcgttgttgttcttgttactgagagtagtttttaacgaggttgcttcttgctagtcaaaagtgactaatgttacttatgttactgttctctacattgtgcaggatccagagttcacatattgaggtactctcctttgtcctttccttcaccacaacattttacaccccttttacaaattcaccgttccattcatgcccctgcttttagttcatagccggctggtgtagaaaccattctaccaggaatttctctgtagatacaagtaataaagtttccaacgatcgggggtatcaatcaagggagttgaaaccaagccttgtgaaggtacgtacacaaagcttaaactgtatacttatctttgtgtgtctttcatttttcaagccacaaggtttgaaccttaaagttgttcccttagtatcttagactagtgtgccaaattagtgtagttacctattccagtcatacttataggaggattatctatttcttcacagttaatctatatccctgttaccatggcactgtcccttgtttatgtttccggttactccccgaaggcttaagattcaacccatttcatttttctaatccaaccagtttcactaaattttctgttgtaggatggttttgtttttgcctgtgttgtgactcttatcttttgagactgctggatgtttaccttcacagtcctagagttatagaagattggtgattgattattaaagaaattggctttgcattgcaggatgatgttgcaatcatcaaacacatacaaaacagtacaaaggaattgaaacaagggccagttgggaaaaatctatcatcggcagagaaaaggaaatttcttgtcaacactgtatgcacagctagttttcgtattgtctagtttactatttgacagcatgaagtctctatgataattaggttttgtttataatcggcagagaaaaggaaatatcttgtcaacactgtatgcacagctagttttcgtattgtctagtttactatttgacagcatgaagtctctatgataattaggttttgtttataattgcttcctggtagagaccaatcaataatttttataacttgtagctgcttgacctggaagattcaaaagaaggtgtttacagcactctggatgcttgggttgcctttgaacaggagtttcctgtggcctcgttaaagcaagcacttgtagctcttgaaaaggaggaacagtggcatagaatcgtccaggttttggatattataatttacttgattttaattgtgttttatcgtttgtaaacccaaaattaaataattggctaactacatggttaggtgataaaatggatgctgagtaaaggacaagggaagactatcagaacatatgagcaattagtgtgtgcgcttgagaaggacaacagagcagatgaagcttgcagaatctgggagttgaagatagcccatgatctacaatcagttccatggcggttttgccgtcttatgttgggtatttactacagaaataataggctagatacgcttgtcaaggtatggatcttaagtctttgtccatcaagtactgtttttcttatattttaagctaatgatcctcagtagaagttgatgggtcttgagtgatcaatgatgccgcttagtctcttacagattctatattatgataaaacccacttatgtgtatttcatttccctgtttttgcttatgatttcagctcttcaagaatcttgaagcatgtggtcgtaaacctccaagcaaagatattgtacggaaagttgaagacacatatgaaatgcttggtctagtagaggagaaaaaggaattgcttgagaaatacaaggaattgtttgacaagccatcaagtaatgatagaaagaaagggcggcagttcaaaaaggctgagaagaacacgaaaaccggctagacatgtagtgatgcctgcacctctaaaatctacagcatcgagcttccaggatggcataagcttagagcttcacagtgcaggttggaaacatctgaatatctgccagtctcttgcccttgagtttcacaatgcaagtatgtatcccccggaaaaaaaaaatagagtatgtacggtagtacagttgttggaatataaagctgtgatcattgtttcctacaactgtcgcttcaagcattgttgtcattccttttgcctccgtccagatttgtttctgacagtgtatccatactcagatcagagcctgatgtgatgcagcaagcaatggtatttgctatgccctctgaatgttaatacatcccgtattttttaactgatgcttccaacaaaacactgctctgaatgttaatacatcccgtgttttttaactgatgcttccaacaaaacactgctcgtgttcaatccttggcacatttgttattccgtcttcctctgtccagatgtgttactgagcgagcatccagaattacatgagaacctgatgtgatgaagcgagcaaattgttggtatttggcgtgccgtctgaacatgttctcttgttatttgatgcaaccattggcacatcggttaatgggccaacccaagaaatatatatactactccctactccctccgtttcaaaatgtttgacactgttgactttatagtacgtgtttgaccattcatcttattcatatcatttgatttattgttaaatatactttgatgtacacatatagttttacatatttcacaatttttttaataagacgaacagtcaaatatgtgctaaaaagtcaatggtgtcaaacattttgaaacggagggagtagctcgctgagccagccgattgatctgtcaatctctatgacaggattagttgagatggaatcgtattcgctgttgtctcctatttcctttgtgtacaagttgtgcaatctacggtgtatataatccgattcaggaggtgtgcggctaatataatccgatacgatttcgaattcacgacccaagagtttgtatataatcggatcgaggtgtgtacatctgatttgtgttgaagatccaagagtagctagcaacctgatccagaggaagacgaagaacatggcgatgacggaggaggagatgccggcggcgaagaagatgaagatgacaaaggaggaggtgttgctggcgtatctgtcgcgcgaggaggaggatgggaagaagaggaagaaggtggtgaggaggctggggaaggaggaggtggagaggctgctgtcggtgacggtgacggtgaccgtgccgaccctcagcgaggaggcgatggaggaggacgatgaggacgacgaggaggatgtgcgggagagggagatgctgctccgagccgaccggacgctgagggaggccgtcatgagcatgcgcaaggaccaggacctcatccgctccctgttcgaggccaagggctacgtcgacgtcctggacgaggtctccgacgacgacgacgacatggagatggagccgttgtaacataacttcacctgtaatctgaaatataccggaataaaacacataccagctatttcttttgattacggatttaatttttaagtagttaatatgatattgatttactagaccgtcatatcagtgtcacgtaggacgatggagccatcatgtaaactgctaagggattcgatttacactagttttaatagtcgatggatactcttctgtggttgagggatgaaaatgaaagttaagtttttcctaacgcaaacagcgctgattttttttatgtaagcacatgcatacaacctagtaatcctatctttctataaagttaaggccctctacatcctaaagctcaacatgcaaagatgctacgtcatccgctaacatttactacatctcaaatctcatgcaagcatgctaatttattaagttttagagctttaaaatgcaagcatgttaattaaattatcatcccacataattcacataatatttcaatatatctctccatcactttttataatatcctatatgcctatatagttcatctcacttaaattttagagctttaaaaaattcaagcatgttaaatcatcattccacataattctcaaaatatttcaatatctctctccaagtctccatcattttgtataatatctatgtacctatgcatgttatttctctcttctgtcattaagctatatcatctcaattgtttttagccctcaaatgattaatctatggttggaattatctctcttattttcttctctcataaaaccacatcatattacttttaaaattaggtcattattctatataccatttaaattatgataaaccatatcaacttatgcaagtttctatcatctaactatattacacattatttatatttcttaacatcataccaaactcccacagcaacacgcggggtttcacctagttacaaaaatgagcatgcaacaaccacatatataggcaagacgctcaatgaagcacggtgcatccattgatccagttgatcaacaaactattggcccgctgaaaacgttagcgcaacgaaccgcgtccaattggttaattagatgcatcattacgcgagcaaacatgtttaagcatggtttgattgtgttgttttcgttttacaacttattgtagcatatgtatttcttacattattttctaaaacagaaaacattatttcttaatgtaaacgaaaacattatttcttaatgtaatccgagtattgctattggctgaaagagaaaaggagaattaatactatcaggctgctcgcactttaaaaaccacaaaacaccccgcaaaaaaaccgcaaaacaaatagctcatgaacttttgttagaaccggatattgacagtggtcacgtgggtaggttggttagaattagaattccaaacaatacgtgctgtaattactgggctgcgcgcatgtgtcagcgagacacggaccggtttgcaggaggacccaggccgagtccgagtccgatccattcgtggtgggctggaccgagtcggaggccgggatgcgaaaggcattaaaggcggaggcggtgtcgaactcgaacccaaggcccaagatacaaagaagaagaagagagcgagaggagaagtaaacccaatatgtagctccaaggatggcgtgtaggatcgaatcacaagaattaaaccaactagatgggggtgaatggttggtatacccaaaaaccaaaaacttttagcggaaataaaagttaccctcgaaatcgacggaagtcggtctgaccgcccgtatgtcgccggtctgaccgccgcttgccgccggtctaaccgctgaaacccggtaaacacaaatcgaagaacttttaaagtggatgacgactttattgattctctctatgtttacaacgtgcaccaacagcactccttacaaaaatttcgactaaacttgaaaccctaactcaaaactcaactcaattgctctcaaaagcgataccgggaagcctcacgctccccctctatttatacatgaggtaggcagcctaaagccacgaaccaaactcatactaagaggcctaaacaacttaggaaaccctctagtacaagaaagaaactttacataaccaatcgtaccaaatttgaactccttccaaattcgactccgtatcccatacgcacataataactccatcgtatgccatatgaaatctccatcaaccacgtgcatcaactctagcctaagtatcccgcatgatctctgatcaccacggacgtcgtcttatctccaagccgactccctatcaatcaccgcaaatactctcccgaggcatcgagtcacctacacatgaaataaataaaaaaaccatattctgagaccaagttatctccaacttgactcattagtagcagacaacagtattacatacgtatagtattcatcgagaagtcataatcatgaaataatcacggatatccaaacaaacaacccgaaaccgaaaccgacacagtgtcggccggtcagaccgtgggctggccggtccgaccgctcgatcaccgccggtctgaccggcatacacagcccggtctgaccggtcacatgaaataataaaatcctgcgattacctgtgaatccaatcatctccaaaaccacttcgtgaataaattccaaataacaaaaccaataatctccaatgtctaattgttcatcacagaataataatcaaaaatacctttgattttatatggcgatgatgagggggtgcgccgatggggagaagcggcggccccatttcgagctggtgtcggcggcgaagaagaagaagacgacgacgacagaggatgatcatgaggaggtgttgctggcgtatcggccgcgcgagaaggaggacgggaagaagaggaagaaggtggtgaggaggctggggaaggaggaggtggagaggctgctgtcgttgaagctggccgtgccgaccctcagcgaggaggtggtgatgcctatgcctgacgacgacgaggatgatgtgtggcagaaggaggtgctgctccgagccaaccggttgctgagggagagcgccatcaggatgcgcaagaaccaggagcttatccgctccctcttcgaggccaagggctatgtcgacgtagaggatgaggtctccgacaacgagatggacatggacatgcagcttgtctaacataacttcacttcacctgtaataatctgaaatatatatatactgcaatctggaatacatacgggaaagttctcttaattgttgtgttgggccctctagtgcaataagaatcatgatgtggtcgacttttgtacccatgaaggctcttgaagatgcaagtttctgctttcgaaaccccgaaagatgacgatcaaacactatatgtaccgtgcatgtctgcccgggaccgggaggctaaagtgtgtaaactactcctagctagctagctagacgcgtttaactggagttccttgaaatatcatctctgatttaatttgttcgtacagagaattgccaaattcttaaccaagtgatctgctcatttctcactgccaattgatctgctttgcaagtttgagttttcttaggtgtgatgtgtgaagaggatctgcttgctgtatacagttttttttctctttttcacggagagttaataggtcccttaaaggcggaagaggatcctctcatttacttccctatgacttttaagtggcacaagttagtggaaagtaagttagagaatcttaatcccttaacagccatgacctcgaaagagaccattaattaattgagttccactacgatactctctactagtattacggtactctctactggtattacgaagcaatctaaaccgtttgtcccatttgattaaagggttcagatttatttataatatcaccttaggtaatggtaaaccggtagtagaaacgtgaaggagcattattataaaaaaaaacggagagatgcaatcgtcattttagcagtgactaaatcttttttttcttctttagctttttttatgaatatgggcaatgccaatgtaatggatggccatatatcaatctagacgggaaaaaacatatgacaaagctatccctaattattatattaataaattattgatttacccttaataataaggcaaaattggttatatgcctaataatattgatagtattataccactaggagagagtataggagcgctctaattaattatcatgttccatgtagtacgtcaatacaattagctagactggtagagaattactacagttgtttcaattcagtaacacgtacttgaggacagcacaaattaattaatttcgatcgctgcagttcactgttgaaaagttaagaatgtactgaccatggccatgagcagaacaaataatagtctctttggcctaacaattactaccaatctctaatctctcttttagtactactagtagcacagtctacacagaggaagtgagattcagaagagcaggagtaaatgtactaagtatttactccatccatccatccgtcccaaaatataagacttataattaattttcttacatagtcttatataatatactttaaccattaatacatttcatgttaggtttctgacaaatatgaaattagcctcgtatgaaaaatcttcaaaatataaatatagtgatataacgtacatatataatacttaacataaataaatatagcctaattttattttttttaagaaaagggagcgctctgtaatttgggaggagtatttatttagacaaaggaggaagtagtacatcacatcaattaagcaatagagcagggagataaaatagttagtatgtttgattaacaatggggaataaattcatttgaggtctcttaattttacacttaatccgattttcatccttgaacttcaaaaccagatataaccagtccttgaactttcaaaaccggtgcaaacgagatccctcggtggttttggcttacgtggctggtttaactaggtcttcgtcccacgtggtattgatgtagtgcttacgtgccaattccatcctagaaaagtaataaaaaccgtggtcccacatatcaattaaacacaaaaattaataaaaaaaaatggtggaacccacgtggatcctacatgttattctctctccctcttcttcctcatcctcactcctcttttcttcccagccatggaactagctcaccttcctccccattctcgcgtgcccgcggcgggcggcccgacaacatgaaggttgtggccgtcctcgggtgcttctcctcgcgctgtggcaccgcctcacggtcgtcgccgctgccgttgtcgtcgtccccccagtccccgccgccactgaggacgacgacgacgccgccgctgataacgacgcggggtcatctgggatgacgcagccacatggaccagcacgaagttaacgaggtctccatctcctccctttggacgcatggcaacaagaggagaggggagaggggagaaggaggcgtcgtcgtccttgggctggcctccgattgctcagcgtcgtccgcgccgccaacgttgttgtcgttgtcctcagccgccttgcctctcgcctgtgctccgcctgccgcccgccctagcctttgcctgctctggccctcttcttgcaggagagagaaaggggatagggagagaacaccgcggcgcgggcctgggcgctggaggtgcacgcgctgtggaaaggacctgacgtgacgctgtgggtggcgccggccgttgcggccgccccgcctcctccctcccttccctaaccccacacactgtcctcctcgcctcatccctctccggccgccgctcgccctaccctgcccgatccgccccgcccatagcccgctccagccaccgctcgcccatgctctgccagccggccacaagcagggggagaaagaggatagagagatactaagagagagagacgaggggagagggaagaagggaggtgtaacaccctgaaaattcgaccgacaaaattaaaactctaaaaatgcgggctttcaaaaactttttaaaccaattgcatcatgccgactttattcgcctgtttcattggattttgatgtcggagtctattaatcgcgaataatgaataactagctaggaacaaaccataaaagaaaatctagttgactaaataaataattaaaatataaattaaaataaaggttaggtgggtttggaaataaataaaatattatcgcaaccagattagcaataattaaattttagtacgatggaataaccctaattaaaataaactatataaacagaatatgagtgatattaaattaaggaggattttagttaggataacacaaatgtgggatgtacttcatttatacaagatttagaaattatgaaatcaaatttactttgaaaataacctaaaatcgggaataataggaaagtgcactattcattgcccgcaaggtgttcgatgtggtccctagcctttccccttctctcccacctctcccctagcccagccccctcctctgccccgcgcgccgcgcgcccggccgccccgagccccgtgccgtcgcatcgccgtcgcgtcgcccgttgccaccgcgtcgccgtcccatcgcgccgcgcaccgactcgtcgccactgccgagccgtcgccgtcgtcgcctcgcaccccgtgccacgccgctcccccgagccccgtgccgccgctgttaccgcgccgcgccgcccgttccatcgccgcgcgccgtcaccatccggtcgtcgcgtcgcctcgcgcctcgcgcccgcgcgccgctcgcccgttccatcaccgcgacgcgagcctgccgcctcgcgccccgcgccgctgctgtgagccgtcaccgcgcgtcgacgtcgctgcgcgaccgtcccatcgctgcgcgcgtcccatcgtcgctccgagccgcgcgccgccgctgccgagccgttcccatcgccgtcccctcgcctctgccgcgccgcaccaatgtcgccgtcgccaccgccgcaggtcgccgtcgtctcgcgcctcgtgccgcccgccgtcgcgtcgccgcaaccgtcgcgtcgcctcgcgccgcgtgcccccacctcgcgccccgtatcgccgtcgcgtctctcttctcccttcccccccccccccttagctcttcccctcccctatataagcctcactatttccccctcttcccctccatctccacccctctcctctacccacactaccgcgccgccgcctccacgccgccgcgccaccgcaccgccgttatcgcaccgccgccatcgtgccgccgcgccgccgccctcgtgctgtcgtgccgccgcgttcatgcccccgtgccgccgccccagtgtgccgcaccgtgcgccgtcgtcgccgccgccgccgtcgccgtcgccgccgtcggtgagccgctgccccccccccctctttcttttgtcgccgagccgagagagaaagagagaggccgagggaggaaaaggagaggaaggaaggaggaagccgggagggaggaaagaaaggaaaaagagaaaaagagaaaagagaaaagaaaagaaaaaggaggaggaaagaaaagaaaaggaaaagagagaaaagagaaaaaggaaaagaaaatttaagagatttagaatatttaacatattagaaattaattataggattaataagaatatcgttagatgaactcctactatttaaaataccaaaagtactaagatttgattatagaattaattatttacgaattaaaacaattagatgaatcttaatagattattatagattatttttagtaatgtctataggagatcaattcgcggtaataatttagatcaattcgcggtaattattatagattattttgggtaatccctataagtaatcgattcatggtagaaattcggatgtaatcgctaggaattttagacgtatattatattaatcgtttagtcatagactaaattaaattgtataatatttctaggatttcgtccaatatttaactcgtaatagaaatttctaacctattatatacaatgctcggggaaagtaaattattgacaacgaaataattatacccgcaaagtagtttaaatcgaaattgggtttgccgtagtttgcagatagtaaagttaataaaaaggaatcgactttcgcattcgactttcatttggatttatttggatttttatttgaattctaaccgaattcaaatcaatttttgcacgtaactatagagcccgagggagttgcggatccaagcgaaggccaagacccgcaagactttgagcaaggcaagtcatcactattccttgaacatgttgatcccaattgcgaaattgttttgtttacaaatagaattgcatgcaatgatgaacatcccacttgtgattatgccatgccttgattattgtttacccttaaatctttgtaaccatgtttacgtatgagtccctagtcaactatgacaattgcttagaaatgctattctagaattatgcatactcatatttatcaaatgctatatgcttgggcaattacctttgggaaggtaattgagatgcggcatgtggagacatgagcgccacattgccatgatgttgatgacatgatttgtgaaaggaaaaaataaaattaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggagacagtatccctgcatagatggttcacccctgagtgaggcaggtgcgctacgatgggacagccgttgaggtagggccaagaggcgtgccctacatcggtgtcgccattggtaggactgccatgagtgtgtgagagagagaacttaacttgaaccataatttaatatgtgtgtgagacttccctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtacgggtaaagtgtacatccactgcagtgtgagtaaaccaaatctattcgaatagccgtgctcgcggttattgagcaccgggacatgtattacacttggctagactctaaattcttaacttgtgtgggatgggatattgcatggtgatttttatgctgatggagccacttcctgagaggagggaaggtggacgtcctcagaaaaccatgacgactcaatggcgggaagctatccttgggatcacaatggatggtggacagaaccgtcgttgtttaatgtgaacactggaactaaaatttgatcagtctatgataggtcttaggcttgtgaaaatatttgcaaaacgcagctttatgcaaaagaacctaaaaccattccttgaataccctctatcatatgcattgttgttgtggtggcttgctgagtacggttggtactcacccttgctatttatatatcttttaggagagtgttgaagagaagcccttgtcggtacgcttgcgtatcccacaagatgatcggagtgcggtcttgttctaggtctcgttccccagtcgactgcctgtggcatgttaaccgggcccttatattattttgtcttccgctgttgttctctgatagttgttggcctacctggccctaatgtaagtgtttaactcttttagcctaaattcattcgtgatatgttgtgatccaactatgtatgtgtgtaccaactactgatccagggattggtacggataaacacagaagatttccgattttcaaaatcgggggtctacaggaggatagaggctgacatgtgggtccacggtttttattatttttccaggatcgaatgccatgtaagtgccacgtcaatgtcacgtgggacaaagacctagttaaaggagccacatatgcgccacgtcagcccaaactgcctggggatctcgtttgcaccggttttgacagttcagggacctggttgtatctgatttttgggttgaagaacgaaaaatcggattcggtgtaaagttaagggacctcaaatgaacttatttccaacaaatggtgagggtgtgggattgcagaagtagaagtaggaagatccatccgggtatggtctagtgggctggacttgtccgagtcagattacatccgagttagaggattccaaaaattaagcccagcccagaggtggtgatagagtcgagtcgaaccaaccaaaagaaagaagaagaagcaaagccccaaaatcgctagcaatggagatggagttagatggggagagtacatgcgctgctccatgcgagaagaagcggctgattaattccaagctatttcgagtggggtacggtctcagcgacgaagaagatgaagacggatgaggtgttgctgccttgctggcctatacattgctcggcgaagggaagaagaagaagaagaagaagaagaagaagaagaagaagaaggtggtgaagaggctggggaaggaggaggtggagaggctgctttcgtacacggtggtcgtgccgaccgtgagcaataaggtgctgggcagcgagacggtgcctgcacgacacaaggagatcctgctccaagctgtcgactccatcaagaactctgctgtcaccatactagggatggacaaaaagctcgggctcgtgagctcggctcgggcttggctcgagctcgttaagctcggctcggctcgaagactaaacgagccgagcccgagcttcctccacagctcgtttgcaaatcgagccaagcctgagctagctcgcaagccgctcggtaggctcgtcaagtctgtggaaaacatgagtacatgacctgacctggcccattaacaagttgtatcagtctggctcatgagaaacagagaaccctaccctaccctaaccgctcgccgaccctccccattctccatcccacgcaggcgcaggcacgccgccgctcgcgcgcacgactggcatctggtggcgactggcgagaggagttgccggacaccgcctccgtctccctcccctgcgccaccgacccgctgtctccctccccagtccctagtcgtccctcggtgccgccggcccgccgcctccctcccctgcgccaccggcccgccgcatccctcccctgtgcggctgcgccggctccggcctccctccccagcgacgcttgatgatcgacggctcgacgctctgtgccgccgcagcgccgcctccctcccctgcgctgcctccggcctccctccccggtgccgctcgagctcgacgccccctgcgccgccgaccctacttgctgcttacatcacaagccggctcgagcttttatacgagccaagccgagctacactttttgctcgttccatttatcaagccgagccgagccaaagcctgtttttgaccaagctttctcgcttggctcgtttccacccctacacctaggggtgggcaaaaaaagaccgaaccgaaaaaccgaaccgaactaactgagaccgaaaaattcggtcacaaattcggtcatcagttgtaactaaccgaattttacacggtcttttcggtcatctcgttcagttaaccgaaataaccgaattgaccgaatcactatgaaagcccaatacagcccaatagcccattagctacagaaaaccttaacattccatcccgtccccacctccttcccactctgcccggtcctcccacaaccccacttgcgcgttgtgctgcctcttcctcgcgtttctcctcctcctctccgcctcttcgatctctgctttctcctcctcgcaccacgccgctccgcgttccccacccaccgcgccgccttcaccgcgcctccgccatctcctcgcgccacgcctctccgccttctcttcgcgccgcgcagcaccgccgccttctccccacgcgtctgcgcgcccgctccttccgctcttccgccacttccttcgaggctgatgggagacgcgagatggatgggatctggactttctggtggagtggttgagatcgacgggatccatggctggattgatttgcttgatttgattttttttccatgaatcatgctctacttgctacttgttggtggcatcatcatattttactcattcatcccagttgctttctcatcgatcttgtacagaggactcaaaaaattttttgcaattaatttttgtgctaagtttggtctataactgagaccgaaccgaactagccgaagaccgaaatgctcggtcttgagttttcttgaagaccgatcggtcttgtgattctaaagaccaaatttttcaaacaccaaataaccgaaccgaatttttcggttagactgaatgaccacccataccaccatacgccagaggcatgatgtcatccgcgcccaattcgaggccaagggctacgtcgacgtcctggcgaggcctccgacgactctgacactgaccaggagatgcatccgctgtaattactatagacgctgacaaactccactttacttgagcaagtttaatagtatagccaactattagctctaaatcatatatagccaatttatacaatagttgcttactatattattaatacctgaccctgtctatcatacacacattatgttttagagttcgtgctgtagctggctatagatctgtagcccgttgcttttttctctttttctttatctttttaaaatatgtttatagctggcttatagtctgttattgtacctgttcaaattcactagtatattactatagacgctcttgacgatgctggttacataatgtctcgttgatctgcatgtacatttgactggattactgaattcaacttgttaagtggaattaaaaaagttacgaggcctggtttaggtagcaattgaaaggtgacgagataaagcagcggcatactattatatgtgctttcatgatgctcttctcttcttttcttcctttctttcttttttccccatccatgacaaagtgcggccatctcaaatcctggaataaaacatatcctggaaatcatggaaacaaggcttttaagttgttgtgttgggccctgcagggcaacaagaaccatatggatatgttggtcgactagttgattttgtacccaggaaggctcttgaagctgcaaatttctgcttttgaaaccctgcagaaagatgatgatcagacactgtttgcaaagccgcaatataggaaccttaatttaacaccttttgcactgtggccgctcgggaggctaaagagtgaggtcctagctgcctaaactaggaacattccatatctgcataattgaagcttggtgattttccttcctagccaaaagtgattccctctcagcctgtcgagttcgtgggcatcgcatcgcatcgatctccctctggatctgggacgtgtttgtttcgactgcctccagatcacatctcttgtttgttcgtacagagaatatattttgcctgattcttacaccaactaggcactagtttccctttggtagtttaagctgaatgtttttgcaaatttgacgctgctcaagtgtgaaagaggcccctggttgctgtaagcaggtcaatttttaactgctatatatcgccatgaaagaggcgaggtagtgcagcaataggtagctatcaaattacgactaaatcaataaagtagattagcacatgattaattaaaaatcagctgcttgtttgcttcagactgaaaaatagattttttttaaatatatatatatatagttttcattaaaaaaccacagtctaatgatttggaaagcttgtaaatgaaaaatgagaaagtaactttttctataagctgaaaaaacggtgccctgagccgatattggtttcagtcctgtaatatgcagtgcaaaacagattaattaagaatttaagatctatcactgcagtgcatttttttaaatgcaaggaatatgtcatggccatgatcaaaacaaagtctagtctctttgatctctctattggtaccaaagcgcaatgagatccagaagagcaggagtaaaggagaggttagctggtctggtctggtccaaatgagactgtcctagtagagacatgatcgcgcatttctttctttatgtgattcctgtgcgtcccaagggccaacattaattctgatcgttcattttgcacccgacaataatctagtactaccagcatagagtacttaattagttgtagcagcaaaaaaagttcactatattactacctctaatcccaaaataagttaacttagtatgaaatgtgagttaacctaatacgagattctagattcttagtaattttaagatggaaggagtacatcattcacaagttcatggaggtgctccctccggttccatattaattgacgttttagataaggttgagatcaaacttttataactttgactatcaataactttaaaaatatttagtttaaaggaactagaacaatatatatatatttgtctttcaaagcactataataaaaaaagtaaacatgtatttatttattatatatattataatagaaaaataaggtcaaaaatatattttgtagaccgtgtcgttgtccaaaatgtcaattaaaatgaaactagagggagtagtctttagtgaagagcagagagagcacatatagggccatgtttagttcacccccaactaccccaaacttccaactttccatcacatcacatcacatcaaaaactttcctacacacataaactttcaacttttttttttcaaactcccaacttttcccaaacttccaacttttttttcaaactcccaactctccccaaacttctaacttttttcaggaactaaacacaccctagattgtttttgaggttggagttgtattttgtttgaattaacatgctgattatatacatttgcgatcgtgtgagtaatccaacacagtccaagccaacccagccagagggagtattgaagtattttatacatgtgaacacgtgtgtgtagcgcagatctacggacagtatatttgttggattatctatgtactgtagcatgcaatagaaaagcgcctttgttatttaaatggtgatgaaatcatggcacgaatcacgcaaagtggtttgattgacaattggagtagtaggttaagaggaagttcagtagtatagccaactactggcttcaattcatctatagtcaatctaatagctcatttatataatagttacatactacactattaatatctcggattccacctatcattcacacactgtatcttggaatcagtgctacagctagctacaaatttgtagcctgctgccattctctctccttatttatcttcttaaaatatgtttgcagctgacttatagcctgctattatatctgctctaatgccaacaggtagctgctaccgaccgactgactgagagctgactcaaattaaccttgaaccaagcaaagtaaatcaaccaggggttaatttagtttagtttattactatagattgctgacgaatctatctggaatagtacaaagtttttggatgtgcgtgcgcaagcccatatttgtttggtcgatgatgagaagaagaaagcatgtgcacatgaggatcagcatgttgatgctgtgggcgtgcaacgcatggcagcgagtaaaatgaccgagattgaaattgcagtgaaatatactaggatttattggtttcaccaggagtagtagtagtagtaggaaaaccgataaatccttccttgggttgatggatgggcgacgagctggcacatggagggaggagggcctacgttcgtacggtggggactagtcctttgggcgcctgcagtttcacgagacgagtcccggggctcccgactccattttcccagctgatggtcgaactgttaaagcaagtttaatactcccactggtacagaatataatcatttttagtgctagacacggttattaaaaaaatagatagaattaaataggggaggattattattggatgagaagtgaaggtaggtgaaaaatttgaatggtgaagggttatgattagttaaaaaaaaagaatattggtgtaaaagttattatattttgggacggagggagtagtagtttaatattataacccactactagctccaatacatctatagctaatttaatagccaattcatataatagttgcttactatattattaatatattgtcccacctgtcatacacacaattgcgtcttggaatccgcgctgcaactggctacattatctgtagcccgctgctcttttctctcatcttttatctcattaaaatatgtttatagctggctaatagtctactattgtacctactcttaatccctctatctgttagtagatactccatccatcccataaaagaccaacctaatatcacatccggtactagattggtcttttatggggacggagggagtagagttaaataacttttactccttataaccgatccaggtataatgttggttttggagtatttaagatgtgctgctgcaaatggtgaatggtgtgtattactaagggcacccacaatagttatctataggctctatacaagagattcatgtcagcatatttttctacttggaataaattaaatgaagagagagagagcaaagctatctactaacctggagatagtctatagagaaaaacgaggcaatggattagagagctatagatacccatgtagatatactattgagttggtttactattaatctagtttattgctgagatatacatattttatatggagagcaccttattttattattgcgagtgctctaatagcttgattagcttagcttaagtagacaagccactttagaggaacaatgaagatcagtgagacaacgaaggagaggggagtcaggggacacgagatttcgatttcattggagagaaagagacatacaacgtccaaagcaaagcaaaaaggagaaacaaacaaaagcaaaaaagaagaaactagagagagagagagagagagagagagagttgtggaatccaaccaaccaatatgcgccgctcctcttcactctccaagcagagcacaagaacgcgctttgctcaataacacactcccctagctccccgaggatgcctgcccctgcctagcttaatgtggaactaactaggagtattaattaattccttccactaatcacccatcagcgccaaccggcggccacggccaccgtccgctccgacgacgacgacaagttgccactgctcactgctcactgctctggaaggtggtgaagcaggtgtcgctcggcttcactatgaagggccaccaccaccaccattccttgccgccgtcgccgccgcccaagcgccggtgtaccgccctggccgcggccgtccctgcgctcgtcgtctgctccatcctcctgcccctcgtcttcctcctgggtctccaccgccccggtacgcgcgcctgcctcctcgcctcggatctgttctgtaccttacctacatgctgctcacctcacctcctgcttgtcttttttttcttaactgtcagcagggcatggatcggaggagcgcgccgcggttgtcatcagcactgtacgatttcatcaacacattttttccccctccttctgaatttcatacatgctacatttcgaaattacttatttttttctcattcttctgacgcgcgtgtgtccttttaattaggaaatggggtttagcaagcacaagcatctggatgggaggatgaagcacaagctactcaaggtaatgctgcttgctgattctgcccattggctgactcataactcttagtcgcccagctttactgaaagcataagagtgcatacgaagtttgaaaagaaacaaaaaaaaaacttgctggggattccagcgaactgggaagaattttcccatttgatattctgtcctgccaattggaagatttgtgtgactctggagtaagaactgaccttctgaacataaattcccaaattttcaggcgggttttatgggtaggtttctgtagtataaggaaaaaaaaaaacaagacggcatcggttcatgcactctgcatgtgtgtgcagtgtgcttgctgactctttactgccttctgccttgctttgcaggggtattcactctacactgtaagccagggctttgttgctattctggtattaccaccccaaaattgttctttgccaatgacactgacaaatggacttggactgttgctgctgtgagcaacatttctgatgaactgcacatctttccattttaactggtcttatttcttttatgtttttcttttgggccttacattgttgccttgctttcctcctaactgctgttgtcacacctaattttcaattaacatgctgttgtgaaaaatatatctactaatttaccctgcggtacttgcatgtaaatgtatatgtcctgtgactcatgtaactgaaaactgctctacagcactgcagcagactcccaagtggggcttcggtcgaatactatcgcagtatgccactacggctatagtatatttgctattcgtgcctggtatcgtcatgttgggggtgtaacatatggattagcagttttgtactaaatgtattgtattacaaattaataccaagtagatgaatcagctcgtatgcgatatggtttacactgctgcctaaacttattttgaatgtgcactgctattgaaatgaatcacccatgccattttgatatttgcttggttacaataatctttaagagcttgctccactgacctctcaaatgattcctattattttggctaatctcctttttgtggaaccaggatgtttctagaaagaaaattcctggatctgatgggattttgggtgagaaatctggtagtagatcaaagtccaagaatgtttctaccaaatcaaaagaaaagctcaagggtgttttctctttagttcagctaaaaaatgagaccagaaaaaacaaaggtaagaaatgtcagatcagattttgcagtgtgttactgcatttactttgtaaaacaagaactgcaagataccaccagcatccattttatagtatccaatgttatttcagaacttcatacacaaagaagataccagttaaaggacttatcctggagatcaaaggtaagaaatagtttctatatttatttgcaatcttgaggattttaatatatgtgcatttcatcggtttggagtaaccaacggattattcttgtctgtgagcacagttagttataatgtttgttcttcttgctatgataagttgattagtaatggtattttacagtcaacaggatcttcaggaagacagatagtgaatgtgaaatatttgagtaggaacatttttttgatttccagtgtggcatcagtaataatgtacacatttgtgttgattaaaagtacaataattttgtactatacagttgacttgtccttttggccatatttcacaccttaaaaattgcttcttagatatctcactgttgccagtactttcaatcagttaagaatgcacatacttgacatagtttgcagcacagtatagaactgaattttcctctgaaacttagttggttgccccttttttttctgctgttactaagtttattatatggctcagaaccactgagtaattttatattactctgcaaatcttgtacacatgtgtttggtgcgtctgtttgttaatgctttcgcaaatcacaactgcattatggacataatgatacattagaaaaggctttttcaaatttcatattttttccttgatataaatgaatttaaagacaatagtagcacaataacctgataggtgtttgtgtaggatggatgccctttccttttctgccacaagactctgaatctgttctgtgacaggatactactattgataagaaagagaaccaagaagtcgagcatgaggagaaccccaaatcctgtgaacttgaatatggtatctactgtctctggtctgttgaatataaggaagtgatgaaagattttattgtgaagaggcttaaggatcaactttttatggcaagagctcactatcctagtattgcaaagctgaagaaccaggaaacattcacacgtgaactgaaacaaaacatccaagagcatgaacgcatgctcagtgacaccattgcagatgctgatcttccaccattgtgagtccaatcttagtaatcaaatctatatcttctgctttgtttgtaaaaaaaaaaaacttatacaattaaacttcataacaaattatatgagaattagcaatgtcaggactgcttcttttgttataatatttgaccttatttacattctttttatactttttcagttttgcaaagaagctagagaaaatggagcacacaattgaaagagccaagtcttgtgaagtcggctgcacaagtgttgaacggaaacttaggcagctacttgatataactgaagatgaagcttatttccatacaaggcagagtgcatttctctatcatcttggggtacaaactatgccaaaaactcaccattgcttgaacatgagattgactgtagaatatttcaaatcaacgtctattcatacggtccagtcaaacaagcagaaacttgaagaccccaccttccatcactatgtgatattctccaagaatgtgcttgcagtttcgactacaattaattcaacagttatgaactccaaggtatttccaactgattgaaaacattatgaccaatgagtaatccatctcagttctaacttgcatcctcttgacacatttcaggattcgggtagcattgttttccatttgttcaccgattcacaaaatttttatgcgatgaagcattggtttgacagaaatatgtatttggaagcaactgtacatgtaactgacattgaggatcaccagaagctctctaaggatgttgattttcatgatatgaaactgttacgacctgctgaggaattccgtgtcacgtttcgtaatcattctcaatctttccagaagcaaatgaaaactgagtacatttctacttttggccattcacatttcctcctgcctgaccttcttcctagcttgaatagagttgtagttctagatgatgatttgattgtccagaaagacttgtcatctctgtggaacctcaatatgggtggtaaagtggtgggagctattcagttctgtgaagttaaattaggacaattgaaggcttacaccgaggaacgtaattttgacaacaattcatgtgtgtggttatctggtctgaatgttgttgaactgaaaaaatggagggatctccacattaccagtcggtatgaacaattgcttcaaaaggttagtactcctatccctaagatcttacattcgattgtaacttttatcatagagaatatctgaattcctttctagtagccctagttatccttccataacttcatttattaattgtgtcccaatgagagcagtattctcatgcactgcctttgtctttgtagttgcaaaaggacagtgtgacatcatttccacttaaagtacttcccataagcttacttgtctttcaagatttgatatatcctttggaagattcatgggtccaatcaggtcttggacatgattatggagttagtcaaaccgatataaaaaggtctgttactctacactacaatggtgtcatgaaaccttggcttgatttgggcatacatgattataagggctactggaggaagtatatgaccaacggggaaaggtttatgacagaatgcaatatacattaataacagtaacatgagattcaccacattctacatttctgggattttggagcaacagaactttcgggaacaaagagggttagagtgagataaaatctgatgcagcattataatgaattgagtatagtaagggtggcatggtggcactacattaattccaaaatggagataggatgaaatgtttttgtgccagattttaagcaatacttcatagtagctaaagatggtagcaggccaccagcatgatacctttgaagtagatccctggttaacaatggtgtatgttgattccttcaccttttacacgatttggatggatcttcttcacatttaccactttaggattgcaaaagtgcagttccctggtggtcatttttttcgtataaattctttcatgtgtatctttgctcgttgtataagagctatactgtataacttgggtgttgactggcatggcatgtacagatgtagaatgccttaacccgaaagcattgggtgattctttctttcttcttcaaggctgagatgtaccatgtcacaccaatgtcaagtttcgagatctttgcattttgtacatcggaaggattcttgtatcatcagtttgataaaagatacatagagctaaagcagacgtcgaaacattgcaaaaccagaatagcgtgattgcatactgcaggttcattacctttacattttgtcttcagccctgtgttcattgccatggtttcctaactcatctccctcgttttccacgtgcatgcttttcaaactgataaacggtacatgttttgtaaaaaattaatatagggaagttgcttaaaaaaatcatattagtccatttttccagtttttatagataatatttaattaatcatgtgttaatctatcgttctgttttccgtgcggaggggagaggttaccaacctctccaaaaagaacacagcaggacgtcctgtaaaggtcactcattcacatttatcaacttgatatgttgggtcatcattgattagcaaaatataacattagtaaggttttattcagtctgacaaccaaagcaatagcatgaaagaattttggttttgatgccaaaataatgtgccctaccaaatttttagcaatttgaattgtactttggctagtttttggtttgctaaaaaaataccaataataacacacatatagattgacaaaaaaaaattggcactaccaaaatttttctaggttttggtattttccatattaattttggcatggtagcaacggaaaaaactgaaaaaaaaagaagaccagggcacacactacaagattcatcccggtctcccgccgtatagtaggtgaggtgaaatatatgtagtataatacagatacatcgatggttgaggggatcgtcaatagctaatgacactcgatggttcagatcgttaataattaatgacagtttgcagcatcatactccctctgtcccaaaataagtgtagttttacactattcacgtttaacgttcgaccgttcgtcttatttgaaattttttttatgattagtatttttattgctattagatgataaaacataaatagtactttatgtgtgactaaatatttttaaattttccacaaaattttcaaataagacggacggtcaaacattgggcacgaatatccacggctgcacttattttgggacggaggtagtactactaaggagtacatcagtttcaactagaggttgttggagtcaacgtagcccttggtccgcagctggtcgagagtgttggcctgcatctggcggatgagttgagagctggtgttgagagcctgcacgacgttggcgagggcttggtcgatctccttcagctccggggaatcgtcacggatcaccggaagaggaaccggtgccctcggcaccatcgacagcaggtgctgcacccgttccatcggcatcctcttcttcttcacagcctcctccttcttcatcctcttggcctccttctcctccgacggcgtggagcacctcttcagctcatttgtcatcgccacacgatttccgtcgccacccatcaatcttcttctctttcctttaattcctctcgatcgagcacgcagatatcaatcgatttgattaatttccttacgattttcgggatcgatttcctcgttgcggcggctctagggtatcttgctgcccttctcgatcgagcggatataaaccctaccaccgggccaccggcctgttagcaaccaaatcaccaaacaacaagaatttcaccacgaacaactattcagtcaacagtgctgtttttggaggtggaaaatggggaaatacagggggctagaaggttctggaagctagggaatgggaggtggaggagggaatagatactcgacgaggatccagcctggacccaatccgccaccgccgccgattgccaagccgcctaggttggtcgtcgtcctgccttttctgttcgtccttgaatgagcagcagttattgctttatgtattgctcttcctaggtttgcttgggctgggatttgcgtagtggaccagctgtggtgcagcccaacaaggtgtctaacaatcctctctccttgaattcggcttgtccccaagctgatgaattaaaacctcccggatcccatggttgctccaaatatttggtgttagacaatggaacatcattgaagaagaatagagcaggtagctttagcctcaataacttcttactccatgcgaagtcctcctgtgtgatgcgtgacaatggcactgttatgaattgcttgccaacagtgattcccaacaatttgatatgctgcaaacaatgacaacctcgttagatcaactgcagagtccacccatgttcatgattatgtccatttattggcatgccgatttcatcagtcgagcatatgcattgctcaatagattctaatgtatttaccacctctgtagaaactaactcaaaagtatatttctcatcacgaattgaattagcatcttcttccatgtctttcacccttttgcagcctttttcatcagcaatcaaatatagcaaatctctttcagcattcaaaccaatgtaatttgattccaaacatgactcagattctgatatcaccatgcaaattattctcatattccatttctccactctagtttggtagtagttgagcaacatccccctaagatcaacagatgataaccaaacatataatgatttaggatcacaaataactagattgctttccttgctagcaagtgttgtcaaactgacctggaaagttagatcccaaaacttctgcattttctgctcaaagcaagtgcaagtttcagtagtcatcattttcttttgctcattccaaggaattatacttgcagcagaatcagtagtgcaacatttcccttctctagcttctagcaaaccaactaatggcagccaaggtggcatgccaaatagtctcagcttgtcacatgttttcctttgaaggaaatgatcatagaaccaaattgcccagtactgctcagctccacaaccatcactcttgcaagaagtaagtgactccaacttaagtagcagttgtcctttctttccatttcaacaaaagatagccccgaaagtaaatattcaagttcaccaacagcatacataccttccttgctagtggctgctataaggttgatcaaaaaggacaactcacttttcactccaacattgagtctcagctcattgctccacaaaatatacttccaatgaaaataatgttgtgggaaccaatcatccatccatattaatattttgtgaaggtggacctttccatcacctggatcccacactagtggccccaacatgacatgtataatgttcagcgggtttaccaatgaaaattgcttgcccacaaagagttgaaaccatttcgcttcggttggagggggccaaggtggcagtatatgtacttcagaacagctgcagttgaatgccagccatgacattaactgtgactcccatataatgaactcttgatcccttgatgttatgggtggccatggatcaacttcaaagtgttgcaacagcagttgccatggaactaacaaatgtcctccagctgattccactaacattggggtgcttaagaaggacaaataagacacaacctgagagttgttagacccagaacatttcgccgaatacctagtgggcatcaatgtgtaccgcttgatgtcggtgatcatccttggtgagaaggcactcaatgatgcaatggatgctggaacggtctcaagtacaaccgacttggtcaggaacacgatgtcgcctttgttggcgtcccacttgacatcgaagcccaacatcgaacacttgccgtgcgtatccttggaatagtcagtggtggcaattttggtggtgctagttgcaccatcatcagctaccaacttcatggaggccatgggagtggtggcacatttgtccaccgcaaccacggtgagattggctcaatgtcgggactagagcatttcgtcgagcatgtggtgggcgtcacctttgactgctctttcttaactgacgctggcaagtcttttgcctccttcccaacttccggtgtgcatgcttcaaccacatctatgagagaccgtatatcagctctagttctccgatcagcctcctctcgcctcagctcgtactcctccatccgcctcaacagcaaatccaatttgtcttctattgccatggcaccctacttgaagagaactttctcaactagaccaagagctagatggggggaaccaggctggctctgataccaaattgtttttttttactaactcaccgggggggggagagattccccacctgaattgtcattgcataatagattgaaaggttttgttacaacagattcagagtttgaagtgcggaagagaaaagatgtttccagacatctattacatgtcgatcttgcacagctagtgtttctgcccaaagggttgcttcacttatcgctcggtgtaaacaagcagctaaagatggttgctgccctctgaagaccacatcatgcctatggttccaaagcgcccaaaagcataagatgtagaagacatggaggtgtttcgacggcagtaacggtgaattgctcagccgatgaaagagttgcacatcttggatagctggctgaattcgcacttttgaccagaagtttatcgcaaacgggcaagtcaggaataagtggtttgttgtttcgtccccgctactacagattgcacatgaagctgattgaacaattttcttttttgatagattcatccttgtcgacagtctgtttcggaccagtagccaagcgaacaattttaccttcaaaggcgcccgacagttccagattatcttccaatttggcgatggcatttgtacagggaatcttgcatcatagatttctttggttgtgagagaggtcgatcggttgttttgccagacatcgttgtcattggtcagagtaaggtctgccaccattgcctgaaggctgtgaagttccgcatttgcagcctctgaaagtcttgggacaaacattatcattaagcctcttgaaagaacatcttttacagtagcatgacaatctgttgtgtgagaataaagagccgggaagagatttgctaactgaagaatcccaagccaacagtcatgccataatgaagttctagagccatttccaatctttaccgtcatcagcttttgaagctccggcaagaatttctgtaacgaagtccagtgttgtcctaaaggaagggatttcagtagagattgcccatcaaattctttccaaatccagttcgcccaggaagattctgaggagaagaggctgaataaccgcttcaggagaagagcctcattttgaacttttaagttttttactccaattccacccagttcctttggagagcaaaccacatcccaggcaaccaagcaacgcgctctagaacaaacatcctcccccgtacagaggaatgcccgccttcgcttatcaatttcctcaatcaccgaaggtggcagcttgaaagcagacattgcatagacaggaaggctattgaggaccgcattgattgaaacgagacgctctgcctgaggagcgaagcttcccaacctgctaagaacccatccaccttgtttagaagaggctgagatcacccgtagacaacttgtgcacagttagcgggagacctaggtaagacattggccagttttcacgcttgcactgtagcagttccgacaaagtcgcttctttcagcagatcaacatgaagagagatcatagtacttttcgcaaagttgatatgcaaaccagttgctttggagaaactgaggatggaagattttagggctcggacatcatcttcttctgctctataaataatcagcgtgtcgtctgcatattgaatagttgcgtaggggcgatcatggtatattggatgtcttaagcttgcatttctttcaagcagtcgctggagcacatctgctaccaagataaaaaggtatggagaaagagggtctccttgacgaaggccccttcgacaattaatccaactccctgggattccattaattagaaccaaagattttgaggaggtgagcaacttgttaatccacccgatccaattgtccgggaaacctctgaccgctagtatttttagcaggctttcccaatttactgaatcgaaagcctttgcaaagtcgagcttgatgattaaagtttggcatcctcgcttgtggcaagcttgaatcagttctgtcgcaaagattagattttcaaaaatgcaccgaccttttagaaagccagtttgatccatgtgaatcatttttgtcaaagcaatttgtaacctaaaagccagcacctttgatagaattttgacagagcaattctgtaaagagatcggcctgtacccatccactgtgttttctttacctggcttttggataagaacaatgaaggctctgttaattctttccagttgaatagcgccctgggagaagcctgatgctagatttaggatagcctccctgatgtcgttccaagccgcctgatatatagaagctaggaccaaaaccgtctggtccaggggcactgtaagaattcatgcccttgatagctagcagcacctcctcttgtgtaatcggcaaaccttgagtagccagcatgttagagtcgcattcctccgacaagtagagcgctgaaagatcaacatcccacaccggctgagactcaccccccaaaagattttggtagtaggagtgcattaggcgcgctttgccattgtgatccgccacctctgtaccgttgtgcttgattgatttaatccttgatttcctgaaattttttgatgcatgagccttaaagaacgcagagttatccagacccaactttattcttctgactttccccctctgcttccaatatgagagtctgctctgaaccaactgtgccagtttattctgcactagatttcttaaacattgctcaccttgagataaaggcctgaattcttcgagaatgtccagtagatcaattgtgaatttacaattttcatcgagataaccgtgtttccggtgatccttcatccattgtttgatttgtgacctggtgtgtttgaggtttgataccaaattgttagtaaccaaatcaccaaacaacaagaatttcaccatgaacaactattcagtcaacagtgctgtttttggaggtggaagatggagaaatacagggggctagaaggttctggaagctagggaatgggaggtggaggagggaatagatactcgacgaggatccagcctggacccaagccgccactgtcgccgatcgccaagccgcctaggttggtcgccgtcctgccttttctgttcgtccttgaatgagcagcagctattgctttatgtattgctcttcctgggtttgcttgcgctgggatttgtacagtggaccagctgtggtgcagcccaacaaggtgtctaacacggccttccaggtcgagtccgactacgccgttgcatcactatacacgggcaatacaagtccgaggcagagtctaattgcatcgaccaatttcaggttcggagaattaaacaccgcccgatatccgtataatccagccgttccagcgaggttgggaaattcgattctgaatccctgatatttttcataggacgtcggagaaagaaataaactccgaacccccttggccttgggtgagctcaaactcctccagtacagcgttagcgtcgcttctctacaaccactacaccccaagtggatgcagctgcctgaaagggtccttctaatgccttacctctgcttctttgacagtccaagagaaatgcaacatgaaaaatccaaacttgcgcaggaaaatataatgaacaaacactgtctagctgtaactggtctgatctgaactggcatgcagcaaattaatttgcaatgcatctcttgccacaaagcaccagcaacactcaaaatcactcaatcagggaggataaaaaggacaactcttggccaaaactatcaaactataggaacaccagcaatcagttgccattgtatttcaggggttcggagaattcaactccaaacccccacctcccgattccagtatttgagggattcggagaattaaaccccgaccactacgtaccgctccagcatggtgggaaaattcgactacgaaccgcctgataattttaagggggtcggaaaattgaactctgaacctcctcgatcggcatcgccgtcgctagctcagcacaccagatgctgacgaaaaaaatgcagtggtgtaaattaactgacacggatcggacgagaagacgccgacgctgcccctcgctcaaattcaagcaggtgttgcgcaaatgaaaccttacagaaggcaaagtatactataagctatgtgtacatgtgctgttaatttaggtggtaacgagaaattcgatcatatgatttccggattacatcattatactggtgtgaatatatattatcgtttctctgtatattttgacagacgtaggaggatttgtaggcaccagcaagaaatcaaacgatcaaacaagactcaagcaatctagtatgttaaatgatggaaatcatgctccaacgacaattggaatttccaggaatctaatctaatctagtgaaacaagactcatgcaaagaatctagtaaacaggctgctgcaactagttacgatcacatgatagtaggagagaaaaaactaaggtaaaaaaaattaaagcattcattaatttgaaataaaatagccttgcttagatagttaggttgatactagctagttgaaattggggaaattaatcggcgaccaaggcgtggacgtagccctttgtccggaggtcctcgcgggcgttggcctgcatctggcggatgacttgagaattggtgttgacacggttaatggccctgatgaggagtcggtccatcctgttgcgcaacgagttgggattgccgtcagagtctgcagagaccaccggaagaggaatcggctccatggtcacgaacgatagcagatgctccacctgttcctccggcaccatcgtctgagtctccttcatcctcttagcctccttctcctccgacggcgtcgccttgcagcacctctttagctcatggctcccctttgagcaacccgtcatcatcgtaaaaaaaacgctggatatgaaagaaagggctttcatatcgatatgcattaagagaggagtgagtgtgttcgctgggaatcgaactcaggccgtagggcgcaccaccgcagaccctagcgcagttctctacccgtcatcatcatcggacgatgatttcctgtatatatgatttcgagctggttgggtattggaatcgatttgtgaattgctggacacgagctgagctagcgatgctggtctgcatttatatatgcatcactttacctgggcgaggcaaaacaagtaggattcgatcgagtccaattgcatcacccggccggatcggcgttcggtctcttaatcggatcggacgcaccgcaatatatgggctatggcaagtgtaatactagtacgtatttttggtcgtcgtcgtcgtaataaaatctgtttacagatataatacagatgctactaatcagtaataaaatctgtttccacaccaccgaattaagaagcaaatatcatcgtaatgtcatgctcatctacattatattaatacagttaggagagatgctgatgcttgaattgaggcacgcagagcagggcctagctaggctgttgaggccagcatgtcgtcgtcggcggcggcgtatttggtgacccagcagtcgacggagcccttggtgcggagctcctcgcgggccctggcctggtcctggaggatgatttgggtgttggagttgaggagcagcacggtgttggcgagtatatatgtcctcgaactggttgatctcggggtcatcggatcgtggctttcgatctcgaggaaacgtcctcggcacgaacgacagcagctgctccacctttttcgtcgtcatcctctccttcaccttcaccatcaccgtcctcttcttcatcttcttggccgcctcctcctccgcgttcaagcacctcttcagccccagcctcgccccatcagatcactaaattctcactagaacggataccatcatctcaatcgggcggcaacccctatctcaatcgggcacggtgtccgtcacaggctaaaagtcactgatgtgaaaagttatctcaatcgggcaaacggccgtcacggatgaacctatcttaatcgggccctaattaaagcccattactgatagctttgacccagacaacatgtcaaactatagcccgtcatggatgacctatctcaatcgggcctaaactatagcccatcacagatgacccttatctgtgacgagcattaactatagccctgtcacagatgagtcatctcaatcgggcctaagttaacagatgagtcatcccaatcgggcctaagttaatgcccgtcactgatgagtataaatctcaatcgggcctaagttaacagatgagtcatcccaatcgggcctaagtttaacagatgagtcatcccaatcgggcctaagttaatgcccgtcactgatgagtataaatctcaatcgggcctaagttaacagatgagtcatcccaatcgggcctaagttaatgcccgtcactgatgagtataatcctaaaaaatataaattttatttctagctagccttgccatgccatcccgccccactcatgctaatccttttttttttttgtccttgctcatgtgcacgaagttcacttcccgatcggtcacccatcctaaaattgctccaggcccagtacgcttaatcggtcacccatcctaagatcggcttccagaagagtagttgtagcttcttggtatcagtgttctattaatcctattaagccctaggccgggatatgtcacaccccaacatcccccattcatatacattcattcacatacacaaccatcaaaaatcataaacaacaaaattgtatgactcatcgagatctacaactgtatcggtcctttgtacaaataagtttatttgaacaattcaaattttgaattttcaaaatttgacaacttcgaagaaaaattagggttaataaatgattttaaatggaaaagtcaccgaaaccaaagttgtagagctcatcgaggtgcaaaatttttattttggtcatttctccatctgactctatttaaacaatttgaaatttaaaattcaaagtttgagaaattcaaatagaattttttgttagggaacgacttcaactgaaaaagttatcaacaacaaagttgaataactcatcaagatctataacttttattttggtcatttttctatataacattttttgaaccgtttgaatttgaatttaaaaatatgataacttcaaacaatattttcaaatactaaatgatttcaactgaaaaagttatcaacaacaaagtttaataactcatcaagatctataacttttattttggtcatttcttcatctgataaaatgttaggaacattgttcataaattttacatatatgtgtatagtttataaatccagataaaagatatgtcaattttgtgaacaatgttactatcacttatacaactttattgttgatgacttttccatttgatattatttactacccgtaaaattattttgactcgtaaaatgaattattatactgcaagttaattattttgctatagttcaacttacaaatataaacatttcatatgaaaaatagaaaaatactcatcggtgacgggctttaattaatgcccgatagagattaagtgattaattcatgtcaaccggggattagtatatagcccgtcactgatgagttatctgtgacgggccttaagttggtgcacgtcactgatgatggtcatctgtgacgggccccaacttaaggcccgtttgagatatggaatgttatctcaatcgggtctaaagttggtgcccgtcacggatgatggtcatcagtgacgggccctaacttcaagcccgtttaagatatggaatgttatctcaatcgggtctaaactacggcccgtcactgatatgtgttatccgtgacgggcttaagttttatgtctatctaatgtctgtgcgaccatatctcaatcaggctaaaatgcccgattgagatgactttcttgtgacggcccgctatttccagacatgttagagcccgtcacagatagaagggtctgtaatagtgtctccagccatatcgctcgacacctcgatctcaatttgatttgcggaggggtggttctagctagggattaccggcggctaggcttctctctctattttatctcgtgagtacgcgttccgacttccgaatcagaaacatattagaacacacgttcataattatgttgggccgcacaagggccgagcaagataacattggtagcccatatcaattagtattactctctattaacttctttttttttattttggtcggatcaaattaatcgccacttgaatcaccgtaattttgacaatttgatccttttaaaaacttatttgaaaattagtccgtgtcaaaaaattattgaaaaataggtcaaaacctcagcgccataaattttggcgctaaagcctatctgagttggacaccacgtcattggtggggcgctgagctcccatccatctaaaatgttacataagtgagcaccttaacagtattgtttgcttgctgtagtggatggattgttaggtttgtactcaataggtgacgggttctagcccttctacctgcaccgttttttccttcgtaatttaatttcctttttatttttgaattgaaatatcgagaagaagtgtatattagaaaactcaaatcatctctcttaagaagatatcctcttatttaaaaataaaaggatatcttctcgagggacaaaaatccatttccatatattagcatatatgcttgcaaatgaagagatccctgtgtgtatagtgtaaagtgttatgtcacgtatccaaactcaaatcatctctcttaagaagatatcctcttatttaaatttaagaggatatcttctcgaaggataaaaatccacttccatatattagcatgtatgcttgcaaatgaagaggcctctgtgtgtatagtgtaaagtgttatgtaacgtatccaaccatgcaggtaattaagcaaaaggattgattaatttatccaaatgtacaagcgtcctcgttccctactactacctctatattttaatgtatgacgccgttcatttttttccaacatttgaccattcgtcttattaaaaaaaatttatgtaattatcatttattttattgtaatttgatttatcatcaaatgttctttaagcatgacataaatattttcatatttaaaaaaaaattaaataaaataaataattaaacattggtcgaaaaattaactgcgtcatacattaaaaatacatacggagggagtacttaatttcctagctagcggcggggagatctcgcatccccggccggccccgtagagagtgttaatttcctactacgtacgtgtgccccttgttaatttacgtacatgaaacacgagaaattcgctcttaatttctggattactacaatatatatacgggatcctaatctcactggtgtaaattaagaaagccttttaattatttggagcgacatatatcaaatccctcgtttacgcatacatgcatggatacatgctatatatatttcctaagttaattccttgattgcatgcatgtgcatcactcgatctgtatcagtatatattgaaacgcgcgctgattggctccatcattagctccattattcctatctagctagtacatttctcctaagagtacccgcaatggtaaagtaaggtgctatctataaaacatgtacatctcagcaatagactcgattaatagtaaaccaccttaatagtatgtctacattggtatctatagctctctcatgcattgcctcgtttttctctatagactatctctaagttagtagatagttttgctctctctcttcatttaatacattctaagtaggaaaatatgctgacatggatctcttatagagagcctatagataaccattgtgggtgccctaagatacatatcaagatatgggcgacagcttgtcttgtcagaggaacaccgacgacgacgccgctccgccgccgccgctggtgcccgtcggcggccagcagcaggcggagtacatgagtaatcagcaggtgaggacgaggagagagagaggccagccaagcagcagcagcagcagcagcagcagaaaccggggcgtgggcgtggcagatgaatatcaaacacgacgcggccggtgttgatgataatgttggctttcccatcagttcacagccccctacgctgcgtcctcacaattttatgagattttgcgctacctgcaaccgcacacttagtccacagatgaacgtctacatcttcaggtacctagtagctaattaatttgttgatgacaattgacaaaccttatattctttttctttcataaatgataataactttgtatacatgcacgggttagttaattgattttctaatctccatacataattaacttgtacacatgctactaattatgatcacttttacttatttaggtgaaatcaatttatataacttttcatccgcggttcttttcatccgtggttggtagtgcattttgtttttatagatagggaagatttttatttgtttgacatgcacgtgtgaattcttttttaaaaaaaaacaagaaagaaattattgttgaacaattgtaatatatattgtacaatgagctaggtggattgaaaacttcacctccttttatgcctctcttttttaattttaaggtgttgtaacaggggagagagcgctttctgcagcccggaatgtcggcaagtacaaatggacgcctatgctcgcatacaggatataattaattcttgaacttgtgcaaggggtgatcatcatattcaataacgaagacagaataatgcaatttaatttccaagccatatttagagaaactgatacccttatttgtaatatgcatgtatccatcccttcttaaagttctagaaggatatccatgaatgttcaagcctttacgatctcatcgtctaagctatatggttagtgaatgcttcatgcaatcagtgtacatctgtcttacctatctactccgaagtgtgctgtctatatgcatgtaatgctactcttatttatatgatatggttgttgtttaaatgtgttctttcactatgtttaaatttgagacctttttgacgtacttgattacctctagattcaaataaaatatcattgccccaatatcaatcgacctaatttgcattctatagatgtgtatgaatcgtataaaaaatcacaaatataatgtgtaagaactttatcaaaagaaactacgattatatatgcaagccaccggatgaagtgaaagaaattgttggggtatggtcttaattataataccaaactgtaagcatttgcgttaaatttttgtatagaatatgtgagctagtcaccatacgacacctttgaagtaggctgcagtttaccagttaccagggtgttatgttgattacttcacctgttcaactgcacttttgggtttgcaaaggtgcagctccttgcaagttgtcattttattcatccaattctttaccaattgcaatcctggctatttttcggtgcgttgacatctttataggcagaaaaacgatgtttgttttgctctttggcatcaaattaaatggtatctttatgtcctgcatattccaatatgtttttgtttgcaaggaatttaagcactcagatggcaacactgcttgtgccttgtcccctttcactataagcagggcattgtggcttttggattgctctaagaacacatcttgtgtaaaaatttcatacggtagataagaacgcataaatctgaaagctcacatttatctccagtaaggatcaagctaaatctgtaagtggtttctgatttctgtgaatataaatcgtttccatttatctacagtaattatgcaagcttttgttaggttgatgttgttttttttataaatgccccttcaatgactggatcatgtgtatttttctatcgattctacaagtaaagagtacattatcaagtaacaacagtagagaaaatccaatccaggtgttacaagtcatgaaacttaggaccatggggataatgaccttccagaggacacttgcaatgcttctgcaactcaaggtacttttccatatcaaaactattcttggcacaaagctttctgtgtcttgacaaatacagcctttccatgaagtcctcatatgttggatcccttgaggtaatgaggaaatatgcgtaaccaacgagtaggccagatgcagttgtgaagaaggcaattggctccatcacatcccatgaaaattcccagaaagtaaggcggaagaagagcccaacttggcacatgaagaaacctagtccagaccacaggatgcgccgaacttgcttgtgtgccagcttgtcgatctcttccttcttctcctggagcttcttcagctcttcttttcttgaatcgttctccggtgagagtgcaagcggaacagctcttctaacaagctcaaccacctaaaaattgtcaaaaaagaaaaaaaaaggcttcagtttaatagcacaagtgtcaccgagttctaaaaattgatcaggcaactaggcaatttgggagaaatgtcaccttctcggggtggaggtaggccttgtcgcggaacagcagcacgacgccggcctcatccatggcccgggcgagcgcctccgcgtcacgccgcgtgcgcgccgcgccggcctcgacgcaggcgtccaggagctccccgtacccgaccacctcctcccgcccgtccctcagccgccgcttgagcgcctccacgcccaccagccgcaccagcctccgcgcctccgccgccgtcacctccgcctcggcctccgcgggccgcgacgacggcggatgcggaggcggggagaagaggcgcacgtggcggagcgcgcaggccgcccctgtggcggttgccggagagggaggaggatgcgcggcgcggcggcggaggaggtgggaggcggccgcgcgccacatggttggttgccgaatgaggccggccgccggcgacggcgtggtagtagacttgtatactagcaaatgggccggaagtggactggactggacagagacccttcctctcgttttcctttccttttcagtttttatttcctttttctacgtgctagtaaaatcttgaccttttcttttctttttttcctttttttttttggaggatgtcgccatcgccaacgtgctgtgatctttacttcggaaagtgatgacttgggatcatggacaagaatcaacaaaaggatgtgccgttacttgtgtgctgttgtgatgttgtccattcttgcgaggttgcacagagaattccaatttgcaaatacatcaccaactgaatttatggggatgcaaaagatttttctttgatgaaagcatgcaccttgtgctgacaaccaagtcggtcatccttttgcatcctcatgccttatgcagttgtgctcttactcagtgtatttagggcatgtttagaagggctttcacttctaaatataactattgaaagtggagtttggagtagaactatggagcatccacaccgcctcactagttatttttttacgatcactctagtggtctagcccctttttcttttagactttagccttagaaaaaaagtgaagctagaatctgatcaaaacacaaccttatccttgtcaaacttaattcgcgtctttagaaaaagtaaagcaggagcttaagcccaatcaaataaatccttgttcttgtcaaacattatttgttgcagttatgcagtattgttagcgaattccacagacactgtacgtatttttcctgctaccgctgatcagctaacagttgtatccaatgtaacttccatttttacgctttcatagttaggccttacaccatgtcaaatcgaatgtttaaacacatgtatgaaatattaaatataagctaaaaaataactaattgcacagattgcgactaatttgcgagacgaatcttttaagcctaattacgtcatgatttgacaatgtagtgctataggacggattaattaggcttaataaatccgtctcgcagtttacatactgaatctataatttattatgttattagtctacgtttaatacttcaaatgtgtgtccatatatctgatgtgacacgccaaaaatttataccctggattaaacacccccttagggtgtgttagttcacgccaaaattgaaagtttggtttgaaattggaacgatgtgacggaaaagttgtaaatttatgtgtgtagaaaaattttgatgtgatgaaaaaattaaaagtttgaagaaaaagtttggaactaaactcagccttaccgtgaaattctagcatgaatgaatgtcaggttaccagatcagcggataacagagtacgggaaggcatggcaggagagactgcagtgtacagtaagcagtactccgtactggtctccggcgagtgaggcaggggtaggcaaggtttactaccaaaatgaataccttcacccaactcctcttaattctgctcatcatttcctccaattaatattgctaccaagtcacagacagacagacagaaacaagaaagccgagttccatcctccactcatccccgtctgctaataggattaaacttgatcaggcaatgtaattgtaaccccttccagcattcaggccagcagttcaaggaccaatgtcattaaaaatcagaccatgagctttgttgactgaaaactgtaaaaaatgaggcgagtttcagtctgcagttggtgctgtccctgcaactgattgtagagctcgtttgttaagcccgtccgtcaaatagacagcttcagatcaaagtatgcagagcaatttctgaggcatttggtcttgtcatcgcggagtggtagcaacaaacaggtcgtccggcggggccatcgttcacttcagtcagaaatgctgaattgattttatctgacgctgaagcttaggagacgatctttaccagtgctagcacattaacagcgatccgaaaaatcaggatcacaatcatcattaatggcgatccaaacaagataagctaggggggctttctgaaaaatgttgtcgattgcggcctcgtagccattggatgctttctctgtggccaccgtctcctctaccaatccaaaccctcgagagagacctcgccgccgctgtggtggtcgtcgtccatggctgtcgcgagcccaccgccacatcccatcttgtgccactgccgcccaggcgcccatcccatccggatgcaatggcgaattggcgatggctgaacaggcgacgcccgatggccatgagatgcgatgtgtgcgtgtcagcttcttcttgctcttgtgcatgtaaacccagcccaggaagggatcgtcagctcagcaatggcgaaactgtaagtctgcagtagctgttcttgtttcattttttttcgggagaatagctactttagtccctaaagtttgtctgtaggatcagtttagtccctaaccttttaaatggtccaaagaaattcttaacctttgtcataaagcctagaatagtcattgggtccaccaaaatcatcatatggatatgccatgtcatcattcatacaaaatctaagatgaacagtccaatttacccttacatatatcatagaaaaataaatataatggtgaattagacataaccataggaaaaaaataattcttttttcacccttttgaggtatatttttgctcttacatatactatatatttttttaaaattttccttttgttttttattttcctatgcgtaagggtaaattggataaatcatatagattttgcataggaaggtgacatggcatgtccatgtggcgattttggtgagaccaaggactatgggctggtttggtttcaggcctaaattagacttaacaatatttggtaatttcaatagtgtttagcgtctatttggtttgaagacaaattttggcatgcctaagaaaaataggccatttcaatagtgaacttagactattttggcttcaatccaaacacaactttaccttaccaaaattagtcatgccaaaacttgctaaaatttggcattgacaaaatttggtaaggcctatttaggtcacaaaccaaac

SEQ ID NO: 62836 - DNA, 2046 bp, Oryza sativa
atatataaagctcaactagtcaagttataatatcccaaggtatcaaggaataaagtaatcaagaacaaaagggctataacaaacaataggttaactccacccaatgacattcgaaaataaatgcaaggccaatggtgaggaccatgattatgctcaaggaggaacggacatctagcatactcgggatgccatgtgataatgttggactagagcttaggtacttgagattcaacttcggtcaacactggaatcaagactatacttagggaggaggtgaggtcgagacagtcaaagataccgggtgatgaatttggaaacaaagtcacaaacggttggtgacgaaataactttgtaattgtcagtatatttcatcaacatacaaatgaactaggatttctactcctactttgagtaggaggtattgggtataaatagatgaaggattgaggctcgaaataatatagccgtaggtgactcttagagataaaagttagggtttgttttgaggctacaattctagttcatgagttgagagatgagtgctttggttgcattttgtaaacacaatttgatgcaataaagttaatctatcttcaatagtatcttcaatttgtgttttttttggatacgatagtttgaccgcagttcattgggcgattagactggcgggcaggttgactggcgacaaagagttctgaccgacttactccataaggattgaaggttctttttgttttgcaaaaaaaaaaattatgcttttgatgttcctatcattcacctcccatctggtttcttgtattcgatcctacgctgccctcggccccaaggtcaccaatggccacctctctgcctccctcgagatccggccacctcctcctccaccctccactccaatgtcatcatcgaccacctctttgccatccacgagctccaggccaccagatccggtctgcaggtggttggggaccacaggttctgaatgccttgagctctctacctctaccataaggtcatcgttgtcatcaccggaccaagcctatcgttcaaaactctatgaagactactgcaatggcagcgaccacagccaccaccatctccaacagctcatcaagaacctagcagacattctccctcagctcgtctatcgaccacgccaccatcgtctcttacaccaactacaacaagcacatcatcaggaattttgagccgtgattgtgatcattgagatccaccgatttttttccatagattttttgtctttagagattattgtgtgttagaataggtgttgaatatactagtccgtggttacagttgaacttggagtggtaatagctggtagggggtggagttagagtcggactctataacctggcaactctcttaaatagaggggacaccacaatgtatttttggggactagaatgcagcgtacacacgtagggagataatgggggccaggtctgggacccgttgtggctaggagctctattgtttggggaggagcgcccataactagagtctcggagatgtaggcttcggctttgaacttcgctaacaaatattgtgtgttactatattgtcatctagtgtgtcttgggtgatcgactactgaagcgatcaataaagttagttcacgttccactatattgacaaacttttataacaagtggtatcaaagccgtatgtttcagaattggattcagaagacatgtcgaggaggaaaaatgaggtgagatcgcacatcgacagaatatcgccaatcgtggcgaaaggatcgatggcgacaacgaggactttgcggaggcgatgacctcactcacgatcagactggcgatgtcggcacgtgacccgaagacgatgccggacgtggccaaatgcgaccaaagagatcggagggtgacgctattgacagcgctgaccattcatgcaatgattgtggatctattgtggtccggaggctgttgcttaagtgccaaacctgcgagtatggtgagtgaacaagaaggatttcactgccgagtgttaggggacccattggatgtg

SEQ ID NO: 62837 - DNA, 15686 bp, Oryza sativa
  unsure (1)..(15686): unsure at all n locations
aatcaattcacaaaaaatctacgaatcaactccacagccaccgcctggctgcctcccctcccgaatcccgcggaggggaggccgccgccgccctcgcgcccctcgggccgccccggcgccaccgccgccaccgcacggccgcctcccctcccggatccggcggaggggaggccactgctgccctcgcgcccctcatgtcgtccccacgacaccgccgccgccgcccgccagaagggagccggaggggaagaggggagcggagtggaggaggggaggggatgggaggaggccggaggagaagagaggaggagaggggaggaggagatgagggtgagtgaatgacgggaggtgtcacgcccagaaatttagcccaaatttccagactattttgtgtattaaatccctgtccaggaatcagccagggtacacaaaagacaagtaataaacagttccaaacgtaaataaagagtaaatacttacagaagaggctcttagtcctcacaccgaaaagaaagcagcagcagcggaaaaaggcgatcctagcggggcttcagctccactcctcaggcaaaacacaactggggtttgagccttggtcttctaacttcgtcttcagctcagaagcactacacttctgaaaaggggaaaataatagcaaaactgagtacaaccaccgtactcagcaagccacaccaatgatgcagacgtgcaagggaatacaaggacagtttgttgctatttgcataaaggcggttgtaaaacattttattgagaaaaagggtaaaactgttgactaattagagtaacattaaatctccactgatcaacactacaccacgttgaacaggcccaaccatcccacctgaactacagtgcattgggtcgatttattaagtgtgagactaatcacggtgaatctggtcaatcgcccataaccgcgggcacggctatttcaatagttttactctggccagaggtgcactactgtacccacatgacacaatccatcggcatgtcaccgtgccaggccagacacgtcaccatgtcgagtaattgtgacaagacccttcatataaccccctctgaccaagcacaccacacctcaggtttcacccctgcccccagcaggcaacaggcagtcccctctcgtgcctaggcgaatcagaaagccgcataggccgtcgcagggcccatccgaactccatcacgctcacccttgcctggatgcatcagccagcggaaagctatacttcaagtcaggtagttacccattcccggttgtggcaagcgctgtatgtcttccagtgcatcccgcgaaccggtccttaattgccatgggtgcgaccagcaaaaccatgcacccacagcccaccattcagtcgcattttagttggatagttacgaccaatgaaacatggtcatatgtctcgagcacgcagctcgtaatgatactaaaaggtctaattctgcaattatcccatcaactgagctagtgataattaagcatggtaagcatatagttctagctagatcaacataagtgacacaagctagtcgaattatcacccacagttgacaaaggacagatatcaaataatatggtacaagcaagcagataggtaaaccctattcccatgtaattagcaaaacggtgcatatttatttgcaaacaataaaacatttataaattgggatcaacatgctcaaggggaatgtgtgacttgccttgcttcttcaaacaatcttccaaactcttatcctcgtgaccacgaacttccgaaacagtgaaatctacacgctggcacgcaaaacgaggaaaaactctaataaagaccaagcaaacagtacaataaaagtaaacaaacatgtagagcccaattttagatgaattttgcaagttgaatggctcaatttggagttcgaatgaatttgatatggattttagaagttctgaaccgtttaaatgaatttctagaattattaacgaatttattgcgcattaaattgattaatttctcaaaggacaagggacgcgttgagtcatcaaggggaggccgacgccgacacgcgagccccgcacgtcagcggcacaaaggggcggcgcacggtggaccaagtccacacgtgtcctcgggtgcgcgtccaccacatggacgacccagatcggcccaagccgatcgggcggccgaggggagcgccggccaggggcacgggtgcggcacaaagccggcccggccaagccaaggcgcggcgtcggcacccgtccactgtcggtagcaccgggcgacgcggaacggcagcgggcggccagaggacagcggtgcgcacggaggatggcggcgcaccccaagaggcggcggccggcaagaaagggggacaggaaaaaaagggggagggaggagaggtcctcactggaagcggcggccggcgcggaggatgatgatggcgacgacgattgcccgatggcggcttgcgaggatggagggcggacggggttgcccttgacctgcggaaggagaagagggagttagggaggggaggaccgatgcggggtgactggaaatgaaggacgatgacgacgacaagaggtggagctcaccggcgaacttagtggatgggtttgagcggcggaagacgacgaccgagcagcggacgaggtgcaggcgagcactgcgaacgcgccagcggcagcagcacggctgggcaaggtccccctcactggcgaggagcgactggagctctatggaagtggaggtagctcggctccgcggtggggaggtggttccggtggtgaatgggagggatgaggcggcgacgaaaccggcggtggatgcggcgcagtacggcagcggcgggagcggcggtagcgcgcggctggaggcggcggatggcgatggcggctcgggttcgcagtgggaggatggctgcagtgatggaatggggaaacagagcggaggccggggtgcggcacggcgaggcgaagccgaaggaaccaacggtgcggcgcggcggtggctacggcgacggcggcgtgcagccggagctcgccggcgggcggcatcgcgcggagcagcgtggggagagcgaggaggagtgcagtgggttcgggcgaaatgggggaaacgagagaggatgctccggggatcgtttatatacactcgtggagggggaatcgtggccgagtggggcggcaacggccagtgaagtggcgaggcatcgtgggatcgtgggggccaaatcggcgccggtttttggggaaaaacgagggaggaggtggaggagaggggtggcttccggtcccacgcgagagagggctcgaggaggccaggaatggcggcgacgtgggcggtttttagcggccatggtggcaacggcagttgccgacctaaggttggggatgataggtggggtccatgggtcccatctgtcggccaaagaggagagggaggccggctggggaggcaaactagacttctgggaggagagggccgagcatggagctgggttgagggaaagagagagagcccgagagagggaggggcgcgctggccgcggggaaggattcttgggccgaaaatagcccaaggaggaaggggagtttttattttgtttttcttttcatttaaattgattaaatgaactttatgcttttaaaattaattcctgagctccgaaaattcacggaaaaatccggagagtatattagggcacaaagaatattacaaaatattcttggtcaatgatttttaagggaaatttttaattttcccattatttcacttgattaaattgctttaacttttctaaaatatctagaagatgcattattaattgatttttaatcccgaccgtaaatcggggcgttataggaggagaggaggagaaaggagataaggtggaagtatcaaggaaggacgcgatcggacgagtagagtgtggctcggggccgatttgtagtcccggttgtttaacaatcgggattaaaaatagatctttagtcccggttggtgttaccaaccagaactaaaaatagtgaaggggtctaacaccgcctgccatgttttgagctggaactaaaaatgatctttagtcccgcttggtaacaccaacctagactaaagatcaaaaagtacccctgaccttttgaaccgggacgaaagatattctttagtcctgattcctacacaaaccgaggttattgtggattttagctgacccgtcaaagatggtttctctacactattacaatacccatttttccatgcggtggatcagcccgcctgcaacgccgcgtttgggaaaatcgatattttcgcgtgcgggagggctgaccgcacgggataatatattataaattagccaaaaattgaccgagctcaattataaacatcaaattacgtagaatgtatagtgtttgtaatattacaagtttcccccgcgacaaataaaccttttagaccatagcatgttccctctcccacacccttaggttcttgaatttggggtccgtagcaagttcactatgaggatcgtggaactctcctagatggttacagatgtcgcaacgaatgaactggcacaagtccatgcataagttgatcagcgttttctgatcgaaccggattgcgttataagggatgctcgggagctatggaaagtaaaagacaaatgatttgtgttaaaatcaacttaaatgaaatatttgcaatatctaaggagcatgaggacttacatctgtaaattcagttctgtatctcccacagaccctgagcatctcgcacacttaatatccgcataggttcgacaagctcggttgcttgtaacactgcattagaatagtggacacgtcagtagtaagaattgacaatcgtgatatacataacgaataaatgttgtcataccggccagcgtccccttatgtagagtttgtctctatttggattctttccaaacccaccaagtttcctataacggccgtgtgctctacaaagataaattaattaattatgctgactccacttattacaaatgatatttacagaatattgggggtttgtttcgaacttacaagttcagcaagcataggaactccatgtacgcttgcttgtcatagtctgccggatcaagaactacgacggtttggtccgttggatagacgaggaatagtatatagtgattgctgcgaacacggattattaaattatgtaagacatatttgaatgtgcggttattaatatgtgaacggaacgaacaggtagttgcttacccaaagtgataggggaccatgatgactcgtttgtcagagtgagagagcattgagtgggccaagtaatttgccacctcggccatctttctcttatgcaaacattcgacgtaatcttttttctcctcgtctatcttattctttagtaccgtactattctccgatatccgcacagtgtgggtcgtctcgcaaaccatcattgggtttacgtatgcaattgaggcccccattctttgggcgtctacccattgtgacatgaggaaatttggaagttagaaagactatgatgccccttattaaatgatgtataggtaagagtggaagggcagtagagggtaaaatagcgagaaatttgaatgaaaagtgattaatgggaccattagtactctattgtgacaattgttttgggataaattcaaatcctagaaatataattattttgggacagatgtagtaagaaagaacatccgaataggcaaactggaaacctaaggagaattcatgaggaaaaaagtttgaagagctagcaaaatcattagtgaagtatcttccttgtcagtctatttcagcgacatcttttaggccgatgttgggcgtatcagctgcgcctggcttgaatgaggagaggaaggacccgacctctagctctttacttttactgcccttgtaagggcgttgagaccatagcgtgttacacaaaagcgccaggaaagacgaatatgtgtgctcagcagcattctagtagcaaaaaaacattttttttcaaacctttgcacgcctccgttaccttttgggaggcctacgccgaaatagtgtgagttactcgctcgttatttttgtgcaggattgactaaacagctttcgtagtgcccattttcgttgattggcgagttaatacaggaaaagaaaaggctgtaccaatcatgagtagtaaagcggtaccagtgaattttttgctttttcagtgaagtactcttgcttaacttttgtccataaatcccgtgtaagcagtaaatctcgtaattctcaataggccccctttctgttaagtgaagtgaggcggggtcgccgaacgaacgacgttagtttacttgcacgcaattaattatcatctttgaccacgagccattctagacagtgccgtcggcaaagcattttttaatggttttggtagttcaatttcacgtcatgaaagattagatagcaaccggtataggctctagttttcctagagggggttaaacccaccccaggtagagacactcagtctaaatgcccccccccccccccggtcnnnnnnnnnnnnnnnnnnnnnnnnnntcctcgttagaaaatacattctaggagtaggagactcatccttctatacgttacctgcctggaaacatgtaagttcatgtcccgcaagttagcgaggttggtcgggcggagactctcgaacgaggaaaaggatctcttcgaaagaattgaacgaggagccgtatgaggtggaaatctcatgtatagttctgtagagggacaggaagggagacttatctgtcgacttttccactataaccccaaaaaaacccaactatgccttacggaaaattgccagagtacaattaaccgtaggatttgaaatcgctgcttatatacctggtattggccataatttacaagaacattatgtagtattagtaagaggaggaagggttaaggatttactcggtgtgggatatcgcattattcgaggagccctagatgccgtcgtagtatagaatcgtcaacaagggcgttccactgcgttgtagattcttatccaagactttatcatttgatgatgccggccaagaagctgccagctgactgcgccccttcaacccgacctttattcactatgcgtccaagctcttggaaccaaaggtatgtatgagcattctgggaaggtcgcaagaagccggttttagaaggtttggagcaatcgcaatttatcatcatattattacccgtttcaattgatgactggctaatatataagtgttccatcacaaattatttttggttcctcaattacagcttattctttttttcgaggagaagggaatatattactcaactaaagagtcctcacaaacaaaatgtgagatgaaattacatttatcatccggtcaaaactcagtaagagattcacaccgggctctgttagctagagtatggctaacattattctgattttgctgaatcttcgcgatgatcacttccatgtttcctgataacagttcttctatgtccctgacaatgaatgcaagttcagagcgccctttcatcgcagattagatgaggttcttctccaccaaacaatcagtctccactataattggaaggagtgtccactgaagaaccaagttaataccttccctataggcaaggagttctgcctccaacggactgctgcaccggtcaagaaaaccacaagcaaaaaaaaaaaaattaccatccccatactgttctttgactactgaatcgagatccatatattatttgtttcatgctggacatgtggactcgagaatattatctccgggatcagatcagataataattttgtgcattttgccttatcgtgacttatatcttggacgtgcgtgctgtaaattgttaaactactacgagtcatggtgtttttttaagggtttgctgccagcttccacagatgatacggatcggatgctattaatatgttggaaactactaccgccgggcgcccgattgggggtgggaaaaaaactattttttctcttaaattatttatccaaatcatgatccgattgcaccattaaatttgttgcaattaaatatttaaaacaagactacacatggatatattccgatgaaaaaattagcttattattgaaatatttttaaatattgcacgttgttccaccaagtagatcagaattgtttcactgagtagatcgaaaatgtttcaatcgtttaaatcgagcgttgtttcaccttatataaaaataatatttcagcaaatagcgaaagaatgttttaagtccctgcaatatttgatccatacatagtgaaacattataagtacactaggtgaaacattttttgtggaacaaaaaataaaacgaattcccttaatagagggtttccataatatgtgggtgatttgttgcaaaagaatgttttaattcactgcagtattagatctatatatatatagtgaaaaattatgattacactaggtgaaactttttggtggaaaaaaaatgaaacgaattcccttaatagagggtttttaaaatatgtgggtgatttattaccctcctcccatccatcccaaccgagcgaccgattgttgatggtccttatcgatcagtttcgaccgtcaatattactaaaataggagagaactggtgatgcttgcaatgcataaatatgttagagtaataatattccactagtattaggtttactaaccttttgcagagaatgatcatgtagtagaggagaatcgacatcaactcagacgataaatcaatcggacgatgtcgagaaccagacttgtgtatgaataggccaagaactcagaattgaaacgatgaattgggccaaaattcataagtctgcggagtagagcaatagaggaggccaccagccgaaactgggctggatagggcagccccaggttcggccgaaccaatcctggcaccgttggatccagtttttggcatggacattcaggattgcatcccaatgacggttggagggcacttaggacaattccccttccacaaccatcataaccacctgggcacttaggacaattccccttccacaaccgtcataaccacctctatataaggagctcactctcttcacttcaacacacacctcaagcaatagctctctcattcctctcaagtttagtttagtagtatctagctggtagaatagaaatagaatgggagtcaggagtccggaaaccttcggaagagttcgggtatggccctagcagctttcctttcctcttttgtaagctttgtacttttattagaatactcttctatatacatttatggtattgaaatactttccgagtatatgagtacctactttacattacgttcatgttatactgaatatacggctagcttatctgggagatgctttggtgcgggtatagtgtttgcttatgcaattactctatgtcatgacgatgatattagagtagtacctagtagtttagacgtggtgtctagattacgatatatcattatttggggttatatattgcggatgagaggtgggccgctgatggtgacagctcaatacgggtattcctccgcgcctatatataatcctaagttaatttcctagggagggttttcctccgtatttagccccggttggatggtcatgatgggctgtcgtaaggaactcggcagtcaggggtggcttttcgaagtaccaggagggcatcgaatagagggtgttagctagtatatcagttaactagaatggatgtatactatgtatattagaagtataggaatagatttcttttctcttttctttccacctagcttagattatttattatgaggatgagcagaaatgcttgtgtgtcactctacccttggattatcttaacccctgcttagaatatgattatcacaagtaatatataaattattagttgagttctctctacatgattttcccacggaataaaataaatacgacacccttagaatactctcgggtgaaatgctacaatggtataaccataatatactagaagtgtttctgcaccattgctgggaattatatttctaataatatcgttaagaaatactaacaccgattcggaggattcccgtaatatgttggctggcgagtttgattcattaacttcatcctaaccacgttttctaaattgttaaatgttaaatgatttatttttgtgaaaaatgttatatataaaaaagtttttaaatataataaaacaaatctattttttaagtgttaaagaaataatcattcattagttgttagtgatttatcttgtttctcatgaagcaaattaggcaagtgggacagctcaaacgcattctagccatacgagggtggcgcctcctgctgacggcacaactgctggcggacggccggtgtggtcggcgcagggaatccacacggcggtgccagcacggggaatgctgcttctgcgctcttagtggttggaatataaatgtaacggtgatgataaagtaggataaaattgtatataggatggtatctccgataactgacttatattgagtaattaattatgtgcttctcgatagcaaaaacatatatcttctaaaaaatagtgaggttttcttacatttatatatgtatagaaagtattaatctgaagcaggcaatcagtgaaaaccggcccgtttggctcgttggaggcagtcaagtaataccactgtccactgccaccaccacttctggagttctagtggctcatccaaatagcggattgatgtttgttgttagtgaatttattcgctcaagcaataacatgagctttgaagaagccattgatgtcgccgcagtcgctctgtcattatagatataggcattggtgatgcagaggttgagagtcggcatgaggaagtcctcggcgaagtgcatctttgagttagtgaagtagcgaatgtcagtgatgcctatgatcagcaacctaaaacaccggtcaaggaaaatgaaacactggtaaaataggatcactggagtggaaatttccttcgacctccctttagcgcttggttaggatcggaagggtttagggcttgtgaggaacaggaaccatgtcgagagagtagtcattttctcgtacgaggcttatttctcttattcctcttaattccattggagtttagtgcgagtgatccaatcaacgcgcatgttgtgcgcacgagtccatagactcataccttttctgttgtagagatcgtcgaactcacgtgggccatgccgcatgcctccatcttgctcggatagccagagatcatgacctagcatttgcatctcatagaaagaataagaccgaatcaatgatccgacgtgaccggcacctgtcttaaaaccggcacttatgtgtgggacctatttggatatcgaggtgccggttttaaaaaattttgcgcgtgggtgcaagggtgggaaaggcattatacgtgtcggttttacatactccggcacctatagtgccgatacctatttacctttctgtagttatgggtgcaaacagcgtggattgacaagaaaaaagtcaaacggaattggtggaaaatatgtgacagtcttttcaccaagtatttcaaatttatattcatcatatagattgaagattcaaggataactgaaaaataaaaattgcataacccactcaggagtgagaatggaacccacgccatagagttatcaacttgcggcgctagccatctgactaattacgagttttgaaataaaactaggaaggtagcccacgcattgcgcgggcatgtattttatattgcgtttgaaaagcttatataaacgaaatatcaactggatgaaactaccatgtttcaaaagtactatttctccataatttttctcatgcatttcttagataatttatccaaactttttgttaccttttaaaacatataatatttaattcattcatataaacaattatctatggtccgtataaaaacctgccatgtttcaaaagtatctatttaatttgtttggaaaacaatctacaaattaaacgtaaattaaaagcttgtttaattgaatgtttagtggtatttttcaaaaaatcctaaagaactattgttgttagtaaataaaactatttgtaccatcaagttagttctctttttagttggttcagattcacgcaagttgttacatacatataaattaacaaacacatatcatatagatcctcacttccttgtaatatttatgatctatagtatctcttctataagaaaatatagtcaacatgagtccaaaaaatttaaatgtaatagtaacaaatatgtaagcattaatatgtataggatagatgcaaggccattaatatgtaagcatttaaaaattattataaaaatggaacatgtaatggttggtccaattttagtgcaaagtacaaacttatttgatttttctccaaatagttcaatttagtgactattgatatgttatttttttagttttattttatatcagctcaaaacataggggttatggatctttaaattgttggtttagttatgaatagagcaatagttagattagaaatcatatgtgcaacttaaaaaatatgcatgttttaataacattattgattttctcgctataaaaaaaggagggtagaggagagagtggagaacttgaggtgagaggggagaggacgggtagtgctatgttgtgcacatgtgaggggagggtgaagtgcacgggaatatttttttctaaatgatttaattgaaaaatgaagatccttattttatcaaaatttctaatttccttttttttcaaaattttaggatgtaacacatgatggcttaagattcgggtagtattgtgttgtgcacatgtgaggggagggtgaagtgcatgggaaattttttttttctaaatgatttaattgaaaactgaagatccttattttgtcaaaatttctaatttccttttttttctaaattttagaatgtaacacatgatgccttaagattctaaaattatatctattggtttaaaataatggatccacctattaagtgaaacttatgagtagatatattttcttacaatttctaaggttttgtttttaattaagacgtacatgtgatgtacgtacatgtgatgtacgtcttaagtgcgctgcagagaataaacaatgatttgaggtgacatattacttattgtaattttttataatgctttgtttcttctatttggttatgatgcataaaggataggtgtgcaagctcaggtggtgtttatttttatacagtgaaatatgagtaatatggatcttaacttatttatttataaatacattaacaattcaaataaacttttaaaaatcagatataacataagaatcataattatttagcttttgtaattattgatcatttttatattatgctattaattagttaaaaattataagacggaagagttgagtgggagaagagaagaagagaaagtacgcacacatataattatgttttatacattttatagtgtttatttatatgttatagttagctacaaatttagtcataaataaattgaaagatataagcggattaaaaattagtggtataggtcgtgtttagttctttggccaaaatttttttgagtgtatggacacacatttaaagtattaaacgtagactaataaaaaacacattactgattctgcctgtaaactgcaagacgaatttattaagcctaattaattcgtcgttagcaaatgtttactgtagcatcacattcttaaatcatggcgcaattaggcttgaaagattcatctcgcaatttacatgcaaattgtacaattggttttttttgtccacatttaatgatccatgcacatgtgtccaaacatttgatgtaacatttttgtaacacccgtatttctgttgcttttatttaaaaagttgtcatttacaaatttggagttaaatttggttcttaattgatttttgtgccaaaatggatctcaaatcctctcctagaaattcccttcaatttctgtgaaaccctagtccaaattcaaattcaaatcctttcaaaatctcctcaaaattcaactctacaaatctctggaaaaaggtgaaagttcactgttcaactgggccgccctcccctttcttttttctcggcccaactcccctccatcctctcctctgttcttctccccttagcaggccggcccagcccagcccgcaactcctcaccttcttcctccttgagccagcctcatccacgcacacaaggtgttcgacagaatgccgacccaagacgccgcaccgttttcgtgtcgtggcagcgccgcgtcgcactcccgtgcaccgcgtgtcgtgccaagaccacctccgcaccaagccgaggccgcgccacaccaaaatcgcgtcgcgccaagccgtcctcgccccggtttctgttgacggtcattatcgatcagtttcgaccgtcaatattactaaaacaggagagaactagtgatgcttgcaatgcataaatatgttagaatagtaatattctactagtattaggtcttctaaccttttgcagagaatgacaataaagtggaggagaatcgacatcaacaccaacgataaaacaatcggacgatgtcgagaaccagacttatatatgaatgggccaagaagtcagaattgacacgatgaattgggctaaaattcacaagtctgcggagtggagcaatagaggacgtcgccagccgaagatgggctggtttgggccagcccatggttcggccgaaccagggggttcgggcaaacccccatctccaccgttgaggccagggtttggcatggacgtccaagattgcaccccaatgacggttggagggtacttcagacaattcctcttccacaaccgtcatacctgcctctatataaggagctcaccttctcacttcactcacacacctcaagcaagagctatctcattcctctcaagtttagtttagtagtatctagctagtggaatagaattagagtaggaatcaggagttcggaagccttcggaagagttcgggtatggctctagtagcaattactctatggcaagggtagagtgacacacaagcattactactcatcctcataatatattatctgagctaaatggaaagaaaagagaaagaaaatctattcctatacttctagtatatatacattctagttatctgatatattagctaataccctctatccgatgacctcctggtacttcgagaagccacccctgattgccgaattccttacgacagcccatcatgaccatacaactggggctaaatacggaggaataccctccccagggaattaacttagcattatatacacacgcagaggaatacccgtattgagctgtcaccaaagcatctcccagataagctaacagcatattcagtataacatgaacataatgtaaggttggcattcatatacttggaaaatattccaatgccataaatgtatatagaagaatattctaataatattacagagcttacaaaagagaaaaggaaagctactatagccatacccgaactcttccgaaggctctcagggtaccagctcgattcaaaaagtgaattcatcacact

SEQ ID NO: 62838 - DNA, 54483 bp, Oryza sativa
gttggaacggcgctggtacttctcaaagaccacgtgcttgatctgacggggcagccaagcatgctactgcagttgtcgtccaatgcttgaatctttctgccatagtcagctttgtaacagcagaccacttttgttggtcgcgttggttgctgccactcaaagagcaccgcagtgcccgggtgactggttttcagtcccgagcttcgctccccagaggatgggatgtagatcgtgctagagcctagaggaggtggctggcgccgcagtgcagctgtgtttgctcaccagaggaggaactgtaagggaacaagaggaagtcggttctggagatggctaggggcggtacgatggctattgaggatagaggagaggagagtggaatgatggtgctggaggtgaagggaggaaagaggcgcggccatgcggtgctggctaactcagttgggggagttggcgatggaggagagggtgtctgcggctgggggagtttctggggagagttgttgagatagctagtgttagcagattgtagatgggctgggcctttcccagtggagtacggcggtctggcaggttgtctggtaatgtggtatacccgtgctgtattgatggaaacgaataggagatgttaattagatggaaaatctacatcgatatggcaacagtattcagtgcttctggcaagctcaccaggctaaaatggttttctaattagataattttggacttcaaaatgtatgtgaaactttttttaggatcccattgcaacataccggcaatcacctacgtatgtgaaactaattctttgagtttcgttctactttatctttttcatgcacatcattgctgatggtatatatggcttgctcaattttggtgagctctgggttcccctaaatcacattttgttaatttttcagcttcaggcaacatccgccagctctactgcctgcaaggcgactgaacatgcgatcatctgctttcataaaatggacctgtttactcaaaatattcgaccgtgtcggttgaagctgaccttactcccaggtgcgaaccaataatgtaaaaaaaacatgtacttcatcctatttctgcaaagtagtttgatgtatttctccaattcttttcccatttgctgtggcgtcagtcgttgggatgtcatctttcttttcattttctggtgattacacatttttggcccttccataaataacacggataagccagtgtaatagggattaattaattaattaattatgaaccaactttggagaaatgacctatataaacacttgatttccccacgtggtggtccacatatcaaatcattagcattcggtttcctatcatttcccttgttggtatcttaattatgtctcgttccaaatgggaaatgattttctttccaattgaaatatgaactgtatatagcccgataagtgggatttgcggtgccgttgggtcacatataatgcagatgcatgattgagtctctactgtactatgcgtggctgcgtgcagcctttggaccaggatccaagctacagtccctacaggagaagtccagacagcattcattcatgtttatgtgctcctaaatataaatggatttttgttggatgggacgtatcatagggctgcgaatctagatgggaaatattttcagatttataatactagaatacgttttatctattccaaaatctattatattaggtcggagggagtatatttgtatgagcagcaggtataaatggacgtttccggtttggtgatctgcatgcacaaacacatgcagctagcgcccaccgacgaggattacatgtatacgacctccggtcctaaatggtacacattctaaggacctgttttattatttcttgttttcaaactgttaaatgttgcattatttaaaaaaaattatatatataagttgttttaagaaaaccaaataaattcagttttcaaatttataataattaatacttaattaatcatgtgctaaggaggtttctcgttttgcgtgccagaattgtggagatcgaacggggcctaatactatgggtgtgtttagttcacgccaaaattggaagtttggttgaaattggaacgatgtgatggaaaagttgaaagtttatgtgtaggaaagttttgatgtgatggaaaagatggaagtttgaagaaaaagtttggatctaaacaagggctatgaatcagacagattgtttaagatatgtcatattcgattataggttgttatattttaacatggatgaatcagacagactattcaggatgtgtcactactgaagaaatgatctttgttgggtcacgcaaaaatcatattattcccggtttgagtaagaaccaggactaaaaatatctttagtcccgatttaaaaatccacaggtactaaagataaatctttagtcccggttgtttataccaaccgggacccaagctctaaaaaccgtgaaaactcctgagccgcgcgcgctgtgcctctcgtccttatcccatcctcctctcctcctcccctctcattttctctctacctccccctttcttccccctcctcactcctcctccgacggcgacggcggccaggaggtggcggccgggtggtggtagctgggtgcctgggcggcagatccggccgggaggtggcagaggtcaggaggaggtggccgggcggcgccaacatcaggcagccgcgaccgggaggcagtggctgggtggttttgtgatttttttttttagatttagggatgattttgtgaatgacttggggattgtggatgatttttttggatgggcaattgtagatgatttgttgtgcataatttgtgaggatttgagggtgacaataaatggaagcagaaagaaacaatgaaccaatttttccaaaaaaaaaaaactaaccaaccaggactaaagatggtagcgccagccacgtggtgttaccatctttagacccggttggtattatcaatcgtaactaaagatttatcttttctcccagttattttaactgggactaaaatgggtatctttagttttaaattggacgtctcggtttgcaatccgggactataaggggctataaaccggaagtaaaaagactttccctattagtacgtacattctgatcctacacatcttatctgaccatacatggttctacaggcaaattgatcagcctccctcgtgatgcacggtcaggtcgatcgtatgcacgtacaaagccttaaacatgtaccagctagctataggcgcgttgtggggcatgcagcatatcaatgcaatgatgcagcatggcaaagggcttatgcatgcatattcgatctttggcgatcgatatgactaattacgtggataaggcgtgtacatacacgtccttaagcgtcttctaattttaacacacgcttaaattatggtttggcgaatggtcaagtgtgtcaaatctctacggtcctgtttccaagatacgaagattaattagcctgtgacggtgaatcaataacgtgctagcgatgatctaaagacacgtaggcttacctaccttctaagggcatgttcaatgatagagacgtgtatggttttttaaacaactatgaaggtggcccacgcgatacgcgggcatccatgctatcataatagaaattatattttataagggcaaactataggtcgggcatatctgaaaaccattgacttagaagatagatcaaggtcatatgacatttgaatttacttttggactaagtgagtaaatatgatgtatacgcgttcgcgaaaagtaaatattatgtacaccatttaaacacatactatataatattgctacaagtaaaaattgcgatagcaaggacttaaaattattgtgatcgaatcgtctcatgaagatgcacgatttagtgacaaccaaattaggatagattaacggttggattgtttttcccttcgtagaagttcaaaattttcatattcttttccaaagttttaaagaatttttgttaggacacaaatcatttgcagaattgctttgttgggtagtgcaaaatatcagcaattgtttgaagcttttctttttttttctttttcgcatgtttgattgttttcttcgaaacgatatttgtttgaaataagagcaaaattatataaatttaattggtatgtatagtgtttatcggatcaccatatcaccttagctgcctcaggtacgatgcttcatcacacgtgcagaaggcaaacatacacatgtgcgtggtctttagaagtttcattttacttttataaaagatagatatggcatgcttgttaataggtccttaataggtctaattaatagatccatcagtttaagtgaaaaccgatatcaaaatattttgttaaaaatagtataaaatagtgggttgagtaattaatgtaaaatattagttaacatagatcataaatgggcaatttactggtagagaatattattgcgtaacatttatattaaacaacatgtttttaaaattttcatataaaataatgatttgatataatagatgcatcggtttaagtaaaaaaaatattatattgttaatataaatggtaaaataatatagttttataaaaattattttcaaacatttgtgaatctaatttagacatatatatatgatgatatatataatctatgtttataaagttataatttcttcaaatttattaccactactaataattacaatttcgtctatacatgtagaagagaaagaagaagaaggaagcaaatgtaatttttaatgacataatttatatttttatgtttttccactttatctttttaaatgtgtgttgcagttgtatatgtattttcagcttttttacaagttgtaagtacgtacctttctcgtcggtgcgctgagagagattaggagagagattataaataggatttaatctaatggtcggagataacagatccatcaatttaattaaaaattgatggctagatattgtagttttttttctcacattttctagatttttttctaatttattagagtatattttaagtttaatacgaattttgattttgtatctcatctaacctagaagggaaaaaaaggaaagaacaaagaggagggtaggtacatatgtacgtgcacgtccatggagtgatagaggactttgggtgacgctaatgggcgatcgatcgcctggagcgatcaacctccatcccctcgtataaggtcctctcccctttcctcctccccttcttctcttcctactacaacataatttttttaaaaaaataaaaaaacaaaattaaaaaaatttatgtatagaaatactatatataaaaaatatttgaatttaaattcaaatttgaaacgggtatgtaaacttttgacttataaactttgggtctataaactttaggtgtataaagtttagatgtatagaaatactatatataaaaaatatttgaattcaaattcaaatttgaatcggatatataaacttttgacttataaactttaggtctctaaattttaggtgtataaactttagatatgtaaacttgaggtgtacaaactttaggtgcaaaaatttactaaaatagaaaagtaatgcggtgccaaaaaaaatcacgtggagaagggggtgatcgagcctggcgagcgatcgcgcattaggaattttggaggactttttctacaagtgattctttttccagatgagcgtaatttcaaaatcttaagatagatctatgttagctagaaataagggagaagggaagagttgggggtggctagagggagggagtacgtgctggctaccggaattttgtattttagatagatctaatggttaaaattaatggttcaccgatttaatgaaaataaatttttataatttattataactccatataacaatttaggagtgtttttagagcatttacattgtacatgcccttaggagtctcacgtggcggcttgagagagtttgtaggaagtttagatgttaggtgctctctaatataggccattcattttctttaaaatccatgcaaattttataagtagggtgacgtatatatacaagatattctttttggcttttttttgtcagtactatgtattcgtgtgtacgcgggattttttttgggaggaattattttttaatagatgtgatctgatgctataaaataactggttcaccaatttaagtgataatcgaaggtcggaatttctagaatctcctattataattacataattttaatacgaagatgaatgatcaaatatacactcactcaaacaatgtcaatagcataaaaaagcagggttttaaatctcctgctatagctgtttgaaaagggttttagctatttgctctcatgtataatttagccgctatagctctatttaacccactatagctgccgctatatctgtttaagaagctaaccgctaaatgtattagcccgctatttaaaacatcctaaaaaatagaggttgtagggtaaaaaaggggtaaatggggagagtgaaagaaaggagggcacataccttacctgggtacaaacgggatgaagcaggtgtacgtacacacggtgagatgagagggagggactaactcttcttttaatctaatctaaatctaaaataaaataatagacccaccaatttatatctcacattgtaaaaatatttttattcatcagtgaataatggagtaagtacgtacacaggatgattctttttggcttttttaggtgaatagtgctatatatttatacgtacatggtttggaaggtattatttttttatagatctatctaatgtataaaataacttgtccatctaatttaacgtgaaaatcgaggattgaatgttttattttattctcaaaattttttaatactaagatgcatataaatatacgctcaaaaatatcaacggcataaaaatgagatgatataaatactcctatattgtaaagtatttcagacaaaattaaataaaaaagtttggggggagttaaaaaaaaggtggggcacgttcaagtatgttacatgcgtgccattgggagggaggcgtacgtacgcgctcgtcagatgaggggtggactaattaactttttctttaatctaagctaatctaatggtctaaaataatggacccacctatttaagtgaaaatcgagggctagatatttctaatatattagaatactacgtggcgatctaagagtatttttaggagtcccacatggcggcttgagagcgtttgtagaaagtttaatggacctttagtatataatagatacagattatttagagacgtgtctttacaatagttgagacgataaaggctctaataattaactcaaaaaatatttcttttgttaatattatttttatttttttatcctcatgcaaccatatttccatattatagtgattaatagttgttgttaagccgttgttatgcataacaacaatgttttatctttactctttctctttcttccatgtcaacaagtattcctaattagcaatgctaagagaccactattgacaaccattgtacatgccctaatccctattttattttctggattatgtagcttagctaccgagtgacagaatatctgaacctggactatttagaagagagttgaagatagtaatcgttgtagctaatataaactcttccaaatagtgctaagtctgacaaaaattaaattactaaaagtatatatgcataaagttcaaaaaaagtatagctgcatatatacactacttaaaaataacttttgcaccgctttcttcacatgcggacctgtatataaaaagatttaggaggtgtccaataatggcccagctacaaaaatttattttcacagccagatctcttaagaggtttgcatgcgaattttggtacccagttggctcccactccttttctctcctccttgcgttaaatcatttcttctccctacttatccctcttctcctcagtcctctcgccctcttctcctcgaccgctagatccggtgatggtgaaggggtgggtaggggaggctatggatcggacgcgtcgaatttgtcgtagcggggagtgtgacggtggctagggtggtcacgacgacaacagcagccttaagggcggtgaattcgtcaatcgtggccccgatcagggtggatccagtggctatggcgactgaggggcagatccaccagcgatcttgcccctccatcgcttttccccctacctagtaaatatgactttgtaaacgtggcagagtttcatgtgagaaggacacttttccatgccggattgaaatacttttttttggcggttaggccaactcacaaggaaatgttcatatatataccttagcattataaggaaaaccctaaagaaagtaagtatataacattggcggtcaattttaaccgcattatcgagtaatgttggctgttttattttggccccaagaaaattaattggctgcctgcttaatcaaattatacgctgcggatgctctgatcccttcatgattccacaaatgctggtgactagccacacccttcttaaaaattaatggcattgacccatcacgggacagcttatatatcatcgatgggcatatggacatatgggtggacaaaagctcaaattaagctcgtggctttgatcggcttgaactcgtttcgtaacgagttaagctgagctagacttttagctcgtgagttataatgagctagctcacgagttgcttgttagtaaaagagataacaatatatatctttatatattccatgcttcttaattagtacgtagtctttaatttacattcaaacttttgtatttgttgagccttttcttagtcagcttttagactatatatattaatacgtgataaattggtaagtttgaaattataaaagtgatatataaatgtgttaacgagtttaacaatttagctcgcgagctgagttgagctagacttttaacttgttaaggttagcgagctgagtgaactgacttgtgacttgtaaagataacgagttcaaacgaacctgagctggcttattatgcagccctagatgagcatcttcggatgcagccacaagagggaatatatcatcaggattttcagtaaaagaaaaggagagagagatcatcaggattacaaggtagtccaatcggcccctctactacttcaacagctgtcgttgtaaattggtctattgcatgtctacgtacacatatatacaagcaatgcattttttttaaaaaaaacacatacaagaagtacttcattagtatataggtggtcacaatccatatcctctagaatgggatcgatgtatagcacttcaccacacaaattctttctatatgttccacatgactatatgaggctctagtaggagaaggtagctaggatgtaagccatacatatatagcttaattaaggttgtacactactcctgcctgattgctgctgtattattggctagcaacatactgatgctttgcaagcacatcagctacaactaaaaaattaattttgagtaaatttcataaaactacatatattttgatcaaattatcacaaaactatatatttaaggttatatatcataaaattacagatttaaaattaaatttatcataaaactacaaatctaatatggagtattgcaaaactacagatttaataagaaagttatcacaaaactacaggtttcagagtttagatccttagcactagtgttatgtttgagttataaacatgtaagttttgtaattaaattgtcactaaacctgtagttttatgataactttattactaaatatgtagttttacgagtactgtgaaaaatttagtgttaaatctgtagttttgtgataatttgattaaagtatctgttgttttataaaatttactctttaattttagagacgattttaagtttttcatcatataagtatattttagcgttgtcttttaaatcatcaagaatacatataatttttactgataagttatttttgttaattgttttatttatttatttttaatcggtgaggcacatatatattagtcagtatcactagcacatattagaagacaacagaacagcacgcaaaatctatagaaaagtttgcaacagtatgtatgatctgtcaagagtcgctgtgatgacagcgaaatttttgtataggcatctcccggttgatggaagaatccatgcacagcattttcagagatacatgtgccctcacacgaacggctgcaacggcttcagcatgattaggcctagccaataatcaaaacgtactgtggcttcttgaatatttaatttagaactttattcgagggttttttttaatttcttcgtcatttccattgcttggctctcttttcatgattgttgagaagataaattttttttaaaaaaactcccctgaaattatatctaaaaataaaattttagaatacaaatcgctttaaattatactacaaaggtgaaataagcttgcaggcctatcgttgaaaaaaaaaacttgactagagaatattggatgataaattacgcttagtctggttacttccaaggctacaaggtcaagccactaaagaatattgaatgataaacaacacccaatctctagtagtctcggacatggaatgcaattttttttacaagaatgtccctcttttccatctcaaaatataagacattactatcttttagaaaaattattatttataacatttgtctaataattaaagtcatatgttataactagatttgtatttagaagtacctatatgacgttaattttctttttaaaaaaatatatttagaaaaaatattgtcaaagtataatgttgcattgtaaaccgtgtaaacagttaataatgtcttatatattggtaggagctatatgagaaaaagtttaactcatagtatatatatatatatatatgaatgaaaatcttttttcacatttcaaacaggccgattcattgtcgacctcaaaagtgaaagcatatatggacatatcaacaacagtactatagtcacttcaagaaagtgcgaggaggccaatacgtacgggagcatgacagtacaacatgtatacttcacatcttttcctcatttgagatctctctgatgttatttgagaggaatatttttgtatacggcttattattaattcgcagccacatgtttggcagcacatgctatatattagatgttgtattatcctgcaagctaggactgcatgctgtgaaccgcaaagccgttcattggttgcacacttgtatataagcctacagtttgctactagtatacatgatatccaaatcatactagtttattaatgtgaaatctgaattattttatatctattcaatttaccaccgcgcttatttattaatttgaacatgtttactcattttttaaaaaaaccgaatgaattacaaagacatacacgtagtgaggcaccgttgttggtggctctgtatgaagaaaaaatgattcttctaaaatacctctttgccttgtcgcttgtgttatgctatatcggacctcttctttccattgccttctctcttcatccttcgcagaactagaattttcttaattctagagttgagctaccgtagttcgcataattttatctttattctctctctttttgaagaaaaaggaaaaacttacatatccttgcacaccagcactccaatctctatggttttcctttctcgattaattatagcttttaacacaaggttgcaatatgacgatgttagcggtattacacgtatgttaaattttaacttgatgagataaattggacctgcaaatgcttttttttttccaaattttgatggaaacactcacagacacatacaaccaaagcttcctttcctgatttgtccggtgtgcaaggtagcatataacctgttgctgtttaagggtccctgtaacgtgtacgtagctagctaaactccgggtaacaattttgtcctcatttattgcatttgatgtgattacagcttagactgactgaccggtcagtagattatagaaatcgggcagccgtactaattcagactactattagtgagcagtaacaataatccaactcaatcgaacttgaggcatcaccattcatgatgcatgtactttaattaaacactgttagtagttagctaaacgccggctaagtacagttttgtcctgatttactgtacctgctgatgagatgcttgagctcatgcaagacagctagaaacatcaccagtgcacgtgaaaaccaaaaggtatgtgggacgtcctgtggtaaataaaatttaattaacccagcacaggaaaagcaggagagttttattcttcggtgatagccaatctctccaaaaaaaagtatttgttgggtcctgtggttaataaaatttaatccgttctttctgtactattacagaaacgctacttatttgcatttttaatatatgatgccgttgatttttgacatatgttcaatcatttatcttagaaaaaaagtacgaattaccccccgaactatcgaggtcgaccgaattacacccccaaactcgaaaatcagacattctacaccctcaactattgaaaccggacaaataacccccccgactcaatccggagtggttttgggtctacgtgacaggccagtcagcaatttttcttaaaaaaaatcaatgggccccacctatcagttctcaacccacccccccccccctctctctcttctcaccagcacggcggcggccacgcgagggcgggagcaggcggcgctgccggtgacggagggcggcgggcggctgagacagaggcggagctcgtcgcgcaggttgccgtgcaagttgaggcggcggaggagcacgagtgagccgagtacggacggcacgtacccggacaggtttttcccggcgatctttcaataagtaaagccaaaaaagatcatatcaaagtacgacaagtcatggaatttaaatggaagacaaggagagaagacgattcgattttatttttcaaccagttatctttcactttaaaattttaaaacccaagatgcagcgctaagagtggttttagtggtgtttttttaccactttactaaccatcatgctattatatgccatgcatcatggtggctaatatatataggaaactgtatccacgtttcgcactgttatttccatcatttcctcgcgctaaagtgataagatagggagatgcggggaggaaagggaacaaagtgtatgatatgatgtgtccagtgttagctatttaatacaccctccattctaaattgatctacatatagtttttttaagattattactaaatgatatacatatttatgttcattcattaagtctatttgttatttgtgcattggagtaaatagacattaatgcatgcatccatgcacacaaatatttataacccacatgcaatatcttgatttgctattggctaggaaatagtggggatggtgcatgcatcgagtttgttgctaaagtaaatatagtatgagagagttattagtttttttggttttagtgtatctatgaaatatgtacatcaatttggaatggagggagtagttaattatagtggcggaaaatagtgttatatactatgaatcttaaacggagatttatgagccctattttttcacataaatgaaaatattaacatgttccatttataaccgcggaacaacgtacattattattacacaaagattaattgaagataagtattattcatacatatacaaatatctgtgacgcaatctataggatgtgatatacacctacgaatataagtacgtgaatttttttaaaaaaaaagaatcttggagtaaattattaacgtgatatagctagtttaatttgtgatagggaattaaggatacatagtcatgtcaccttcgtcatatatattaattattcactctcgatcgattgccaagtaattatattattaacacgcatgtggtaaacggtatacccacatacagtgacatggctagtctgatagagaaggatgtacagtcaagtcaccttcattgtcgattttgccaagtagagtaatttttttaacgcatggtaaaatggtagcttagacgtagacacatgtacagtgatagctagtctgatagagaaggatatgtacagtcttgtcaccttcagatttggcattggccattttgccatacacttgtacgtgccgattcacacgcttgtcgatctgtgactgtagtagtgtggcaagtctcggtctctctggcaatgaccctgcttcaattcatactccactggtaattttacatctatatatatccagccgtttattgagatagagacgtgtaacggggagagcaggccggtctaatccatatatgcatatttgtgtgaacgatatataggcacgaatttacaaaaaaatatcgggtattctgacttttaatttctaatgtttgtttttagagtaaactttataaaacgatgatttgaccaaactatcacaaaacaaatatgcgttttttttaaccaaaactacatatttagtgtcaaatttatcacatatctgcatatttaaggcatctacagattatgaggatattaagaactatacattttatagtttatatccatagcagaagtttagtttgtgataaaactgatgttaaatctatgtgattttctaatacaaatctattattttgtaaatgaaaattatgttaaatccataatttttgtgatacaaatttttaaatatatagttttgtgatatacaaagttgaaattaatttaatcttgtttttaatgcaaaaatttataaatactaaaaaagattacgtattacaaaagttttttttttgcttcatacgcattagttttttcttatttcaaccattttaaaagaaattagtgatcaacgtcgacgcaatattagcaatattgtttaaggaagggagtacttttttttgtatattgttggaattttatgttccctagcttgtgtcctgttcatcacgatagctacgtatatatatgtggaatcatcctgactcctgtggacgaaaaggtgggtcgcgagaagtacgttcatggtaatatcgtatgtatggaacgacgttttaccttgcgtgaagtacgtcttctgactacactttacaccattctttcatgaaagaattattttttttttcaaattcatcctgaaaagttttttttttccggatggagtacgttttaactttgcttgcgtagtacctatagtagatatttcggtttttgatttttttttttctctcccttgtccaggcagttgcgttttgtaattgaaatattttttttctaatatatcaacgtgtaatctttttacgcgttcgtgaaaatatacaaagagtcgtttttttttccatacgtaggacatatccgatatatgtattggtacgataattaatactgcccaggcaaagaaaatcgactcaaaatattgtacaaaccatgaagtgttattttttgcggatgatagcacggtagcgtaatcaatatgtagcacttggagattctctaatgcaaatgggctaaagatctagggaatgtcatttactctcggcacagtggaaaaatgtaacccacttccaattcaaccatttagttttccatataccataattcataacgcctaacaaaatatgatagcaaggaaagggatgtcatgtcctcttatttttacgtgtgaagaaatttgataagatagaccaatagattatgtaccactacataaacatagaagtttaaaatcgacctatacaagttaaaaacaaataacaaagatcaaatttgaacttggatgtagtgtacgtagtcagtgctctaaatatggaagtttggagtgatataccaagaattgatacatcttgttcgatttttaattagttttatggctattcggaaatgtcatgaaggaggaaaaaccgtatatatgtgctaaatcggggatgagcacacacttgcttgtcttcctacagtgtgaaatagctgtagcaaataatcttgtgagaggccactgctagctctagcttagctgctctatggcacaggagaacatataggagatgtaacagcaagtgcacagggagggaaagagagagagatgagtgattggcaatacacgcacgtgtcccaatccctcgatcaatcaagctagcctagcctagctatatattaactagggcgccacaccacagacgccggagatcagaacgaatcatatcgttcaacgagcgtccggccggcgggcgacgcgctgtcgagcaagagcgccgccgcccgatcaatcgctcgccaccatgattcaccccaaccagccgctggcgctgtccgcggcgaagaacgcgagcaccgtcgtcgtcggctcgccgctcctcgcggcgtcgccggcctcctcccccgcggcggcgtgctgtagcagccagctgcagcagcggcgagccgccgggcccgggaggaggggcgccggtaggctcgcggcgccgaggtgcagcaccatcgagcaggccgccggcgtgtcgtcggccgtgacggtggacaggacgctgacggtgaccgccacggtgaccgtgcagccgcccatcggcgtcgtctacgccgcccgcggcatcgacgacctcaccgacctcatcggcaagacgctcctcctcgagctcgtcagctccgagctcgacccaagtgagcagcacaacatatccatggcttagccgaagctccatggatgcatggacaaacacatgtagtagtaattaacaccatgtctatgcatgcagggacggggaaggagaaggagacggtgagcgcgttcgcgcacaggacgatgaagcaggacacgtacgaggcggagttcgccgtgccggcgacgttcgggccggtgggcgccgtgctggtggagaacgagcaccaccgcgagatgttcgtcaaggagatctgcctcgtcaccggcgccgacgactcctccgccgtcaccttcgactgcaactcctgggtccactccaagttcgacaaccccgaccgccgcatcttcttcaccgtcaaggtactacaaacatcgatcgatctcaccatcacaccatccatgaacacttggaagcatcatatcaacgacgtctagcgcggccatggatcgatgcagtcgtacctgccggcgcagacgcccaaggggatcgaggcgctgaggaagaaggagctggagacgctgcgcggcgacggcaccggcgagcgcaagttcttcgaccgcgtctacgactacgacgtctacaacgacctcggcgaccccgacttcaagatcgagcacctccgccccgtcctcggcggcgacgaacacccctaccctcgccgctgccgcaccggccgcccccacaccgagatcggtaaccccacctcacctcccagaaattttacatcattttcacatcaaattaatcacctattccctccgtttcaggttataaaacattttaacttttgtcaaagtcaaactattttaagtttgactaagtttatagacaaatataataatatttataatattaaattagtttcatcaaatcaataattaaatatattttcataataaatttgtcttaggttaaaaatattactacttttctctacaaatttggtcaaagttaaaacagtttgactttgaccaaaatcaaaacgccttataacttaaaacgaagggagtaataatgatcgaagacaaacctaggacagcttagacctgagcctatgtttatctccataatcatgctcaaaaaatttctggctcagccactgctaatggattaaatgtatatgtaattaattagatccgcggacggagaagaggagggggccggtgtacgtgcctcgggacgagcagttctcggacgtgaaggggatgacgttcagcgcgacgacgctgaggtcggggctgcacgcgatgctgccggcgctggagccgctgctggcgaaccaggagctgaggttcccgcacttcccggccatcgacggcctctacagcgtcggcatcccgctgccggcgcagctcgccgccgccggcgccgccactgccacggccggcggcgccgcggcctcctcctccacctccaccaacatcgtcggcggcgtcatcccccgcctcgtccgcatgatcgaggacaccaccgaccacgtcctccgcttcgacgtccccgagatgttcgagcgtacgtgataattaattaattacgtgccatgattaaaggctaatcggtagtactaattagtactccctccgaatgtattttaatgtataaccgtcgctgactttttaactaatatttaaacattcgttttattcaaacttttttataaatatgaaaaaatttatgtcatgcttaaagaatatttgatgattaattaagtcacaataaaataaatgataattatataatttttttaataagacaactggttaaatattgaaaaaaacttaacgacgacatatattaaaatataaatatcgaggtagtaacatgttgattaagctatcgaggtagtaacatgttgattaagcaatggatcaattggatttggctttgcattgcgcaggagataggttctcgtggttcagagacgaggagttcgcgaggcaggtgctggctggcgtcaaccccatctgcatccagctcctaacggtagcaccgccattcccaaccacatacactattcacctgaggacgacgtcacttttcgatgacgtcatcccccaaaaagaatgaattttcgctcgtcccgtcctggtcatcctttaatgtgtagtggcgaacccagaatttttatactaataaatatttcaaaaaatatacatatgttgatgtctttaggagagaaaagatatatagcagtagaaaaataaacaaggggtacagtggcagatggaaaattttttacaatgggtattaaaaattatgtagtatttaaaaaacatgttagagactttatatgacaaaaaaatgaaacagtacaatatttgggtaaaagctgggtggctgagactaggaatcgaacccaagatccataatgggtatattaaaaatcacgtactccagtatttaaaaacatgttagtgtctttagcagaaaaaggattcaataataaaaagaaaatatgcatcctatatgttagcatcatactcccttcctcaatttatggcatgaagttatacccatcttaaactctcaactgagttttttgctgatgtggttttgaaatttaaaaatatatatataactaacaagttgtaaatgatacaaacaattcttttaattaaaaataatcatatattaaccatacggtaaaattttaatgtttatataatcataaaagtagcccatgaattaaatgcacaggtttcctaaaatttatatgcagaaacttttataatacatactattttatattaaaaacaattgaattcgaatctaaattaaaatctggcataaacttttggtgtaaaaattttaggggtataaactttagttatataaacttaacaaaaaaataaaaatcgcgtgacaaaaaagaaagtgtggccgttcacagtgtgcaaacattagcccttttcgctagataatttccctctcaatatttagctaaaaggttttaatggctttaaataaatgacactattgctttttctaatttctaggactatttgtcatttgttagcatcatattcccttcttcctcaatttatggcatgaagttatacccatcttaaactctcaacttagtattatgttgatgtagtttagaatttaaaaatgtatatataactaacaagctgtaaatgatacaaaaaatattttaattgaaaaatagccatatattaaccatatggtaaaaatttagtatttatataatcataaaaatagcccatgcaatgcataggttttaaaatttatatgtagaaacttttaatacatactcattttatatattaaaaaaacatttgaattcgaatccaaattaaaatcggacataaacttttgtggtaaaaattttaggtgtataaactttagttatataattaaacttagcagaaaataaagtgtggccgctcgcagtgcgcaaacattagccctttcgctagataatttccctctcaatatttagctaaaaagttttaaatggctttaaataaatggcgccattattggcttttctagtttgtatgactatttttcatttgtagaaatatttgtgcaaatagacaaacatacgagtcgtaaagtattattgatgacaaatctagtggtatccctttttttctattttgcttaacattgaacgaatgtctgtttttaaaagttttgaggaaaaaagtctcaaatggtgtgagtagcaactaaggaaaaccgaactcaccaattaattaatggcgatcgatcgacgtgtgcaggagtttcccatcgtgagcaagctggacccggaggtgtacgggccaccggagtcggcgctgacgaaggagttgctggagagccagatcgtggagtcggtgacggtggaggaggcgatggcgcagcggcggctcttcatcctggactaccacgacgtgttcctcccctacgtgcaccgcgtccgcgagcggccggagacgacgctctacggctcccgcacggtgttcttcctcaccggcgccggcacgctgtcgccgctcgccatcgagctggcgcggccgcagtcgccaacgaggccgcagtggaggcgcgccttcgtccacgggcccgacgccacggcgtcgtggctgtggaagctcgccaaggcgcacgtcctctcccacgacaccggctaccaccagctcgtcagccactggctccgcacccactgctgcgtcgagccgtacatcatcgccgccaaccggcagctcagccggatgcacccggtgcaccgcctcctccacccacacttccgctacaccatggagatcaatgccctggccagggagagcctcatcaatgccgacggcatcatcgaggagtccttctggcccgggaggtacgccatggagctcagctccgtcgcctacgccgccacgtggcgcttcgacgccgaggccctgcccgaggacctggtgcgccgcgggctcgccgttcgacaggaggacggcgagctcgagctcaccatcaaggactacccgtacgccaacgacgggctgctggtctggaactccatcaagcagtgggcgtcggattacatcgacttctactacaagtccgacgaggaggtcgcctgcgacgaggaggtgcgggcgtggtgggaggaggtgcgcaccaaggggcacgccgacaagaaggacgagccgtggtggccggcggtggacacccgggacgggctcatcggcgtcttgaccaccatcatgtgggtgacctccggccaccacgccgccgtcaacttcgggcagtaccactacggcggctacttcccgaaccggccgacggtgatgaggaagaaaatgccggtggaggagaacaaggaggaggagatgaagaagttcatggagatgccggagcacgtgctgctggacaccatgccgtccaagatgcaggccatcacgatcatggcgacgctggacatcctgtcgtcgcactcccccgacgaggagtacatgggggagcacgccgagccggcgtggctggcggagccgagggtcaaggcggcgttcgagaggttcgcagggaggatgaaggagatcgagggcatcgtcgacgagcggaacaacgacccggagctcaggaacaggtgcggcgccggcatcgtgccgtacgagctgctcaagccgttctccacgcccggggtcaccgggaggggcatcccaaacagcatctccatctgagtttcgctagctaagatagctagctgcatttgggacaagattggagatggttaagatttgtacactaagatcatgtaccaacactaatagctcccgtgtatgcctgcctgccacgggagaggcatttgctagtgtgtttgagttactagaatgccacaaattagtaaagaggttattgaactaaagctcagttcgctgagttttctagaaattggcagtatgtcatgcggacggatgggatctgctggattcagcacatatcatccaagaaaaattactcacagcagaacaggcatgtcatgcatgtgactgaatcgagcagcattgtgagttgatcaggaccagcatggcatcgtgtttatagttcattggtcactggctaacgaacatcgttacccccggggttccagacaacgaactatacagctaagctgagacactgccaggatgcgtatctttttagaatgcaagacggttaggaaagataagggtattggagccgaccacaaaggcacaaagtgattagtcaggggaagataaggctggacctgcctgttagagttcactagaaagagcattccgagcagcatctccatgctcacgccggctcatttgagtccaaacttgtggagttaaacggttcctaatacatctagccacgcgtgacttggatgtaaaagagtccacttcgctcggttctctgaggtcaagtgatcaaccatgaaaaatttcaagtcttgtgcagtccacttagcacagcagctttgggtttctccgtttgaaactgacagggtgtgcagaaagtgatgcggcgcttgaaatacttgagtaccgctcctcgagtacagaaattgggggggtggagggaagggctttatctctgggagatgcagcctccggttgcactttgacttactaaattagagcaatgaaaataaggcttcgaaatgaagaatataagaacaaaaatggaagtgtgtgttatcgagtgaggtacctgtaaaggatggctcgaaatacggtctggttgttttgaaagagggttcctgagcatcaacctccaagtgttgtgtcgtcgtgctggtcttttgaagacctgtcgactggacaagcttcagtagtttgtctgttatgactgtcattggcggacggagctctggtgatttctgcattgaaggaagaaatacagccagtaatgatcacaaatatagggtgctgaaattcattcgatgaattcataaatcattaggaccgcagtaattagacatttttcagctataatccccttcaattcccatttaggagcagagtctaagcattaaggagtagtgcatgcggtgtttcaatttgcagcttggcttctatcctcaaggtagcatagttcaactaagtaatgtgtaccagaaaaaggtaacggacagttaccttgatgcagagtaagatgatgttgcctaacgtagagatagcttgaggtggcatagatgcatgtattcttggatcagttattctttccaaagaatcaaggttatggagatgaggagatgcccaatcaactagaaactgctcattctgccttcttgaactgaagaggaaaaagaacttcattagagaaccagactacagctgtacaagattaagtgagcatatacctgtcaaaggccttctgcccagtcaaaagcacgagcaaaatcacaccgaaactgtaaatgtcagccttgatgctatctgttgctgggtcagtaagctcaggtgcaacatagcctttaccactgttgagagcttctgagtcctgttttttcaggtgaggaactgttaacggtcaacggattatacagaagatatatcattgactttgaaaaacaccagtatccccttaatatgtgtgtgatttttctacccacttctgaagggaccacggttgatcctagtagggacacacacatatacatctttcaaatatttcaagggagagtagcttgttttgatataacactataatgtataggagtctatccagcgacctacctttgattttggttgagatgcaactgtaagcaatcgtgacaaaattccaaaagtatgggtctaaactggcttattattaatttagtctttcttccttttggaaaatagttcaagagctatagcgttcaccaaaggacataagcaccagcccggtgccttggtcttaggacttgaacccaagcagatggggaggttaaacagcctcaccatcaacaggacaaacccttttccctaaaaagctaactttatggatcgttttttctcaatgcatccttctctgtctaaacttaaaattccttatcgttaagtatgcagtaagaactccaagagattggcaatccatgacaacaattagatcctagaattgttcaagtaaaacattaactatatcaccatcactaatgattatgtacagaagtaagaacactatccaatataacatggaaaactagtgagcactgaccgttcttatggcactgacaaattggcttagcctggctaatccacagtggctgaggtagggcatgagctgagcatcgagcaaaatatttgtcgctttaatatttccatgaacaactggaggagagcacgtcgaatgcatgaatctgcataagcttcaaaatttcaggaaagcttccagtatatgtctaaaaattgacatcagttcagcagaacaatttacagaaagccattaacactatgaggatgtgtataccctgcagtacaaaacaaacagctagatgatttggtaggaatctaagtccacaaaaatgtacttactccaaagcataggcaactccaagagcaatcttcatccgagctttccatgacaaagccctggaccttgtggctgctgaaaacaaaatatcatcaagagagccattttctgcatattcatatagaagtgcacagtgcccaaactcgacacagtagcccacaagcgcagagatattggggtgcttcaaattggacattttcccaagcatgtctatgagctcatcttgttccgataatgacagatctaccatgttgatcttcttgatagccaggagctgcatgtacgaggataaatacatgttatacatataaaacacagatgtaaaataatctgtagaaaaaatatgcgcctttactatttagcaaatgataaatttgataaatcacatatttttttctaatattgatttcgggaagttgcaatgagactaggaattgcatcctcctcgtgcattgaattttaaagcttatcgagagatcaagagaaaaaaaatgtcaacgatgcaagacaagttttattgccgataagaaaaggaaaacggccagttgatgaacaaaaagtagtagtaaataaacttaatacaccaactaaaggaaaattcagtattaggacactgaaacacgtagtagaaattagattcgagagcttgttctaaagtaacaaaccaatagtattttccaacagggtactaacaatatgatacctggccaccaggaaaatcacctctgtaaacttggccagtgaaaccttcaccaataaagcattctttactgaagttcctggtagctgctaagatgtcaacagcttgaaactgttttgcagttagaaagtttttggatgtcttggcccaaacttttgttttcatagctctttcaggcttaatgacgtcactagaggaagcctcacagtcattcataagagaattccaagagtacaagacctcatttgctttagggactgtaaaatgatatgtatgaatttcagtgatatgaaagaatgtaagtctatccaataatgcaacatgcaggaatggagaacaagtatatatatacatgattggatattacatacagatcctaacataaggatgaatattaagtgatgaacaagaatatatagaatatgtctagccatcaactacaattgcataagccggttatgcttaaactaataaagttccagtgctacctttttccacattggcaggtggagatttggcattgttagcggtgctcttaggactgtatgtgcagcttttcagaaccaagccaacaatgaggagcacaaaagctgtaccagtaacagtagctattgcagcagctgtcactcgagagtgtgacttcctgtgctgattatggttgtacatagaagaatggcttaaggaaggcttcaaaggttcgggcttgtgtttcaaattttccttaactgctggtggaggtggggacataggtggtggaggtgaagatggaggtggatgtggagttggtggtgaatgagcactcctggtaaatgagggagatgcacgtttgaaacctggttgaaactggttcccatcaatcctggaatgttagattagccacttatttcaactagatatgaagtcaaggcaacatgtatgcataaatatcctacggaaagaaacgtgggttattaagcagaaccgaatacctcaactcaggaatggactcaaaagttcctggcacataaccactgaagctattgttttcaatgttgctgcaaccagttgataattgtcaggaaggatgagaataaacaaatatagagaaggataaaatacagttgaatttcttacagggatgataatggaaggtctgccaacaaaataacagatcctgtgaactcattatgctgtaaataactgtaaaaccaaaacaaaatgaaccttttatattctagcatatttttgtgcatgaaatcgttaagaacgcacatcattcttacaggtgatgaaggttcttcaatgagctaaacgacgttggcaagtcaccactgaaagagttgaatgataaatccctgaagttgaatacgaacaaaaatgaggtacagactacagtgggtgaaagatcgaattactcgaagatatatagctaaatttgcatggagaattatagtagaattgcaagaaggtccaaaggaactactctagcatcaaagtgtgtgcccatattaacaggtcaaatgagcttgagccttgaagattgttttttaagaaaccataaagcaaataaatgcaaaaatagaaacaaacagactgtaaaaacttatgtatcaaatgatccatgtgatttatgtgagtgcaacgaaacatgcatttttgtggggtggctaagaaaacatgcagttattcacaataatggagggggaaatctaggaaacacaaatgtatgcagttaagcatggctgaagcttctcttgtacatgcaaatattaaataatgtttgggctgcaagaattcgcatgtcgttgcaggctacagtgcaagaaataattcatttattcaagaggataaagaaattagaatctgggagcactacattgttcctaagctttccatgttgacaaaaacatcaccaattattccagagagcttattgtggctgaggttcctgcagcaaagattaattacaggccagttatttgattctgcaaccagagttcactatagaaaattaggaagtgctccaattgccaaaaatgcactcacagatatttcagagtgtgcaaccatggtagtgacggtggtatactcccctcaaactggttggctgcgaaatttctacaggagcacaacatatggcgattatgtcaaccatagttcatatttgatatttaacccagccaaaagggggataaccgaaatacaaagagaacatacaggtattccacacttgggggcaaattgcgcgggatttcaccagcaatgttattgaagctcacatccctacggtcgtcatgattcagcgaagcaaagaaattaaagactggactaagaacagcagaatcatgatatgctaacagattatcacaaactttctggtcaaaagctcacagtattttcagagagtaaaacttgagcagctccagaccaagccacccgccaactcctagcccactaatatttctgtgtacgagtgaaagaagagcaaaatattcaactcagttaataatccctgcaaagttgcaggtgaaactgatcaggaagttaagaataactgaagaattacaaagcgacaatggacgaatccctgcaaaggactccatgccatggccgttgttcaccaccgcggccacaggggtcaccgccctgagatgtccacccagaaagctgccatggagaatccaatgttcgatataattcccaaagccctaaagctgtagaacaaccagaaacaacagaaaattaaacataaggcagcgaagtcatacacaaacatgaagacggcatgacacgcaggaattgaacaaaggtaactacgatacggtcacaatagcatgcacactcttgttgtggcacacaatcacatacatcgatgtggacaggatcagatcagaaccaacacgaacactaataccaaatgggagcaagcatagatattcatcatgagactgtgcaaactactgcacacgcactgggcaaactcatgctcgcgcaatcaccgaatcacgagtacgcgtgcggcgtgcgcgcgatggctagctgcgccgtcaaaccagcacagacccagccctcgcaagcaagcgcgcgagctcggagtagaggcatcaaacggtaactgctcgatcgctacagattaggggttgagtagactcaccatcggaggggtcggtgaaccctgatacgggggcgaacgcggcgcacagcaccgccgcggcgaggaggaggcgaggcagcgccgccgccgccattccgatgcctccgcggctcagcgcgccccctcccccccaaaatccagcgccgccgccgatcgccacgaaatccagaccaaatcgagcgatccgcgcacgaaatcgccgacgacgccaaccggaacgttctcgaactttcccaaaaccccccgcgctcgcgcgcttgctcccgacgccgccgctcccccagatccgcgcgcccccggccgtctcccgatcgggccgagcaatccgcccgcgaattggaggaacccaccggttgggggggaggatcgaatctccccgagcggccggccggagaagccacggggattcgcgaggagggtttagggtttttcaaaagtttgggaggattctcgctttgggagggaagaagcatggggtggggaggaggagagggcggtcacgtgaggggcgcgtgagaggccgttacggcggcgggaaatggaggagagaacgaggaactattttggggagcagcaaaattcttccggaatcaaaaacatctctatctgaataatttggtttctcgttcagatttcgaaaaacagaagttacaaaatctagaaaatcaacgaaaagtaaaaggcttgtttttcctcgtttagattctcacaatatgatgaattgccaccagctacttttagaatctaaaaatttcttccatcagaaaaaaaaatgaatctaaaaatttcctaaacgaattatgagaggtttgttataggaacttccggctgttacagaaacttcggctgtgttctgcccataagctttcaactcatcatcctccctcgtttatcgtgtgcatgttttttaaattgttaaacggtgtgtgttttataaaatgtttttataaaaaagttgtttttaaagatcatgttaatctaatttttttagttttgtatagctttttttttgcggggatagttttgtatagctagtacttaataaatcctaagttaacctattgtctcatgtatactttgtatcaaattatcaattgttgtttagtctaatatatgttataactaggataaagaaaatgtaattggagttcacatttgccatgtgcttgtgaaatttgtttatttaaggtgcttgcaaaatcatatttatcaatgtacgtcaaacattcgagccatgaatactagttgtgtccaaataaagggcagataattgatgtcatggcatggaaggttattggcggttttatgtcgcgacacattgtggatatgctgcactattaacagatgattatacgcttcgacatatagaaaaaggataaatataaaaccaatgatgccatgtgtttgtcttttctaattgaatattattggacaattaatgagaaaggcgtgtccgagatataagggtaaccacaatatttatttaccaacttgatagtaacgtgggtctcaatatccgacaatagttgttattagcaggtttcataatgtttagtgctgaagtggtaattaagatggggttcacatttaatgctacttgagaagattgttatgcatacacgagcaaatagtatattttaatggtttattgctagtagtaagcatactactcggttataactaccatctctaccacaatgtatcttaccaggtaagaagctagcattaattgcttattacccattttatcctcatattgtggttactctaacaacaccaaatggttttgtccaagaataaatctacagtgcgtggctttactatatatactttacctttaccaatctatatcatcatggtaactcaccttttatccaagctgctagggatatcaaaagcatcagcaaagatgcgatagggtgcataggtgttgattctaggattacgggtctgcttattttcactcggctatatatttatcgaagctaatggttatgaggttaaagtgacggcattagcgagacgcgacacgtggcaacgataatctgtatttagtaaaattgggtgtcggtatggattgtctttttgacaatattattatccggtgctttctttaaaggtggagtcatctaatattagaactttgcagtggagtgaaaaaaccatttctggattttctactttattcttaggggcaattgtattcttgcccctactttcatttgcaattgtgattttacccttactttttaaactttgtgattttgccctcactttttgacgttgaatggtctgtttgcccctggtttaaacgtctgttaggtggactcagattaaatgagtttaagaaaataagaaattgacttgcaaaatgtaaaaagacatctctatcccaaacctttcaacctaagccactgctgactcctccgtccccgattcctaaccctcgcgagcggtggcggcacacgcgggcaagcgagagcgaggagcgcgcggtcgtcgcggaggagcgcggggtgaagcaggctgggccggcgccaaatggcgatgtcaagctgagctagcccgtcgccgtccgccgtggtggtcactgggctcgtcggcatcggcctcggctatagtacccgaaccgctgcacagcagatgatcgagtacatacgtactgttgcatatgcgtagctagctaggctgccttgccaccattagcatggccgcgaggagctcgcctgaggcatgatggtgacaaggaggagaagaacagcaaggagaggaggagaggaacatttgagttttattgtcttttactttttcttctttgtcactccccctttagtttttatttttcttactgccttggactattggttggttcctaaactggacaggaccaacaaagctattctgttgttgaaagaaagagatgagagtagtgtttcttgtttgcatattcataaatcccttgactgttaaaatgattaaacatgcagggcaagttcatacgtcaggcattgaggcattgaattcatacctcagtccatagtgtttcttaattaataaatcccttgattttttttaaacatatgctggagaatcgcatttcttgtgtagttacaaagttggatttcgttgttaaaataattaagcatgcagggcaagttcatacctccgttttctactgtaatcgtgaaacacagccaaaacacaaagtcctcacaagccaaatctgcaagggcatagatgtccttttacctgtcagttaacaccattaaagtcctcctgacggaacaggggcatacctgagcttcagttcaaaatagtgagggtaaaatcacaaagttaaaaatacaagggtaaaatcacaattgcagttgtaaatagggacaagaacacaattacctcttattcttatgattgtatcgggtcgacatgctccacccaatggaggtaagtaaggaaagtaagctccctccagttataatgccctgcaaatttagcaacatattagtgctattgttaagatgtaccaaaaataaaatacaaccatttgtgggcaagagaaaacagataacattagcagagcaaaaaatggcatcccatttcactgcagtaaaaaaaaaaacagagagaaacggaatagcagaggctactacagggcaccgcacagtgcagcggccagcagtgcagtacaccactgcagagtgcagacgaaggcaagcgtggctgcaaccgcaagcagcaaaagcaaaaccccggaagcttcccccaaaatctctctctccctctccccactataaatcctcccctctcgtcgatcgccatggctcccatgctctcgatcgcctcccgctcgccctcgccggcgttgattgcacctcacgcctccgcccgcgccaccggtcttcgtgctccgttcgccggcaaccgcattgtggggtgggggtggggggatcaaaccaaatcaggtacggatcgtaatcgcgcatcgatctgtgtcgtcctgttcctgcgcgtccgctccggcgagcccacgcaggcgccgcgggatccccctgctgcggtaggcggcggcggctgctacgtccggctgccggcgccgccgcgagaccgggacgcggttttggtaagcacgatccatttctttctcccccgaattccgacccgctcgtttggttgattggtttcgattcggtcgtgcggcctcgggtcacgtacatttacttctactacgagcaagcctaataatacagccgacttgttggttataaggttctgtgtagcattctctcagcctacccatataatagttagctccttacaattaatacagggctcacatgtctctctcgtagagtttcttggttcctgtgtctaagccggctgtaagtttatagcccgcttctcctctctctcctctcttttctcctccacctcaatatttaaccggcttatagtctactattatacttgctctactacgaccatagcagtacaagcgtgcagttttggagtttattaaactttaaagttggagtagttgtactactatccgaaacgtaattagtaagcgcaagtcaattctactatcggacaagtaattacgtttcggttagtagttttttaatatatctctcgtttaatgcgagtagcggcttataagacaaagacatgtgtacaagcggcgataaataactatagactatagagtatggaccttatatttctactagctaaataatcatgcttttatacggattaaaacaaattaaggtttttgggacaatttcattctagatgaaataagatagaatcatatgtagaaggattattttataacattaaagcatgtagagtaattggaagaaaacatgatggggtagtcggtaaataaaaaaaaacttggtgaggtggcaacattgctctcttttataaggagtatagattcttagcggcccaaaactaaagttaaaaatggaaaattacgaaaaccttaaattaattatatatctcatgggatttaaatttggttgctgcttataagccaacgagggtctaggaaccgataaaatttgtaaaaccaaagggcgataaataaatctcagggatacgaacacatatgcttcagccagtgcccggtggatagaaaggctatacataggaaagggaaaagagacttgcaaaaatactattgttctagtagaaagtttcatgttggtaattaatttaactttttttttgatcaaagggccttaaccctccatttccattaaaagaaatgtcacagtttacagcagaaaaaaaaaacagacttaatttaacatttgtctcagttcttcagcaattgaaagttgtttcgtctggagttgggataattttactagttttacaaaggattattctgtgggacttgaatatattaacttgcggttttgagtttgtgccgtgtgatgtcgattgaagtgtggattggtcctttctttcttgaatatgttgccatctgcttttgaaatgttggcactcttgacaaattgacaaagaaaatattaggcttgtttgctaatcatttcttattttcttgtagttgtatgtagtcgacggttccagaaaactgagtagctgacaggtgctgcctttttcttgttgcaggatttatttctcaaagactaccatttcagattactgaagttgggcgatctgcataactagcacggtgccacggtttttgagaagaagaacgagcaatggttcgacaggtacctggtttaagttctttctttcagctgtttgcctggacacttcattgcattgggtcgatgttctgggctgtcaagaactctgctgcctgaacaatgatgttttttttgtttatctagttagtttgcatgtgaaaatatcattagtttattcatatttatattgaatttttattagacatatttactgcatttctttagctttgctattacatttacttcatttgttgagcagatatgcataagctagattcttctatctaaaaatatgtataagctggacagcccccaaatacatagccttgagtagaaaacaatactatatctcaaaatataagattcatagtatcagctatgcctataccatacacatcaaattcactgtatcataaaaaacgagatttggagggagaggcgttcctccaacaattaaataagaaattgtgagcgtgttggggattgaacacgggattttggggttaaaaccacacatcccttgcgctgcattatcaagtgcatctcaaattcactgtatcatagtctacctgtaattgctgagcatttgcaaattagaaccttgaacataagtcaagtgttataattctttccttcagctgttggtattgttattgattttgttacctgaataacgatgcctttcattgtaactctccctttcctttttccagtatcacgtttgcttgttcactctacttctctgcttcatccctatcactgctttggcggaatccgatatcaagaatttatttgctctgaggaaagcaatcgctgttggaaaaggcttcctccacaactggtttgagctagaaactcctccatgcaactggtcaggtatatcatgcgtggggcttactgttgtggccatagacctgtcatctacgccactctacgtcgattttccatcacagatcattgcattccagtcactcgttcggctcaatgtaagcgggtgcgggttttccggtgagcttccagaagccatggtgaatctgcagcatctccagcacctagatttgagtgataatcagcttggtggccctctacctgcctcattatttgacttgaagatgctgaaagttatggtgcttgacaacaacatgttctctggacaactaagccctgccattgctcaccttcagcagctcaccgtgctatccatatccacgaattccttctctggaggcctccctccagagctaggcagtctgaagaacctggagtacctcgacattcacacaaatgcatttagtggatcaataccggcatctttcagtaatctatctcggctcttgtaccttgatgcaaacaataacaatctcaccggatcaatattcccgggaataagagcgttagtcaaccttgtcaagctcgatttatcgtcaaatggtttggtgggggcaatccccaaggagctttgtcaactgaaaaatctgcaaagtttaatcctatcagacaatgagttaactggaagcatcccagaagagattggtaatctgaagcagcttgaagtactcaatctcctcaaatgcaatctcatggacaccgtccctttgtcgatcggcaatctcgaaatcttggaagggctttatatatcattcaacagcttcagtggtgagcttccagcatctgttggtgagctacgcaatctgaggcagctgatggcgaagagtgcagggttcactgggagcataccgaaagaactcggcaattgcaagaagcttactactctagttctgtccggcaataacttcactggcactatacctgaagaacttgcagatttagttgccgttgtcttgtttgatgtggaaggaaacagactctcaggccacattcctgattggattcagaactggagtaatgtttcatctatatcgcttgcgcagaacatgttcgacggacctctaccgggtcttccattacatctggttagtttctctgcagaatccaaccggctgtcaggatctatccctgccaagatatgtcaaggcacctttctgcagatacttagattgaatgataacaatctgaccgggagtatcgatgagacatttaagggatgcaagaaccttactgagctaagcttgctagataaccatctccacggagagataccagaatacttagctttgctaccactggtgtcacttgatttgtcacataacaatttcacagggatgatccctgacaggttatgggaatcatcaaccatcttggacatctctctcagtgataaccagctaactggcatgatcacagagagcattggtaagctcttgagcttgcaatcgttgagcatcgacagaaactacttgcaaggacctctccctcgatcgatcggcgctctaaggaatctgacagcactgtctctcagtggcaacatgctatctgaggacattccaatacagctcttcaactgcagaaaccttgtcacattggacttgagctgtaacaatctgacagggcacatccccaaggccatatctcacttgacaaagctcaacaccttggtcctgtcccggaatcggctgtcaggcgctatcccttctgagctatgcgtggctttctcgcgcgagtcccattctgaattggagtacgtgcaacacattggattgattgatctgtcgcggaacagattgactggtcacatcccgagagcaatcaacaattgttctatactggtagagctacacctgcaagacaacttgttaagtggcactatacctgtggaacttgctgagctgagaaacataacaaccattgatctatcttccaatgcattggttggacctgtccttccatggcctgtaccattggcaagcctccaaggccttcttctgtctaacaacagactcagtggctccattccttctggcattggcaacattcttccccagatcacaatgctggacttatcgggtaacgcgcttaccggcactcttccattggatctactctgcaaagagagcctaaaccacctggatgtcagtgacaacaacatctctggacaaatcccattttcctgtcatgaggacaaagaatccccaatcccactgatcttcttcaatgcaagcagcaaccatttctcagggagcctggatgaatcgatctccaacttcacaaagctgacctatcttgatctccacaacaacagcctcactggaagattgccatcagcaatagcaagggtcacttctttgtactatcttgacctatcaagcaatgatttcagtggcaccatcccttgtggtatctgcggtatgtttggcctgaccttcgcaaacttctccggtaaccgcgacggtggcactttcaccttggcagattgtgctgctgaagaaggcggggtttgcgccgctaaccgtgtcgatcgaaagatgccggatcatccgttccatgtactggaagcaaccatttgttgcattgcaacggccattgtcattgtgctggtggtgatcctggtggtttatctgagacgacggaggaagatgttgagaaggaggcagtttgtccttgtccctgccggtgacaacgccatggctgaccatgagacaaccttgagtaacaatcttttggggaggaggaggatgaagaagagggagccaccgagcatcaacctcgcgacgttcgagcacgcgcctgtgagggtcaccgtggacgagatcatgagagccaccgggaatttcgacgggatgcacgtcgtcggcgacggcggcttcggcaccgtgtacagggcggagctccccggcggccggagggtcgccgtcaagaggctccacggcgtcggccgccggttccagggcggcgaacgcgagttccgcgccgagatggagaccgtcggcaaggtgaggcaccccaacctcgtccccctcctcggctactgcgccgccggcgacgagcggttcctcgtctacgagtacatggagcacggcagcctggaggaccggctgcgcggcggcggcggcgcggcgctcgggtggccggagcggctcacgatctgcggcggcgccgcccgcgggctcgcgttcctgcaccacggcttcgtgccgcacgtcatccaccgcgacgtcaagtccagcaacgtcctcctaggcgagggcctccagccgcgggtgtccgacttcggcctcgcgcggatcatcagcgcgtgcgagacccacgtcagcaccgtcctcgccggcacgctcggctacatcccgccggagtacgcgctggcgatgcggtgcaccgccaagggcgacgtgtacagcttcggcgtcgtcatgctggagctgctcacggggcggccgccgacgtggtcgtcggcggaggtgacggcggagggtgacgacgagcgcggcggcggcgggagcctcgtcgggtgggtgcggtggatggcggcgcgcgggcgtggcggcgaggtgttcgacgcttgcctgccggtgtccggcgcggagcgggagcagatggcgcgggtgctcgacgtcgcccgcgactgcaccgccgacgagccgtggaggaggccgaccatggcggaggtggccaggagggtgggggcgatcgaggcgatggagtacgggcctctggtggtggcagtgtccagtggcgagccgccggcgatgccatgatcttgctgctgctatactgtatactgtagtgcatcatgctcctttttgtgaattaaggtgttttgatctcatcttatatgcggacacagagatgcagcagaaactcaattttttaacaagttcatacctcacaggcatttcatcaaacacctgttatgcgtgcaaccaacccgctcattataacctcatctttttttttaatgcttatccttataagttaatatttaaaattttcaaccttaaatttgaatttcattttaggttttttcatcgatgtttacatcagttgcacttgcagcacaaccaaacaatttggcggtgtttcatgcaaaacaaggtgataatattaattgagttttagttattacaaacttaaaaaatggattaatctaatattttagaacaactcttatatagaaagttttcgtacgaaacgcaccgtttagcagtttgaaaattgtgccacgagtatttaaattttcatccacttgttatagaataaactaacgggaccaaatgtaattccatccatcccacctgcggtttctcccatctacaagggctaaccttctgagcgcgctccatctctctctctcataacagacaactttcattatccagattggaaaccaagcccaacagcacaaacacaaagtcttaatactccgtacaagaacaagaacataacacgacttcattgggaataagcgaaacgacatatttgtaaacgaaaaataatttacgaataaaactttcatatatgtgatcttagcgatataaaagcaaagactgaaaaataaacttcgttgaaataacccaaaatcaaatctaaatttaaggttgaaaaattaaatttaggctgataaacataagcataagcgaaaatatgagaccgcacgaaccttctaccttctcttgacagtcttttatcatgctataatgcaccacatgtaccccttatgccaaaattagctctaaaattatatttagtgatttaaagtttgaatgccactgacaagccaacaagtaaactacagagcaaattaatatggtgcaatctgtcatcttccaatgttgacatcctcttgcttggctagtaaccacgttttagggcttggtccggagagcttaaaattatgggaagcagctagttggtagcttctgagaatctacaaaacttgggttttccaacttatgacttatagttcattttctaaattttacaattacaacttttcaaaatctaaaccaaaagctagactgcttggggagcttctgattatagaagaagctgcagcagcttgaaattgcctccaccttgacagctcggttctgctaaaagaccgctcctgcaatcgaaccaataaaaaaccggtgaacatgccagtttttccttgaaccagtggcgggtatttaagtatcgaaccggtttttatttttcctatggcattatgacaggatgaatttattatgttaccacatcacatttattttttttaatgttatgaccatgtaataataaatataatggtttatttatgcatattttcaccaatttgtgatggttatatattaaaaataatacaaattaaatgtaatattaataaataaaaaaccagcggtcgaaccgttgacccggtggttcgtccggtgaaccaatggctagagcggatcgaccctcggaccggtttttttactatgcctcaaacatgttcttagaaaccaaagaaacactacttgtatacaatgacaatccctcgattccgatgtatagctggacaataacgactctttttattcaccatggtttggaacgaaaactttggttcgaaccaaagcatctcggaatataattccgtttttttatgttccgaaatccgaatgggaccgaatcaccgcgagttctgacgcaactgataagtgataaccaaccaaccaaccaaccaaatgtttgaaccaaaatcgggaagcccggcaaaatcctcccaaattcggcaaattcccagacctcgtgccctacctcaaaatagcgagcgggaatcaaaaccacacctgaattctcaaaccacaacacacacacacaaacagttggtccatagccctatactcactgacatgtggaccccacttaaataaaccccacgagcccactgaagtactgaaccagacgcgtaggagtactctcaaacacaacccgcacgcccgtcgtcccgctcactgacatacgggccccacgaagctctagaaaaaaaatccctagccaccgacctccactccaccttccccacagccactgacaagctggccccacccaaaagcgaaattaatctcccccgagccgcaaggattctcctcgggaaggcaggggctttcaaatccgcgcctcccctctcctcctccgccggctgcttcccccccacgaaatttcgcccaaaattttccctctcgcgctcgcgctcgcttcgccgatcggggctcgagtcgaggccgccggggcgagcgcgttggggattcggagatctggggggaggggattagggtttgggagcgccaggtcggtccccgatggcggagggcagcagcggcggcggcgggaggcagcagcagcagggggttgcggagcggcggctgctccggtcgcggtacctcgccgtgaagaatctcatcagcggtagggggctcgccgtgggggtggggtttggtttggttttgggtgtgcgggggtgtgtgatttgagctgtttgtgctgtgtgttttgtccgccgcagatgagaaggatgacatggcgagggcgggctccgacacgttcgccgccatcatcacgcaggtggactgcctgcacgagctcggtatacgaaatcctccccccctttcgcctttgctaaaccgtgtgtttttctgcagtttgatgtggttatccttgccttggactcgctgtttccgatttgtattgcatttgagtcacagattagaaagacatcgtgatatttgaaccttatgcttaggctgttagtactagctgctgaagtggctgctggagcacttgttgcaggttcagaaaaaagaagaaggcatattagcaagttgttcatctgcattgtatgtgtagtgaatctcagcaggatctcaaaacattggttggtcttcagataactgatatagcattattgcgaactacttctggtttattctactgttgacattttacttcaaattgctactcgaacatcagagcatcagcatgattgcatttagtttcgttggttgttctcccatgctaatgttgatgtaattactcagttcctatcttctacaagaccaatgctttgtaatttgcctgcatgattgcatttcttggcaaaacttggtgtttattgccatgttaatattagaagttcagaactcactgtcgcattccaaaattagtactagtacttcgaatagctgcttatgatatattttactggtttggatcatttaagcataagtgctatatgaagtacacaaaatgatggcatccttctacaatgcagtgcagaggcctagggagcaaatagctgatgcagaaactctgttggacattgcaaacactttggtaacatccgttaggtctcagtcaagtgaaggaatcactccctctgatttcgtaacagccatgctgaagaaatttgggcaatcagggggccttgattctgaggctgcctcattgcgctggggggatgttgggctttctgtgtcccatgtcttcagggctgcacctggatgctgcactatgtaatgaagctctcttccgtctttatatatgcgcatcatttcttgctttctataattctatccgcctggcaaatgacttaaacaactcaaatctgaatctttacaggcttggacccatgaatacagaagtaaaacaacggaaggctgtggttgccaatagaaaacggactgcgaggccaacggaaaatgctcgtcctgaacaggtagccaactaggcaactagccatatgctattctatattacaaagggtatgatagataccaacaaaaccataatagccatctgtgcatttctttcatcatggtattcattttttccctccattagtctctgaggtagttaacaggtctggtgctattgttcatgccataacaggtctggtgctattgttcatgtcattagctggaacttaacatatctatcttactgattccattttgtaattgtattgcttacatgttcaaaaccatagaacgtttctttaaaggaacatctggaacagaaacatttatattccttgtccactatcaagtttcttgtccgtgcatctggcagactgatcttttttacggcaatttattttgtttatacctggatgcaatcactgggcttgtatactgttccatggcttactctgaatagcacattgatatgatgctaccttgtatgcagcttgctgaatctttggagggagtaaagacagacactgataggaatgtgtctgtcatatttgatatcctgaggaggaataaaagggcaaggctggagaacattgttttgaacaggcgttcttttgcccaaactgttgagaacgtttttgcactgtccttcctagttaaagatggcagggtggcaataaacatagatgacaacgggcatcatatagtctgtaagacccttttccgctgccctcatttgtttccttaaatgatatgacaagatgccgcttctttagtgacatgtctaagataattctattggtcctatgcagatcctagaaatgctcctgctgctagtgcgatagcctcaggagaagtctcctacagccattttgttttcagatttgatttcaaagactggaaggtatgttagtagttctttttgttgataaaccttcagatttttgactttgattaatcaacttcaactgtagaactgtacaaaattcaacttcaagatctgatatatagaattattcttaagttttaccaccccattttgggatactggttttctcaggagtgagtgccctttgtcttcatttatctgataccaatccattttgttgctgtacattaggcctaagctagagcttaagctaggaagaaaaatccttgtgttgatttttgttttggccagctcctctataaaatgacaatttttttcgcacgccttttctctttttatttacagttctgggcatcaactaatctacaattggccctcttttttgtcatccatttccagcttatgcaagaagtcgttccggacggggaagaactgatgccacacaggaaccccgagaacatcccctgcgccgaagatcatgaccaggctgatccaccggagctatgcgcgcaaagaacacctatcaggaagctcacccggaaccggggcctggtgatgcagcaggaccagatggtggtcgcggagacgcccgaggagaagcagccaacctccaagcggaggcgcctcttcagagaccaacaatcttgaagcgaaaccccccctgccctgctcgtcggctgctgtagtttttagcactttagcgtgtgcgcctacctgctctcgtgttgtatgtagagggagagatctattataagttataatagcccgctgtggttttgcctagtgtctgtacaacagtcgggcgacatagctcatctcgtgctagctcgtgtaacagcttagatgtaactaatgttcttcttttaactctattagaatttagatcaggcagcttcgatttttccaaagatcggtggaattgtactcttgtagtgtgacgaaagatcgctagaatttgctccttagaggaatgtagcaccagtggctgctgcaatccttccgaggttttacaaggagcaccagtggatacagcaatctttctggagtgctttgattgccaggtacgcaagttagccttgacccataattctgagctacgactaaaaagattatctaaccaacatggtaatagtttcacattgaggtagaaaaatgaaagtgaagacacattggggtagaaaaatgaaagtgaaaacacatcgaggtacgaggtagcagtttagcaacaggaagcgcagacagcagatcatccttgtttgggtagttccaacaatcaacgagactgctcactttgccagagaaacagtcacagtagcattaattttatgaaaagcatagtaatcatcaaccacagtaggctttaacatcgcaggagaaaagggataacataatcacataaccaggcgtacgagaaatagctcaaaaataaaatgcaataaagaatccagaggtaaaacaagacagcacataagcctaaacggtcagaaaattcagcatcagccctcaaagtttcgagttacaatgactaatcgctacaaaccacaatggatctcaagcagcagctgatttccgaagctcattttcaccatgggcaaaatggcacctgtcgccaaaagtgcacgaccctttggtgaagttctcgcacagcttggtcttgaagttgcttccggggcctcccccgcggtgggatcctcccacaggtttcttgccttgtggaggggcaccgccaccgatgctgacaatcagctccctcaccattgcactagcgttcttgatctgatcaaatgtgccctcaagctcaatgtttttcaagttggtgtctgattcatgatcacggatggccagcttggcccctgtgactctggatatctgctttgtgttaaccccacccctcccgattatgccacctgcaagagatgcatcaacactgatcttggctgtggccgaagcgccaaagcttgctggagtggacatggcagggctaggcattggtggaggtgcaaagtgaccagtgggccttggtcccattgggggaggcattgagctatccatcaacataggcttgccgagctccctctcaccgtgcgcaaagtggcacttatccccccatttgcatccctctgcagtgttatacttgttgcacaggcgagtcttaacagtgggtgttggtggcccatcaggaacagcatttcccattggcattcttcctggaggcggcgcaatagctggaccaccaagattggtcatctttgcaacagcttggtagccaccagggaagtggtggaggaagtggcaaccctcaccaaaggggcaaccagaggtactgcacaataagaatatcatgagtgcaagcaaaaagatgctgcaaataatgtcctaattgaagaactacaccaaaagatttcattgtaaatgcaactgatgtttacttggaagattctaatatgtgaactttaataggtcaacatctcataaacaatgattggaaatgatattaacaagtgaagaacaaatgttaagatgcagtatggactggaggagatttctggaaccaccaccacatttaaaaacaacatggcagtaaactacattctaaatgttgagcttgacaatgggtgctaataagagatgtagaccatatgcacaaattttggtaatgactcataacatcataagcttgatagaaaataatttcaggagcaactatttacggaagtatagattcaaaccatacagtagtaaaatttatccctgcatgtagcaaatgttaggataaatattatatgttacaaaggacataagtggcaggatttcaaaatgtgagttcagttgcagttcccaagtcatgtattcaatcttcttttctcaatttgagcagatgaagctgcatcatgatattactgacaggttgttcatctgacaaggagttacatatccttaattccttatactgttgcatctttcacaggttcaaagtgatttcgcgcaactgtgcgcattccaattttactccagtgagtgtttcttaagcttggattaggtacaacctgtatcacaatctttacttgattcatgtgttagcaacaatacaattcttttaggaaaaaaaacagaagcaaaattttaatgaaataaccatgcataataaatgttaccaggtggagttcattttaagttggattataacctgaaaaatttggtgcatggcttcgatttgcttcctacaccggtttgaaatgactccgattctgttgcatcaaattaattatgcgttccaagttaatagttgttgatttgctaatctttggtacacaagagaacattaatactccttttaactacttttacgttcctactgcaaaaacagtgcaaaaataccgcattaattgaagcagctactacactctttatcaactacccacagcttccctccaagtttttaaaacccataattaattcaaagtacgccttgaaatgaagaacacggagcaacgagaccaccagatctggtttaagcagaccaaccaatctgaaaaagaaaaacacatgccaactcggcgaatcttggaagaaaaactacaaaaacattagctcgcctttacgaaacgagagtcacatccgctcttagtctctctctctctctctctctttccaaacctacaaaccctagcagaataagcagcaaaagggcacgaatcggggaggctcctcgatctaactacgcagcgaggaaaccaaatctcgccgcggcgggagagagggggatgcgattcgggaagacgagagcaaaggtcgggcacgggaaaggggaggagagggttgcgactcacctcgcgcgcgcttcccgccggcgccgttcgcaccgtcgggcttgcccctcttgcggccgccgacttccatctctcggctcccccacacccgcgcccgcgctcgcgctcgcgcacgccgcctcggagctcggctagggtttccggctcgtcgcggcggcggcggcgggtagaaggcggaagggattgggtgggcgagaggaggtgagagatgtggagtttggaagagagtggtgtgatgtgttgggccgcgcgatgtggagtggagtggtgtggtgggctttgtgccttcgtggctggatcaaagcatcgccaactcactgttcttggaaaaagaatataaatgaactgcaccccaatcttgcaaattgaaataaaaatcattttctcggatttaaggtcccattcgtttccaatgaaattatttgagtgaataataagaagttagggcacaaataataaaaacatatattaatatgtgattagttaagttttagttattttaatattgcaatataaatttatttgatattttaaaataatttttatataaaagattttttttataaaacacacctttttacagtttaaaaaaattgctaacaaaaccggaacagaatattaccccctccgtatcctatgtatccaggttcattgctagaattgaattctttgtaggacagcagtaatcagatttattgttagaattatttttttttaggacagagtattaatcatcaatagaagtgaactgagcctgataacttcccagtgcaatcgaaaatcaatttctgggtttttttcttgacaacgttccacttattgccctatactgcataataattttgcaacaaaatgtcaaataacttaaaaaatactccacgttaaacacctttttattttgcaacaaaataatatcccacgtatggtcaattaacctcgtaaatcgaaaatctagggtttaagtctaatgaaagataacaatcggcctgtcgaaaagtctgatgggccaagcgtaacaaacggccctttaaaaatttaattgatgctttggttggggtgcaccaggcccgggcagcagtgcaacgactgggcgacgcgcgagggccccagtggctagccactgtggtgggccctccctcacaaaaaataaatttaacatcgaagtgggcacatggcccacatatcagatattaaactgataagaacagatactacacttgatcttagccaaaaggccgagaaaggtatgagttgctctcctgctctgggcctcctcttatacacgctcctccgccccgcctcgctcagaatccgcgaggtggtactaacattgagaacgaaaccgtatcagctcctccctctctcctgctgcgttgtttggttgggcccgcgtctcttggtgggccgcgcagaaatgggcttttcatagcccaaatcactctggattttacttatctttattttattttataagtagtttcatgtttgcatttttaagcgtggcgtgatccgtgttctgttcttcttgcggagcaagcctgcattccaatttttgcctgggccatccaaaattcagcaatttatttatctgtttctacttttgcacctgctgaaaattaaaactatttttaacaagctaattattgaccaatgacgtggctgaacagtcacaggccttcttcctccccgaagagacaccaaccacgcgatgataataatatattttatatattttattttagtcatggtcgtatctaatttgtcttcctgtttgcaatttgcaatgaggtgtcaactacctcattctagaagcaatttgaacccaaaccttttggaatcaatttgaccaaattttactatctttattgaccaaagtgtaaaacggagaatttttgagggggctaagtgcgaaaagtgcaggaaaaaaatgggcgattttttttttatttataggcgaggaacaatcgctcgctcggtcgccttccccttcttcctcctctccgggagcgctttgaacaatcgctctctctctctctccctccccgattcgattcaattcgcgacgcctccgtgaaattctccaaagcgtaagtgcatttcatctctcccggttgcgatcctgttcgccgtaggctgtaggattcctgggcgggtggttgtgtagatggatttttttatgtggaatttcggtgggttttttttctattggattttggttttctacgcgggggattacgaattgtggatccgttgtagtttcgagagatttaatttgctttttttaattattatttttttcggtttgggaggaattgtttggaatcgatgtggcgatctgttcctccgcgcgtgcgcgtggtggtgtttaattatttttttgcgggattttggttgattttgggatgtattatgttctgacgaaatcgtttacttcgttgtttgtttgcgcagcagcttgccctgtagccgcgtgctccggccatggcgttcttcaggggcctgaccgcggtgtcgaggcttcgatcccgcgtggtgagccatccaacatcttgcatgcctattttctggcgatgcgtttgcatttatgtgcgctgaaaaattgttcgttgctttgtgttgtcaggcacaggaggccaccacgcttggtggtgtgcgatggctgcagatgcagagcgcatctgatcttgtaagtcaattagtttttgttcgttcgtgctaaatgtgtggttgaaactaccagttactatgtgccatctgtggctaggctcgaaagtggggaatgtgctctgaaaaaagatgtttgattgtgtttctaaatattatatgcaggatctcaagtcccagctgcaggaattgattcctgaacaacaggtttgttactttctagcacgtctaataattcacacaaagttggaaagtatatggcatccagttctttatctaccctttttgctttactgctttagcctgtagtgatatcatcttcttgcttcatgcgatattgtgtgagggcatgcttgcaacttccaaatgttgtggattatctcttttttgtaaaagctgtgctggcgcatggaagcaaatgctgcatgaacattgcattacaccattgtttcagcaccttcagaaaccgctcatcacaaaatgtgtatattttgagcagccactagctttgtgttttctgcactattgaaaatgcattacaagattggcatatcaggttattgttttcttcacaagtttagttttgcaccaagcagtaatcacaatattcagaatctgtatcagagaagaccataattgcagctagttgcatgctcctatcattatgaggaagtcatcatggttgatataaaataacttcaccatttcactgtttacctaaaatccatatatgagttgcatgccctgtgctttgtctcaaccatccaagagtgccaaattcctgtcaaataccaggaaagaaaagctcaactcactttaccattctgttacaggaccgcttaaagaaacttaaatcggagcatggaaaggtccaacttggaaatataacagtcgatatggtatgcttttggtattgattatttatggattgtttctcaagggtgtcctttattgattggtctaaaatcttaaatggtgtttatccaaggtccttggtgggatgagagggatgactggaatgctttgggaaacatcattgcttgacccggatgaggtatgcttgtaaactataatgctacgataccataatggcataatatagaagcaaatttggatattttgtctatgtatatcttgaaattggaatgtgcaaaagttggaaaataaaatagatgaatgatgaatcaccatattttcatgatctccaagcaagtgtactaacagttgagcatgatccgttcagtgcacagtaggaatgacacaatgattgctcatatttgtcaatctgaatcaagttctgtaatcaactttagcacattgatttaaaagaggtacagggactaaatagtctagatttctatagtcattatgtaggaatgtgcttcattacaagagtttgatgcttttatgatttattttttaggatggcggcttttctgcagattttaagttagatttttagcttagtttgactttgtgaaatttaaacgtgcatcactctatatcttgctgttggatgtaagtctgtacctctttcctatccagggtattcgttttaggggtctctcgattccagagtgccagaaagtgctgccgacagcagttaaagatggggagcctttgcctgagggtctactttggcttcttttgaccggaaaggtttggcttcttttgtttaactgtttttcttgtaaacttggttttcctgttcttatttttgtcggcatttagctgctagtgtggactgataggtatttgtttgtttcaggtgccaaccaaagagcaagttgatgctctatcaaaggaattggctagtcgttcgagtgttccaggtctgcaattgtctcttctggtttattgcattattgtttgctcaattagtaaaaaaacctagatgagttttatgtcattatcttatttcccttttcttagaagataaaaaatatagtcacggatacatacagagattatggagtttttgttcctacgaagctttattctgcaagtaccataaacacaccaagtttcttgtataatgttcccccagatggttctttagttagtcaatttgaaaataaattgaagctactgcattatgaatttctgatagtaatctgagcttttaaggttaaactcttcaattgcctgaaaatatgaaatgttgttaacttaagcctatattcttaagtgtatttgatttattattatttttttttgctgggcaagtgtagttgaaatttgaaaggcaactgtagaaagttttttttttgggactgttccatgatgttctctattgacttcagttttcttaatcctgcctttgataatgatatagctcatttaagtattcatctgtgataagttgatttgagtttttgtatactcaatcattggaaaaatatgtctcagggctgcattacaaatttgtgcttctgtaaacatacggcatgttacccacttacctacttggcacttattcgattgacttatgatacggatgcaggtcatgtgtatgaggcaatcgatgctcttcctgtaactgctcatccgatgacccagtttaccacaggagtgatggcacttcaggtaaaccttgtagcatatatcactcatctgaaataaatacatattctgttgccacttatttgaaggtatatttattttggagatggtgcatgtaaaaaagacaatcatttaaaaaaaatccattgataaaaccctcttattttgctgtttgtaattctttctaggtctccacacttaattaatttgccttttctattttaattcttatttgcaggtggagagtgagtttcaaaaagcctatgacaaaggaatgtcaaaatcaaagtatgcttgggatttatactgcctccaaaattgcattagttgttgaatggattttccatgtactgacctggtgctattttaataggttctgggagcctacctatgaagattgcttaaatttgatagctcgccttccagcagtggcttcatatgtttaccggaggtagctttttatcaattcattcaccatctttacttaccaggcaatctgtaaaaattttcaactgcaatagcaataatgccgttttctggttctctgaaggatattcaagggagggaaaactatagcagctgataatgcactggattatgcagcaaatttttcacacatgcttgggtttgatgatcccaaaatgcttgagttgatgcgactatatataacaatccacacgtaattcattccatccttgttttagtttctatttatttctaaaagacttggtttgatttctttttcctttcacctgtgttcttccagtgatcatgaaggtggaaacgtcagtgctcatactggacatctggtaatttttgtatttctggtttcaatgcagtttttttcttgttagcattgccactattgttgtaaacctgccaatggatcatttctggctgctacatcatccttgtgcctttttacatatgttacacttttggcatgcactattgcactggatgccactttaagcctttgatttgctttgctgttattactatgtatcggagatatattaataagcactgataaaccaaactagccattttaaggaatatgaactaggaacaaaactaaaacttaaactgcttttagctgagttcttcattactttaactgttatcttgaaggatcatctgcttagtactcatggagtcattagtcttacattttattgtctaatagcatcaaagctatgactgaaaatatgtatctatttctgctagatagctattgtatgtctaggaaaatcctggtgtatcagtatggccttttaatgcattaggaaaggtaatataattggttgcgctgtgatccttgatccagttagctgaatctctatcttcaaggtagaagtggtaatgatagtacaaggtagcctcttaatttgccgcagaaaaccttgcaatccgttatctttaggatttatcacttatgatctatgacttattttcttttgctggcaatggcctctctctctctctctctcatgactcatctatgggcactgacctcttcattccgtgctcatgatattcaattacagggttggaagtgctctgtca

SEQ ID NO: 62839 - DNA, 4822 bp, Oryza sativa
  unsure (1)..(4822): unsure at all n locations
gcgcgcnntttagaatcctcatcttgcatgcctgcacgtcgactttatatgaacccctttatttaaccctccaatgacggttgtaacggttggaatagtcggaaataccctccaaccgtcattgggagctaatccacaccgtccagaagaagccctgcatccaacggcgacgagggccctggttcggccgaacctggggcttgcccaactagcccatggtttggctgggggcctccttttgtgttcttctctacagacttgtgaattttggcccagtttgtcatgtcaataattctaagttattggctcattcatacataagtctgattctcgacattttctgattgatttatcgtctatgttgatgtcaattctcctccactttatgatcattctcaacaaaaggttagtaaacctaatactagtggaatattattattctaacataaatatgcattgcaagcataactagttctcctctattttggtaatattgacggtcgaaactattcgataatgaccgtcaacactcccgtcgcctcgctctgaaccctaccacccaaattccggctgtagccaccgtcggctgcgcgtcacccacgtctcgccaccaatcccgctctacgtgcgtcacttcgtgtcgcgtcgccgtcgaatcgccaccagtgcatgacgccaagtcttcacgtcgccgtcccctcctcccaggaatcccatgtcttctcttccgaccgccgaggagtatctccagtagcaagccgagtatgaagacttctaaatgtttcgtgcctagcccaaacctcgcctgtggaataagttagttgcctaggttagttgcctagtgcttagttgtttagtcgcttagtctttccgcgctgttcgcttctgcgccgtcgtttttatggttatttctgtaatgattgtgttgtttatctatgggcctgtccatgatgacaacttatgtaagaactactacccggtgatgtaataaagtagtttactttgattcatttattctgtgtgtaccagctagtgtatcctgggactggtactatattaaaggtaatgcataacactccggtgtaagttagctgtgtttatggctaacgaatgtcaggcgttataattttttgtcaaaatttttgggatctaaacacacccataatttagatgttatagctgctgaattgtttaacagaaaaaattcttttctaactaataaagtatgataataggagaaaaaaatatgtgcaaaaatatgaagacattgagagaagaagaggtgaaagtaacgtgagtatgtactatccttaaaacaaacatacatacatatagtaatacgtacggctcaaggtgaaaaaaaaaacgttcgtacatacatatagtaatatacgtacacgcccaaggtggacctcgtatggggttaggcagtttgttttcttttgataaatctaatggtggtaaataatggatccaccaaatttaatgaaaagcaatagctagagaatttttagaaaattctctaatttattataatactacgtggcggtttggaaacgtttgtagtgtatcctgggactggtactatatcacaggtaatgcataacacccctatgtaaattagttgtgtttatggctaacgaatgtcggggcgttacaatttttggccaaaatttttggtatctaaacacacccataatttagatgttattgctgctgaattgtttaacagaaaaaattcttttctaactaacaaagtatgataataggagaagaaatatgtgcaaaaatatgaagacattaagagaagaagaggtggaagtaacgtgcgtacgtactatccttaaagcaaacgtacatacatatatagtaatatacgtacaggccggctcaaggtggaaaaaaaccgttcgtacatactatataatatacttacacgcccaaggtggacctggtctggggtcaggcagtttttcttttgataaatctaatagtggtaaataatggatccacctaatttaatgaaaattaatggctagagaatttttagaaaattctctaatttattatagtgccacgtggcggtgtaggaacatttgtaggatgacacgtggcgacttaggagcgtttgtaggaaatataatggacttttagtatataatagataatagatagatagatagatagatagatagatagatagatagatagatgatagatagagaaacatgttaattacatgagcattgctctagtccttcttttttaccacaaggtactagtaccgtgaggtactgaaatcccgtccgttgatgatggcagatcgaacggtcgcgattacatggtacctcggggtactagcttggtcatggggtggcaatcgcgagtgagccatggtgaaagggtataatcatattttctcgtttggaaggatgtttggatcggtggtttgtttggggaagtgccgcagagtagcaaaaccctaggcttcctcctgatggtggcgcgtggcggacaatacgacggcgacggctatggcggcggcatcagttggtctcgacgctggcgtcttccacttgtcccgtcattttccccttcgtggcggtgcctcatccattcctctcgacaccgctactcctgcgaccatgcggcggatagggtcctggagatccactgcagccacagcccttgcaacggcgtcgagacgactcctgcgactgcgacgatgactcctgcggctgcggctgcgactactcctgcgaccgcagcgataactcctgcagcgctggtgaggacacctgtgggggccacgcttccagaacgattgaggatctgcatctgcctgcggccgtgcggccgtgcggcggatagggtcgaccttcacctcgacttttttctcccgtgcagtgcagcggcgctagatgcaggagaagggaaagcgagagatatcgaggcgcgcacgctatttggaccacacgcgatagctccccatcgtacccctcagcaatcaacggccggatggagactggtgcctcatggtaccagtaccgcgtgctacaaaagtgaggacgggagaaaaactctaattacgtatattgtaattatagtgtgtaatataattatatctcaaatataaaatatattgtaattatagtgtgtaatataattatatcttaaatattttatatttggaagttttatgacgtgttttgagctgatagcccacgcaccgggactgttatctgccaacccacgaggtcacagctcatctgtagtcttgtttttacctgttcagacagtcacgtgatccattcatccaaggtagtaggaagataaattctccatccctcccatcaaatatcaatataatcttaacacattcaaattcatagtattacaatgtatcatatctaatattgttgagtttttataagatggaaagagtacaagtgagatagacgagataatatagactagcctattgaaaacttttactttgccgtacatgtagtattagttttttattgaaaataattgaagctaagcattgaccaaatttctctcgagatgttacgtataaggatcccatataatctaggagttcttgctaattaactactccctcattaatagaatataaaaagttttaggattggacacggttattaagaaaatagatagaagtgagtggtagagggttataattagatgagtagtgaagataggtggaaaaagtgaacggtggagggttgtgattggttgggaagagaatgttgatcgagaagttattatattttgggacagatcctgagggctattttgggacggaggaagtatagtattcctctgcaacagtatattgatgaacagtgtttggcaatttggaccactgcgttttgatgcacggggattaatactactactgctaaagttaatttcagttatactggcggttgcaggtgatctccattttcgtcatgtcacacgcatgcaggcaccacaccaacatgatcaaatccaatttcccaatctccattcttgattgggagtaagcagtccactccaacagacacaattttatacattcacacacagtgcttcgttgttttatatacatatagttgcaaatatcccagtttcttccacactattgcttgtcaaccccagtagtgctaccaatggcgtcggctttgttcctttggctttcatggcttgtgctctccctcctctccatctacctcctcgatctcctggcacactcccgccgccgcctcccgccgggaccccgccctctcccgctcatcggcagcctccacctgctcggcgaccagccacaccgctcgctcgccggcctcgccaagacgtacggcccgctcatgtcgctccgcctgggcgcggtcaccacggtggtcgtctcctcgccggacgtcgcccgcgagttcctgcagaagcacgacgccgtcttcgccacccggtccgcccccgacgccgccggtgaccacacaaggaactccgtcccgtggcttcccccggggccgcggtggcgcgagctccgcaagatcatggcgacggagctgttagcgacgcaccggctcgatgcgctccacgagctccggcaggaaaaggtgtcgaagctggtggaccacgtcgcgaggctggcgcgcgacggcccggcggtgaacgtcgcccgcgtggcgttcaccaccagcttgaacctcctctcgcgcaccatcttctcgcgcgacctgaccagcctcgacgaccgtggggcgtccaaggagttccagcaggtggtcacggacatcatgggggcggccggaag

SEQ ID NO: 62840 - DNA, 590 bp, Oryza sativa
gcatatggtattttcttgtgcatgctaacaaaactttgaaggtttatttgtctctagcatagcttgtatgtattctagtcttttcatgagatttatattttacttttaagggagatgatacatgacacttaaattctacttgaattaagtaaatatgcaatgttgatgctatcatatggtttgatttataaatgctctatatatatgctttattgaattgttattcctcaaatagctttaattgctcattgtgaaaaagagaataaaaaatatgaaaaaaatgaataccgaatccttggaaatagtcttgatgacaaggacgtattcgatgtgagcaaaataatgggtgccaaatccttggaaacagtcttgacgacagggacgtacccggaataaaagagaaaaatatgagcaaaaaggctcaagaaaagaaaaggttcaaaaaaaattctcttggttattttgtgctaaaggttatttgagaaagagtgataaatgcaatagatatatgtgtttagtgtttattcttcaacctatgtgcttgttaagatgttgcattataaatcgtatgaaatcatgaattttgattg

SEQ ID NO: 62841 - DNA, 1187 bp, Oryza sativa
actatagggcgaattcgagctcggtacccctgtcttctcctgtaagcttgtttacgccacaagttttctttcgtgataagttatcttttggtataaactttcttctaatgcaagcttctttctatgctgacttttcactcttgtcttaattcatccacataaaaaacatatttcataacaatattgtgacatttatctgaatatattttggagtggcattttaaaaactagttaaaaccatatgatttgccgcggatacatggataattgcacggtactacctctgtctcaaaatataaaggattttgactagatatgacacataatacgaatctagacaaggagtttgtccatattcatagtattaggatgtgtcacatccgaccaaaatcccttatattttgggagatggaatatatattatagaaaggaagtgtcagggttatggataccacatacccaatagtaatcgactaagctcggcagggcccaccatatacgaagtcttataaggaatcatacctcgtatatagaaggagttctggataaggaaggacaataagagttctacatggaaacgacaaggactactcggattgtatccatattggtctccctagttctacttcgagaaggggacatctatgggtataaatacaagccccctaggaagagaggggacacgccacgagggcacaagatacacaagccaatgcaaaccaatatgtcaccagataccgacatcagagattagcctagacaaacccaatccggtgcctacggaggccgacaagagggattagcgctatctctgatctcgacgagttcatatttgaggaggaagacaactctgccgtcgactacgtgttggttatccatgccgccaaatcgacgaaagctagataggttatccaaatattgtacttgtgtgattcagatgaataagagcaacaccggcttcggccaacatgatgtagggctattacctgtcagataaggggcccaaacatgtataaaatccttgtctccatctcttttacctcaatctcacatataccctggtaccgacgatctccatactatccaaataccgtagtcgcgatctcaaacatcgacagtgtaagggtatacctgagaggctatacccgcctacagtatttgtatagtatgagaatcgttggtgcaag

SEQ ID NO: 62842 - DNA, 3552 bp, Oryza sativa
  unsure (1)..(3552): unsure at all n locations
tgcgaacgaccgcccttcacttgaatccagtaagggccgctgccccacgcaccgatctgcgnncgacggtcgtccacagcccggatcacaagacggtgtcggcctcagcggcatgcgcgcgacggcgacgaagagcggcgggttcagcggcgcgtgcgcgcaacgtcgncggtggtgacggccggacaggctcggacggtgggaaggcaccggatccggctaccgcgacggcgacggcgacgatgacgatgacggagaccgcgatggcgacgacgacggcgaccgtgaggagggttttctttttttggatattttttttggttttttatttttgcgtgcgggcgacataaccaccccgcacgcgaaaatcgcgtgcgggtgcgccacccacacgtaaaaatagtgattttaaagacacttggttccagacagttggaagatccgcacgcgaaaatcacttttgaccgcacagaagaatcatttctctactagtgtgtttagggctgtataggtccaggacctaaagttgtgactccggttggtcctatggtagatcaggcccaatgtgacctggatggcccacggttggtgggccaggctacgcactctaataagtggtatcatagctcaggtttggaatccgcaatgatttctatgggtcacatgggttgatgtgacggaaaagattgttgacaaaagtatgatatttacacaaatatcagatggctacctcctcgtgtgcaaagtagagttttcacaaagtttggaatccgcaatgatttctatgggtcacatgggttgattgacggaagagattattgacaaaagtatgatatttacacaaatatcggacggctacctcctcatgtgcaaagtagagctttcacacgattattacgcgggtaatgctgcaggtggcttatctattctattttcctttctcttctctctcttttaaccactttttaaaaaaaaattagacaatttttccttctaaattaattatacgattcatgattcaatttcatcattacgttcgtcataactaaatctttataaattgattctgcttgattatatttatgagaaaatatataatatgattacagatctaatttaaacatttttatattatacacgaaacaatgagatgtaaatgttggaatattagaaaatactcaatgaaacattcaaagtacaatacgtgcaatatttctgaataaataagtaaaacattagaaaataatgaaacatccgatgacactacatgcaccattaacaaataaactattgaaacatcacaaaataattattgaaacattaaaaaacacacccggtgtgacatttaaaatagatccattataacacaaaacttaaaagatgcagcatagtcaaattctaattgtaacatttatttctcacacgtcaaacttttgttggagaaaagaacggtacaggtacaactgcactgaacccgtcccccaatttcttcttgtaaatacatatagttgcaaatatcccagtttcttccccagtactgcaatggcggctttgtttctttggctttcatggcttgtgctctctccctcctctccgtctacctcctcgacctcctcgcacaatcccgccgccgcctcccgccgggaccccaccctctcccgctcatcggcagcctccacttgctcggcgaccagccacaccgctcgctcgccggcctcgccaagacgtatggcccgctcatgtcgctccgcctgggcgcggtcaccacggtggtcgtctcctcgccggacgtcgcacgcgagttcctgcagaagcacgacgccgtcttcgccacccggtccgcccccgacgcctccggtgaccacgccaggaactccgtcgccttgctgcccaactcgccgcggtggcgcgagctccgcaagatcatggcgacggagctgttctcaacgcaccggctcgatgcgctccatgagctccggcagaagaaggtgtcggagctggtggaccacgtcgcgaggctggcgcgcgacggcgcggcggtgaacgtcgnccgcgtggcgttcaccaccagcatgaacctcctctcgcgcaccatcttctcgcgcgacctgaccagcctcgacgaccgtggcgcgtccaaggagttccagcaggtggtcacggacatcatgggggcggccggaagccccaacctgtcggacttcttcccggcgctcgccgccgccgacctgcagggctggcgccggcggctggccgggctgttcgagcggctgcaccgggtgttcgacgcagagatcgagcatcgcaggcgtgtcgccggagaggagcatgggaaggtgaaggacgactttctgagggtgctcctgaggctcgccgcccgcgacgacgacacggcggggctcgacgacgacacgctccggtcagttttcacggtaaggacatgctccctctgaccaaaatataaaaacctcgattttctagtgaatctgaataatctatccaaaataatggtaaatgtcttgtagaattttaggttcttatattttaccacgaagagagggttcagctttttcacatgctgaaacgtctagcgagttccattgtagctactgtaggtaaacagaaacagcaatagttaaattaggtttgctgtcaatgtcgcatacttccgttttttaacccatattgttgttaacttatcgttgttgaatttagttccacgtcggtaattgataatgggatagcacaacttaaaaagtgagggcagtaattatccaagactagtctcactagtactagagaaacaattttcctgaatgagctatttagtttacagacgaacccttaagaagcctgtaggtgaaaatcgcatgccaaaataaaccgattttcttatttttgcatgcgggcattgttggcctcttaaaaatatacttacaagtcaatccttcatcctcttttccctcctctacacttcaaaattcaaaatttcatcctctttttcctcctcaacacttcaaaattcaaaatttcaccttgcgggcctcttgaaaacatgcctacaagtctatccttcctccacttatccctcctcgacacctcaaaattttatctcatccacccatccacgtcattatcctttctatcctctctctcactctctatcctcttccactctctcacctctctctcccgcggccggcgtgggcgcggccagcggcaccgcgcggcttggcggcgtccttagcggcagcgaccgagagcggtgagctcggcagcgtgtgcgcgccgctgcggacgaccgcccctcacctgaatccagtagaggccgctgccccacgccccgatctggcggcgacggtcgtcccccgcccggatccgaaggcggtggcggcctcagcggcatgcgcgcggcggcgaccgagagcggcgggttcagcggcgcgtgcgcccancggcggcggtggtggccggcgggcaagcttcgacggtgggaggcaccggatccggctccgcgacgggacggcgacgatgacgatgacggagaccgcg

SEQ ID NO: 62843 - DNA, 522 bp, Oryza sativa
ttgggtgccgcttgttataaataatcgacacatataagcccagccacgtggcatgatggtccagaatcggtaccaataaattggtataggtgtcggttcttgatacaaaaccggcacttacatatattataggtgcagattttacgaccggtgccgatatccgaagtcatccatgccgttatctgggtgttggttcgaaaaaccatcagctaagtgatttctcgttacctatggtgtagttgaatgtgcacccagtccacctggtcatcttgtatgagcacatacactaattaaaatctttgtgattagctggctggtttgcaatcccattggatgagtttctagaagaaaaaaaaactatcgatttttttttcataataactccgtaataaaaaaaagttctaaaactactggattgacgaaaaccaagcagctttcacggtttttttaatcggtaatgaccccgacgtctttttttttttgctccacccctgacggcagtatagatctaatctaacggta

SEQ ID NO: 62844 - DNA, 3872 bp, Oryza sativa
cgatctccgtcttggattccgcttcggttttatcttcatctccgatacttgaattaccaaatttggttgttaacagttttacactttacaaagtttgtacaacgttaactacataatgtgagtactctaatttgtccggtacccattggtaccacaacactctacgtgttgaatgcggtctagaagttacaacgtaacctttacattactcaaagcctagctttgcactggaacgacaagtgtgaatgacctagagctattaggtggctggcccacgccttaaacctaacgatatgacgtcaaacacatatgtttccccatgagggactataccattatattggataaacatagttgcctggattacccttagcgggcaaatagttagctcctcttaatcaccactaaaactaattcatactactccggcctaccaaaatataaggttagaccctaaataacttaatcaactaagtctatcccataactagcacatgtggatgtacggtaaacaatagtgggtgacacaaagttcggttcttaatcgactcaggcgaacactcctgctatcagtgcacaactaacaccatttctgcatcacttatcgtccaagtctaaattcactatttgttcttaaggcaattattgcgacgagcaaaactgagtttaaaaataattgcaaagctcgcaacatgatttacttgaagtatcattattccacattagtagaatacatgaatcaatgtttaaggtcgtttttacgagtagtacagtactgtcggtagagaccatgtgaaagcactcaaattactaattgtactgctgcagtaaagcataaacactgttatggagtttgggcttgcgcaaattacaattacagtacactcttctgagaaaacagaaattgattctacctgaacaaggcacatcaggtttgtccagggcatactaccttagggccctttcaatcaaagaaattatgaaggaatttcataggatttcataggattgaaatcctatagaaaattttcctatacggccctttgattcaaaggattaaagttttccaaatcctacaaaattctgatggaatgactttttgcgtataggttttggaggaaacttagtaagaggtccaacctcttggtaaaaatcctttgagtctatctctcttatccgattcctgtgtttccctatggtccaatcaaacgatcatttctatgttttttctgtattttgtaatcctctgttttacccttacattcctatcagaatattatgtttttcctatttctccttttttttcattcctatggttaaaaagagcccttagcttgttcgcttgctgaagctttgacccggagatatcgatttcttaactgtatgcacattttttttaaagaatagagaatcaaatattgaaggaattcctgaaaggagattggatgtatgacattggctcaaagagtcgatgtcagaatgatagatcgagacaattaatattaaattcaagcaaggaaacttttacccaaatagtatcaattaagtggtcagccaaaggagaaatgtactagctagcaaaaataaaagaacaaaatctaattaattagttaaatccgaagtgcacgtcagattcagacaagaaatctcttgcgctttttggcatatctttcttggcgtctgatattaagttttgtgcatctggtttgcaccgtgaacacgtcggcgctcagttgaaatttgcaacatgcatgcatatccaactgtttgctagctagaacaggagatgccacataagagcacgatgtgatgccacgtaggtaataactggtcaccatcttgactgacttgaaacaattttggcagaaaagggtgcatcgagaaaatctttgaaaataataaagtgcacgatatttgacagtcctagtacttcgtaataaggccccgttagataatgatgaagaaaaagactagggctatgtttagttcatgctgaaatttggaaatttggttgaaattggtacgatgtgatagaaaagttatgtgtgtataaaagatttgatgtaatggaaaattgaaagtttggaaaaaaaaactttggaactaaacagggcctaggtacgaatacctaaaacaacaaagccaaaccaatgattaattaagttttttttacgaaatacaccatttaacagtttaaaaaacatactggtaaaatttatatcctaataaaaacgaacggggcctaagaccacaaatcacatttgtgcacagttgattagcatcacaaatcagttccatgagaaggagagaacatataaatactattgtacctccaccctaaaattttagttgtaatttttagctatgaatacggacaagtgaactaaaaattgttatattttataattttgagacgggtatagcaccagttataaacatttggcatttagactaaatttggttctaattttgaaacatttgaagtttaaatgtttgaccgaatcgcgtataagtaaatgtgaaacttacagccaaatatcatctcgagttcctacaattatgacacgacgagagtacagtaatattagtaaatgttggctaaaattatcctgttcatgatcgataatattgaactaccgaaaatctgaccatttacccttataaaaacatattattgtaagattagacccgttaaatgttttaaaaaataagccctgattttagcaccatccattctagcgcagaggtctaacacgttatagcaatccacaccgccgctatccacaacaccacttaccccaccgcgatggcaaatgagatttgaggtgacacactgagttaacgagaaggttagcaccattgcccttagccctgacctctaatgccttaaagtagtggatccactacttaaagagtcagtgggtgagagcatctataatgtgccataaaatggatcataaggccacacatgcacaccaacaccagatatggtgagagtggttatagggtatggtgggcctaatcttaaattaggaattttacatctagatgtgtaacccatcttcatatatattcttgtcttaagcattgtggcaatgataccttatttttacataggatatggtgggatcatacatttttccagtccaaaacattactgccatgaagcaagactacattactggagaactgatcattactcggatgccaaaagatcatatttgtcttggttcgaatagaaaggttcaacagctgtcaggcccccaacgatctaccacccgagactaaagatcaatttttaaagcccgattggtgatatcaaccgagactaaaagatgatctttagccccaggaaaaaaattgatttttaagtccgggttgatgctagatggagtatctttagtcccgggataaaaaaaaaatcgatctttagtgtgtagcaggtggaatggtaacgtgcgtgagggctgaggtgagagatcttgagtttaaatctcacatcccacacatttttttaacttggtatgcatatttagtccctgttagacatctttagtctcggatcatgtgtcccggttgcacaaccgggactaaagttcctttctccatcagtgcagcaactacacaaagattgctcgacagatagtaaggatctgtttagcacagctccagctccacctctcctaggtccagccaaacagtttcagctccacttgaaatggtagtggagctgggtgaagcgttctcacaaaatgaactagagagttgtagctgggtttaggcagctccacaactccactccagacttagggcccgtttggtagagctgcagctcctaaatttaactccagggtaccgagctcgaattcgcc

SEQ ID NO: 62845 - DNA, 31457 bp, Oryza sativa
agctagctcagtcgatttattctgtcttaattcaggcctttacgagttacgatcaatcaatcgatcgatcattgaggtgtcgccagccgcgccgccgtgccattccagttccagctgcagctccacctcgccggactcgacgccggcgagcctcagcaccaggccctgcgccgccttcccctccgacgccgaccacacaacggagctcccgctccttgggaccacggcggtgccgtcctctttactgtcaacgccggagggggtacggcggcggctgctcgccgcggccgcctccaccagcggccggagctcgaagaacgccgcgcccatggggtcgtcgacgaacgggtcacggtcgtagacctcctgtaagcaagcaagcggagattaattgatctctagcctagctaggagaacacaatggagtacatcgatcgatcgatggaggattggaaggtacgaacgagagtgacgaggagatggttgagatcttgaacgatgagcgtcaggtcctcgttccacactggattggtgtttttcctcactgtacgagttctcacctcctgcagtcaggtttccattgtcagtgacttaaataaatcttgaaacaaatctaacggtttaaaattatatgaaagttacatacatgttacattatattatagatatatgtaagttacagtgcaattacattacgattatactataattatatcagtcaaatttttaggagaaaatttgtcaacaaatatatagcaaaattaatgtataaacgatacgctcaatccaaaacatacaatgccataatcacttgttacatatggcacatttttttttaacgaccaacaccagaccgaagattctattgacaaattagaaaaaatatatatataactaaagccttggaagctataaaaaaaaagaaccaagaaaaaatcatccaactaggcaactgcacccatgagccaaccacctactgatcacgacagctccacacaactgaaacctagcacaacctggcccccggccgctatacaagagcggtcgccttctggcctacaactaagccagaactataaagatccgctcatccctcgtactaattcagcacactatgaacttacgattgaatcgatcctttgttcacaaaattcttttcttttttaatccttcataaataaaattgtaaatatcatttttttatattttattttaataatcctgttgtttctcgtaaaaaattatgattgaatcttgatttgctatgatttttaattaattaaattaaatggttgagaacttcgttcctcgttggcaaggatgttgtaagaattttcgaagtactcatgacactgctctttccaagatatgactgttgttacgcgtatagctaaacaatatgactgcattttcgtatttctctacgtaccgaattgcacgccaaacaggtagtttgtcaccaactattagtttttgcccccaaaccaactcgatgtcgtaatcttgaggcaatggttatgtaactgtttactaattttggatgaagattcacaaacagaattcaataattgtgtactccttatcttgggttggtaggtgtcttcttttttgtgtgagaaactttttattttgtatgctactctataataattagttgtaactcattgagcaaataccaggattttctattccattatctaaaaaaccaactcgatgtacgtcaatgccgcatcatttgtgattacccatatactccagtaactaatctttcaattcccaactcgtgtagcagttatcttgattgttgtcagtacattcacatcgatgtgtcatgagataataatgcaactaattaagcatttgaagcaaccaatatgaatgcatgcattggcagcgaaaactacatattttagctctgaccgagtcacgaccgcaccattcggcagcttaagttggtccaaatcaatcgatgaacaccataaattgttatgataaagcctctacctaagagcatttgcaatggtccaacttgaataatagcccctgtaccgaggccactccagggagtggtgatttaatttccagggactcggtttggtcaaaccgaatagatgaggtccctcttcaacatatgctgggggcattccagtccatacgaaaatacagtgcacaaaaaacggctacagacgcgattccagcgtataacgtggcatggaaggtgtttcatcgaaattgtaatggcatgtttgtgaatagtcgaatagtaatgttattttttaaatccagtaaatctttaatggcacgtatacgtatgcacatctcgcaaatcaattcctttcacttagctaatgttataccccagaggtttcagatgatccatttgaacatatttcagttaatttggtacaaattcgttcgaaatacggagcaatttttaataatcttatggcatgttcaaattgtagccaaaataaaccttaccaaattttagcaataccatttttttaatttggtaatattgtcaagttttgacaggattttctatgtatttactagagtttggtaaaaaactaaattgatgcagtatttagcaagattaccaaattttagtaaggtttgttttaattacaatctgaacaggccttcaataataactcggcaatagtacgtactagcaagcttaattagcaggtcgaaagagtgaaagagatcacctggttgccgagcttgaggacgacgtagggatcgctgctgaagacatcacggacggcaagattggtccctcgcaccaccttcaccttcaccaccccgacgatcacactgctgctgccgcactcctttgccatcgatatctatcttgctgagcttgagtaagacagttcagagttgtgtcctctcaaattagtcttgctcctctactcctactatatactccctccgaccaaaaaaaagataaaccctgggttttcgtatccaacttttgattgtccgttttatatgaatttttttataattagtattttcattgttgttagatgataaaacatgattaatactttatgcgtgacttgtattttttaatttttttttcatatttttttttaaataagacggacagtcaaacgttggacacggaaatccagggtttattttttttttttgacggagggagtactatgtacttatgcctctatatacatctttgtttgtgcaagtccgcaaggcttatatataattaattgttccacgtaagcatgcatgcttcacgcttggattaattaaaggggactaattgataatgtgacgatcagcaaactgatcatgacactggagaagaccttatcacttgaaattttacacatttaatacagactcaggaccaaatgtgtaaaatttcaagcacatgatgatcaaatgatcaagaaccagttcatagatctggagaatgataaaccatcgtaagagcaggtacaatagcaaactataagccagctgcaaacatattttaaggagataaataaaaagagagaagagcagcggactacaaatttatagccagttgtagcacggactctaagacacgctgtgtgtatgataagtgggaccaggtattaatagtgtagtatgtaactattgtatgaatgagttattagattagctatagatgaattagagttagtagtcggctatactattaaacttgctctaagcaaacatggacataaaaaaattaggagatgacataacgaagcttaacccaataaccagtcagaaatcatggtggtgtcgaagacgccgtggtccggttgtcagtggcatccatcattaattgattggtcaggcatactgacgccgtgttctggttgtcagtggggatgatcctcctgccctgagaggaaaagaaaccagcaaaatgacaggtgcacagttcaaatttctaatgccaaaacaagaattgagatccctaaagtttgaaattattgcagctaatacaatactccacagagagagatctaaagttcttcaccatatttcgtacaaattaaaagccaaaactctaatgcatggcccccctaatatcactacaccagcaaaatggactgcagcacaagcacgtatggataaaaccacaagagtaaaatacaccagcggtccttaaacttgtcaggaggtttcacttaggtccacgaacttgcaaagtgcatatcaaggtctctaaacttggtttattgtattatcccgatccaaagccgcgtttgactgtggtcttgtctacgtggcacgccacgtggacaatgacatggaatttttttttcttccttcttccttcttttttttatttcttccttcttttttctcggtggtgagaggcggcacgaggggaggggttgtcgcagtggtgaaaaaagaaggaagaagggagaatttttttaaaaaaattccatgtcatcgttcatgtggcgtgccacgtaggcaagaccacggtcaaacacggctttggaccgggatgatacataaaccaagtttagggacctcgatgtgcactatgcaagttcgtggacctaagtgaaacctgctgacaaatttaaggaccgcaggtgcattttactcaaaccacaattatggatttgaaagaaatgtatagtgcagctatatgaccaaaggaacataagtaattaacgccagcacttacatgcttacaatatggcaaaagaacataagtaaaccctcaatccaagagcctcataaattggacctcaaataaaaggcaaatgtctcattgcaagataatctatgagaagaacagagaggaacctaaaacatggcaaaaaaaattgctacgtgatgttttttttttcctccatctgaagacttactgctaagaagaactttaggcctagataaggacagataaggacattatgatctgctcctccgtttcaggttataagacgttttgataaactgttacaagtttgactaagtttatagacaaatatagtaatatttataatactaaattagtttcatcaaatcaataattgaatatattttcataataaatttgtgttgggttgaaaatgttattacttttttctataaacttggtcaaacttaaagcaatttgactttgaccaaagtcaaaatgtcttataacctgaaacgaagggagtatctatctattataatattttactaagactgacttgaaagaaggcaccacgttcattttgaaaaccagaaattgtcacataattatttggagaaaaagaaaaatatcttaagtgttagatcatggtgggttcggattataaaagtgtagatcaattgatattgttctatataaaatacaattatatctgcagaaatagaatttaagagttgtatatgaaatctagagcttataaaaatagaacctaagaatcatatatgaaattcaaatataatttcacatataatggtacctatataaataaaattttggagttacatattaaatcttactctatgtgaattatctagcaacgggcaaaactgcagttttgcgcaaggcaatccccctagtttaacatgaaaaatagctatgaaagctcaatagagattaacgaaaaccattgcctctttattaatatcacaaattgcaagttttagttctagatatcatttgtgaactacctagattacatagtcaaactatgatgctagaaccatacaaaattgtcatccaataataaaccatggaaagtatgtatctccgcctagtgcactgcccacttccgtcactttgactagcaccatcgttcagcctgcccttcacatgatatttgcacctctctccgccaccaatagctccctcctctttttttttttttgacaaagagagttttatcgatcttagataattacatcaagaggatacaatcattctaagaccaccctcggtctctgcatagctctctcctcttggggaaggcgattgaggaaaactcattgaagaagttcatatcatttgggacaaccttcttcttgtgaaaatggaggactgacatcaaatctggtgcacatatactgctctctctgtggcaagcattggtggcacgcctagtagtagttagcggtcgaccggatggtagatgccggagagaagtttggaagttccaaccacaactagccacaaccgtgatgaaggaggtggacattgaaaagtccttcaatttgaacaagaaagggaaacaagattaagccaaccacggaacaagcccgaccgcggttgctcctccctcctaatcggtgactaatagccgtcagaactggaggaggaaagggtcagccgagagaaagcatgagtcgtttttgagtcacctcatcaacacggagatagggggaataaaaaaactgaaactttaaatacaaatttaaggaggaaaaaaagaaatatcaataagaagtaaagtggattaccgagaatagggtaaaattatccaaaaaatttagggtttaaatgcgccaagcgatcagttcgaggaagtacctgaaataattttctttattttatggagagatcataaaaatattatagtccctgtacaaaatttgtagacggagagtagtatgtaacatagttttaaataaaagttgtttcacatggttcgaaattatcataatctacgataataccaaacagaaattaagaatataaccatggtttacatcctctactgatttcacagaaagcacacccttcagggaaaaaaaaagaaaggttaggaaaggaaacgagacagatatggtctgacgcacttgatacgtgagccggttgccaaagcttgaacatcccttttggtcgagtcctctgatcctctcacgcaacagtgatgaacagtgcgtgcaagcgatcgatcgttgtcaaacatgtgcaacacacacaaatgcacatagcacactgattgtccaacgagacgaatatatataaaatgtggtggtgatatacgaggacaaactacaaaggcatatatattaacatgcgacattaattagtggtagcataataacatcaacattgttattgtttgtgctaagcccgcgagcttattaggacgcttttatgtgtggccgggcccgatttggtgattgtttttgtagtactgggccgagctgtctgtaccgagattttcctttgcgtttcacgacgccaccaagcgtcgtcaccgggcgcggcatgggaacggggcatgggacagcagcggccgacaacgcaggccggcagccgggtgcgcggcgcgcacaccgaaaccacctaacccacatttggccgcaagtggttccttcgatactcccataatataaaagattttaactttttcttacactatttaactattcgtcttataaaaaaatagaattattatttattttatttgtgacttactttattatttaaagtattttaaacacaactttttgttttttatatttgcacaaattttttttaataagacgagtagtcaaatagtgcaagaaaaaatcaaaattctttatattatatgatggagcgaatagatatagcttttttaagatgttttggtctatctatcggtacaaatttagacgcatatacgatgaagtactcatgcataaatctctacgtctgttctctatctctactattataaaaattgaagatgtttttgtcagtattttaatacgtcaaccgtatttgagtcggtttttaaattcgttcgcttttgaaaatacatatccgtgtttgagttgaattttaacttcgtttacttttaaaaatgcaaaagaagtcgtataagaaatctctgtaataaaactcgcatgctaacttgagatgaaagtcgtacgcctaattacagctcatgattttctaaaaaaatatctaagcgaattccgacgatgaatttcatttagctaaaccgtataaatataataaaattaaaatataattcacatgtttcaacgcacaggcattttttctacttacttaaaaagtataaaatatttccgtcgtccataataaaaagagagcggaaaaaaagtcacgcaaaaaataagggatttgctatagagcagcatgctgtttttttttatcagccgaatgttggctagacagtccaaataataaaacaccatcgaaaaaaaaggcgaaacaaaagttcggtaaaaatacaaggaaaaaaaacgccgtccaaaagaacagcaaaaaaagtacgattcgtaatcatcgcaaaaataacagtggcggaaaaaagccatgaaaaaacaaaacaacgcatatgtaaagaaaataaaaaaacagcgaaaaaaacgtctcattggtaggcaacgaaaaataagccggaaaaaaagaatcccaaaaaatgcagaaaaaaatcattcgatttctacaccacgggaaaaaataccgtgtcacaataaaaaaaatccagcaaaaacaaaaagacgtgtccataaaaaaatttaaaaaggatgaaaaaatatttgtcaaacaatgggatattgtttcaccaaaaatatgtttcattgttctactcattacatgaaatgttccagaagatgcaacatttaataatatacagaccgcaacaccatcaatgaatatatgaaactttgagtcataatgaatgaaacatagaaaaaatatcatatgcaacatgtattatattttacaaatacctaatactttttataccacgtctgaaatatcacgctataagcattgaaacatcacaaattaccaactaaaacattcttaaaacatgctatgtgatatttacaaataaactagtgaaacattacgaaatacttattgaaacatctaaataaaataattgaaacataaacaaagatttattgctacaaaaaatgttttgattggaatatagtcatatcgtatcttgttataaagatttaactacaataaatataatagtgtaatcgaatcacagttttaatatatggttatttggaaaaaaacatttgaagcttgttaaatagctacatgcatgaacaataagtagtatgtcagctgactgatgaaagagagaaatgcattggttgttgaaaaagaaacgacatgtatgttggttgtaatttggggcaagtgttatacggtgcgtctggtccgatctttttagctggatcggacgttcgaccgtaagcattttcctatgattccatgagaaaaagtttggcacaacgtaacgcgagaaacaaaaatccggttccacgcaacgagaaaaaagagcaatccgattcgaggaaaaaaaatggcaagaaaaaacgcagcctaaaaaaaggttcgcgaaaaaaaatcatttcgctcaacgtttaaaatctgattccaggaaaaaaaagtcgtcccggaaaaaaacctcttcgacaccccgcaatgttctatatatcctatctctatgaagagcgaaatttgttttcttcgttcatcaatttcttcttcgtatcggtttttcggtgatgtgctttttgggttttttcacgcacgcattgacgtacttcccgagtcccgcgggagtcctccgtgcgttactaaatcagtttgggtcaagtttttctgcacgtatatatccaattcgtgatcacaatttgatttgataagtttcaagaattttttttgtccattggtagagacaacatccatccaaagatcgaccgcatcggtgctgatcaaatagctaggatgcccacagcccacaaaactttccttgagctgagtctgccaaataaaagcctcatcgtgacctaaactcctctcgccacctagctcattgctcccaccaagcagccaaagctaatcaccgcgagcccgtgatgtactctcgagtctcgactatcatatcgtccatacgataatcgaggcgagagaaagtttctatgcatctatccataagatttaaattggttcaaccaaactactctctgtactcgttaagaaaatcatttagaataatatttaagttaaaccttaggaatataaatcataaataactctcaagttattgtgtttgaaaatataaaaattatatgaatatatttgtcttgaaaaatactttcataaaagtatacatatatcatttttcaataaatatttttatagaaacaagaaatcaaagttgtgttttggagaccgtgtcgctgttcaaaacgacttcctttacgctctctgcgtcgtccaaatagtgtcaagtcttaatttcaaatccaacctatgacaaaggtctataatttcaaaaaaaaaatcaatagctctaactcttgtttcggatcggttatcgatttatttgactatagatatttcatgtgtagtttgacgtaagtagctaaatgagtgaggtgtagttactaatttaagtctctccagtcctctcacttaattttatcgtagtcttatttgcctttcacgtttctctagctagatatgatatattgtaacttttccagtagcaacgcacgaacactttgctagtctatttaaaatctgaaatgtctcctaataacagagcaagtgatactcatgccgtactacacactagtacacatacacaaaatatttttccgtgcggtcaaaatgcatttttccgtacggaggtcccgcctagctgcacctaggtgtctgcgaaaatccatattttcgcgtgcgggtggcccaaccgcacgggataatccatcttcccgtgcagtcgggttaagtggaccgtacaagatgatcgattatcccctacggtcaaattataccgcctgcacgcaaaaaaacgaaaaaaaataaaatccaaaaaatccaaaaccctaacgaccctaaccctagaatcgccggctgctgccgcatgtggccaccgtcgtccttgtcatcgccgtcattgtgccaccgccgctcccgaccgcgccgcttccgagccatccgatcccgaccgccaccgcgatcggccgccgtcactgctcccgggcgcctcctcctcctcgtcattggcgtggcgcagatccggccggtcgctcgccgtgccgcctcccgcctgcttccgttcgccgcctcgttggcggcagcagcgagccgggcgcctcccacaccccgtgcgctcggtggggaggggaggggaggggaggagaggagaggaaaagaagggagagatgagtgattgagggagaataaaaggaaaaaggaagagagaaggtgaaaattttgaagtgagtgagagggaaaagagggagaggtattttcgtgtgcggtccacttaagaggcccacacgattttcacgtgcgggcctattaaggatctgcacgcgaaaatgggaggccgatttttcgtagatgcacgcgaaaacggtccgtctgggaaaatgggagttttcaggaaaatctgttttctaggagtgacaataacgtgaaatactactacctctgtttcatttataagactttctagtattgcccatattcatatggatgtttttttttcagggacattcatatagatgttgcatacctagattcattaacatcatgctagaaagtattgtaacctgaaacggagggagtagtaaaatatttcagatcttggaatcgaaaagccaacgtgctccattaacatgttgctactcctaattaagttttttataggacttatcctattagtttgatgataaccttccatcaaaacaaatctaatactacaaaatataacgtatctagtgctaaaaatctgtataagaactctgttcagatccgtgataccttttaaatctcgtactaactttgactagtaatatgcccgtgctatacgctacgggactattctatttatctttattaacatttaaaatttcatgttagcaattttttttatgatatgtacaattaagctttaattcaatgcatgccttaatcaaatatatttcacaaaaagtacaataatatgatattatataggcacaataaatctggaccagaattgattacataatcacttagtatacaatatagagggcaatatacgtttaaaagtatgtttaaaaagtaaatgagttatttcattaatttgttgcgggtgtaaacaagtacaaaaacaaagcatttgatgcctatgtagaataaggaataattaagaatttgccactcttacgagtggtgataaagtatttgtcactggacccgcatgtcattgacatatgagggcccacatgtcaaagaacacgagtggcaaataattaattgccacatcttaaaagtggcaaaaagttaaacgtgagcaatgctagaaagttttataacctgaggtagtacttgagtaactgtagatatgcaccaattttttaatgatccatttgaacatagatttttttttttgcaaaattctatgttctaagattcacatggtagaaaaaaaagggaaatgggtaaaacggaagatttgaagtggcatgcttctccaatcatacgggaataaaaacacaagaaacaggataggaacactttgatagtaccataagaaaaagaaatgaaagtttagcaagagatcataccccttgttatttttcctataaaagcaaagcgcaggaatacaatcctattatttttttctatcttttcatatgaataaaaggggagatatagggaaaatttcatacgaacttaaattgtgtgaaaatcatttaccgacccaactggcgcgtctattttgtagtgtccaatagagattatcaatcagcaagcggtacaaaaatttagtacaagtttctacaatcatattaaaaacataataagttgtaaaagaatcaaccagggttttccatcccattcacagaccagcatgtttgacatattaataactgaatgttaaccagaaaacatttcattacccaaagactaacctttatttaatgcaacccaacaaaatagtataagatattagtcctttttgcgcgaatataagatattagtccttatcctgctggtgaacatttaatttgttactaccttactggtggccattgcatactccctttatttggcactaacctgtactggtcgccttcctccatcttattttaggtttctactttaccataaatacctgtaatcttttcagtttttcacaacgtaatgcttatctgctaaaaaaactgagtgtttcagttgcaatggagaaagttagtacaagattctatgcatatccaagagtgttcaggttaagaagtgcagggctaaaaacctcatattttaaatttggccatattaaacctaacaaataacataaaagtatttctgggataaaaaggaaatttaaaatatgaagctcatcatcccacaccatcctgaatttgaaatattacagatgacatttgaccatatggacatggcttcgtcaaaggccttcaagtaaggagtactaaacagcattctgtatcttttctacctaattaagctgtacacttaaatcctattcagggtaacaggttctttcagaaatacttgccgcaaccaaaattatagttactcattcccttctgctatgatggctagtgatgcaaggaatacaacatgtatggattgggaaaatatcatcaggactgaagtcactgaactgtgattcaaaactcaaactcaactccagacctaaaacattcagacctcaatttcagtgataaaagtgcagatcatgtcatgcattgcaccacctctgttcgtaacaaggcactgaatggttctaagttctaacgttcagtgcacgggatttgatcgtcataaatgcatcaaaaaataaaataaaaagtgtcaactttccatagaaacaacaaggttcgttgctgttagtatctgtggagattatggataccccatatctacacgacagttataatttagtcggatatatggtaccaaatatagatataatatctctatgagtactcgggttaattctaaacttatatgtcaagaaaatacccgggatcctagtcgggtacgaatggtattttatgtgtaaatcccataatccgttaggaaaatgactgtattttgtaaagcggactccttcccctatataaggagggtccatgtgcctcttggggcgcgattcttttttcccagtttatacaatcaataacatactcggcggaatcatccccggacaggagtagggtattacttcttgaataagaaggcctgaacctgtataaaattctttgtctccgaacccatccactttcctaacttgatagccacccccttttattattgccgaaatcttgtttcgacagttggcgcgccaggtagggtagcgtcaagttttttgccgactaagtgcgatgggttccgtctctggcatcgacgacttcgccttccctcccgagcaggcattcaagttcggcagcctcaacttcatcaccaacgacttcggcaagatctctctccttgactcggattcaaaccagtcggggagagaccaggcccccgtgccgttcggtattccgaactcggtcgaggcctactccaagatcatctctcccgagtcggcttcaaaccactcggacgagatccaatctactcttccgcgaccagatcaagacgacgggtcctatccctcaatcctgatgaaacttcatgatgacttggccgctgtcttcacagtcaagacatctcccactcgaagatctaggcgagctccggctttggccccgatccgatctagatccagggaggttggcgttatactctgtcacgcccagaaattcactagtaatttccgaacttatttgtgcataaaatcctcgtccaggaatcagccgaggtacacaaactgacaatttaatatacagaatcatcaataatagtgttacatactttcaaaagaaaagaaaactgcagcggaattaacggtctagcgatggcttcagctccactcccacaggcaactcaactggggtataagccaaacgtcttctccttctggatcctttatcttcaactgaggttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacaacacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagcctcatcatcatgtctaccatgcgtcgcgatactggaaagtacccgaatagaggctgtgacaataccctttgcacaacacaactcaccacagtgcaccattcctggatcataatcaccccctctataaatataaccagaggcatggactccccagcgacccccacggacttctcgccgcttctcagtctggtgccccgcaatgaatcatgctatacagaaggtaaagccgttgcccatgctggcttgtggttggtacggttaatatttcacaacagtagctcgtgaaccggtccttaattgtcatgagcacgaccttcaaaaccatgtgctcacaacccaccattgtcaagttttagttatcaattaattatcataacacgattaaacatcgtgagctaccattaaatataatcataagtgatagtgtaacattagttatcccaattatgtgataatgtttctaagcatggctaagcaattatatatacatagcatttagctgaaccaaaccaatatataaggttcaagctaatcaatttgttacccaaggtatcaaggaataaagtaatcaatgcaaattggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaaactaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaacaggaaaaagaaaaaaacgatgatgacgtcatgatgatgacctcatcaatggccgaaccaagatggcgacctcgccggagattggatggtcggctgcgactttggaggacaagaacacgtagaggacgacgagacgaacccaacggtacccaccctcgaaccaaacggcgaacgacgacggccggcgacgaggtctagcggcggcgcggcttcggtcgacggcggcgacggggctgcggtggtcggcggcttcgggggtcaggcggccgggcttgtccaccctcccgcgcacctaacggtggtgacggcgaccggcggcgacgacggaggcggcggcgcgacgcggatggagctcggccggcgacgacggcggggtggagcacgtggcggcggcgctacgaggcacgggagaccacgggggagggggcaaacgaaagaggaggactagggggtcctatttatagccttggattgaagagatcggactcctcccgcaagaaatcgatccgggaaatcaaaaactcggttttggagataaactcgaaaacgagctcgattcggataagatactcaacgattagctccgatttttggggtaaagatagaggaggataagaggaatatttcccctcaactaaattggaaaaagagcaacggggaggcgagatttggaaggaagaggcggcggcactgtgcacggcacggctggctcgggctctgcctgagttggaagatgaacagtagctcagggagggaaagtagacttttccggctaggctgagaggagaggaggcggctcaggttgggccggcggaagagagaggaaggaaaggaaggaatgggccgaaaatggcccaagctgaggaggaggattttattactttcccaattaaaataatcacttaaatgatctttgaattgttaaaaatacttccaatgctcaaataatttcaagaaaaatcctcaaaatacttggacactcaaagtacttaaaaaaattacaattagaccatttaatgattaatttaatatgtgggtaattactgaaatgctctttgtaagattaaaaattaggaattgagctccgaaaaatccgagaatattccagagagtataattaaccatggagaatttaataaaaattaaatccatccatgctttaaatttaggaaattttatttcccacatttaacttcacttgtaaattaatgaacatttaatataaattctaataataatttattaaataatttataaatcctgaaacaaaaattcaggatgtgacatactccaacccctcgggacagtctcgacggaagagttggatggctacctcagctcccccggcgtcagttctcgaccaaccgagatcctcgactacgacgatttcggctaccactacgaccacggcgacctcgacaacttcgacgacagctatgaggataactacacgcccctcttcttcggcgtattcatggctgacaacgaaacggaggaacagcgccaagcccgagaagcggaccaagatcgtgcacggcaagaagctgaacgtcgccgactagaggaagagcgacagcgacaggagcgagaacgactacagcgtgagcaacaagatcgcgaacggattgcaaaggaggctgaagatcgacgacaacgcgccttagaatctgggcggcgagcgagagagctcattgggcaacaagacgtcgatgggacagcggtctttcgcaccccccagcagaacacggttgcagcaatcactctcctcaacaccctcctcaaggaagacgcactcaaccaagctgatcatgttgtcaacatcttgaaccagacaaagaccatgatcgccgcctcggttccagccaactccgcaagcacccgcaccccgactggtagccgagtccctcatcttcgatctcaagactatcaccagccaagcctcagcattgccggcgccggatctagtcgcaggagcaggggacatgatgaacggtctgttcgttcgcctcccgaatgatatagggagcgtcgagttgaacgaccacactccccacatcgaaggcgccccatcgatcttcgcgacaccatcaaccagcgccacgcagcaagaggccatcattcaccagatcgcgatgacgacgacgtggacggagttgctgccttcacaagcgacctgcgtcgagtggattggccagccggctttaagccgtctggaattgagaaatatgacggcaccaccaaccttgagtcttggctcaccgtctatggtctcgcaatccgcgcagcaagaggagacagcaaagccatggcgaactatctgcctgtggccctagcagattctgcctggtcatggcttcacgggctaccccgcggcacgatcggatcatgggcagagctacgcgaccacttcatcgccaacttccaaggcacttttgaacggcctggtacacacttcgatctctacaatatcgttcagaagtctggagaatctcttcgagattacattcgacgcttctccgagcaaggcaacaagatctccgacatcaccgacgacgttatcatcgccgcctttactaaaggcattcgacacgaggacctagtcggcaagttcggatgcaaacctcccaagacagtcaagcagatatttgaaaaagccaacgagtatgccaaagccgaagatgctattacggtgtccaagcagtcgggcaccacttggaaaccaaagaaggatacgccgaccggaggagggagtggaagtaacaaccacaaggaccgcaagcgtaagcccgaagaacttgtggccacaacctctccatcttcccgacaacgttcccgcgtcaacaccttcgacaagataatgaactcccaatgtccgcatcatcccaactccaaccacgtggccaaagattgcttcgtcaacaaacagtttgcggagcaatacgtcaagaacgcacgtaagccctcaaacggagatcaaggcacatcaaagaagaaagatgatgaagacgatgccccgactggttttcaagatcatcgcaaagaactcaatcacatcttcggcggacccctagcttatgaatctaagagaaagcagaagctaacagaatgggagatcaatgcggttcagcctaacacgccctaatattcttcggtggtcagagatagcaattaagttcgaccgctcggatcatcccgaccgagtggtccacccgaggcggtaccccttggtactagacccagtggttcgcaatgtcaagctctgacggactctcatcgacggtggcagcgcactcaacatccttttcgctaagaccctggacgatatgcagatccctcgcacggaattaaagccgagtaatgcacccttccacggtgttatcccaggattgtcagctacaccactcggccagatcactcttctagttaccttcggcactcgggagaattttcgcacagaaaatgtttgtttcgaagttgctgatttcgagacaacatatcatgctatacttggatgaccggctttggctaaatttatggccgtcccacactacacctacatgatgatgaagatgcctggtcctcgaggagtcatatcactacggagcgacatcaagcaggccgtcacatgtgacaaagaaagttgcgagatggcccaaacccacgagactacgctcgcccgcgaagaggtccgactggctgcgaccacagcaagcgagggagaagtgcccgcaaccaagctaacgaagaccgaagaaagtgatgccaagacgaaaaaaattcccttagatccctccgatcctgataagactgctgtaataggcgctgagttagattgtaaataggaaagcacgctcatcacctttcttcagaataataaagatatttttgcgtggaaaccatctgatatgcctggtatccccagagaggtgattgagcactctttacatgttaaggaagacgccaaacccatcaagcaacgactccgccgttttgcacaggacaggaaggatgcaatcaaggaggaattaaccaagctgttagcagcaggcttcattaaggaagtccttcatcccgactggctggctaatccagtcctggttcggaaaaagacggggcaatggcgcatgtgtgtcgattataccgacctcaacaaatcctgtcccaaagacccttttgggttacctcgcattaaccaggtggttgactcaacggccagctgcgagttactcagcttcttggactgttactcgggatatcatcagatccgactaaaagaatccgactgcttgaagacctcgtttattatgccctttggggcctactgctacatcactatgccctttggattgaagaatgcaggagcgacctatcaacgcatgattcaaagatgtttttcaactcagatcggtcgcaatgttgaagcttatgttgatgatgtagtcgtcaagaccaagcagaaggatgacctgattgtggatttagaagaaacttttacaagcattcgtgctttcaagatgaaactaaacccggaaaagtgcatcttcggagtaccgtcagggaaattgcttggatttatggtatctcaaagaggcatacaggccaacccggagaaaatcaacgccatcctcaacatgaaaccgccaagctcccaaaaagacgtccaaaagctgactggttgcatggtggcgctcagccggttcgtctcacgactcggcgagcgggggatgcccttcttcaagctgttgaagaagactgacaatttccagtggggacccgaagcacagaaagcctttgaagacttcaagaaacttctcaccactccaccagttttggcctcgccacatccgcaagagccgctactgttatatgtgtcggcgacctcccaggttgtgagtacggtcctggttgtcgagcgtgaagaggaaggccatattcaaaaagtccaacgtccaatttatttcgttagcgaggttttagccaattccaagacaagatatccttaggttcaaaagttactatatggtgtcttgattaccatcaggaaattatctcgctactttcaaagtcacccggtcacggtagtcacatcgtttccactcggggatatacttcataaccgcgaagcaaatggacggatcgcgaaataggccttagaattgatgtcttttgacatatcgttcaagccacgaacttcgatcaagtcacaagctttagctgatttccttgccgagtggaccgagtgccaagaagacatgccagaggaaaagatggaatattggactatgcattttgatgggtcgaagaggcttataggcactggagctggggttgttttaatctccccgactggagaaagattgagctacgtattgtggatacatttttctgcgtcccataacatggcggaatacgaggcgctactccatggactaaggattgcaatatctctaggtattcgccgactaattgtccgtggagactcttagttggttgtcaatcaagtcatgaaagagtggtcatgtctagatgataatatgatctcttatcaacaagaggtacgcaagttggaagataaattcgatggactcgagctcacccatatcctccgacataacaatgaggaagctgacagactggccaattttggttccaaacgggaggcagccccttctgatgtgttcgtcgaacatctttacgaaccaaccgtacccagaaaagaaacaatcggagccatggatactcaaggcgtaagcataatcgaaaccgattggagagaacctcacataaaatttttgagcaaacaagaactacctcaagataaaaatgaagccgagcggatttccaggcgcagcagactttacattattcataagacggagttgtacaagaaaagtccatcaggaatactgcagcgctgcgtgtctttggaagaagggagacaattgttgaaggatatacattctagtatttgtggtaatcatgctgctacacggactattgtcggcaaagcttaccggcaaggttttttctggcctacagctgtgtctgacgctgacaagattgtgcggacatgcgaaggttgtcaattttttgccagacaaattcatctgccagcccaagagttgtaaaccatcccgttgtcctggccgtttgcggtctgggggcttgacatggtcggcccgtttaaaagggcagtcggcgggtacacgcatctctttgtggctatcgacaaattctccaagtggattgaggctaaaccggtcatcacgatcacagcagataaagctagagattttttcatcaacattgtgcatcggtttggggtacctaatcggatcatcactaataatggcactcaattcactggcggagcatttaaagacttttgtgaagactttggcattaaaatttgttatgcctccgtggcacaccccatgagtaatggacaagttgagcgcgccaatggcatggtacttcaagggataaaagcacgactgttcgaccgactacgtccctatgctggcaagtgggtagatcagctgccgtccgtactttggtctttacgcactactcccagtcgggctaccggccagtcgccgttctttttggtttatggtgcagaagcaatgttgctgagtgaagtggaatttgaatcactatgatttcggaacttcaacgaggagcgctatgaagagggccgagtagatgacatcaatcgactagaagaagcccgtgaagtagctttaattcagtcgactcggtatttgcgagggttgcgccgttatcataatcagaatgttcgatcgcgagcctttttagtcggcgacctggttctgaggaaaattcaaaccacacaggatcggcataaattatctcccttatgggaaggaccgttcataattgctggagtcactcggccaggttcttatcgactcaagcacgaagatggtactctcatcaacaattcttggaatattgaacaccttcgtcgattttatgcttaggcatttcgtttgtatctttcctctttgactgctaacttcaagtttttccttgaagttttcagtcgaggggctactataataataatggagtgtgattttttatcaattcaatttgcttacttgatgtatcattgccctgtttgatttcttggcttagtcaatgaggactgaaagttttttaacaacttttgcgggttttaggctcaacaaggtttgacaaaaacttttaagaaatcaggaactaagttgagatatcaagcacaacataaattcatcagtattgtacaaattgtgcctccatcatcattaatcatcaaaatcattggtatattaatcaatatcagtcttttcattatcagaattatcaggaccagtcggtcgaagatcggtgtcctgaaatctctcaactacatcaactgctatcttatcagcagatttttgtgcatcgctgatgaggtcaagagcagcttcttcgctcgtcccgtctgcaaagccatcaatggcgtcaacgtcaaccctcggataaagagatttggtcatcgcacgccagacttgctcccatacttctaacctctttgatgctcttgaaatatgtatctggagcaactctcagcttgtcgaagatttcagaagcatcaagtgcactcgggccgttgttattgaagaacatcgcttgaacaattggggcagcagcgttagcaacctcatctcgggctccttcaagttttttgatcttgccaaccaggacgtcgaattgagcttgagacttgatattgcggtctgtatcaacagattcacattaatgagtcagcatttggaggataatggcttttgaggtattgattgttgataccttcaacttcctttaaagccaagtctttttgtcttgctagctctgccttgtcattctccagagtttaaatctgcttctctaactgagatatcttggcagcttgcactacattgatcacggttaatcaagattgcaaagataacagtatgagtcagttgagcagagtttgtgcataccttttgacgagccactcagttcaaaatttgattcctggagctcagcaatccgatccctcagatcatgttcattcttcctagcaagttcttttgcttcgtgcagttgattcctggtggcttcgagggttccgagatgagggactaacctctctaaggttaccgttttggcttcgttcctaagatgaatcctctgcaagacagtttaattagcgcatgaattaaatggcaaacaagatggttgagatcaggtgccagagagcttacatttacaatgcaggttgcctgaccaagtgcctccttcagtaggcataactcttcgtcctctttttgcttatttatcacgatcccttgaggctgcatgttgtcatcccaccacttgaccagaataggagggcgtgaatcctcagctgcttgtatccggaggatttcttcttcatcaccaattattggccctagtgtatccatgaatgaagatgaagcggtcaaataaagtctgttggatcaaaatgatttcagatagcgtgtctacctgtgatgattcccggtcggggacgagtggactttggtgtcttcacaggagatctggtttctgattcactgtcagcatccttcccgagaggcctgttcgtttgagcttcaacctcgggaatcttttggcttgaccctacatccgactggtttccagtcgggggctcctggttagcgccaacttcagcttcggccgactggttcgcagtcgggggctcgttgctgggttctacattgtcggttgccggttgtttgtcactcgggcaatcctctgcagttggcccggtttcttttgaagggtttgcctctatgtcagccggctcagggtctttttcagaaggatctatgtcagacggcttcctacgaatttgagttatgttgttagtattatttcaacagcgggtaagctgcaagacaaggaagatggccaaatgatttgtacctggaagattttctgatttttggcaaaggacgactggaggttttcttcttcggattagttggcttcgggggttttccggtcgctcctttgtctccgagccttccggtatcatcgccttcgtcgtcgcttagaactagcttcctcttgcaagaatctgactggccgactggatcggaagcacttggttgagcgtcagaccgaatttttggtcctccactcgcctgaccagtctgctggcaaggtgatcggcgttgagcaattggaggatccgatttcatcaaggcaaattcctgggcatgatattttgaattttcaattagcttaatagaggacaaaagcatacttttgaggaaggttgaaatgtttgaatgcataccggtggaggagggttgaatgcattgaatggcacaatgggcagcagatgtgaatagctgacaacaatagcgtttgagaagatcttgtacattctttctttcatgaccttaaagtcaagagaatctggatcttcctgatttggatcatgcttgccgtcaaactcaaaagccgtgcgggatctctctttgattggagctaatcgacttttgatgaagtgtcgagtgatctgttctccctgcaaaccttgttccttcagttttagcatgcgttccatcaattccactgcctgagcagcttcatctcccataggcaatgagttccatgtgtcctggtaaaccggaggaagacaggaatactcgggaagtgcgggttcaggattttggacgtaaaaccagtttgcgtgccagcctttgtgtgaggtcttgaagggcatagagaaatacttttggctcagtgttcctctgagttggaaaccagcgcccccaaccacacatggtttgctcttattcggttggggcttgaggaagaagattcggcggaataaggcgaaatgaggcctaatgcccagaaaagcttcgcaggcatgaacaaaattggcgatatgcactatggagtttggattcagatgatgcaagctaatcccgtagaagttcagaatcccccggaagaatcttgaggttggaagagaaaatccgtcgtagaagaaatgagcaaataccacgatttcgtgcgtgtcgggggtcgggaatgcttcgccgaacgccggtcgccacccgatgatttccttcgccggaagaacgctgtgcgccaccatttccttcagattatcttctgttacatcggagggcgcccactgactctcgaagctttctctttcttccgccatgaatgtaaactggatggtttaatttggtccgagatatggctagagtggaatggggaattggagcggtggacgcggggagaaattttgtgaagtttttgagggaggattggagcagattgatgaaccctaacttcgtcggcgcggttctgtactgtagcatggagcggggaatggcgagagtctcggcggggaagacgaaatgacgtttggacttcggtgtttttagggtatcgggagtactaatgggcctgggcctgtacggtacttcagcccaattttgttttcagcgtggcccgttgtgatccctagggacttaagcgctttttgctttggcaatatgtgctcacaatgatgtgacccgatgctgttaaaatcttttttaacgcaattcaataattctttggaattattatgatgcacataaaaaggtacccgacagaaaggtgttatactatttttgtaagcttttttaggctacaaaagctgttgggttaatttgagatgactgatttattagtagtcattctcctagcatgttatatgcttattttgattatggtaagggttatagcctaggctattaaacttcctaattgccatgatctttatcatatttggtggatcattttacgagtttcttactcagattcctatcaaatatgcctatttttggacctttgagtgtttatcactcggcccttcttgtatttttgttcttggtatgttcaagttgagaagcagtcggctgggtatcttactaagtaccatgcgtgcttcgctatataaccactcggttcttgactatatgtttagttttttcaactaatcacatagtcaggggctacacctaattaggtgcatctactcgatgcaccatgttttatttttgcccttcgtagtctttgattttagcactcggcaagttgaattgaagcactcggattactgttttttgtttcgagaaggctattactgtcaactgcgaaggtttcgggggctactgtggagattatggataccccatatctacacgacagttataatttagtcggatatatggtaccaaatatagatagaatatctctatgagtactcgggttagattctaaacttgtatgtcaagaaaatacccgggatcctagtcggttacgattgtattttatctgtaatcccatattccgttaggatatggactgtattttgtaaagcggactccttcccctatataaggagggtccgtgtgcctcttagggcgcgattcttttttcccagtttatacaatcaataacatactcggcggaatcatccccggacaggaatagggtattacttcttgaataagaaggcctgaacctgtataaaattctttgtctccaaacccatccactttcctaacttgatagccacccccttttattattgccgaaatcttgtttcgacagtatcccaaggacaatctatatgaaacatctgaaatttatagataacacatgtgaattcagagcaagactttagtactggaagttgtcgaataatgtcaatttagagctaacacatgtcaatttaaagctaacatctgaaattgaaaaataatgtgcactgctggaagactaacgagtactgaaatggtgtgctacttaatagggtactgaaattgcaaaatatagtgcactgctggaagattaacaaatacaattaagcatggttgaaatagtaaataagaaaacaaaagctgctcaccacaataaaccggtcttctgaattaagtaaattgtattcctctcccactcagtacgtttgataagctttgagtcggtcaaattcagtcactcaattttcgtaaattaagttaagtggtctatctggatgaagcaaactggaattcatgcaactttggaatgtagccacattttctaaatagaagcctactgattttgacatcaccatttcaccagatcatttttcggtgacgcctacttatttgatctttatataatttttaggttagtactataataagactgccatgttgcagcttccaggtagacattatttcttgccatgatgtgcatgatgcaattgagataaataaatcatgggcaattttttctcctatataaagacaaagatgaaaatatccccttcatatcacgaaaactgaaccctgattaatgattagttttcccgttgcaatgcacgggcacactattaaacacatacaaccacagaattggtgtccaaaaccagctatatgacacaggtatttttgccaaaaaaaaaaaacacctatgcctcaacctgtaaaatgaagtactacatgtcatcgtcgtttgcactaaccttaatcactgtcccattttatttgccaacataaaaccagctaagcttgagtgaacgtatccgccggtaggagtcagggactgtacacagtggcacgaatcctatgtacaataaaagctagccattttaccgcaagaaatatgccaagatgacatgttgttcataatagttagcaaacacacaagggaaacaggggaaaaaaagagtagaacctacaagtgaggaggaaccgtcgtcggcggtaaacagcaaggggtcccaagaagcaggtagttggctaacgacgatttttgattgggtagcttatgctcctgccagatgacgaagttagtgtgcaaaccaatcatgattaaaataaaaatgagtatattcaaaattcactcagaacaacccagaaatgatatcgccaaattcagaaatattcagagaggaaagccaaattcataaatattcagacgaacatttatatatgttggcgcgatgtccttcgttggtcaaatgtatgccgaagcaatgtggggcatcggcggcgtctggcgttgccggattgagaggcaccggcggcgtttggcgaagcggtcggattgagacgcgtcggtggcattgatctggaggacgttggggagggccgaggaggaagttgacggagcagcttccgtcgaagtaggggatggcgccgttgttggtggaagggctcgccgtcgatctcgagttggctggcaaggtaggtacgaagccacgcggcgtcggggttcggaggcggcggcgtagtgggggatcggtcaccgcgacaaggaactgcgctccgggcgagagggattgcgcatgaggggatgggtggggggtcaccggcgatgatcaatcagcggcggcggcggctgctgcgctcgggacagagggagcgatgggagagagggagcggagattgcccggcggctgtgctcgggagagagggagcgcaaattgtgtttgcacgtgaggaaacggggatgggaattgggaagcagagagaggggcaatccgggaggggcggggtttgcagggagagagtatgggggaggtgggagtaacgtggagcgttggatttgattggggcgatcctgaccgatcgatgaggaatgaggatgtaacacactgttggtgaattatagggtagattactgtagaacggaaagagtaaagggcactaggcacgcgtcgtggtgcttgggcgattgtcccgtgagagtgtgagacggtgagagctaatgaggagcacggccaaccatgccccgccacaacgcaccaaacgcagcctggtgcgccgcacaccgaaacgacctaactaaactaggcgcggcacgcaaagctgccggacgcaagtgctcgcagaaaattgctgcgaaaaaattgccgtactaaataaaaacaactcaattcatcgtcaacatgctccactgacacaggtatcccacgagcaaatttatcacgagcattgctttatcttttttaagtcaaactactagtttgagttttcgctccgaattaataatttggacaagaacacagtctctaaaaacaattttaatcatatttttcattataatataaaagtattggcatatatatatgattttattacattactttttaagcctaatcgatacatgtaatcatcatatctgatagacaaatattttaaaactgatttataatcaaaggttctaatgtttgacctcattcttatctaaaacgataaatattatcagcccgaaggagtaatcaagtttatagaaaaaattaatattttcaacacaaaataaaaatattattaaaatatatttaatattagatataatgaaattaatttggtatattagatattactagaacaaatgttcgttcgttgcaacgggtaaggctattttaatgttattattgttatacgttttagttaaggtaaaatctactgtgggaactcgtttggatatatatatttttaagaaaattatgagcggcaattaggagtacgatcgtcttaggttagcatgcaagttttttaaagagaattattatacaattacttctgtatttacgaaagcaaacgaactcaaaaaaccgactcaatacacatctatattttcaaaaacgaacaaactactcatactcgaatgacgtaccaaaataacatataaacatcttaataatttttataaagtagagattaattatttttataaacttaattaaatttagcaaaatttaattctaaaaaagtcatactcctgccatccccgtcggaactcggaaagcagccaccaacccgaggcgacgtaaaaatcaataaagaactccccgacaggtggaccccatccctcgctcggttagaccgtccacttccacactcaccagtcaccaccgcaccagatcggtgaggtgatgtgctaccgcgcgccaccgcctctccactctaccacaccgacacg

SEQ ID NO: 62846 - DNA, 1645 bp, Oryza sativa
aaaagggagagaagaaatgagacacgatttactttttgatataattgaatcaatcgctaaatcaacggagtatccttgatttacttttttctctacagcgatactgatagctactacaatacaccgatcactggaaggatatattcaattcaaatgtattgcctatgttttactagttaattactcaaatgccatcatgctacaataattttgttccgtaccttgcccctctctgatcaacggtgcacattatttcaccttcaagtaccttgcaaacaccgtaaaagatctcttatcatttacatatgcagagtaatatctttcttaaagttggttctcattaagttccatgaagattattattgttaaaaatataataatttcttatgatccatatatgttccaagtaagaatggcaatagacttgaatgaagaagggttttccaaacttattttctgtatgtcaaatcatattaataaagctcacatttgtctgtcaatcactccaaacatattgctagcatcactgcatccctgtaggttggtagatcaccgtagaatccataggaggtgttctccattgcccttcaccgcgattcttacctcccttcaccaatcacaccactaccactcgattctggccgatgctcggcggatgttggtcaccacacctgtcccttggggcaggcgttcggttttcccagttttatctggtttgtcttttcagtttctttagagttcagttttcactagaaagaaaaagacaacgaggcaataaaaccaagaaaattcggttcagttttcagtagaatccgaagcaccgaagaaattgataggatgcagaaggggctgggcaacctctcggcagtccgtaccgtgctgtgctgctcgttgatttccgttaatctcatgggctactctgcagtggcatccgaagcatggcgatgctatcctccaccaccaccaccacaggcggacggacgtcaccgatgcctcgttctgcttcgtcacagcgtccgctgcatcggttcacagcccccaggttgccaggcctccggcgctattctttctgtagctagcattcttaccgcatggctccactccatcgcaagaggcactacttgagaagtgctcatctctcccggttcgcaaccccctttactcccgggtagcgaatcgggagggagaatccgggactaaagatgacggtctttagtcccggttcaaatacccaggagtaaatctccatctttagtcccggttggtgacaccaaccgggactaaagatggctgagccacgtgaccggcaaagccataaccgggactaaagaattttcttttattttttttaatttggttgtgctgcctggtgtacatatatatatatatatatatatatataagggtgcgtaatagctaaaatgctcctctcactttcccctctctctctccgctttttacggatctagcggcgcagcggaggcaaggaggagagcgatggctgcggcggtcgatggagcagttcaacagcggcggcgtgccccgcctactgccaagggtggcggcgtccaggcgacgggcggccgacttaatcaccaccctctcccgccgttgctcgaggtgtgttgcccggggttgtcgtcgg

SEQ ID NO: 62847 - DNA, 873 bp, Oryza sativa
aaaaaattcattgtcctattaaaattttaaatagaaaaaataatttattacatttgttttattttcaaaatttatggcaaaattttatgctctaattatttagtctcattggtttcataaaatgcatatatcgtgtactcaaacaaaattttcaatcgtttttcaagtttatattcaaacatacatcatccaggtcgatctaaaagatcccctttgcaaccaaacttaacagtgaaacgaaggaaaatgtaactgcagaggcatggaagaggatcaagttaaaatttcaggggtatcgaatggataaggtaaatttcaagggtatgaaagggattgtgtttgttttcaagggtatatagagaatttagtctaagaaaatctaacctggtttatattttagcttacttattttattttaaattatctattcaccctcatcaatgtctaagtgaccctttcaaaggtagatcgacgtctacccatagccattataccttgacacctttgatatcttggtatcatggtaccgatatcatttctggtatcgacagtatcatgtgcggtataaatagttatcaaccagaaatagctgctaagagcaggtataatagcagactataagccagctataaacatattttaagaagataaaaaaggagagaaaagacagcgggctacagatttgtagtcagctgcagtacagactctaagacgcatgtgtatataataggtgggaccagatattgattgtgtagtaataggtgggaccagatattgattgtgtagtatatgtttatatgtaactattgtagaattggctattaagttatagatgatttatggccagcagttagctctactattaaacttggg

SEQ ID NO: 62848 - DNA, 2700 bp, Oryza sativa
acgtgagctagccagtgacccagtgaagccaacacccattacttgtagacctgagcatatccacgtcgatttacttcaattcgcgtaacggatagatgatgctgagtgggaactgcaaactcttgtgtagacggcccacatacctgtccagaaagcttgagggcgcggttgaacgcggccaatgccatgtcctctgcggcctgcttgctggtgaactgcaagggcatctgaacaatgaagcattatcagtacaacagtatgtctgcacagaagataccagcttctgaacaatccaccgaattggctcacgcgctcaaagcgtgctcacaagatgggttcaaaacaagttcaaattcgggattactcggagggggagccgaggaattaccttgccgagcagctgcgccatggaggccatggagtagggcacgacgacctcgaggacggtgccggacgcgccgggcacggacagcagccacccgagcgcctgcggcgaatgcgcgctttgctttagtctaggcgccaaacagtactaccatatcggatcgaatctgccggcgaatcacggcgcggcggcgcgcaagtggggggcagcggcgaggcgaaggggggttacctgcgaggcgccgccggcgaggtagatgacggcctgggcgcgagatgagtggatagcctccaccaccgcgcggacccagctctccatcgcgcagccgcgagaagaagctaccagacgacggaggaatttgtccggttccctttacgcctctggccggctgaaccgtttgatcggtcttcccatcggacgattttgcccctgggcccactcgtcagatttaagagacagatagaggactccagaattcccagatcgatcgataaagcatttcccagcccgagcgggtcgcggcgacgagaagacgaaactgccccgtgcgccgccaacatctcccctctccggctaccgccgccaccgcgccgccgcgctcctcgctcctcgctccagggcttccggccatggccggcggcgacggtgaggaagcaaaccctaagcggcaccatccccggcaccggcgcccccccgttctgtcctatataccgcatctcccttacaccgttcccccctctcccctctgcaggcgatcgcgcccgcgcgccgaagcggcacaagtcctcggcgccgtcgaggtcgattgacgagaccgccgaactggactacaccgatgacgtcgatgacgacgtccgcgatggtaacaccgcgcgctcgaatccgccctaaactcaccgcccctcccccaatgtatgagggtttgcacggaacattgaactgattggggatttttgttttgtgggggttggaactttgattcggtgcagccgatagggaggtgaagaagagggacttcaccaagctagagctgaagccggatcacgcgaacaggccgctctgggcctgcgccgatggccgcatcttcctggagacgttttcgcccctatacaaacaagcctacgatttcttgatcgctattgcggagcctgtttgcaggtcaacttcagtcacctctagcctcaacattaaccttagtaccttaattgcatagtaggtttggactttcctgagactgaaattgcatccaccaagtggagtttagtccaaatctcaatatcttatacacttagaagccactaagttattgttaattctctcttatcttgtgaagtcacatcatctcaactgtttttagtttttttttcctttttgtggtttatcaaaggttcagattgtgctcaagcacaaagcaaaacctcctagctacaaaacaaaccacctcacatttcatgtttagcattttggtatgcaaatttcctgcagcattcatggggttccatctatgtggttgatttcccccaaaattagcatggtttcagcattcatgttggaataggcttgtttttgtcatgcagtgaaacagaagttgaatttagtgatattatcttcattgagagctgtggggatcatatcatattctgagggtttcactactttatcttttagggactttggtactgccatgtgattactcaatttgattttctgtgaaccacttggatataatttgtttagaataggttaatttgtttggaatttgaggggaaaaccaatggtttgtaatggaactaaccatgtattacttgaaaatggtgagcacagctatgtgataggcatatcattgtgccattagattgtttgaatagatttaatatgccccatgtggctatctagaacctagaaagtatactgacatatataagttgcaaccaagttgatgaccccagcatgacttcaagagagcataaccattccgttgttactgtcaaagtaaattctagccttctaggattctttagtttgagtgatgggatggtgggttaaggagattattagtcctttttttcttaagttaagatgggactgagtttgacctgaagtctttctgcaaaacaaaatgatgcctatactccgatggacgagatgatcaaattggtcgtcttttttatttgaacttcttttgaaatactacctccgttttttaatagatgacgccgttgactttttctcacatgtttgaccattcgtcttattcaaaaaatttacggaattataatttaatttggtaagaggtggtttatcactcataggac

SEQ ID NO: 62849 - DNA, 1800 bp, Oryza sativa
  unsure (1)..(1800): unsure at all n locations
acactatttttgttcaacttntgttttggatctgaaaagaaagaaaagtaagttgttttggcgacatcaaaagaatgatgttatatctanttgattcttagttctgaaggtacaagtgcctgtaaggactttttcctttactaatgtagtagttgtctgtagaatgtactgggccaaaaagattctagaatggactagtggaccagaagaagcactttcaactgcaatttatttaaatgacaaggtaagacctatacacatgtttgggaaatacagttgtgttattttgaatttgtcctttttatagttttgctagttgtagttaaaatagctatatttcaacacatggaacatgataaagaaacatggaacatgataaagaaactgctcacatgaaaaattgtaattgaatagcaacttggaagagtctgcccatgcttaaattagttcctgcgccgataaccgaaaagttggagtcacatttatcaaattaagaaatatataatttgacattcttttcatgtaaggcagaaaattgtatggttggtgctcttttcattatcttatcttcccttaagttaaaaacatcatccttctagggacaaccagacaataaatcagcttcacggtcgcctcggataagctggactatcctttttcttggttacctgtcagaagaaagatacaaaacagtaactggggaaataaattttcaggaatgtgaaattgctcgaagatattttcatagttgaacctacaattctttccccagctggattgttctcgttctttaataggagtagttgtttgcattgaagtacttctacgcattttatttatgctttacaaaaagtctaacagcacagatcttgtgtcagtatgagatagatggcagggaccccagtggttacgtgggatgtatgtggtccatatgtggcctccatgatcaggtcattgtgttatcacttctcacttcacagggaaaaacaattttgcttttcacaagcattagattgttggtgacattctagaagcgagtattccttacaccactgctgttttctcagggttggaaggagcgtccagtatttggaaagatacgttacatgaattacgctggctgcaagagaaaattcgatgttgacgcttacatttcttatgtcaagagattagctggtcaatccaagaagaggaacgctgaggagtctccaaatcctgtagtcaagctttccaagtctcagcactaaatccgactaggaaaatatgaacatttctttgtgtggtataccacgagctcggaaaattgaagaacagtgctaacttgaggtagatcatgtagggtatacactgtagatctgtttgtctgatatccttgtaggcttctaatcattcaaaatttgctagcattgttaagactttaagacatacagtgtcacaccagttgaattcaagtgtacacattgatctaacactgaactaaagtactgcttactgcctaacaaacagtacttggcaaacgatgcctactgtgtaatgagaaagataaaagaaaatgtcttgcaggtagtgacgtttttttttaagtaaatttcacaaaactatatgtattttgtacaatttatcataaaactaaagatttaagagctttcacaaaactacagatttagtgtctccgtttattataaaattataggtactttgtacaatctatctcaaaactatagatttaagaatttatttcacaaaactatagatttcgtgtatttgtttatcacaaaactacacattcagtgtcttcat

SEQ ID NO: 62850 - DNA, 678 bp, Oryza sativa
tactaggcattagatgatctcagccctttccctgctgaagctggacaaatggtaaatcccttgatcggtctatcccagcctcccaggctcgccgctaaacaactttaattaatttatctaaaataaagaggaagcatatcatcaactgctatcctcgtcacctctcccctcccgagttgacttcccctctcacgcgtattcaggttggttcgccatgccggcgcgaatgtccatcacatcggcgtcgcgtcgtctccgatgagtaaagctagtcggcggctgaaacaggaagggcgccttaacgtacgagaggacacaggtacaaattgttgtgcttttcaaatttgggcctagtttagtttctaactttttcttcaaacttttaacttttccatcacattaaaatttttctacacacgtaaacttctaactttttcatcgtatcgtttcaatttcaatcaaacttccaattttaacgtgaattaaacataccctggttcaactcgtcagcatggcaggggtttactctttgaaatccggatatctccctcgctttcatttcttctcgcttacgttttcttgccctttggtatgggtatttcatatcatctgaaattgactttcgagattttgaagaaaacaggatgatcaaacatatatgcaagaccataaccatat

SEQ ID NO: 62851 - DNA, 1987 bp, Oryza sativa
  unsure (1)..(1987): unsure at all n locations
ccatgtgcactgaatgcccncngttganaancaccttcgttacncattacacacatgcatatatgtgtgcactatatgtatatctatacatatatataatgcaattatacatatagtgcacacatatatgcatgtgtgtaatatatatatatatatatatatatatatatagacctagggtgcgtaatagctaaaatgctcctctcactttcccctctctctctccgctttttacggatctagcggcgcagcggaggcaaggaggagagcgatggctgcggcggtcgatggagcagttcaacagcggcggcgtgccccgcctactgccaagggtggcggcgtccaggcgacgggcggccgacttaatcaccaccctctcccgccgttgctcgaggtgtgttgcccggggttgtcgtcgggtcgtggccggatcggcatgtggttctttttggttagatatgtagtgcacccgttaccggtgtccgcatccattgtctgctggaggtccttgtatatgctcatcatcgttggatccattcgcttcttgggtttcttcgtgccggttcttgttttcttggtattgctttgctcatggaggttcatgttttgttgatgcattgtcatggtggtggatgctgcatctcagccttttgcatgattaatttcagattgtgctttcctttcttgtgcagtgctgctactagcatcttacaaggtcattaaactgtatgatggggggattggttcaattaagtatctcgttgattctcagagttattttctatatggaaaaaaatatgtttgctttcttttatggcaaagcaattcacaacagcaatattatggctatgaaatactaggtttaagtgaaatcatatttattttgctgatttgtgatacttagaagtaaccttcattttttttatccagatggctatgagaatgcctctccagacggccgtggtgacagatatctgtcgacagggaggacttgagaatatgcagcacttcgtcggctccatgtcgatttgttttattggcgttgtcttgcttgttggattcgtgcatgcatagatggatcattgaccttgatctacattgtcgtattagtcttggcatcaatcttcatcaccgtatccttcagtggtgttgctgttgtgatttttttactggagctgttgtgatctttaattagttctgtttattctaccaatgtaccacattgcatgtgtgatcacatcgttgatgtaataccgaaattaatttactcgatcaaaatttttttaatctaacttgtgagtaattaatttactgatagaaagcgggctataagttatgtctacgcatagagtaattcatctaatgacataagaccactagaaccggaacggaattcttgctagattcaatatgttctggcaatagtaatttctttacataaaagccaaaaccaaggaggggaatggatcaatatatttcgtcgacagtaatttctttacttagaagccaaaaccaaggagaggaataaaataaaccgggagtaatttttttacttaaagccaacacaaaggaggggagcaaaataaaccgggagtaatttattttaccgaagaaaatttcgtggcagccaacaaaataaaaataaaccaccggaaataatttatttaccgaagaaaaaatcatggcaatatttatttgttgattatacgtaatttatttactaaaagaaaattcgtggcaagattaatatgttgattagtaatttatttactaaaagggaagagaagcagtgggaatcaaaaaaagggtgggaatggaaggggtgggtggcggttggcggacgagagggaagtgggggtgggagcggaccaaagggaggtgggttgnaatccctccctgcngtttggtgggggttgggggttgtgttgggttgggtgtgtgtttggtgggtggggttgtggtttnggnttttntgggtttttgggtg

SEQ ID NO: 62852 - DNA, 2300 bp, Oryza sativa
ggcaatgccaggcggtcagccacccgtcctaacaacagctgcagattgttctcatcagggggaatgcacttggcccatgtgaacgccacgccccctacctcatacgcctgcccctctgccgggcccacccctcgaagccccgtaccacagcgacacctgctagctttctccatgcttcgcttcctacaacagtagaggcagcctgcaagcctgatgccctgatcagcgatcacacaccacgcgtggtcgcgtgctgcgggttcctgtatactactacagtaccatccttactactcctatacaggtaatctgaaatagtgctaagcagcttgccgaagctcaaacacaaacctatactgtagctgacacattggacgtttcacatttttatctgcaatgaagaatgtactacggcagtgtttagttcacaccaaaattaaaagtttggttgaaattgaaacgatgtgacggaaaagttagaagtttgtgtgtaggaaagttttgatgtgatagaaaagttagaagtttgaagaaaaactttggaataaacacgatgtacgtactccagtagatgagatacgggcagttggtcgcgtttcacaacacctcctgtacggagtggtggtgatccaggtatgcatggaattgtgcatctactcctctttacaaaacaaattcaccaagaatccagccttcagtcgtgttggtttatttttagaataaagagagcacctcctatatacatgtcatctatgtactggataatgttacgtcacgcacgtcacgctataaagtggaagaattttgaagggaagaagtggtaacatggtgtggtgaagtgcaagaccgtatttttctttattggtatacactctttgtccaaaataaatttttctatgtccagattcatgtataaagattatcttattggggatgaagggtgtgctagttatgggctctcaaaaatctgaaaagtatcatttctttctctcttttttaccactttaaacaatggcatactccatctattaaaaaaatagacttacaagacgtagatcggtgcatttcctatagttatggtggactaatccgttagaggacctaacaaaggctacacgaaagttagaaaggcaatggctaaaaataaggttgtagctatataacactaaaaaatttcaacataaatattttagttacattataactaatgcataactagcatgtaaaaatatcaaaccaaagtgctaactcagttgataaggcacacatttagctgtagctctgatcgtaggttcgattcctcctactatcgcattatagaatttgtttcctactcccttatctgtacaaattttgaaatgaatccaatgatttggagccaaatttgacagtgtcaaaaccttactgtccacgttacctacccaaaaccacgcgtcaaaaggaaggagcaggagcggagagaaggctctatacgctccgccaacatgatcgacatgcaagtttagggctgatagtgggctccgccaactgtcgtgtgacaagaacaagcataccaacccctgtgggttaggttccacttatatatgcatgcatgggcaccgtgtatctctttacggttaaaaaaggagggtcaataccactagaaaagaaggaagagctagtcttagaacatctctatagtctccacacataacaaatcggctttagtgcctaagaacaaaagtacaccaatatcctatatacattttagcaaggaatctagacaagaatatataagtagagtgttacactttccagtggcatgttcagtaaatgggttatgaaattggaaagtggagcacctgatgtatgcctggaggtactgagaaggaaatatttgaggaattgaaattttttcacaagaaatgggaatggtggctctcaattttggatgggtttgctgaaatgcaaagggtggctttccaggctggtcacaaaggaagtgcacagtgggagagatgtgagtttttggaaggatgtttggtgtgataatgtacctctgaaagtcaaatttcctgatctctttgaaattagtcatgatcaaaatgctactgtcaaggatacggtggtaggcagagaatggagcttggagtttagaagaaatttagatgaacaaagggttagagaggttagggagcttgtagagttaattggggaagctcaactaggaactgagaatgacaaggtctgttggcctcatactgaaaaaggggtgttcaccacaaaatcaatgtatagaattttaacttttgggggtatta

SEQ ID NO: 62853 - DNA, 7516 bp, Oryza sativa
atcaaaggcgcataacttagtgcactattaagactgcaaattcatagaagaaacagacaaagctctttgtatatgaccccatttttctaacatatggattgcatgtatcagtgtcactcttgaaacaggccaaaaccaaaatcttttattttcataatgtggtatctaccaaaagtgcatcctcactaatcaacccataattccaacatgtgaattccattatatcattataaatcataaaagaggtgaatatctattatttttatcatgtagagactatcaaaggtgcatccactccatcataattctaaaggatcatgtgaactatactataaaatagctccatactaagcttaactaagtacatgccatgccgagtacctgagggaggggtagaacagcaaagacatcaatcagaaaatatgttgacaagtatcgctttgctattgcatatctatcctcaaccaagacaccccgatcaaaagttgtaggagaagacgcgatatagcctgtcctgaactgaaatatgatatggagtatatagaagatatctgtgaaaaagcgcaggacacttgctgtgatttccaactttttatccaaataccagcatgtattgttttcattgataaccgggatatagaagaacaatggatccacagaaactgcaaagatacatgacaaaacaaatatcttgttccagctttgcagaaatggtccctgaggatgaagagttccagttgtcaacttcatttcatgcagcaccgatctctctaaggtttcagaatgcacaaggtttcctaggaatgcaaaaattccagcagttctttccttaagtgaacttaaagcattatgcctcgcagtgacataacagactgcttggatctccagtcctcaaatctgcatacatggttaaaaaaatacagaataattattacatcgagttttcagtagttgttttcaatatttactcaaaactttaatggatcccaggactttaatattcattgatcaggtccctagagacccaaactttttttctctcttctctcttctctcttacttcaactacgatatttttaccagcagtcttcattatttactcaaaaatttaatcagatactggtgctgtcatttccatacatttatatgtcagacttcttgctgatcttgaaccgaagctagatttctattttggaaaaattggagagaaattattgcattcatgtttatatgctgcaaaagacaaggaaatgagcagtagcaatcgttccaacaagtcaatccatgccagggtctctcagaggccaaaatgtccaaaaccatcatgtgatgaaagtagaagcactgatttttttttttcgaacacgcaagagatatgcatatcatttcattaagagagagaaagaaatgcaagggatgcaagatttaaacaaaccctgacacccacccaccgaaagtcttacagaacacaacacacacccactcaaaaactgaagaaactcaagccgacctctctaggacgcaagaactacttagacaacagcttttggagtttcaaagctcccgccaaagaccaaactaccaaagtgtggcctcattattgacagcttggatcacatccaccacactagtgtagaaccaccgaattaccattgctctttagaaatcatcaaactctctccatgtttcatgtcctaaacttgttactataagttttgacacaaaacatttgacaagcctttattctttgtaaactaaagaaattctaaatcaagcctccctgaagattaacccacccagttataaccagggttcaaaattccggaatttcggtcaattcggaccctcccgatacgatacgaaaatattttgaccgaaatttctaaattttttatgaatttggtaatattttgttcaaatttaaccaacatttgttcaaaattttggaaatttcggtgacctccgatagaatcggccaaaccgaaaatttgaaccctggttataaccatggctttgcctgaaaggcagaaaactccgcagccgcaaaccgaacccccaaacctgctgacgccgcgctacctattctagagtctagacacacgagaccacaaaatgagaaagcaagcagggcatcgtagcgattagcgaagaatcagtaacaaattaatagcggcctaaggcggcgccttgcccgctcggctggctgtggagggagaacccgaggccggagcaggggagcgcagaggcttacctcggaggtggtgcgcgcagatttgacggaggggtgggggaggaatttggtcctcctccgcgtcgcggctgggattgggaagccggcggcgtccgcacggcggaggtggaggtggtggtggacgtacgtggtggtactggtagtgcggtggaggtggagatggaaagcggaggacggaaaggtgtgccaacggtcccccgctttgcttcacggctaggtcctaatcgtgggttcatttatatttttagtaaatttcaaagtaactacaacttgattgaccaacctatcaaatctcttctctaatattataaaaattaaagatatttttgtcggtactttgctacatcatctgtgtatgaaaaatgttttcgttggtactttggtacgccatccgcagtttttaaattcgtttgcttttgaaaatacatgtctgtatttgagtcggtttttaaattcattcttttttgaaatacagaagaagccgtataatgaatctctttaaaaaaactcgcatgctaatttgagatgatcaagctcctaaccacagcttataactttcacccgttgcaacgcgcagatattcttctagtagtaaaaaactagaaaatctgcatttgacgcgccgatatatgtataatcttatttagagctcatatggaatatataaaatttacgtacctcttattttagattatttatcactctaccaaatttcgtgtcagatgaggggatgcggcaaattaccttatcatgctcatttagtacattctaatagtagttatgttaactttgattactggatatatgtggcattgatgaaaggtggagataggggatcatgatctaaaaattgaaatgtgggaatgaccagtaagttggaactgatgaagtaatatatgtttacacgagttagtttaacacccttaaaaaaatctttcaaaagaatggaatttaattttgtgtttgtcccagacgaatggaatttaatttaatgtttgtcccagataaatgaggaaaaccaaagtatcatgtaattagtgtatgcaactaattagacaaatgattagagatgctattagaaaaaaacttaatgtttcctcaaaattgtggcaattttattaaccaaaaaattgtgcatacggtatccataataaaatgcacattcgaagaatattatttcttagtattgcaaattttcattcaatctttcaccatatttctattatttagtttttttattatttattttgtagaaatataggatatcaatatgactcaattttcggttttaaccataatgtattttattttttcagataaattttgcaaaattattcatatttttctctttgttatttctttacttctgtttatcctatttatgcttggttctgtgtgcccattagcttgagaaggcaatttcttgtgttgtagcaacggcgccagatcaccaggtcccagggcaggcatgggtgactgggctgtacacgccaatgcaccttttctttctgttctttttttcatttcacggggaaacgtctaggctgtttcctctaaatggacacgtggcagattcctggagggggcattgccaaatttaaagagatccacctggcccaataggaagctagagtttggtccctgaaatcgattttacagatagtttcaacttctagaaggttcatggtgttttatgggcttacgaataattggacatgggacaaaatcttcatgggcctagatgataaagctgcagtgccgctgtttcttttaatcacgttcacgaaaaaagaataaattcaccagccgacccacaaaatttacgtcgagtttgtataacatccctaatctctaatacaaaaatcttcaccctaaactatataaaaccgtgcactttcagtcctacactaatatgaatctctagttttgctgacatagtatcctagtcagcaaaataaaaaataaaaaaattatggcacccacatgtaagtgaaaaaaaaaagtgggaccctcatattttctttattgtcaattcttctctcctctttcttatcctcttctcttcccttctcttctcttctcttcagttattctagggccggtggcgatagagagggaagaggcagccaacgagcccagccgagctccgccgccgcctcgccgccagcagggagaaacacaatgaccgggattcccgcggcgactcagtacgccgagagtgcggcggaggtgtccctcgtggatgcgcaccagacgtcagcgatgggacggaagagcagcgcatggcataggggttgttggggtcgccattgggagctagagggaacggcgcgtaccatgcagagaagggcacgatgccgtgtagcctccttgcagatgttctcatcggccgcgcgacggtgcttgatggcggcattgtcggtggcgcagcgaatgcgatgtgcggcggggcaggcagcgcggagggggaagtggagtgggggtgggagaggaggaaggagagagagtcggcgtgcgcggtggctgccatggtggtggggaaagttagggcggcggcggcgtgagcgtggcgaattgtaaatggacaatgctgcaaataacatctccaattatcaacagccatcataatggccaaaattatttttcataaatagagagtttctgattcgttgggcctaaagtcttgttgtaataagccacaggatgaccatgctgactcaaaacagccccaatgccataagcaagcatcagtctcaagcacaaagggacgactaaaatctggtaatgccaacacaggggtagtggtcatagcttgtttcagttggtcaaaagccagctgtgctgcatcagtccaaacaaaagcttttttcttcaacaaggttgtcaagggtcgaacaaaaatactataattcttcataaacttcctataataaccagtcagtccaagaaacccctcaaagcaataagagaagttggaacaggccaagccaccattgttgcagttttctcaagatcagtgcccacccctttaacagaaatgatatggcccaaatattccagctgagagcaagcaaaggagcatttagattgtttagcatacaatttgtgttgcctcagcaccaagaagacttgctgcaaatgagctaaatgagtctacaaatctgggctatagactaagatgtcgtccatgaaaacaagaacaaacttcctaatgaaaggggtaaaaactgagttcattaagcactgaaaagttgatggagcattagtaagaccaaaaggcataacacgaaactgaaactggtcgtgatgtgtcttaaaggcaattttaggctcatccacttccaccattctgatatgatgatccagccttaaggttcaacttagaaaaattattgtgtaccagcaagtttatccaacaactcatccacaatgggcatagggaacttgctctcaatggtaatagcattcagtttgcggtaatcaacgcaaaagcaccaagtcccatctttcttgttaaccaccgacacaggtgaagcaaaagggctcatgctcggtgtcaccaagcaagaatcaatcatttctttcacttgtctttcaatctcatctttctagagaggagaatacctgtaaggcttgctgttaaccggtccagcatcaggcaacaaggagatgcaatggtaatacactttgtgtggaggcaatacagttggttcctaaaaaatgtcatgaaattccaagagtacctgattaacagaagaggaaagtggatgtgcaagactagcagaagagtgctgcaacattgcagcagcccatatatcacaacctttctgccacttcagaatctgaaggagagaaactgactggagttcagttgtgattgcagaatctaccacaccctgcaatgaaatctagctaccttgataatgaaatttcaaagtcttccaagcccaattacaagtcatatcaccaagtcatgcccaaaatagcatcatgaccacccaattcaaccactctcatatcaaaaacaaaagtgtgtccttgaatccaccaagtaaagttaggtacaatatattgacaagtgagaaaatccccattagctactctgaccatagaaggagatacagattacaaaggtaatcccaactgctgagcaaagtgcagatccaaaaagctatgataactaccagaatcaaccaacattaacaacactttgctatgcgccaaagctctcaatcgaaatggctcgaggatgatgagcacctgacagtgcattcagcaaaacatgacattcatccacttgatcagattcttcctcagcaatcactgcattcagcaaagcatcttgaatgatttcagtaatctgcattgctttgatttggcccagcacagcacacttgtgctcagatgagtacttttcaccacacttaaaaaaaacataacccattatccttgcgaaaatcactcaattgccaagccttccacggttcagcttgttcaggcttcagccccaaagtctcagtcccaactagccgttccacttttggcacaaatttcttagcaggcaagcgcttcatagaaggggaagaatccagtagcagcccttcctgagtcaaagccaccgcagtagcttgttgaatagtttgtgacagctgaagcaaaaccgcattgcgaacttcctgcttaagccccaaaacgaaacgagatactaacatcatgcctcccactgaaggatcaaacagtctgacctgataaacaagtgaatcaatttgttgcttatattcagccactgtaccagtttgagtcaacaaccgcagagctaaagttttctctcggtgcgtgttgccctcaaactcatgaatgactacataacggaaatgagcccaatcactgacatcctccaccagtttaacagactgataccactgcgctgcattgccatacatatgcaaaatagtagcagacacccaaaaagtagcagaaatttggtacatcttaaaataagtctcacacatatcaatccaaatatgcacatccggcccctcaaaacgcagaaaatccattttcggcaaatacgacttagcccgccccccatcctgagctcgatggccctcgccgtcaacccaatagtgtgcgtgggaaccaaatcgaggaggtggtggtggtggcggtagtggtggtgttggtggtgcaccagcgcccgaacgcgagaccccagaagaagaaccaagaatactcacaagatcgcctgagcccaaggatgatgac

SEQ ID NO: 62854 - DNA, 1810 bp, Oryza sativa
  unsure (1)..(1810): unsure at all n locations
atgctgcntttgaacaaggatcacanttagacaattgttatgcgcaaccattggcacgtgttcttaagcaaatttagttacactgttcatgaaaataatgcattcggattcatctgatgcttcgatatttcactacactatggaaattaattaatgggtgacactgaatcaattgtttatgcatgcttaagtattctcaactctactacatgttgtaaataaacttttatcacttccatgtgtcctctgattcataagctttattgatttgtaacaaaatttggaataccctgtgtcatgtgtatgtataattaaaatactacctctgccaatgccctggtaataaaaagaacaataattacaacacaggttacaacatcggaatttataaaatatttatgctgaagtttgtacccatgattgcctaatgggtttgtcttcctcctttatcattcgagaacttttacggtgtttgcattccaaaagggtaaagatccaacagttctcaatcacaggtactatgtaaaggtatttaaatattagtatagatacttaggtactaaggataaaaatataattttgttaatagagaaaaagggtaaaattgtccctccccccaaattataataggtaccacgtaggtacgactgtacgagttaacatctacctggtaccacatgttcttatttgcgtctcttttgtgtgatttcctgtagatttacgttgtgtttgagttaggtcatttacctggcactagtgtaacatgttcttaattcattttctctagatttacttttttgtattctttgatgttctcttttgcgtgatttttttagatttacatattgtgttcttataacatgtttctggccttgggctagcaattggtgacgaatgtactcgaaatccatataattttcattttcgtcatccatgaaagcctcattttcatcaccaatcccagcttcagtagtatccatgtcatcctcatttaggtcatttgcttgctcatgaactagttcccgcaagaccaacaaagcagatggagttataaagagaggacctttccgtagatctgtagcacatgcgtgaattgcactcgcagattaggcgaccgcgtccatgtctagcggcaagccggtgagtgccattaatctggtcgttagcgccatgtccaacctggggaagaggaagatggcaacgggtcctcaccgacaatggcgatgggagagacgcaggttgcgctgccgcaccgacaccggtgtgggcgatgggagggacgtaggtggcagcggaggtggctgaactggttcaaaccctagaacacgaatgaaacaaaagggagagaagaaatgagacacgatttactttttgatataattgaatcaatcgctaaatcaacggagtatccttgatttacttttttctctacagcgatactgatagctactacaatacaccgatcactggaaggatatattcaattcaaatgtattgcctatgttttactagttaattactcaaatgccatcatgctacaataattttgttccgtaccttgcccctctctgatcaacggtgcacattatttcaccttcaagtaccttgcaaacaccgtaaaagatctcttatcatttacatatgcagagtaatatctttcttaaagttggttctcattaagttccatgaagattattattgttaaaaatataataatttcttatgatccatatatgttccaagtaagaatggcaatagacctgaatgaagaagggttttccaaacttattttttgatgtcaaatcatatt

SEQ ID NO: 62855 - DNA, 7602 bp, Oryza sativa
accccatagtacgcctttcatttacttattaagttgccaaaaattaaactacacaggtagcatattttacctggattttacaacatcgatgtttgttcgccttttctttttaaggtatcatcttaagttacttagatgaaaatctagtcatgtttccaatgacagtgccggacaaatattttggagtgtctagcgttttatgctattatcttggtttttaaggtactagaaaaatatccgtgcattgcaacgggtgaactctactttaatcttattattgttatacggtatagctagggtgaaattcactgttgaaattcgtttggatattttttttagaaaattataggttacaattaggagtccgacttttatctcaagttagtatgtgagttttttaaaaagagatttattgtacgactccatttgtattttcaaaagcaatagaacttaaaatccgtttgtattttcaaaatcgaacaaacttaaaaaaccaacttaaatatggatgacttatcaaaataccggtaaaaatatcttcaatttttataatagtagagattatcttgcttttatttaagtgagttgctgtaaaaataacatcatgatatttcttggctgtttgcagagaccgaatataatttcatttctaacaaaattatttttattatctactccttctgtatctaaaaaaccaaactaatactagatatgacacatcatagtactgtaaatctggatatatctttatctagattcgttgtactagaatatgttacatctcgttctagatttgttttctgtgggatggaggggggtatagtggtggcggtagtgaatttgccacccccacctactctcatggtaattttttaatttagcgcttaaactctcttagtatcaaaatcaatcaaattttaatggatagtcacaaataaagtcaaattaagatgaatatttcttatagcaaaatgatttattgatactccctccgtcccaaaataagtgcagttttgtactattcgcgttcaacgtttgaccgttcgtcttatttgaaaaatttttatgattagtatttttattgctattatatgataaaacgtgaatagtattttatgtgtgactaaatatttttaaaattttcacaaatttttcaaataagacggacgatcaaacgttgggcacggatatccacggatgcacttattttgggacggaggttgtaggtaacatatttcatggagaatacatattttatttattttaagtaatattataagatatatttttttacttatagtaaaacatgcacatataactagtctaaaaaaatactactactattctttatctgttgcccatcaagaagacgcaccaagtctccggtttagaccccccaagtcttcccccccgcgcaacagcactccggttttagtaatgcatacgccgcagttttaaattgcctcattaactttgtagtggtaccttgcttcccccactggcacactacctagctggatcggggtatacatccaacagtggcatatatctggtgtgtgttgtgttgttttcagtttacacaggagtattaaaatcccacgagacgagaggagagatagcacagctaacacactcatcactagcagccgcgcgcgtgagagagaaactatggagagcggaggccgcgcatgcgccacgcaagttgcaacgtgcaagtcgccgctgcaattactctactggttcgtagcgagtccacttgcgcgcgtcgcggtcgcggcggccatatcgctcgcgccccggttgctgcttggctttggcattggcatacgcattctctctcaaagtacgcccgcgtcgcaacaaatctggccaaatttctcgcgctgttgttttcgcggcgcggcccgggccgcgggggtaccagcgggcgaacggcgtgtacggccaaaaagcacagcgcacacccacatcagaaattctaaggcaacttgcaggggtttggcacgcgccgacttatcaaccaccactactcagtactcaccatcgcgaacgttatctcttcgacgcggatcgaccggtttgtttaagatagaaccgatcgacgtgcaagggtgcagcactggagggggcaaccaaaatcgtttttttcatgcggctcagcgacccgcctggacccacaggtctacgaaaatcatcttttttcatacgtagagcccaaccgcatgtgaaaaacatgatttttatatgcggtaacctatatcaaccacatacaaaaatagttttagagaaaaataaaataaaataaaattccccaaaagaaatttagcataaatccaagatttccattctaccgaaaccctagctcctcatcgtcgttgcagcggccaccgccgcaacccacggtgccacttctaagggtgggggcagccggatccgcacaccaccaccgctcccgaggacgggggagtcagatcccctcacccccaaggctgcctccgcctccgctaaggccaccatcgccgctctctcggacgggtgcagctggatccgcgcgtcagcaccgcccgcacccgagaccgccttcgtcgctcactggcggcgcccacctgcgaggtcgtcacctctgtctcagccgttggaggtggagaagagatggggtaaagagaaggggaagagatgaggtggagtgggagaggaaggcgaagagaagcggttttggagaagaagagagaaaaaaaagagtgatacggtggagataaggaggagaaaaaaaaaggtgtgggagaaaaaatagtgcggggatgcgtagggcccacttgcttgctgctccaagttgccggcatgaaaaaatctatttaatttttcatacaatctcttaataagtctgtctaaaaaatagacttattttcgtacgtgatctcgatagtaaaagaaatatcgtttttataatagttccagtaaaccgcaacgtttagttctcgttgtttcgcacatcatttcatttttacctgtcgttgaggatataaacactatatcgatctaacatgtgccttgaccgttacctcttactaatttgtagtggtcgtacgtcaaggggtgagattaatgtccatccccggtgtcaaggtctagactttgtgttgtttcccactaatcttcattacgattacatatatacgcggcgtagttcagtgaacaaattaatgcattccacactccactagggattgggtatgccaccaacaagatgtgtgcgcgtagagcatatgatagtttgttactccctccgttttacaatataaattattttagcattttccatatttatattgatgttaataaatctagacatatataaatatatatgtttatatttattagcattaatatgaatgtgaaaaatactagaatgacttacattgtgaaacggaggaagtacgcatctagagtacgtttttatcgtagttagtacctcctccgtcccataatatatgggattttgaatttttgcttgcaacgtttgaccactcgtcttatttattttttttaaaaaaatattatttattttatttgtgacttactttattatctacagtactttaagcacaactttttgttttttatatttgcaaaaaaaaaattaaataagacgagtggtcaaacgttgcaatcgaaaactcaaaataccttatactgtgggacggagggagtaccttttgttggtagctaggttaatctatatcgttttaacacgagaaattcaaatatttctgcagctcagctggcctccgggttgttgaagtttgacaatacaaatgctaaaatggtactacctctatttcaagttataagactttctagcattgcttatattcatataaatattaataaatatatatacacatatatgtctagattcattattattattttatatatatatatatatatataaatatagataatactataaagtcttataatatgaaacagatgaagtatcatttttcttccctttcaatgtaggccatcgataatctccaatgaatgtattttattgttgttattcttcatcttatatctagcgccaaggaacaatgaaaacatgtatttaaaaaatatcaataaataaaggagtaaatttcactttacgctatgttattggccaaagttgcacaattgagtaggttgactcgttttttccatcgacgctaggaaccttgcaattcgttgggaaggagctcctacgttaccggatactcctcctaggccacgtatccatattggatacggctacagatacggatacgtattgcatacgccccgatacgtatcccatacgtatcggccatttttacgattttcagataataaaaaatatttccgatacttctccgatacgctgtaaccctaaaatcatcgatcaaaatccccagccaacacacagcgagcaaaaacccaccaacagcgccacctccccgaccccaactctgctcgcctcttcctcgcgtcatagcgcagcgccgccgccgccacgccgtgcagcaccgccgccctccgccgccgcaacgccgcacagcaccgccgccctccgccgccgtgccgcaccgccatccccttccgctgcgccgcgccgccgtcgccctccgcccccggccacagcgccgagcgccgccggccgcagcctccagggcgcagcaactccttcgtcgggctgccgactgtcaaccccagcctccgacgacgggctcaactgcttctctagaagactagaactcctacgtatagcacattatctatgggagagctacctgatgggcctgatctcctgtcagagtgctaaaagatttttggtgcattggacctgttcgatgatatggcactatcaatgatacaaacaccaattaaacttatttacctattgacagttgaacttgatatcctgactagttcatgccctgtaatgctatctcttttttctctatttatactcttgcagttatttatgttttctttctatattttttattttttaaatatatataaacgtatccccgtatcagtgttttctaggaaatgccgtatcctcgtatctccgtatcgcgtatccatatccccgtatcaagataacatagaggagctccatccccattgctctttgttgagtccgcgttgttgtcgtttgtggttatatccataacagcagagttagcaatcaaatctaacgtgcttctctctctagctatattatgcactgctactgaagatgcatgtaggaatcgtgcacggacgtacaacaatggctggacgctcagataatggcgatggcgctctgaccaagtgcgtgaaccaagaactgcatcatgatgaacattttagttttatttacaagtggaaaaataaaatctccagtgctggcaacgcacgtttatattaccattatggatacaattttgagatgatatcatcaaagtcggagctaaggaaagtaagacattttccaaccgaatgagagcctcattagttgctcatatttcataataaaccaaaacatctttatttgcagcaaattaaaagacaatactaaaaataaattacgttgaaaatatcttaaaatcaactttaaaatgaagttcaaaattcaaatcttgacttttgctttggcgtattaggctaactgatggggctctgagtgaaggagaaagagtggaacttgaaataatggatcagaaccctttaatgttatattagcattgattgaaacacaaattttaggggccctagtttttggaggcctatgccatctctttaccttgcacttatctagatgtgggcctatttatatttttaaaaatctaactatatgaaggttttttgcataatataatctttatatatatggggacaaagtatatttgaaaccaaagatagcactagggcatcatctttttcatgatttattactacatacaccattgctaccttggtcaccatacgcataactgatttcaattaattgtatatttgtgttcatggtttttactttccaaaagtttttccacgctaaatttgtgcctcagttcttttggcatcatgtaataaagctatacttttctttctgtcatatggtacaaaacatgtcccagtatacttttacatggtgtttccactttccagttccttgtttctatcacactcactaggaccaaagaattcccctgttgacgcaatatcccacctgattcctccaaaatttccagaaaagacgcatactagtccatgcatggcacaacagaacactccacaatgcacaggtcatcacacgcaatatatatccacccgaacagaataaaccatggatatttaagcaacactaatgcagccattgctttgatcaaagcaactgccaaagcaaacccaataaaaagaagaagaaaaaagaacacagaaaggggccaagtgtgacatggcgagctgcccccaagggcacattttccaggccaagccagctcacatcaccagagcaacaagaacaatctatcctccatctttatccagctaccagctctcgatgaagccatcccgcggtatccatgggctgagctgactgcccccacaaaccaacacttgccactccctccctcatctcccctgtgccgtgacgtcgttctatccaaagtccaacacaacagcagggcattttttatacggttccagccaccgaaaagaggaaaagataaaaaacacacacacacacacaccagaacaaaagtagtatagcaaaccatcagcttcctcctccttccctccacgcggacatggtatagccgtatagggggcgcagtatggtagcccccattgcccccatacacaaacacattccggcatctatcgcaagccaaaccacccacccacaccccccacccaccgctcctatatatccctcctcccccttcgtctccctcctctcctacttatcctacgcttgccgcctatagcatcgccaacagaaggaagcaagagatagttcgagtcgagttgagttgcatccgtccgtactggggtagaggagagtaggagtgtgctagtgtgtgaggtctactgaaatggacagctccagctgcctggtggatgataccaacagcggcggctcgtccacggacaagctgagggcgttggccgccgcggcggcggagacggcgccgctggagcgcatggggagcggggcgagcgcggtggtggacgcggccgagcctggcgcggaggcggactccgggtccgggggacgtgtgtgcggcggcggcggcggcggtgccggcggtgcgggagggaagctgccgtcgtccaagttcaagggcgtcgtgccgcagcccaacgggaggtggggcgcgcagatctacgagcggcaccagcgggtgtggctcggcacgttcgccggggaggacgacgccgcgcgcgcctacgacgtcgccgcgcagcgcttccgcggccgcgacgccgtcaccaacttccgcccgctcgccgaggccgacccggacgccgccgccgagcttcgcttcctcgccacgcgctccaaggccgaggtcgtcgacgggctgcagg

SEQ ID NO: 62856 - DNA, 1903 bp, Oryza sativa
cactcacccctatgaacacacgcacgcaaaccctacccctataaacatcttcgaagactgagccagcaaatcctggagagattgacgaagtcaccataggcgcctcgctgtcgacggatacgtcgcctaccactgaaagcacaacgccgaaaaatcctggaaaattcgctcccatggggagtcgaacctaggacctcaggtgctactgaggctcttgtatgactgatattttttttctcgtgatataaattgtttcaatttgcaaagtttggaggattataaaaaaatagtaataaactttaaatctactttaacaatatgatatatgcaaaactggttggaaggctaaaacaatctgttatgagtataaacatgatgggactactaacagacaatcttctcttgtttgtaacaatttctcaattgacaatgcctgtagctagctcaaggatcctgtcagggttatggataccacatacctaatagtagttgattaaatctcggcaggacccaccacataccatgtcctatacggaaacaacctacggatataggagaagttccgcataaggaaggataaccagagttctacatggaaacgacaaggactactcggattgtatccatattggtttccctagttctacttggacaaggggacacctatgggtataaatacaaggccccctaggaggagaggggatacggacaatcgacacccaccacaatcaacatagacgccacaaagccaatacaagccaacatacgccaagacaagacgccggatatcgacttcagggataagcacggctagtcccctacggtgtctccggatactgtcaggagagacgaaagcgttatctctgatctcgccgggcatggattcaaggaggaagactaccctgtcgtcgactacgagtcagaccttcagaccgccatgacgacaacagttagataggctaccccaagtattatactggtgtgattatggtgaataagagcaataccggcttcggccaataggatgtagggttattatctgacaattcaggggccctaacctgtataaaaaaccctgtctctgtctcttttaccgcagtctcgcgtataccctagtaccaacgatccccataccatgcaaataccggaatcgcgacatcaaacgtcgatagatccatttgataagctcttggcctgaaggaacataaaatttaatagctcgtcggacaacaaactaagattgaaacctacaaaaattaagaacacattggagcttctcatttcatatgttttttttctactgcacctccagtttactatattgacaacatactccttctgtctctcttgtgtagcaatgtgtctactgggctagactgtaccgagtcaaactggattgctcattccctgccaatggcaatataataaagtttcggttgtcaagaaaaagatgctaaactggaatatgaaaaaaataactactgtatatatatacaacgttacttctttgctggcattatggaacagacagatggattttggctgcagcaacggcattagttggtttgcagaaccaaatggaagttacccattagctaacctgccctaggtatgaacaataaacactacaaaaactctttaggattcttttaatttaacggcagagtgcaggaccccactcagaggccaaccacaaactcttacaaaagtccgaagtaaaggataattaagtctatgaatagtttccaattctctgttcactgtatgctcaatattgtttttattgcctgatcaattcttctgaagcggagttccacaaacattgatatttccgtcaaacatcgatgttttgtgtgcgtttcagttatgctagccttcaatcagtaaaccaaaaaaaaaaaag

SEQ ID NO: 62857 - DNA, 2979 bp, Oryza sativa
acggggggagatggtttatgtccatccatagcagggagataaatgatctacattcacacacaaaagatattaacacaacggttactgctgcaacagattcaaggtttccctggaacatgtccccaaagaacctccctagattatggctccgtttggcattgttgtcctgtttaatttactcctagttagttagaagagttatttactaattccagtacgattttgccattaatgctccaacaaaattttatacatccaaaaaaaagaaataaacacgtgaccttcaaagccacagccaaactgatgacttgctatggtgctactaaatccaatgctgtgaaaaaagatgcctataagcgtaaatgaagagcatttcagatgcatagaaactacagaagttggatgatggagctgatttccgattcaccatgtaaaccccagtgaccctcgtcctttacacccttcccactgcttcccagtttagtaatgctttctgatgtctgaacccagaaccttaaaatgtgaaaagatgacccataactagtacgccaatggttttacattacttaattttccagtttctacgtgagtacctcaaacacatttcatgcactgaaaatttcatgctagattactggtgtgcacctaaagcacgcgactattggaagacctacatcaccactttagaggtaattggcttaggttcagagcaagaaacaatgacaccttgcaacacataagcaactctacaactattgaaaagaaggtaaaagaagccttaagctttcatttatgtgccttttggaacatggtctttgtcattcttgaacaaccaggatacttttatgtcatcagcaattgtgaggaagatgcaattccggttttaaacaatatagcatgatgagctgcatggactgaaaatattatgctacaataagtagaaaacaaatggtgctcagccaaatctcagatcatatttcttgggtctgctactgtaactagatttggctgagctacgtgaaaatggccaaattatttacttaaccaacatattttctgcaattggataagacacaaaaataagactactacagcaggttactctgcaaaagaagcttgtgagaacataccctcataagaagtgataagcaaagatgccgttttatagccctcctaagatccttggggaggttcataagcaagagttcttcatcaaccccgctcgtctggtgccatctatatttttcatgacgacgtattcgttccttgagattctcaggaagcagtcgatatgacatccattgatctgtatcacggcttttcactctcatttcttcttctctcagatgggctgactgcaaataggtctgtagaagtcacaaaaaatggaaggatgagttagctacccaaattacgcatttatcattacgcagcaaaaacacctaatttcattcaatgtcagggatcctgtgaaacattctttgtagtacaagacctgaaccattttgtacaaagactactgttgcaaataaggactgatgatcttattcctaccaagattatgctagtcttatctccaaatggtattggaatgaacactcgaaacctagcacaaggttccatatctttagtttcatatccctaggagataaaataagttggactcatttttctcagaattaatttgatttattatttttaagttttccataattcactcataaaaatattctctgttgttctggggtatatctttagcagcagtatatagcattcatgttctcttcaattgattatgtaggcattagacacataacacacttaaaattttagcatatttctgatttgcaatgcaagttctattatgaaaagcttgaataataacataaatcaagaaaatgacttgtaaaattaatagccaatgaagctaaatatgcgtacctgcacattaccaattagcagtgcaaacagaaccaagcctgatattgagacaaaaactgcaaacagattctcccatgcataagtgcttgtcttaaggttttggcccagagagctgcattaaatagaccaacacataaatataggtggcatagagaagtttattggttcaagcagaaaatactttaaatgtttctgttttgcacaaacctaagattttgcagaccccaccaaacacaatagaatagttttgccaaaaaattagttgattgcgagacattatttagagctggcacataaattccaaagttcggatctatatcgtttgagtcgattggaaggcaagcagtccgtaagatcgagttttccttatccccacagtacaaatatgcctgattacagactgtactattattactacacatgtctctccagcaggcatctttgcgttcaatggaaagcaagtaccagagtgctccaaggacctgcagcagttcaaagatttgtcataaatatataaggtgcatggaaatatttaattatatccaatttagtggcactgcagttgcaaaagtatcccacttatgaatgaagtcaactagatggttgcatgggccactaatattttaattatttgccaatttagtagtatgaagtcaagtttcataggccattctttggttgtgattgtccatgacattccaatttatccacccagtcctccaagttttccgactatgggtcatgattgtccttactcctttgaaccagttgaagcactacaaggacatgcatatcaaacgaattggccaagccaagagatcaagggtcaacaccgattagtcctgtacaggcgctgctcccggtggatccaattttaatttttaatgaggaaaatttgaggacacacacacatctggatgatacatcagagcccaacaggagcctcaagcaaaacttgagagaccaaagtgttgttacccataaggatattatagccattttttttacagaaaacaaaatccatgcatattattttct

SEQ ID NO: 62858 - DNA, 6686 bp, Oryza sativa
tttgctgatgaaaaccacaaaacaagaggtgtttatggctctggtttggcaaaaaataaaaaaaaatgagactacacagtgctattccacccataccacacatcaaccaggttagccgaatttattttgatcaataataaattcatgtaatctttacaggaaattgatcatgttttcagctttccactattgcagttaaatattgctctagcaaaggacagttgatttggcattgttgactatccagagttattgaatagaatacttacatgactggcgagcaagtaaattaaaaggttcaaaacagcaccagcccatggtgtctctgtaattaccccagcagaccttgtgatttggagatacagtggccttattcggatcagccgaggcacatattggcatataactataaacatcaagatatttttggcttttgtaacctctgagcctccaagattaggtagcacaaccaaaataaccacctggtaacaaaattgaccatgcttacaagcttgactgagaaatcaaaggcgcataacttagtgcactattaagactgcaaagtcatagaagaaacagacagagctctttgtatatgaccccatttttctaacatgtgaattgcatgtatcagagtaaaatcaaaatcttttatttttctgatgtggtatctaccaaaagtgcatccttactaatcatcccatgataccaatatgtgaattccattatatcattataaatcataaaagaggtgaatatctattatttttctcatgtagggactatcaaaggtgcatccactaatcataatttatatgtatatcaccaacataccatcataattctaaagaatcatgtgaactatactatgaaatagttccatactgagcttaactaagtacatggtatgcggagtacctgagggaggggtagaacagcaaagacatcgatcagaaaatatgttgacaagtatcgctttgctattgcatatctatcctcaaccaagacaccccgaccaaaagttgtaagagaagacgcaatataacctgtcctgaactgaaatatgatatggagtatatagaagatatctgtgaaaaagcgcaggacacttgctgtgatttccaactttttatccaaataccagcatgtgttgttgtcattgataaccggaatatagaagaacaatgggtccacagaaactgcaaagatacatgacaaaacaaatatcttgttccagctttgcagaaatggtccctgaggatgaagagttctagttgtcaacttcctttcatgcagcaccaatctctttaaggtttcagaatgcacaaggtttcctaggaatgcaaaaactccagcagttctttctttaagtgaacttaaagcattatgcctccgtggtgacataactgactgctcagatctccagtcctcaaatctgcatacatggttaaaaaaaatacagaataattattacatcgagttttcagtagttgttttcaatatttactcaaaactttaatgggtcccaggactttaatattcattgatcaggtccctagagacccaaactttttttctctcttctctcttctctcttacttcaactacgttatttttaccagcagtcttcattatttactcaaaaatttaatcagatactggtgttgtcatttccatacatttatatgtcagacttcttgatgatcttgaaccgaagctagatttctattttggaaaaattggagagaaattattgcattcatgtttatatgctgcaaaagacaaggaaatgagcagtaacaatcgttccaacaagtcaatccatgccagggtctctcagaggccaaaatgtccaaaaccatcatgtgatgaaagtagaagcatcgatttttttttcgaacacgcaggagatatgcgtatcatttcattaagagagaaagaaatgcgagggatgcaagatttaaacaaaccctgacacccacccatcgaaagtcttacagaacacaacacacacccactctaaaaccgaagaaactcaagccgacctccctagggtgcaagaactactgccttagacaacagcttttggagtttcgaagctcccgccaaacaccaaagtgtggcctcattattgacagcttggatcacatccaccacactagtgtagaaccaccaaattaccattgctctttagaaatcaccaaaccctctccatgtttcatgtcctaaacttgttactataagttatgacacaagacatttgacaagcctttattctttgtaaactatttcaaacaactggtgatggaggaaactgacctcacatatttgtcctctcttcccatcatcattttccaaaaatccaccaaaccaaaggttagctgctagaacagctttattgattctacaagggtggcgacatttgcatacatggagttccctgatgattatcaagcataattgagtaagggaagtaacgcgtatgcacatgaatatggacacagaacaaagaacagcaacataatcaaatggaaacagtaaatttaactttgttatgtcacaacagtcagcttagattttgtgcatggacaatcactcatcacacctgacaggaaatgtccatttgattgttgaatattgaatgattgcatttagctaactggacaatagatagaatgctgaagtggtgatttggtgtttccctcgtgtaggcaggctccatttggtattgcggcggactgtgtttcatttagggcaacagctttttgggtattccagtgtttggtaaaatgcttgtatttaaatcaaaagttaattttgagtttcaaattatgactattttttaattcagatagagcttattacttctttttagtaatcatgttaaaatcagcttcccactataatacaaagatgttctaaatgataatattattatgttgtgaaaatatgaaataattaggagagacatgaaagttggatgatatattttatcaaactataatttgattgatcccataaaataaactaaacagctatagcttataagaatcatttccacagcaaacctagcctagcctagccttaacatatataactctgtatttctatccctctctgttatttcggagggagtcgccatcaaatacatggtggttaaactttgcaaagcatagataaggtatggctgccgagtatctcaactcccaaagtgtcacaccaatttcaccccgatgaacagataagcaggaaagtgacagttagtatatgaaacatcaattaccaccagtgcccatagtcgttccgattaacaaatgattagaattaccaattgtgacctatttgttccctgtgatgataggtaaaagcaaccgatcaagcaactaaaaaaattctaacccacccagttataaccatggcttggcctgaaaggctgaaaactccgcagccgcaaaccaaacccccaaaacctgctgacgccgcgctacctattctagacacacgagaccacaaaaattcgctaagagaaagcaagcagggcatcgtagcgaagaagcagtaacaaattaagtccggcctgaggcggcgccttgcccccctcaggcggcctccctccctctgcctcgcatgacgccaccgcccccctcggctggctgtggagggagaacccgccgcgcgacggagcagggggagcgcagaggctttacctcggaggtggtgcgcgcggattggacggaggggtgggggggaattcggtcctcctccgcgtcgcggccgggaagccggcggcgtccgcacggcggttggtggtggtggtggtggtagtgcggtggaggtggagggagcgatggaaagcggaggacgaaaacgggtgccttggtttcgttcgtgcggttgggtgtgggtggagttggactccacggcatggcggcgacgactaggccaacggtccacgctttgctggcctgtacagttttgtcctaatcgtggattcatttttaaaggatattttttgtgaaaattaattaggtttagatttttaaaaaaagtaaatttcaagtaactacaactctattgtctaaactataaaatagtatgaaattttactacatagctacaatgttaatgaatacaattatcccaaaaatacaatcttgttacagtgttaccttctaatgttactaacatcatagacctaactatcatacaaatagaatttggctagagcgaaactggacaacttgttgatagtcaccgcggtaacacatcctattgtagtagtatgttacgtcatacaaacgcgagcgtcgccttggtcataacttggtaaaaggaggaggcatcacttctcccgagtcatggccatagtgagatgtcaaggaagagaatatggaaggaaaggaagaagtatcactacctccttccattcccttcaaccgtatattgaattaaacgagggaaacatagtcgaatggcacgtgtggagtttactcctctctctactggttagttgctattgttgtgttgcaatggcggacccaacattttaaacttgtgtattcgaaataggaaggggtaaaaaaaatttgttcgtacacctagaaatataataatttgcttgtatagcatcacacactaataattatataacataaagagaatatagcatacaattgaatataagttcacacattgatataattcaccatcagttgaaattgtttaacatataaaaatactagttggtgaatgtatcgaagtgccaacctaaataatacataaagactagaaaattataaattggtaagaaatcttacaattttgagatcaactttttgatgtttgatattttaaaaataagtgataatgtccttatccttaactttcaagaagaaatccctttcaatcaatgtaactaaacaatcattcaaatattaagagattttgggattttgctagccggttaggggaggggaaatggactgagttagtaagttgcggcccaaagtggcaaagcaagtgcgggctaagagcctgagagagaggaaagggggacgaaagtgggaaatttaggcccaatagtggaggaagggtgaaacaaggcccaagataagtagtttaaggctttttctttatttttttaatgcatatacaaagtatatatatatatatatatataattatatatatatatttatttattatctaaaaatcttggatatacatctgaatatccttgaatctataatacgcccaccctaatgtgttgttcttttttctcttctctctcgatgtctaagcatgttatctcacaaactttattctcctgtccaattatattttgtatttgtaccaatttagcatgtaaaatattatatatcatcctgaacttaaattagatagaaaagtgtgatgtaggatatgacatgatcattatctgcctgaacttttatttcatgctattttgagattaaaaattcattaatattttctatgtgaaactacttgggttaaagatatccatattttcattccataagacagacaaggtttcttcttattcgtgtggaatataaagaaacgaattattcctttactctgatatcgaggaaacctatttcaccacttcaatgttttatgcagtacgactattggtattttttttattattgtaaggccctgtttctttcagctttggattattataatctagattattgagccagattactatagctagattattataatctgtagtagaataagcggttagttgtttctttcctaaattattagggcctagattattgggtttgcaagtctaaagagggagtggggtggcatggtggttaattttttacccaataatctgaaaaaagctcacctaaatgagcttattagattataatactctggagactatactaagctattttaataagttgttcgtctctttcaggttactttcaataatgtagattataataatgctaaactgaaaaaaaaacagggccactactaatatttcagttgcataaaatggatcgaactattcaatacctaattcacgcgtgtcaattgggtgcatattagttagggtcattggccacacattaaagtatgataaagctgcatacgaaatatgcatacatggatattctttactggcaggattttcgctaatattcagctcatgagtaacaaatatccaatgacatttatttccaaataaagattgtggatcaaaccaaacacaaccaatatcaatctgtatcacaaatttctaattaaaccgacgaatcattttccagtaagaaagtgtaacgtttagtaatatcttcttccttcaatctgttcattacaatctctctctctctctctctctctctcgaattcgcgaacacgcgacgcgacgtcattttctcccctgcaccggataaacaacgccaaaaagtttgttttatgtccccgcccaggcctccgtcgccgccgactcaccgctgcgccgcccgcgaaggccgaagcggcggagggggcctcgccggagcgctgctcaggaggatggcgcgcgccgccggcctgcgggctctggtcggcattgaggcggcggggcgtgggcgccgcgtcgccgactgcccctcccccggcggaactccagcggcctcccgcgggctccccggctggcc

SEQ ID NO: 62859 - DNA, 871 bp, Oryza sativa
atttaagttccgttaaatttttaggattctcaatttgcactagcgcaacatccgataacgcatctgaaccgattaatttcgctttaaactctcgcccatcttctaatttaatggtgatcttttctgcatctttaataacgtgattattagtaatcacatagcctttttcagcattaataattgcgcctgatccttgacctcggaaattacgtggcacattacgttgttcaccaaaaccaaagccaaagcgttcagcaaaacgctcaccaaaaatatctgggccaaagaaaaattgaagttcttccggaagttcacgtttatattgtgcattttcaactttagttgtaccttcaatagcaatactgactactgccgggcgaacccttttaatcatagatgctaaacttggtaatgcttgaccgcctaatattgttggtaataccgcttggctcatagcaggtactgaaagtacacttaaacctaagactaatgaagataaaattgattttttcatgactttattcattcgtatcatccttgtatatgctctaatttataaaataagtgtcaaattaactgtgttatttacgacagtgtaattaaacaacggttcactaaaaacaaaataactgttgataaaataaacgaactatagcgttctgtcttttacaggtaagcggtgaatttttcaccataatttaaaaatcctttgactttaataacgacttgatagagtattgtcaactatattttatactctaacgaagaaaattccaatgcgtgataagagagacttggttgaaataaaaaaccttacctttaaacgtggcaagcgggtaatttatgaaaaccttaatttgcgtgtgcaaaa

SEQ ID NO: 62860 - DNA, 752 bp, Oryza sativa
caacaggtcgtgtaaccactgttgaagctaaagtgttattttttgtactgttaatcattgcttttttattggatttatcactcaatcaatacgcatttttgctttcatttgttgccgtggcattagcggttatttatccgtttatgaaacgttttacgcacttgcctcaagtcgtacttggtatggcttttggctggacgattcctatggcatatggtgcagtgattgaagatttgccgttaacatgttggttattatttttagctaatattttatggacagttgcttacgatacgcagtatgcaatggttgatcgtgatgatgatttacgtattggagttaaatcaaccgctattttattcgcacaatacaacaataaaattattgcgctattacaatttttgtcactcattttatttattctgtttgggtggttaagtgaatatcacattggttattttattgtattagccttaacttcaaccttatttatttatcaatgttggttaacaaaacaacgggttagagagcaatgttttaaagcattcttaaataataattactttggtttcggcattttcatcgcgattctagtgggcatttatggtttttaagttgttatagatgaatactataaattgatcattaaacggttaatcaattaaaagcaattgtggcaatagcctcaatgtaacggctttatttgtaaaggaagcgctaagcggtagaatttttgcgaataaaagcatttt

SEQ ID NO: 62861 - DNA, 41904 bp, Oryza sativa
aaagacacgctcaccagccgcagcggcgcgcccctctctctctcctctccttttaactactactccccacgaggagcagccgcgaacaccacacaccacctcacgcagcagcagcggcagcaatggcgtccatcatcgtgctcgcctccgtcctcctcctcgacgtcatcgccttcggcctcgccgtcgccgccgagcagcgccgcagcaaggcaagccccccccccccctcccactcacccccttcctttctcctaccggcctctggaggagccgtctgctgacgtacgtacgggggttgctttttttgcaggcgacggtgacgcccgactcggagaagctgtacgactactgcgtctacgactccgacatcgccaccggctacggcgtcggcgcgctcctcctcctcgccgccgcgcaggccgtcgtcatgctcgccagcaagtgtttctgctgcggccgcggcctcaagcccggcggatcccgcgcctgcgccctcatcctcttcctcttcgcatggtaaatcaccatcactccgcttgctactactcgatcgaatgcttcaccacattaaccaaacaacattacgaatgctttgcctcttttttctttctactcatattttgggatctcgcgcctcttcgttgcttgcttctggatctgggttgctggtagtttaatctccgcggtaatttttagctagatctaccacttgtggtttgagcacagaacgcgcagcttcagttcagatccggttgttggtgggcaattaatggaggatgggatctagtggtttgagcagatctactgcaacaaatgcttgcacataagcatttagtgaggggaggatctagaggacaattattggatggtttatttatgctggattggctattaatttagagctcataaccattttgcttcagtggaccgggcctattgagctgttctgctcattcactacctaatcagttagtataattttagtctgaaaaaactgagcatcagttcgggcagctgttattcagaagcaaagaggttcttccttcagatctattaggtttactatctctttcatgctaaccaaaaatatattttaagcacatgactgctgcctcattccgctgattgttggtgaagggtcaaattgaattgtggcacactcaaagtggtgatttgttgtccacttataaggaaattagtactactatttttttcagctcgcacaagaggcagctttcactttatgggggcttttaactatttgccacttttagatttggcaaataactactccctccatactcataaaggaagtcgtttaggacaatgtttaagtcaaaccttgggaatataaatcatgaataactctcaagttgttgagtttgaaaatataaaaattatatgaatagatttgtcttgaaaaatactttcataaaagtatacatatatcacttttcaataaatatttttatagaaaaaagaagtcaaagttgtgttttggagaccgtgtcgctgtcctaaacaacttcttttacgagtacagagggagtatttgccacccctatctcaatgacatgtgggtccacatgtgtctatgacatgtgggtccagtggcaaaaagttaattgccacatctaaatgtggcaaatggttaaatattcctcactttatggcagctcctctgtcacaaaagctaaacagttaaaactccaagagtgggggagacttgttcacttttcttaggcttgttttagttcccaactttttcttcaaacttctaactattccatcacatcaaaactttcctacacacacaaacttccaatttttccttcacatctttccaatttcaatcaaacttccaattttgacgtgaactaaagctgtgcttttgcatttcattagtctcacggaagctctatatacaattgaacaattcttttctgggattttaaggtagtacctcccattcaagaatttatcctttcaaagttgcaatagtttacttgaataagtggtagatctactggacttctacatgagtggcctgcatatgtttaattgctactcctacattagtggctgcatatgtccaactgctacatgagtcactgcatatgtccaactgcctcaaatttacttgccccacaaagcgcaaagtgcttgtcactggttgctttgtactactactaggtacttcctccgtttcacaatgtaagactttctagcattgctcacattcatatagatgttaatgaatctaaacactatatatgtctagattcattaatatctatatgaatctaggtaatgctagaaagtcttacattatgaaatgggggagtaggatttaacagttgaactagtgttcctacagtaggtgcacacttgaactaaatattttttattttttaatttaacattacgcagacgttgataacaactattttgggtgtgttcggaatccccctttcccaactcacccctctctttttccgcacgcacgcttttcaaactgctaaacggtgtgtttttttttaaaaaaaaagtttctatacgaaagttgcttaaaaaaatcatattgatccatttttgaaaaaaaaagctaatagttaattaatcacgtgctaatggactgctgcgttttccgtgcggagagtttagttccaaactcccccctccagcgaacacagcctgtcttgttccgtgggtggtacctgtgttattaattagctcattgactttaaataaagtaatgagaccatgttacctggcctgacacagctcactatactagttttgtgggatcatagggagtagtatttaatagtagccatgcacttgtgattatctttttacaaattataattgatttgtgttgtttctttaatgaattgttaaattaattaacttggttatatggtcttccttgaaatcaacaattgggatatcccaaaaaagttctgaagtcaacatcaattgaaagcttgctttcttggtgtccttggctagccaaaccttcatgtagtgtacacctgtcatagtctacagccaaatgtcatcaaatctaattcccttcatcttcctgctctgacgatgcttgttgtgtccatcactacatatacttaatccagaactgcatatccatcatattctaggtgttccaatatgaacagatgtttcaacacctatggtttaaagatatactgatatgcaactgtgcatccgttcaacagtttttgttatgttcccttttcccggtgcttcttcatgttctaatctattggtttttgattgaccaaagtacatagggtaaatggtttagctttgtttctcatttctgcatttatttgaatttaactactactgcctgaatctgtaatatggaaaaattagggtatacgccaattaataagtcaaatcaaatgtacttgccataaaatgattactcaataagatgttttctgatcgttggcaggttgaccttcctcattgctgaggcatgcttgatggccggatccatccggaatgcgtaccacacccggtacagggggatgttcgttggcgagtccgtctcctgcgagactgtgcgcaaaggtgtctttgctgctggtgcggccttcaccttcttcacagccatcctcagcgaattctactacgttagctactccaagtcccgcgatgctgctgggggtgccccgtacggtggctccaacattggcatgggcacttacagctaaaaggagcttgctgaacaggatgatccggtccttgagcttgttggattcaaggtggagcatgtgatcgtggagtgcattgttcttgttaacacattaccttagttacggtgtaattggttggggtttactatcccgttaggttgtatgagattacttggttgggttgtacactattcggattattggattggattctgaacatggaatacacgtatcctagtatgatgatgcgctattgcctgctgacatggtcatctctcttgcttgatgtaatctgtcaccagatcttcactaatacgagatgctggtaaaatggaggtagcatggtagtcatgtgtgttattagttgacttaacgcacacattgagttatatgactatgtatcacagtttctggtcaaagtaaagcttcacaaattctgttttatttctggctaaacgaaagggcgttctttaaaaattcgtatcaaataatttactcatgctggatgcgacatttattcatctttagaaccataagagcaagtgctatggttgatgtgactaccatctctaaatttatttatatcattcactgataaattaagagacaactcatacaatatgttaactctagtacacaaataccaatatatctaatactctcacgttttattcttgaaatttatgtggaggttatcacttgatttaggggtggctcattatctctcttctcacttctcttatctacctcatcactcaatccgatgtgacattctttgggacagtatatgtagcattatagtacttgccctgagggaactagaaccacctttcccactaaggctctgtttgtttcaacttaagattattgtaatctagattattgaaccagattattataagctggattataataaaccgacataaaataagctgttagttgtttgtttggattattagatgcttgttagctgttagccactcaataatctaaaataaactcctttaaagcggattactagattatagtaatctggctttatagattgtaataatatatcataataagctatctatttgtttcagcttgcttataataatccagattataaccatcctaagttgaaacaaacaggcactaaattgtactccttcattcgtactttttagccatttcaatttaggttaaaataaattttttcgcctctttcgtttatcttaaaataaatttaagagctaagtttcttatttgataggctaagtttctaatataaaatggctaccatgttaattcaagaaaattttggctgaattggtttgtaatgatcgtagatatgaagctgtgttcatcttatgctctcaatttagtatcttgttaatttaattttcagttttaatgtaactaatcaatgagttgtaattgatttgaactttttctaaatttagtttaaagcattatagttaaaaggtaaccaatgtatttaatatatgattaaaattttgatatttataatatactagctaagcaataacctattaggtaacgaggccatacatgcattttttttaaaaaaaaggaacttactatcaaacacaattttacatagaaaatgatataggacgaaattcatatgtgtatatttatctaaataaaaaaatactttagtcagtttatcgtatcttatactccctccatttctttacaagtcaaacttactttttatgtttgactaaggtttataaaaaaataataatattaaattagtttcattaaaattaatattgaatatattttgatagtatgtttgttatgtgttaaaaatgtttctatattttttataaacttgattaaacttaaaaatgtttaacttagaaaaaagtcaaaacaagatataaaaaggtccgttggccacggcactttgccgcctcccgtacgcattgcaattgtgcccccaacgcattgactagagaagatgcttcgatgtagatggtgacctgcgttcacctatagatcgacctcgatatccagacatcgtgataggaacggtagaatagtcaggacgccatatagtatagaccatattatctacgtcgtattggagtaaaatgtttttagataaattatagttcgagaaccacactatatatgtagttatttgtccacaagctgacaaaaaaaatactatcaccgatacattttctattttataattttacatatgtacccatggtttagacaaaagcttttaaaaccactgaatttttgaaaaaaaaacatattcaagtacacatgcctttcccttttataaaaaaagtagaaatgtcttttttttaacaaaaataccatcatcaccgtattattattaggcaaaatttgctacaggacactcaaaaatcatgtaattagctgagagacaccgcaaaaacgtgacactgctcatagacactatcaaagttgtgcaattggccgtaggacaccggacgtattattttattatttccagactgaaagtggtgagtttttttttcaaaataaccggagtgcccctgcgcctcaccatctatcctagacttgggtccccggtcgaaccaaacccggtcggattcgtcacctggtgttggcgggcggatgagcaccctgggcacaacaccggcaaggcgagcggagctccacatgtaagcccctctctccctctttgtttctagatggggcagcggagcggtgactcgtcgtgccggccctggcccttgcacacgaccgtgcagcgtcgtccctgccgaggcatcgcaccagcccgtgcctcgccgtgccggcgccggcgctctcttcctcaggcttgcttgaagaaatagcagagagagagagaatgagggagagaaaataaaagaggagaaattccctttccacaatcatcaaagaaccgtgttgaatcaaacactacaatagtgcaattccttcaaatccaccacaaattcagagaggaattaaatcacaaactcaaccagaggaacaaacaaatcaatcgtgtaatcactagcaaagctaggcacagccatggggatgcccacgacaaggttagcactagtagttcttgtcggcagtggcaagcttgcacttgaccttccggaacaccaccgccggcggcgcaagctgcagcttgagcgggcacgtcgcgggagtttgcacttggtgtagtgcgcctggtacctgacctcgccggagactgtcacctccaccttggattttgccttttcaaaatccagtatcctgtgtcccctagccaagataggttgtaagtatactgtatttgtttttgattttttttctagtaatcatgtgatacttgacataaatcagatgcaattaccatttttttcacactgtttttttctattctgttccaatgtagtcatgactgaggtttctgccttttgaggatgcttgagtgtcacaacggcaggactcttgttggatacaacacggtattttattcctttgtttgacattttttaatttttttcaccctatacatacattttttctgcttctaaaagctgactgtttgtatgtttctctttctcagaaggacaagcgacaataccgtgcgatgatttgccacaggctgttgtaccaccgcttcaatgatctacaccctcatcgcgtcatttgaagaactgttttttttttatcctttgttgtttgggggcaaaagtgccaagatgtaatgccaggtcgtagactcttttgtataggttccctcactgatcttgatacagtttgcactaaaactaaagcagtgtgttttgtagactgacactccctagccaaatagtatcattttgtagtttgcactaatacatgtgattttcaacttactaactcatatattgcttcgaaaaggtatctttttcatccaacttgatgttctagatcagcaacccttcttttaaaaaaaaattcaactatgatgcctatgatgtttttgccaataagtcaccatgctgtgccatttaccaggtacttaccacactggtatcagcatggtattcttttttagctaatcatttagcatgctaccatactggtaccaggtatcagcctggtaccatactagtattaggtaacaggtaccatactattaccagggtaacaccctggtatcaggtccatactggtgtaccctggtatcaggtaccaggtactaggtatcagcctggtaccatactactagtaccaggtaccaggtaccatactggtaccagggtatcaccctggtatcaggtaccaggtaccatactggtaccagggtatcaccttggtacctttttttacaccaggcacctgcatggtaccatattggtatcaggtaccaggtaccatactggtaccagggtatcccattttgtaccaggaaccagcatgcctttttttatcaggcagagcatattgctggtacctggtactagctagatgaaaccagggtgtaccaggtatcctttttagttagaaaaatatttttttggctcatagcacaaattcatatgcataactgcaacatgtcataacacaatgtacttatgttatagcacaaatattcataaacgcaacatatcagaacacaagtacacttttgtgcccacattcatcacagtgataacataattttcttagccacaccacaacaaagtatatcaaatattacaataccattgtttttttaaaagtagaagcataggaatgtttcattttttttgaagaatcacatgaactgtggggttttaccacctggtgggatcatcacaatcctgcatataaaaagaggacagtaccaaaatcatcaatcttcttctctttttttttggcgatgcaaacatgaataaaaattgactattttttgttacctcatattagcacgcagagccttgattgctagatgatatcttttcatggctcaccaaacagctggtatcatcaagttttttcttcttagaacttgctgctatcacttggctttttctttttacggcctgtcgaactgctatcttatccctttgaaattttttgcaggcacaactgtaggtttcattgtttatgtcataatgaaccaagaatttcttgttgtcatcatccaaaattagctgcacaaaatatgatccaggttccggcccatttattgttttgtatttggtagctctgtatagcatttcttgaaactcctcaaacattgcacgtgtatagaactttgagtcttgttcttccattggatagccagaccacatttttgggtctgtttggactgttataaaccgctgattgtcattcctgtcaagacaagattgggcaagtttctcatattggaagatgaaattcctgattgaatcagctgggtggacaaaatctttgaataatttgttcatgctctcactcctttgggaggtgctcatgaatgggaagaagtaatccatgaaaaaacaggggacccactttttcctgttatcatagaggtgttgcatatacttgttcccacacaactcatgtctatcaatcattgcatcccaacttgcatcaaattcttcttcgttcaaagaattatcaatgcatgacttcaagtctgtttcaaacccttccttgccgtttaacagcacaccaaggttagtactagcattcctatgcacatgccacatacagcgcctatgaatagttcttggcagcacttttgcaattgcaatctccattgttttgtcctgatcagtcatgatgcattgtggctcttttccatccattgctttcaagaatgtttcaaacacccattcaaaagtttcaaccttttcatttttcaggaatacacacccaaataggacagtctggccatggttgcttaccccgattatcggagcaaatgggaggttatacttatttgtgcagtatgttgtgtcgaagacgatacaatcaccaaatttcttgtatgcttcttttgaggcaccatccacccaaaataagctaccaaccgtattatccgagtccagttccatgctatagaaaaacgatggatcttctgcttgcaattcctggaagtacttgatggtttcagccatgtctccgtttgcagtagtccgttttctcatcgatgtcctcagattgctaacatctttctttgtgaatggtatgttacgcatggtaccatacaaatcagacaggacagacatgattcttctagtggggatgttgttgttgtgcagtaattctattagctcatagtcttcatccgacacgttacggtgtgattctaggaaccttagagaattggggctcaaaggaggatgattgtgatctaagtctactattgtcaccacccacttttcagcccttttaacgaccaccattctcgccttacaatcagttttccgtatgctgttgcacttcctggatctgcttccaatacttgattttgcattctgctccttacttgtgcgttcagaatagcaagcgaactcatatctgttgtaatctttggtgacattgcttcttttgcaactcgaaacctttctaccgaaacctcaattttttgcatacctattgtagtacacgcgtgcctctttgtctgaaaagaactccataccaacaaatggtaccacaggttgtgattggacaccctccatttcagatccttcagttgtagttgctggttctatttcaagtccatccccagcatcaacttgcaaaatactcgtgggtcctgccactattccagctttaagcagtgctgccctcagaacttcagcatctatatccttctcacccacacttgtagcctgctcattcacacttgtttcagcctccatttcagatcctccagttcaatttactggttctatttcaaatccatccccagcatcaacttgcaaaatacttgtgggtcctgtgactattccagcttcaagcagtgctgccctcagaacttcagcatctctcacccacacttgtagcctgctcattcacacttgtttcagcagaaacacaagccccagcacccatgttttgaagatcttccattcttctttcaatagaactaactgacgaactcatacttttttccactcccccttcacattttgatagtgcaaaacaaaaaaaaaacattaaattctatacggctcaaattagacaaacataccattatcaggttagtaccaattttcatcaaacttttttcagttctacaatcagaagtaccagattactaaaaaataattatcagcctttttgcaagagcacaaacattgataaatgagcacaaaacataagtgtaagattaccatggacaatattaccagttttcttttttcaccagttttgatacaaatttagcatttctacttacagaagtatcaggtatcaagttttaaaacatctatctagtataaggtatccagttttaaaacatctagtatcaagtatcaagtttcaaaacatctagtactaggtatcaagtttcaaaacatctagtattaggtatcaagtttagatgaaaatacctatcaacgccgaggagtgttctggttgtggtcagcgccgatgaggtattgcccgtgcaagccgaggatgtagttggcgtcgctgacgaggtatcgcgcgtggtagcgcgcgatgccgaggatgtttttggtgtcgtcgacgaggttgccggccgtcgccgacgaggtggcgcgcgataccgaggaggatcttggtgtcgccgacgaggtatcgtgcgcgcgatgccgaggaagatctgggtgtcgccgacgatgttgcgggccgtggccgacgaagatctgggtgtcaccgacgaggtagcgcgcgatactgaggaggatctgggtgtcaccgatgccgacgaggtatcacgcgctccgcgcgcgatgccgacgaggatctgggtgtcgccgacgaggttgccggccgtcgctgacaaggatttgggtgtcgccgatgccgacgaggtatcgcgcgcgatgccgaggaggaacctggttttgcgccttgatttttggatctgggatatttaggacatatcaccgtaaatcgcggggaccgaatcgtaactaccatattaatgttgtctccttcgaacagcattccgttttgtagcgtctctcttttgatattgaagttgaaggtaagtctataaccgtttgttacccgaattggggcgcaaaaccgctccacataaaaggctccctcctaatagatgaagaataaatatggtagagaaaagagatgatgtatttattaatggcccactttaagaaaccatgggttgtaaaatatagtttttattgtgatgtcttattgacatggcatcatagacattacttatgaacactatgaattaagactgccctcatgcatcatcaacagcagcagcaaaaacagcgcgattttgctatatctcactcgaaagattttttcttatctctcactcgattttctcactcaaatttacagtgcattttcttataaattacagtgtaatttatgaaacttacactgtaacttttgtaagttacactgtaatttttgaatcttcgcatgtaaattttaaattttgtattggatttggtctttttcttgaggatatggtaatttagtgtccattatggtgtttcttaattgctttttgctttttattatatctatcggattttaattcaaagattaaaaatatgtgtgatacaatcataaaaatctttcgaaagatgtataggtactcccaaacagcgcgcacttcaagggggagagcccagctgacgtggcgtcacccagccactgacgtgtgggcccccaccccaccgcttttataacctcgccgcctcgcctcctcctctctatcttctcgctcgcctctccctctcgctgtctctcactcgcactcgcctcgctgccgccgccgccgctgcggcgcctctctcgccggcggggaggggaggtgaggtgagtgagcccgattccgcggcctcgtgagccgagcccacgtattgtcgcgtcaattttcggctgattttttccctttttttttgttgtgattctcaaggtttttcttaggtgtacggatttgatggcggtggcgtcgcggctcgcggtggcgcgggtggcgccggacgggggagcggcggggaggaggaggaggaggagggggcggccggtggtcgcggtcccgacggcggcggggagggggagggggcgaggcggggccgtggcagcgagcccaccgacggaggaggcggtgcagatgacggagccgctcaccaaggaggacctcatggcctacctcgtctccgggtgcaagcccaaggagaactggaggtgaggagaggagattcccttgtgtttgttttttttttctttttgcgaaattggatagcttgtcactgcttcactagtggtagtggtaggtagttttttcctctacaaaaactaggggttggtagaatggttcgcatggagacatcattatcgtatcgggttcgatggaaatgtggaattggagaatttcctattggcatagcctaactcgctgctttagctacgcaattgcagttttagttataaatcgattgatttcgggctttctattgatgactgatgaactggtttatatggctctagtactctaatgttgtgcagacaaactgtttagtcttatgcgttgttaatgcaactgtttgatcatttttttattggtaattttagctgtgattgttatttctacctgatctgctagcaccattcgttgggcatgaaagttctgctggtgcctgcattcagtttttgtggcattggcaatgtcatcttgtttgttcaatttactcccgctttgtttgatatggagtattccagttagttattttggttatgccataaataaatttctgatttcacagaattggcacagaacatgagaagttcggttttgaagttgatacattgcgtcctataaagtacgatcagatccgtgacatcctgaatggacttgctgagagatttgattgggacaagatagttgaagaaaataatgttatcggtctcaagcaggtagtattctgctcttatttcccctataataccaccttacatgacttagaccaacaattaacgtggagaaaatttccatgtgcttcactggagtgccgtaattaactctaatggaaaaacaaacaaaaacattacagtttgttctgacaattttagtttgttccttaattcgaggtacttgtatatggttgcagggaaagcaaagcatttcactagaacctggtggtcagtttgaacttagtggtgctcctcttgaaacattacatcaaacttgtgctgaggtcaattcacatctttaccaggtaatgcgcactgcatccctgtattaacttcttgctttatgtgattttcagttatgatttgtgcattgccatgccatatatatcttcagtccgaaagtttttttttttgccagcagttgatccaatccgaaacgtctattcttgtaggtcaaagcagttggagaggaaatggggattggatttctcggaattggttttcagccaaagtgggcactgagtgacataccaataatgcccaaggtagttttggccttagaccttgtaaagctttagtttttgtatgaattcagtgtcgcgtacatatttaacttaacttacaagaagggttcctataaattttaatgcttcagttttttttctttatagggaaggtacgaaattatgaggaattacatgcctaaagttggctctcttgggcttgatatgatgttccgaacatgcactgttcaggtgagtgtaattatatgttcatgtactaattttggaattccatcttaaagaaacttgaaaacttattgttacttctctaaacaactttacttacttgagtcatgaaggttaatcttgacttcagttcagagcaagatatgataaggaaattccgcactggtcttgcattacagcctgtgggtacttttgttatcttccctgatcatttactttgccctctctcacatgaacctggtttattcatttaatggattgttgccatttaacagattgcaacagcaatatttgctaattctcccttcaaagaaggaaaaccaaatgggtatcttagcttaagaaggtgattgctttattgcttttaaaagtacattgttttgttgtatgaagttgccaacatcattcatgatctgcagccatatttggactgatactgacaacaaccgctcagggatgcttccttttgtgttcgatgactcatttgggttagtatatataatttcataccattcgaccctcttcccccacccagaacactggcaatttgattgaagacctcattttggccaaagatattttacacatgaaatgaaggtttccatgttactgaaattctgattatagtttgtttctttgatgcaggtttgagcgatatgtggactatgcattagatgtcccgatgtattttgtctatcgaaataagaagtacattgactgtactggaatgtcatttcgggtctcttcctgtttgtgttaccttagtgcttgttctgttatatgcagtagagctttggctatagaatacagaacttggttattaactagactaacttgatttatatttgttttgcaggattttatggtaggaaaactcccacaagctcccggggagctgcctactttgaatgactgggagaaccatctaacaacgatatttcctgaggtttgcccttaaatttgtatagctgatcatcatggcatgttgacactgtaagcttaatgtaataactatttgttcttttgtatttggcttgcaggtcaggctgaagcgatatctagagatgagaggtgctgatggtggcccatggaggagattgtgtgctttgccagcattttgggttcgttagcttactcctttgcacttcttttgtatttctgtacactttgcagtgtggtcttggtgtcaagtagaagtaaacacaaagagtttggacatgggtactgtagtaatttatatcttccatgttctataggaagaattttgaaccagttttggaattggtacttgtatacaggttgggctgttgtatgatgaggaatcactgcaaagtatttcggacatgacctctgattggacaaatgaagaaagagaaatgctaaggcgaaaggtatcttgagttatttgtgctctctgtccctgccaagttatataatatactgttgatccataaataaacttttgttttgccttacaatcacaccagttttaacagaattatacaatcttttttgtcagaataatttgtaaattagcaaagtaacccaggttcggaagttacaacatgctactagagtcacctcggccttactgtatttaatttgattaggtacctgtaaccggtttgaagacacccttccgggatggatatgtaagagatctagctgaagaaattctgcagttgtccaaggttatttactttcttgaatgtacattcttttataacacggagtgcatgcagattatatctgcctgtctgtaatgctcctttttttgttattccagaatggattagaaagaagagggtacaaggaggttggtttcttaagagaggttgatgcagtgatcagttcaggtgaagatttcaacattccagcatctcttttcattgatgatgatataaacattttcatggttttgctgggctctagataataaaaatgaagagtttaactctgttttcagacaataattcgtagcctactttgttgcaggagtgaccccagctgagaggctgctcaatttgtacgagacgaagtggcaacgcagcgtcgatcctgtcttccaggagttgttatactgatgctgagaaacctcttacacagcaaaactggacagtctgtagatgtactccccccatacagaaaaaaaactcatgtccattctattccatgcctcggcagctaatgtccgccgtccgttttttcttgagcctgaagagggaaaaataaccgccgtgcagcaattcagcttcacggactcaattgtttctgcctcctggaacatttgagttcggaagcctttgtaggtgctgtctttgttggggccttttacaacttccgatttccctcgtcaacagggagatgggacaaaccactgtttgtaccagaccctcttttgttcctgatgatttttgtatgaaaaataagcccatctggtgcatgatggaaactatatatatatggttccagaaaatgttggaataagtatttgacaagcacgtggagttagttcatccagctaaaagaaatatcttgcagatgtaatggctggtgtatttggtggtctccatgaaagtgcctttttattcggtacttatatgacttgactggttgtttcctgctgccttccttttggacctttctatcaatctatatatgctatcctgataggtactcaccctgtcattttgttatatgacaagtaatcagatattactgcatggttttcctttgttttatctctcttagatcacatggctcttcttattattccctgtgcctatgcccatcttctatttatttttcatcaacaagctggtgaatgatgctgcataaacgaaatttcgtcgtcgtcgtctcaagaacatgatcaagtttgtgcattgttaatgtataagcaaaaaacaaacgtgtgcggcgtgcatgctctctgtccctagtcttctgaccaagcccgtcttcctgtcctgaaagcacgcacgccaccacccaccaccaaccaccaaccttggtttggaacatttcccttactcgcacctactccctctcacttacatgtgggacccataagcaagaggaacatatgtgttgtaaagaaacgggccaagatgtgcttaatcttatcatagtgttttactggaaataaatacgcttccaaaaaaataagtgcgtgtaaagaaagataccaatgctactagctagacattaaagacaaaaaggataatccccgcaaaaaaaaagacaaaaaggataatgaaaagcatataataatttctccatcgaaacatactatcagtagtgtctatatcatccacggcatcttaaaaactagagtgcacacggcaacactaactgctattcctttcgtcctaaaataaatataattttactaaaataaatgtaattttatattatttatgtccaacgtttgaccgtttgttttatttgaaatttttttatgattagtatttttattgttattagtagatgataaaacatgaaaaaaaatattttatgtgtcactattttttttatttttttataaacttttcaaataagacggacggtcaaatgttattattttgggatggaggtagtaactctcttatatcatgtcttatgtcttatctgtagcatccgagttaaatctttgcatatttcgcatgtattctcttcatattaactcaagtgatacatcaactatccgtggagaagatagggagggggtgagcaggggtctcgatcgcctcccctaagcccctaaaactacactacatttgttgtagtttttgtaagatttaaaaagataagtatcgtggatcctctccatcaaataaagtttgtgttttttgtttcgccactatcaacaatttatctacgtgacacaattagaagtgtaagtgacaaacccgcgaaactcacttatcgactaaaataaaccacgagtccgtttatcttgacctataaatagattcacggctgacccacttacacccttagacacaacagtaaagtcgttgaactctatcctagttgaagtcacatgataggcctatgatgccccatatttcagccttatccatatcatcaaaatcctacacatcaatctggtagaaagtattggttcctcgagaaaaagacaactgctcaaaaaaaatgatactgtcactgtttggtatttgataaattctgactataagttcttaatcttttattaataactcttgaaatgatataattatacaacattagacgtataaaagaaactcaaactaccgctatatatagagagatattcactctaatttaatactccctccatccatttcaggttataagacattttttacttttgtcaaagtcaaactatttcaagtttgactaagtttatagacaaatatagtaatatttataatattaagttactttcatcaaatcaataattgaatatattttcataataaatttatcttgagttgaaaatgttgctactttttttctataaacttggtcaaacttaaagcagtttgactttgaccaaagtcaaaacgtcttataacctggaacggagggagtattaaattttagccatcatatttattctcactaattaaaacgttgccagcaaaactatcagcttattgaaacaaaggacacagaaaagacgccgctgatgtggtgctggaaacgtgggtgcatgccaccaagatttaaaaactaaatttcacgaatattacatcatttttttcatctcttttaacatgtgttagaaaatacatttgtaagtatgtaagtttggtgttacacgtacagtggtggtataacaacgaaaaaaaaaacacctcttaacaccttttgtttgatccaaagcgtgataggcgatagccgcctccacacaaacaatcacgaggagcagagcaggcagccgattcgacacctaacccccaattccaatcccgtatttaatccctccaattcccaaatcatccaagcccgattccacccaaaccctcctctcatcgcccgccatgaaatcgctccaatcgttcctcgcacctcaacccgacggccaccgccgccgcccttgacggcatcggcatcggcggcgcgcgcctccgtccgtcgcgcgtcaccgcgtgcctcgccacgcccacgcccacgccgccgcccccgacctccgcgcccctcgcccccgccgcggccgcgcaccgcgagctgtccgccgcgagccgcgccgtggtggaggacgaggcgaggtacatcgtcgggacgtacaaccgctcccgcgtcgtcctcgtcgccggccgcggctgcaagctgtacgacgccgacgggcgcgagtacctcgacatggccgccggcatcgccgtcaacgcggtcggccacgccgaccccgactgggtcgccgccgtctccgcccaggccgccaccttcgtccacgccagcaacgtccagtacaccgtcccccaggccagtctcgaacgcgtcacgcccaccgctcaccacgtgttcgacgcattgcccaaccctctcgtcacgccaagctcaccgtgatcatttctttttccgcgtgcatgtggcgctcgccaagcgcctcgtggaggcctccttcgcggaccgcgtcttcttcgccaacaccggcacggaggccaacgaggccgccatcaagttcgccaggaagtaccagagggtggcgcgccccgacggggacgcgcccaccgagttcatgtcgttcaccaactgcttccatggcaggacaatggggtcgctcgcgctcaccagcaaggtgcagtaccgggagccgttcgcgccggtgatgcccggcgcgacgttcgccgagtacgggaacctagaggaggccaagaaggtgattcagtccggcaaaattgctgccgtgttcgtcgagcccatgcagggcgagggtgggatccatagtgccaccaaggagttcttgcaggggctgcgggatgcttgcgatgaggctggagctctcttggtttttgatgaggtatgaaacatatttcttctattactccttatgtttagtatgttgtgggttggtgttgattgagtaatcaatgctaatctcacaagttgaatccaaatatatataaaactattggtaaccactacacaatttgtattaaaacagagggaattgtacaaagtaaaagttgtttacatgcatttagtttagaccagagatcacactccataggaaccttcattttcatacttattcaaatcagtgcaaatgtccaaagctgccgatcatcaatgaacagttctgaaattctatgtctctgttgcattcagaaagggggcgctgatctaatctaacactcctgttacatggttactaaacacaggtgcaatgtggtctgggacgcactggttacctctgggcgtatgaagcctatggagtagtacctgacattatgaccttggcaaagccattggcgggtggtctccccatcggtgtagtcttggtcaccgagaaggttgcttcagcgataaactacggcgaccatggtaccacattcgggggaggccctcttgtttgccaggctgcattgaccacattggacaagatccagaaacctggcttcctagcagaggtggccaagaaaggagagaacttcaagcagcttctcagtaccaagctgagtggaaacgcccatgtgaaagagatccgggggatcggtctcatcgtcggcatcgagctcgatgttccagcgggtcctttggtcgatgcatgcttggaccgcggtgtcatagtgctgacagccgggaaaggcaatgttgtgaggcaatgttgctgattttttacagagtgaaatatatctcatcttcctgctttgctccttcatcattttgtgctggtacaagagtacttgtagcgtgttcggatcctcttagtgtccagcgatcacacatatatttttctggtccacatacacattcaattgtgtcatcacttttaaaacatgtccacacagtatcttatccctttgaaattttttgcaggcacaactgtaggtttcattgtttatgtcataatgaaccaagaatttcttgttgtcatcatccaaaattagctgcacaaaatatgatccaggttccggcccatttattgttttgtatttggtagctctgtatagcatttcttgaaactcctcaaacattgcacgtgtatagaactttgagtcttgttcttccattggatagccagaccacatttttgggtctgtttggactgttataaaccgctgattgtcatccctgtcaagacaagattgggcaagtttctcatattggaagatgaaattcctgattgaatcagctgggtggacaaaatctttgaataatttgttcatgctctcactcctttgggaggtgctcatgaatgggaagaagtaatccatgaaaaaacaggggacccactttttcctgttatcatagaggtgttgcatatacttgttcccacacaactcatgtctatcaatcattgcatcccaacttgcatcaaattcttcttcgttcaaagaattatcaatgcatgacttcaagtctgtttcaaacccttccttgccgtttaacagcacaccaaggttagtactagcattcctatgcacatgccacatacagcgcctatgaatagttcttggcagcacttttgcaattgcaatctccattgttttgtcctgatcagtcatgatgcattgtggctcttttccatccattgctttcaagaatgtttcaaacacccattcaaaagtttcaaccttttcatttttcaggaatacacacccaaataggacagtctggccatggttgcttaccccgattatcggagcaaatgggaggttatacttatttgtgcagtatgttgtgtcgaagacgatacaatcaccaaatttcttgtatgcttcttttgaggcaccatccacccaaaataagctaccaaccgtattatccgagtccagttccatgctatagaaaaacgatggatcttctgcttgcaattcctggaagtacttgatggtttcagccatgtctccgtttgcagtagtccgttttctcatcgatgtcctcagattgctaacatctttctttgtgaatggtatgttacgcatggtaccatacaaatcagacaggacagacatgattcttctagtggggatgttgttgttgtgccgtaattctattagctcatagtcttcatccgacacgttacggtgtgattctaggaaccttagagaattggggctcaaaggaggatgattgtgatctaagtctactattgtcaccacccacttttcagcccttttaacgaccaccattctcgccttacaatcagttttccgtatgctgttgcacttcctggatctgcttccaatacttgattttgcattctgctccttacttgtgcgttcagaatagcaagcgaactcatatctgttgtaatctttggtgacattgcttcttttgcaactcgaaacctttctaccgaaacctcaattttttgcatacctattgtagtacacgcgtgcctctttgtctgaaaagaactccataccaacaaatggtaccacaggttgtgattggacaccctccatttcagatccttcagttgtagttgctggttctatttcaagtccatccccagcatcaacttgcaaaatactcgtgggtcctgccactattccagctttaagcagtgctgccctcagaacttcagcatctatatccttctcacccacacttgtagcctgctcattcacacttgtttcagcctccatttcagatcctccagttcgatttactggttctatttcaaatccatccccagcatcaacttgcaaaatacttgtgggtcctgtgactattccagcttcaagcagtgctgtcctcagaacttcagcatctctcacccacacttgtagcctgctcattcacacttgtttcagcagaaacacaagccccagcacccatgttttgaagatcttccattcttctttcaatagaactaactgacgaactcatacttttttccactcccccttcacattttgatagtgcaaaacaaaaaaaaacattaaattctgtacggctcaaattagacaaacataccattatcaggttagtaccaattttcatcaaacttttttcagttctacaatcagaagtaccagattactaaaaaataattatcagcctttttgcaagagcacaaacattgataaatgagcacaaaacataagtgtaagattaccatggacaatattaccagttttcttttttcaccaattttgatacaaatttagcatttctacttacagaagtatcaggtatcaagttttaaaacatctatctagtataaggtatccagttttaaaacatctagtatcaagtatcaagtttcaaaacatctagtactaggtatcaagtttcaaaacatctagtattaggtatcaagtttagatgaaaatacctatcaacgccgaggagtgttctggttgtggtcagcgccgatgaggtattgcccgtgcaagccgaggatatagttggcgtcgccgacgaggtatcgcgcgtggtagtgcgcgatgccgaggatgtttttggtgtcgtcgacgaggttgccggccgtcgccgacgaggtatcgcgtgcggtggcgcgcgataccgaggaggatctgggtgtcgccgacgaggtatcgtgcacgcgatgccgaggaagatctgggtgtcgccgacgatgttgcgggccgtggccgacgaagatctgggtgtcaccgacaccgacgaggtatcacgcgctccgcgcgcgatgccgacgaggatctgggtgtcgccaatgaggttgccagccgtcgccgacgaggatctggtgtcgccgacgccgacgaggtatcgcgcgcgatgccgaggaggaacctggttttgcaccttgatttttggatctgggatatttaggacatatcaccgtaaatcgcagggaccgaatcgtaactaccatattaatgttgtcccgttcgaacagcattccgttttgtagcgtctctcttttgatttttgatattgaagttgaaggtaagtctatgaccgtttgttacccggatcggggcgcaaaaccgctccacatagaaggctccctccttcctcctccctcctcgtgtggcgtcgcttcccctatccccgctctctactttatccagggcctttcccctgcttacctccaccccaccatcccccgccgccgccgccgccgccccagattcctctcgcggagacctcagcctcagccctcaggggcgcggccggtttagggtttccccccgccgcagaactgggtgccgaggctcccgcgccgccgccgctgccgccgccaccgacgacgagggaggaggagaggcttagccctctcccgcagcgaccgcgaggtacgtgtacgcgcgttccgcggcatctggtcctggcctcctagatccgatggatggaaggatgggtggggtgggtgggtgggtggtttgggacttgggagtagacgcgttagggatcgatgcggtcggtttgccctcggggggagcggtagggttctcgtccgttcctgttgcgttcgtgatggaacccttggagaatcgtgtagaggggggttggggggaggaatactccatgaatttggttataattcgataatggtagcagctaattgttgtggttccgtgtatttcttgaacaaacactaggcacggattgcggttcatattgactttatgttgctccggatttcgtagtgctggcacttttgggagagcacatttattgtggggattcacccttgctggccgctgttgtgtcaataggccctctcaacttaaggacaaagtttaaactttgatggccctagatttgttgacactttgattggctgcaacctatagtttgttttaacatggaagtgatatggaaagtaggagaactactgacaatgacatttggctgtgatgaatacttgagtcgcagatatatgagaagttatgaatttaaattaggcacacctgttagcaatgccagccaaatgacacgatggattgggttaaaacctttgggtatcttaactttgtaggaacagtttgttcagatactagcagcctgcagccatattagttatcttaaattttaaaatttgattttctttggtgtaaaatctggtcaatttttattagacagttattatactcatcacggggtcaatacacacaaacttatcttaacttttagcgttcgttggaattacatgactgctcatttggacagtcacaatcttatttatgaaataatttacattactgacaaatatccttcgtgattctatatattgatttggtatttttccttcaaagtggcacttttcttatgtaattgcattcttaaattttaattgtgatataaagtactatttatgcaaaatagaaaattgaaatgctaaaatggattatgaattgctacgactcgtgaatactaaacagtaagatgtaaaatttagttttcttttgatgctgtcatgtttatccaaaaaaggtgtttaaggtatatgagggaggaacaaggctgcagagggcttgcagtggttgcttaacttggggaacttgcgatcacctcagttaactctctgtgggtggccgggtgcctggaggccgtgtggtgtcacccagacaacattgcatgataatcgtcttccttgtaggatgtcttgttgcttgggtgtgtcaaacttgctgtaacaagctttgggtggtcgggaagctttttttttcttactttcttacatcatctttctgtctttaactggtatacctaggtccacagttaagttgactgaaaaatctatatatattttttcctgttaccaattgtctttgagctaccaaccaaaccaaattattgtacatttcaggtgcagcctgtttttcattgacatgggacatacattagtgtagaggcaatattagagtcatatattggtaaaaagatttacaacctccattttatgatcagatgacctgcagaatggcagcaggcaagcaaaagaaacgtataataaggtctactaactcagatcaaaacaggacatggaagaagtcaaaagttgagtcttctaattgccatataagtttgaagtctcaaattgctcttaaatgggatgactatcaaaagagagtggttccccaaaaggaacaagttgggattttgtggtcagacttggcaccattcatagattccagacagaagcatgattcagggctggctgatgttacatatattcctccagagacattttccttggagaacttgagaagtgtgctgtcctataaggtgtgattagtttatcctttgtatgtaagctttgttcttttgccatctatttttcacaatgcctgccttttcgtgctaaagctttaattgctttagaataatgatcttgatatcttgatgccccattacaggggtatactcttattacatattaatattgacaattgtgaattgattataggtttgggatacatgtctgacagaagctgacagaaagtttctcatacagtttcttccaactgagattgatgcagaagaaaatgttcatttattgcttaaaggccaaaattatcactttggaaatccttccctcagctggcaagttctctatgatgtgatttctgtgatcacttccatttgcacttctagacattttagctgcattttttattgcgttctagtacaattttagaaattgcctctgtaggggcctacttgtttcatcttcattctagtgtatgttcaaaaaatatcaataaggtttgaaacaggtggatatatgcttttcctcgtagaactcctttttgccttgcatagatgtggcgtgattctccatttgaatattttattttattttgtttggcatattctcatgggaacaagttaggtatgttttacatccatcatagaagtcatgcagtttgtcccttattcattttgtgtttttgttgaacatataattgtttgtcctgctaaagctggggcttgggatgtgttgctccagctcacatgccaactctctttctaagtgttacgtaaatgtgatcagctttctaaaatattctacctggtatttatgtacgccgaacaattactagctccaatatgaatatatgattaatagaataatgcataagctaacataatgtcaaaatgtacttttgcatatcaaacaaaacctttaaattggatttcaagagctaccaaattgagggactatgactcattctggaaggctcatactaacaccaaaagccactgataccccagaatgttccctttacactcatcatattttgtaggcaatacatgttgatccacaccattaaaagtgatatagtgggctagttgctgacattagagttcatttttatcctatttcatgcataattcctattaggcatgtggttgcacacattgtctgtcacgtacatgaattacaatcgatagaccgttcatgcatgtgaacaatcactattttcccatttgatactgtatcagcagtattcagttgttattttagagatattattgagttgttatctatttccttagttttagagataagcatcccgtgggtcaactcatctataaatggggctggcatctctttctgtcaaacaaagacgaataaacaagtccctaaacagagccctggtcttccccagttctattacagattaatctagaatccctgcctcacatcaccgtccattctagttgaagttgtcaccaagcgacctccctccagcagatgtttactaccatgattgtccaaggatcatgaagtcctgtttatgatgcaggtgctaacagtaattttattatagtaacaaatgtaatgttcaaaaaatattacacactactaggatatacactctggagcatgagagaatatcgcatcagctaaatacagtaatttataccatacaataatacaagatttggtaggaataaggaacaaaagcacctaaattttgatcatgtataaactgaaatagaacaaagaaaaatacgtataagacaaagtcctcaagcgctctgagaggagtgctgaaatgagaaaaggacacattaccattaaaaattagtgcaaatgtattatagaaataaagcaataccaaggaaatcaaaataacaagaatattctggattcactgttttcatgtcctacctatgaccaatcctaaagtctttcatggagcaccacttcagcggcacgacttgacttgctggcaacagaagacgcaaaggagtgcagtgaaggctgcaacagtgagttgtttgggagacctggcctatcaggccctattgagtgaaagggagatgagaggagagctccactgggtccattaggcacagcaagtaataacatcctagcagtagaagtaatcgatatatgtagtaacaccatgatagaatagtcaactcaatgactagtcaatactagtctcctattcggtagatggtatctcgactcggctttacgatttagcaacaatgtttggatctaataatcttgtcttacctcgatgttttattttgactatgaagcaaagatccaattttttggagttgatcttgcaaaactagatatgggccgggttgaaattcttcaaatcaattatgtgaaagaaagcaaccaaacaggagattaggagctgcatcagtgtacattttggaaaaatagggaacaaggcgttgtcaacttttcgtaacttgcggcagaagcggaatgagagcaattattggcttgcacgggcctctactagtctcctggctaccgatacataactaactcgtggtgcacatgtgggcttgggtccggggcccaggacagtcgccctgacagccctgctccaggacaacgcctgcctgtttgttcagttgttcacaaatgatattgcactgcacttcttttgtcttttaaaattgttcactagacttctatacttctcaatttctgcaagatgttgattgctgattgaattattattaaattacaggtcctcctctctttgctatggtgatactcacccagatgccttacttaataaggagaagcaaattagagctgacgagaaggcatatcgtgttaacctgaataactaccattccaagtataccaaaccatccaattctgttataaatgtaccattttggctatgatatttatgctaagataattgtgcagcatggttgagtccttgaagaaatggaagaagagatggctaagttctgatgatccagaaataatgttcaggttatgcttcttaaattttttgatcttctatattctgtatcttgataaattactgtttctcatttccttttaaattccacttgcaaaattatcatctattcatccttctgttcttcaaatcatacattatattgccgttggactatcctttttcacatttgagtggtgttccaagtaacacgatcaatgtgtagttctaacatttcagtgctttaaaattgccaagtgccttagttttctggctaatcatatcgacatattcaattactgccgttgttgtgcattaaaatagcttagttttctaattgtataaacagtcatcaatgtttcttttaccaattgacttttttaaggaaaaaaaagacataatctgattaaatatttaagtagagagatgctatctaatttcaacaaaggacttctgaattgctaaaacctctatccgttatgtgtgtgcagggataataaccttgctaaacacaagcaaggagatacgcgaccaaaagttaccagtagtgaaatgcccttgaaggttgcacagagtagtgatgtttcgaagtttatgtcatatattgaggtaagatgttatgtgagccataatgaagtatttttgttcagcattggctatttgagcatctctctctctctctctctctctctctctctctctctctctcgggagagtattggagcttcattaagaaagaacaatgagctcagtcttgtatttgtgcacctctgtaatagccaaatggaaatcatgcaattagtttcagtgcccatcttaaaataaaaaaggagacatttagctgccaaacttgtatatattgctgaaactaaccttctatttgtatatttgctttctttgctcccaaagttttatttccttttcttctagttttgaggattatattacaaagcaaaattaaatgcttaatgaatgatatcagctctataataaaaatcttaaattgcttaattaccattatctcacatatataacccctttctcttatttagttcctaaattattgttatcttctttcccaattcttttgaagaattaatagtcttgttttactgtgtaacattaaccgcagctagagctgtgtaaatttgattacaaatttggatagatggcaatctaactgccaaattgtttctttagcataaaaagccaataatatttaatatataatattttgcagcagagcttttagaaagtatatttgatgattctttccagttaacgcatgtagctaatctaaacaattatatagttctgaatgttgactaatatttacagaaaataacagatatctaattttgaccaatcatatgtaatatactttactatatggaatatataattcgatgttctgtgatattaatgcttgtttaactttttcagatcagcagaacacagcacaaccttgttaagagcatgaagcagtctggtgatggcattaaaaccaagcatcttactcgtgtaattggtaaccttgataaattccatgtaaaaccatatggaacattaatagatgatgaacagaggagactgcgtgaacattggttagtaacattttaattttaacatttttatcttgtttttgggttcaagattcttatggtaaattatttgcatataggttgaacatatcctgcaatgatatacctgctgctttcgaggtccttaagaacaatagggtgacaacagagaaactgagaaatttacttggtcttgagctaggcgaaaagaatgtatctatcatgagaaaggttcgctgtgactaatcctttcaattcttgtttgaaagtcttttgattttccagatcaaggtattttacttgaatgtatgaaaaatatagtggatgatatcactttgttcctactactatgtgtcttgtatttttcatgtatcatatcatacacagcagcaaagttactattcgacatgatgttcattctaaaactctgttaccatgtgtataaaatactgatttgtaatggatctactgtggaagatctaaaaaattgtcattactgaagggaaattgctgtgcagtgttttcttactgatatgttgtagtaccttgtcattttctagagaaagttaacacaataacactcgattagttgtaggggttctacttatttatacggacataatttcctttgaaaagaaataattatttgagtactcaatagatgattatggtttatttatttttgtttatgatgagaaggcagaccagttagcaggcataacaaaagagcttggtcaacatggtgcctgcgaaaatgacggcagcactgatttgcaggatgctctggtagaacagttgtctgaagatatgttgcaaggtggtaatgatcattgcccatctcgtcaagattgtgatgatgatgaaaccaagcatattgaaacatctgctgaccatcatgatagtcagggtagggagaactctgatttgcaagcccaagattacaagggcaccagctgtgcagatagaagcatttcattctgtgccagcaacgtagaggagcagaatgaagatttcgtgaatacaaaattcagtaatgatggtccagatgttcaagctgaagatttcaaagaaataagctatacagatacaactattattgatcatagcccagagagacggcagatcaagactacctgttatacaaccgctcccattgacactcgtgagagccaaaatacacaagctcaaagtcttgagggcattacttacacagggccatcaatgcatgctcatgagcaaaatcagggcctgaaaggcaccagatacaaaattatgatagacaaaggccatagtgcaaatgatatttctttagtaaacagttatccagagatgaatgatgtaactatggattcgaaagaggttgagaatactacagtgataccatcaaacagttccacattgctttccaacacctcagggggacaaattcctgtggaagaacatctaaatggtcaagcagcaaaaggtgttaaagatttatgggagttgcctgaacctgatgattcctattaccttccactggagaatagtagcgtgtataatggttcaggtggcttacagattgggcatagacatctccctgctggacaacagggttctgtagtttgcatggagaatggtattttaagtcagcagcagtcacaagtcaccattgcggctgccttcccaatggacaatccagcgtcatttatgcaaccttgttcaaaccggcaaagcaatggtcaggtccagacagtagcaaatgacattggaatgcttccttactcccttgaacatacagattgcattgggcagtcaactgatttgcattctttggacaacaaccgattctctcagcccactcactttcccagtcccttgcaggagcaacagttggttgatcagagcaacagtgtcctttatgatgaacttcacaagaatttgtattctgatgtgagttttcaaactaaaggaaacaattctatccttgaacagcattctttcgcttcttctggttctatggatcatagatataaccgcttccctcaggagcaccagccacatgataattggcctgcaatggagtcaaataactgcttgccccaggcctttccagttggaagcagcaacacagatggaagcctcttcagtgctttggcccagtacagactaccgtcatcgtcgctacacatgcaatctggtaggtccagccctagccagctccttgaaataaggaaccaagttcctatgtctggaagttttgttcctagaactcaaggcacaaatcttcaagctcctagtatatatggttacacccagaatctgcccagtagttcaagcagtcatgtagcatctgtaggttctctgaataacatgcagtggacaaacctgatacaacagaatcctggaatgcccaacttaacgaacaggcaatttcgaggtccctggaccagataaatcctgagactttagaaataggttgatttaggtacaatcgaggtgcacaatgagaagtctaggtagggctggaacagaatgattctgggcaccaactaacatagtgtggttttgagctgttctaacgttgtggcttcagaatatctgtacatacatttctgctatgcctgtatgtatatatctgggcgtgctgggagtctgaaaagagttggaaactaaggattcccattttttgcagttgatccgtttattttgcctcaataatttcagtcccagattccatttagaggctgtctcaataatttgtttcaggtcttggcctctcagcaaaataaggtttctcaggggaatgtagtagttttctttagttgtgaacttgtgcttgataggtatcttgttgattcctaagatgtaatgacatgaggattcgatttttattcactctatttgaaatgagttctctaacttagccatattttattttactttactggaatgtttaactgattttggtttgtgcactagacaaggctaaccaatatgatggttcatatctgtaaaaacgacgatgtctgcatttattttttcttgcatgcgctatcttctcaatcgtcataagaaattcaattcaaaggtattgaaacacgtggaaccattcgtttgcaggctgattcttggaagtcgtatgtcccagcctctgacttcatggttcgtgttgatgcttagcaagctcaagctgtccacggcgacggtggaatgtgctattctggaacgcggtgccggaaacaaaattttgttgaaattctgtcaaagttaatttatcagaactactagctgcatgtacaaatagggggcagatgcacaattgacaaacaaagtgtgaaatgtgtaatagcaagtaaaggtatggatgtattttcataaaaaatttaataccgtcaacatgtccatatccatcctccagtccaaagtgggagtaaaatttggcttcttaaaaaaaagaaataaaaaaacctaaaaaacagagataaaattaatgttggatattaaaataggggtaagaatgaaattgcctctttagaaaaccgtgttcagactagccagactagcaattgaaggaccagtatactgagagctcggccaattcatccattctagacttctcctactgtggccaattcggccaattcatccgtttggtagccaccattgctgttgtgggagagccggctaccacttgaggagagacatcagtgacacatgtgggcactatttatcctcctagagacgatgttgtgatgccccgtctctcttccatgtcttcggtagaccctacaagtaaaaaaaaaatgttctatatgttcggggatagcgattacgatattctagatgtctcgatctatttaaaggcgttgtactggaggttccctattagtatagtgctcttgtggtggtgtcctcatcagattgggttcgcttggacgaatcacttatttacggctcagttacctgtgttgtcttccacattgattagacgttagtcggcggtgaaacgagtgaactttgatcgacataatcatcagccgatgatttcgaagattctacttcatgggctgatgatttcgaagattctacttttctgatttacgaaaaagaaggaatatatatagctctagtaagctattgggagaaataacagttatgcatactcacgctaactgaaatattccctatatactcctgaaatattcctcaatcccttttatactgtggggttttgctcattacattgtctatcttcgaattttagttttgatctttattagagagaatccattatataccactaagtttgtcacggctctacgatttgccactgactttatcacattctataaaatgccaccgacttttacttaacttctactatttaccatcactgtccgattagcctcctagcactatataattttgtccaaatgaccaaaatacccctaggaaaaaaacttccataatttggacaaaaattcaaaatatcatattagaaatataagattgtaaaaatccaaaattttgccaaaaacttaatatctgatatttcagaatttttgtccaaattttgaaagtttttatcatatgggtattttggtcatttggacaaaattgtacagtactaacgaaggctaaccggacgacaatggtaaatcgtagaagttaagccaaagttgatgatatattatagaacgtgacaaagtcagtggtaaattatggacttgtgataaactcggtggcatataatagattctctctttctctcttactcctttttcatcagttgatcttaagctgaccattcatttctatcaaaaagtccattttacattttggtataaagaaacatataaatttatgtagtatattgttatagggtagaaatttgttatatgataatattataattactagcttagagccaatgtattgtaacagaaaacaaattgagtctctaccttattaaatcaattaataagcacttatttagttcaggcaatactataattttctttattgaacaagtaggtgattttgaaatttggagagagccaataatgaaacgggagatgactcattgtaatataatataatataatataatagtatagattatggagcccacatgtcagtggtagcctggtaaggatggtgtggaaatggatattaccacaactaacattttaaatagtatatatgagtttattatgcgatatattatttatttgtagaaatgactaaactagtattatttatttgttattaaaaattatttatgtatcgtataaatagatttcttttacagcaaatatgttgtattaattttcataaaaaattatggtcaactaacaaaagagtatggaagtgatccaaagtatgcaatggaaagagtaaaacttacggaaataaaaaggatgggcaaagtttatacaatacactgtaattagttttccttaagttataagatgtaattttgtaatcattattcatttataaaattatgtcgtagtttttttaagtaaaagccaaaaaaaaattattatgtaaaaaaaatgtcaaaacgagaaaataacggtcaaacttaaccgagcaatgtctctaagaaaataacggtacctccctcttcctctccaacactcttgtcggatccaaaaaaacctcccaaagatccgctaagccgctatcccatcctaccgcgcgcgtgcgccatcgccatgtcatccttcgactccgtcgcggccgtcgccggcgacggcgacgccgacgacgacgacgtgctccctcccgctcccttcgaccccgccgccgacggcgcccagggcggcctcggcgccctgcgccgtggccaccgcttcgccacgtcctactcgtccttcggcaccgccgcctccgaggacgacctggctggcgccggcgccgggaccgacggcggcgtcggcgccggcattcccctgggctcgagctcgaacggcggcgccgcgtatgggtacggcgggtcgggggacgtgatgaatggccacgtggaccagatcggcgacgtcatgggtggcggcgtggtggtcggcgacggcggtggcatcgacgacgacctcttcgccggcgccggagacggcgacgacgggcccgtcctgccgccgcccgaggccatgaaggaggagggcatcctccggcgtgagtggcgccggtgagtgtgctccactccgatcatcccataatctcccaaaaagcatcaattcgcgcgcatttcttgatctgatctgccgcctcccccaaagcttgatcgaaaaagaaatcaagaaatcgatgggtttaattctgcagccaaaacgcgctgatgctggaggagaaggagcggaaggagagggagcggcgcggcgagatcatcgcggaagccgacgagttcaagcgatccttcgccgagaagcgcaagctcaacggcgacaccaaccgggctcagaacagagaccgggagaaggttggtcggtcaccatcttcttctccgccattgatgagctgcacatcatacaactcgtgaactatcagactgacccgccatcatcgccatggatggtgcagctgttcttggcgaagcaggagaagttccacggggaggcggagaagcagtactggaaggcgatcgcggagatggtgccgcacgagatcccggggctggagaagcggggcaagaggagggagaagcagtcggcggaggccaacgccaaggcgaagcagcccggcgtggtggtcgtccagggcaccaagcccggcaagcccaccgacctctcccggatgcgccaggtcctcatgaagctcaagcagaccccgccgccgcacatggcgcctcctccgccgcagccagcgaaggacaccggcggcgacacggacgccaacaaggacggcgaggcagagaaggcagctggagagattgagaagaaggcggccggaggcgagaaggaggccgcggctggtccgccggtgaccgccgcggcggcggcggatgcgcaggcgaacaaggcggcagccgaggagacggccaagaagtgatcggacaaggctgcattgatcgacagccaaattgctacggaattcgtggactctgataaaattcagaaacagctagtatcatgcatggttctctctctcttctatgttcatgttagaataagagatttaggcgtaagctgttcctttctcttttgcatttttcacaattttgcatcatttatatattgagtcgtagttaggtgtgaattattttctccgttgtaacgcacgggcactcagctagtcactgtatatgtgtgcagcgaataactcggttggttgtcagattatgagctgataatcttcagtgccaaaagcgttcctttggattcgtaactttgaaatttgctttgctagttgcacgtagtatctgcacgttaattttcttctggattctgtatacttgcagcagctggctggaagatacgatctgaagcgaatcagcccgctagtatatgcagtgcaaactctgctcacacatactgttttctctgttcttcagttatttgtagatgttcgacagagttaagagttgttcagttttgcatccacacagcgtgagcatgagtgcgttttaccgacggttatgtttcttttggtggaacctatccatttaggtcgagtcttcgacccagcgcaagtacttcgatttatatggttatactttctccatttcatattataagattttctagcattgctgaatatggcaggggcgaagctacaaccattcatagggataagttgactcgaacgatgttttgcgaacctctcctacccctctttattttaccatctatgaccccagcaaagagaaaaactagaccctagtgatattactgattgttctgtcaaagcccaattagtgactaggaacgatactaacaaacaacaaataaaaaattagctagcacttatgatttatacatcagcccaatatacatataggattgagatttgggtccaaaaataactccacaaattctcttgttgcgccatcatattccttcgagcactttgtcccgcaccagcgctgcacatcttgacatcttatatcattttttttctagcagaacgaaaggcaagaatcagtggttttgataatctttggttcatttggtgtcttttacaaattaataatgtatggtttctaacaaatttgtagtcatttcattttatcataatgtattgtcattattttgtcttgtattttgtatagtcttagatcattaattacaaactagatgacatttccgagttagtgttggattccaatgtagcgatacgatatttttcaccaaattttaataagttttgatatagttttgtcgtgaattctaaaaaacattcaaaatttcactcaaaatatacttttcgtcccacgtcgaaacatcaaattacatgatttttggttggttttggtcaaaaacgtaaaccctggttaatactgaccccggtgaccatttatcctggcttcgcccctggaatatgggcaatgctagaaagtcttataatataaaacggaggaagtactacgtacctaattattttttcaatggtatgccaagtgtcccatggcagcaagatgactatacgtgtacttcatttgaaggatgagggcagctaccgtacgggattccgttgcaacgcagtagtcatgggataattaacaaaaccaccccgacagatttaataccagacttcgtcgtttttccgaccaaggtcaactctgctcgattccccatctagaacccggctgatacgcaactactcagagcaaccccaaccagaaagcagctgcgcgcgatacctcgccagtggcgcagagggccgccgcaactactctgagcggccccagccagaacccagctcagtatcgcgcgcctctgcgcgcgataccttgccggcgacgctccgcgacgccacaactactccgagcaggagtgcttcttcctccgccccgtatcgaggccccgaaccctcgatacctcgccggcaccgccagcaactactccaagtagggactcccccaagccagaaccccgctcggtatcacgcgcggaggtgtgcgatacctcaccggtgacgctccgcgacgccgcaactactccgagcggccccagccagaacccagcacgcctcactccgagcaggagtgctccttcgtcctcccagataggtatcatcttctctagtttttgggcatgagttttttttctctagtttaggtattagcttgtctctagtgtaggtaccagcatgtctctattttttttcaagctataatggtttgtgttctgcctgtgtggggccaaaaaaattactgaaaaaaatgtgtgaattattcatgcagttgcagtttcagttaaaaaatggactcctcggttggatccgctggaagaatgatagaaaagatagcaaatgaagggagtgatttccttggtgaaagaagtatcaaagaacaacagagtggcaaggaagatgtctctgttgaaagagcgatggaacaagtatcaagtcatgatgatgatgcctgatactgaattgaaagcttctgaacaattgtgatgtatggtcagagaatgtcaaattttgttgcacttgagacttgaattttatctgatacttgtactgtgaggtgatcttggtaccttgttgtgagatgtacggagctggtcatgactgatacatgtagtgagctggtcatgactgtgtggtaccagtcatgatacctatagtgaccatgtgctgtaaagtatcaggtctggtgcctgggttaagacctggtaccttggtttttttgtgaggtaccagacctgatacttgggttgtttctaggcaccagaccctggtacctgtattgtgtgaggctggtacccctatcctgtgaggaaccatgtctggttcctaggttaagacttggtacccgggtttttttgtgaggtaccaggtctggtaccttggttgtttctaggcaccagaccctggtacctgtattgtattgtgtgaggctggtacccctatcctgtgaggaaccatgtatggttcctaggtttagacctggtacctgggttttatgtgaggtactaggtctggtaccttggttattgctaggcaccagaccctggtacctatatttgtgaggctggtacccctatcctgtgaggtgtcatgtctggttcctaggtttatacctgatacctgggttttctttgaggtaccaggtctggtacctagtttagacaaggtggtggtagcaggtaccatatgttccacagtaaccctaggttcagatgtggtacttggtactaggtaccaaaccccattgtgtgaggtaccaaggtaccatgtcatgataccttcactgggaggtaccaatcaaagcctccgatgcttgtaggtaccaaccccattt

SEQ ID NO: 62862 - DNA, 6747 bp, Oryza sativa
cagcagtaaggaagagcctgcacaagaagaatggaattcggaatggttttattgtgccaattgggcatggcggtagcgagggaggtggcaaacgagaagctgtttccactcgtgagtatccttaattttccttgaagctttgattctagtatttgattatcttagtgctataatgtgaaaaaggttgatcactatctttgtgaatgacacctaggttaggtagtatttgattgcacttagaaaaagtgcaggatataaggtagctctaatcttcttatagtgttgttgtttttgttatgtctgtgtctaggcaaagcatttgagtgttcacttagggtcgcaatagagcaagtgtagtgtggcggaggtaccgatagaacaggatataccttcagttgatttgtgcaaaactgatgatttgataaaataatatttgccccaacacaaggagcaaagttgggaactatttttcaatatagtatattttttctttggtaaatcccatgtacatgccctttgtagcagaaaactacgggttcacaaatttcacataactacatggagcttgatagtactattaagtattaacacaaaaacacattgtttgatacaggatttgtgaaatttgatattttctgtattataactctcaagtttttctaacaattatataatactttctcagccccattggtggtttcatgagcaaaatgtttttttttaagaaactgataacaattgtttggtgtactactttgtatttaaggctaatatttgtaaaggatgaatggagctaaataattgtctctgcaacatgctgatattttttttaactctaacatatctggttgttaaagtccacttggattttgtttgcaaccttgtagttcaaactgctaccttattccttataatcatgatctgtacaattctatcgattgatcagtaacttttgatggagttaatgaggaataatgttagaattttctttctgacttttgtgcttttagctacttgtaggtgcagacataagttgcatggccaattactagggactgtaaaactataaatttaacaaagagtgcattatatatattttgtctatggctaattttacaacaaagcgaagaaagagaacatgaaaagaagggaaacccaactgtgtaaaaacctgtgatcatgttttctaacaactaaaatcgctgtttatcaaccactcacgacgacaccgagatcttcgacttagctcccacaggtcccaggctcgtcaccccgggaactcgcagcccatcacaactactcatactaggagccacctagctagaatagaaggaagaatctcgtaaatctagactatgatagtgtactcaacttgcagttttccaacagtattaaccatttgttaaactgccttcatcagaggatctagattcgatcacacaacccaatcatatcgcaatacattattctgaggtaatacttaccaatcgatgtttggtttctttcagttgtgtcaatttacaggcatgactaagaacaaacttacagtagaattgctgctatttttgggattagttggttagtttttactatgtgcatgtataggctatttgcttgcacagacttttcagctgcatttcactaaatcaactaatattagtccaaaattactctttcaggtaagctggcaactttgagagtaaaacagacttcagggagctatttctctttcttttcctcatgtagttctgaggatcatcataactcacaaggtgccgtagaagtgaaaaatgtagtgaaagttgtttcaatccgtcctctttccaaggacaagtttttggtccttgattcagctggattgttacatgtattcagtcttcaaaacaaagaattgctctcagaagctactagcaagagatatagtggaaatcacacacactgtttggataatgccatgaaagtgcagctatttgctgtctttccaagtagctctacaagtgagtttttcatcctggatttgttgtttttgcatcatggtggtttacttcattaataaatgtgttcagagtgcttgtgcagagacagaaattttggatttcggatggtgggcattccatacacataatgtcagcacttgatgttgaaccccccaacagtgataatggaggtggtgatggagaaagagaatcaacaaccattaagctcacaggtttgtgtcgtaggtccttttttttttgtaccttaggcctttatttgtcctacctgctattttcaatcattcgattattagctcaaccacatctttagaaactgctcagataggcaagtttctagaaatttctaatttatcatgtaggtttcatattttattaattgtttttttaaaaaaaaattattgacctgttgtgttacattataaagtcatcccaggccattaaaaactgagtagtgttgcctattaagtcatgcgtgttggttaagctttccccagttagcatagatgtgcatgtttaacatcatcaggcttgcaaagtaattgttttaaaaaaccagcataatgtatgaagccctctttttcccattgactaaggtagtgagcttgtttgtttgtttttatcaggccatgatctatcatttatgttgtaactctctttctgtcatgttttttatcttgtgttttcttgcagctattgaagcaatctttacaagtgaaaaggttcaggacattgtgcctatctccaaggattcagtccttatccttggtcaaggtaatattcaatgatatcttgaagattgacattctagattgccatgaatctggatagtttgcttatcttcttctaaacctcctcctaacatcataaatattgtgtttgcaggcaacatgtttttgtatggaacttcttgaattttgttgattatatcatatattcggtaaatctatctgaaaagcttgatgtcattttagtccctttttgctctcattggtttgcctgcaccaacccacacattatctttggtatcaggtgggagatgtgaatgtttgtctagatcatgaatttgcagtttcgatgggtttttggctgaagacagggtgagtttggtgactacaaattgctttcaattatttaaccacttagagtacgatacttatttcttaaattccccccttctcttccatgatgcagtgttggagattttgaagaatgcagttgttcacctgtctttgaagtcatgagtatcattagtctttaatttcagttagcagatgaaatactcgagacttcaacagccagcaagagttgaaaggtgcaggccgttctccatcttgtcaactgtctgaaagcaacattacaaaactataggtctttcagcacagttcacaagccacagcaacttctgaacaggtgaagccagattattcccagaatacaaccacccagttgtttttgcatacacattttgcgtgccaggacaactgcagttctggttgcgatatctggaagaagataaggctgcaatcctatgcccagctcagctgttgtggaacgtggatcatcatcaagtgggtcggttatgaagctacaggtttggtgctccacaaggaggttgatcagttcagagactggaccttgagtccatggtgtcctggagttcagcgagtattttcgttccaagtgccaggccccgaggacttcagaaaccaataatgtatttgccatgttcaatgtcaggttttcacaatgcgcacgctagtacggtgtgagcttgcaaacatttacccgttgtgcctgtttctgaaatcaaaatctagttatttgccccgttggaaagtttatttgtggctcatattgcagcagaaccttattatttgctcgaagttggattcgggacttcacgtcttccatggccatagaaattgtaacgctcccttttaaattgctagctccagtggcctcatatttcaggtgggatatcttcttccagcatcagaacgtactgtaccaatcatctgcacgatcgcacattcacaatggactagaatggcagcaaccatcaacccatcctttgttcgcccagccgtcaaatctcataggctgttcactctgaattctgaaaaccttacgacggtttgacaaaatttctcaaacaatctagtatatatatacttcaggtggaatctcctccctacatcatcagtagatcatccgaactgtgctgcaagcccgaaatgcatcctaagcttaccacagctgacaaatctcataggctgtttgttcattctaattctggatcctggaaccagacgactgtttgacatatgggtccccatggattgcttacgacttattataagccgtaatgtcttattagcaattaaaaaaataatatgtgagtaaaacttttgtatttatgttcttagagacttaaaggccaaagctgaaaaataatacgttgaataaacatcaaaatcaaattcaaaattaagttttaaaatttaaattttagctttggcttataaaaggcaaaggaaacaatgaagcccatagcccgttaggagtactatgctttccttctcacgccgcgcgagagaggggaaaagccagtgaagatggtggccatggccggcggcgacggcgcggggcggcgtttttcgccgtcgtgaggtgctgctttgtcggcttctctccgcaagacgctcccggcccgcatccgcgccgctccgcagattagcgggcgcatcggcaatgcctgtgacgggggctgctaccccgagtgagggctaggtatttggtcgccgagaatgcttccttgccttgatcagtaactaggggactgggattcgggaatgctggtaggtacgttcttcgcctcctcccgggcttgctttttgtggagaatttccctaatctagtattctagtgataatatgctttaaactgtacatcagtacatgttgtcctaaagttcatattacttcctgcatctagaacaccctattctaaagtgatggatggttcaagtatttccctcttagataatcatgatttgctaccttaagttgtgcgtggcctgtttttatctcagagctaatctcgcacggcaagacctgattgaacgcataggcattagctatttatttcctgcctttcgagtagtaccacactagttcagcttctgaaagaaaagaaaagaagctgcaaataggctgggcactactagctttatcacagaatgtatgaattttctttcttgatgaaaaatgaaagcagtacttgtcctctgtttaaaaaaagttagcattatgccgttttgattatttcatgataaggttaacgttctgtatgtttcaaggagaaattcatgtctcatagtattggtgattcttcttttcagttgctgctcaaagtaataccagaatatgttgtcagtgatattgtgacatgttttttcaaatagtaagacttgagctctactcatcagttcatcaaggaaagatgggactatgaagactactctaagcaggtaaaagtaaggctgtgtttagatccagaggtgaaaagttttggcgtgtcacatcggatatacggacacacatttgaagtattaaacgtagactaataacaaaacaaattacagattatgtctgtaagctgcgagacgatttttttaagcctaattaatcagccattagaaaatgtttactgtagcaccacattatcaaataatggagcaatagacttaaaagatttgtctcgcaatttacacgcaatctgtgtaattagtttttttgtctatatttaatactccatgtatgtgtccaaacattcgatgtgacagggtgaaaagtttttgtgtgggaactaacagggcctaagccaaaattcaaaagctacctagctttgctctgtggcataacctgaccctgtatgcgaaagcatttatatgtcaccttttgctagttgattagttgatcagagcatttttgctgcaaaccatcttctcaagccttcaacagagcctcaacctcctcctgcactatccatagttctgcagtgatttgcatttaatgaaaagatatgtctattcctctcttttgattcattacaagcgtgtggctcagatttgcaatttgcaactgatactacttacataaagccttttatatggacttgtcaattgtaaaaacctattataattcctcagagttcttttcttctgaaccattttgattagtttccagatgcactaaagagggtatttcaggatatttcaccaggtgagctccattgcttccacagagagtagtaatttgacttgatcttgtttaacttgataactacttcattcattggaactctgtcatcaggtgcatctcttgagcaaagcaagcccaactcaattatggatgctagacagatattcaagatgattgaatcctcagatagcttactcgaatcctcagtaccacccgtatgaccatcttgttgtagactacagtcggcgacatttgagagctcatatgggaatgcttgactaatccattgcctgaaggtcaactcattgacgaacattggatcagttggttttttccttgtgaagacttcgaggaggacaattccgtagctgtatacgtcacttctgcgtgatgcttttcctgttgatcctaactctgtttgcaccatgtcaaaagagaactggtcagcttaagttagatgaaacaagaatacagattgtacagacttt

SEQ ID NO: 62863 - DNA, 730 bp, Oryza sativa
  unsure (1)..(730): unsure at all n locations
cgtggcatganatgcaatgagaatcagcatggnacccancaggccttgtctttataatgtattaatacaaaggcagatcgatgaaagaaatatatgctcaagcacaaataaccacgggcgatcgagttgcataggcagatagcttggatcactgctcgttacccatatcgccactatgcaatacccctcatcagctaccaagtcttcatggctgcttctcgtcgtcataacagcctgcaccggcagcttattcctcgtcgccgatgcactacatgagcatcatcatgggcggccaaatattgccggcgcgacctgcgtgccgcacgagagggacgcgctgctggccttcaaggaaagtgtcgtcggcgaccccgtgggccgcctcgcttcgtggcgtaccggagaagactgcttccgccattggagaggtgtcaggtgcagcaacctcaccggccatgtccttaagctccacctccgcaacacggatggtggagaggcagctatgtccggcaaggttagtagctccttgctctccttgcagcatctgaggcaccatgatcttagcatgaacaacctccaagctctcccgagatttctcaggatagccggagagggtcctatcccagagttcctattagaataattgggctaggcccgatttattctattaaaatctcaaaggcccataataagtgttaaggataataataccaccttaggatttaagcga

SEQ ID NO: 62864 - DNA, 14229 bp, Oryza sativa
acgagaaagcgtggtggtgcttctttttttaagcagggatggagggagagattctacctgtgattgggctgttggttttggcgattctgccacagataaggttgatgagaacgcaagataacttgcacatcccattggcctatgcttctaattgaccttgtattatcatggaggtgacgtctgtgcacgtttaatactggcagttgctcgcttaaatatcgctctaggcgtcggggtttattgatggaagttttgaaggacatctggttgctaatgcttctgaagttccgagcggattaggccagtcccaaccctctatctaagatggtgcctatggcattaactatattgtcatgtagaactcttagcttatatggcactatattaattaagagagagagtgaagagaggaagaaactgggtctcatacaagacacagcttcaacatgagaacctatccactagatactatcaagttttgcattgggaaagaatagtgtcttcataatagatgaagaataaatatgattagtagagaagtgagatgatgtatttattaatggcccactttaagaaaccatgggttgtagattgtagtttatattgtgatgtcttattgatatggcactatagacattgcttatagacattatgggttgagactgcctttagtgtactgaagcgcttggaattttccaaacagaagagacaatctgttgccttcccttatcagatcagctcacatgaaaacatttgaagtactcccagtgtgtgtgtgtgacggggagagctaggtggcttatcccagcggaggtgcatgaaacttggggttgtcttgttgctagatttggactggagtggagagagtgaaagcctgaaagcgatcgttagccggctgacgaattcattcccctcatagaaaagggtgacaagcaaccgacaacaataccaggtgtgctaaacagccttttgaggttgggcggttggctggcctgcattcacatagaaacagcacacgtctgagtttgaaaaataattaacggtaggagtaactatctagctgctttgcatatttcaattattgtggtaaatactctgattgacagtgatagatgctaaattagagcaaatttattcacagtgtttgacaagttatatcaatatttatattgctgaaacgtgacaaatgataaaacggtgtgatcacgagtagagctatacaacatactagtgagatgggtgatcactgatcaaaataatgaaagttcaatcctaaattacattggaaggtggtacaatattgagggttgataaaaaaaaaagcaaaggatgatatagggcagttaaacagtttagaggccgctgcaccaccttctcatcccaaactttttttaaaacaaaatcatgcaatgttcactgcccgcttaaaaaaacaaagtcaatagatatagcagttaaaaaaaaccacctcatccccacttaccaccaccaataggctcagaaaaagagtggctatgtaaccattcaatagtttgctctctgtgatatttctccctttctcgtggtgcactgtttcatcatttgcttgattcgatccaatccaactctttcgaaaggatttgtcctcctcagccttctttctttggtccccgcacatatggctatgttcataacttacttgtctagcatatatggctatgttcataacttacttatcccgcacagaaaacaatgtaacttattagtgtataaataattaagtattaatttttaaaaaacaaaaaataggttataatatttttaaaataacttttttatatataacacattatttagtagctcgataagtatgcgcgtagagaacgagaaagaaaaggatgtaaattcctagttctgaacgaggtcgtaatcctctttggcttcttctaatgctagtgcattatgttcggcggtatttattcccaacacatctctcgtgttccgtgcgcacacttttcaaactactaaatgatgtattttttgaaaaaaaatacaaaacttgctaagtattttttaaaaaatagattgatataatttttaaaagcaactttcgtatatattttttttagaaaaatacaaaatataagaatttagaatcggatggaacattttatagtagtatgaatatgaatagatccggtcttaggttcttatattttgagggacggagagagtagttaattataagaaaatatgtcgctctgttttgtgtgtgcgggagccgaacatagcctaattaagcaatgcagccatgggtgatgttgatgaactctatttactactatcttatcctagaatataaaaatttgtagagttgaacatgctactatgaaagtaagtagaattaaatgagagaagattgtgattggttgaaaaatggaagtaagtgaagaaattgaacggtggaaggtataattggttcgaaagagaatgttgatagaaaagttattatattttagaacaatttctaaaaaccaaaacttactatattttataacggagggaataattactaccttcttacatgatcattgtcgatgtcattataacctcctaacttaattttatgcgatgtccctaatgttgatgctaattttcggaagtcaccaatcaagaggtgcaaagtatgccctgagacggatgctgggcctagatacttggggtatatttttgtttaaagacgagaatgcatgtggacaacttataaattttgagggtcgttgtcggatatatgggcccggggatatgcaaagtgagggaaatttatcttcccatccagccgcgtggccctacagtctggtcatacccttggacctcgcggatcgcagaagcggccggggggcctcggggtgccacgtcatgcccctcgggccctcgtgccgccttgccccgaggccctcgcccaactgccatgtggcggggggagcgagcagggaggggacctaggctgaaccgctatcaatgcgcgcggcgccccaactgcccctcgccgcatttaatgtggtaggggcagacgtgcggtaccgcccgactgacgcacgtcagtcaggactgtccggtctgtgaccgacctgtccccagacacgaccgattggacgggcggctgtgcccccacgtcgcttctgtctccggcggagtggaggtaggtgtgacccgtcccatcggagtgtcattcggagctccctccacgagaggaccaccccaagtcttcacccatttatgagggaatgacagtgttgtaccccgtgtcacacggggggcggcgctgggtcccgctcaaggacggggtgcggcttagcttccaggcgaaggcacagatcatgattcgttcaaggtagggttggtccccaccccgtagaagagtaggtagaggcggtgcatgtggtatccccttgagctataaaaggaggaccctgtccaccgagaaaggggacgactcccagtaagcctgagctctaggagaagagaagcgggaacgctctccggagtttaggaacccttgtaacactcaaccttaatcccacacacaggagtagggtattacgctccatagcggcccgaacctgtataatcttgtcgcgcacacgctacctagcagccttcagggcggatacgcaatttctagaggcaagctccttcctccggccgaactgacaaaagggagatctcacgatcttccgctagagaggatcactcctcgacagtcgttaacatacgcaacctttgtcctaaaataattactccttccataaaaaaattataatcttaaagatgtatctggacatatataatgtccagatatattctaaaattggaacttttttttaacagaggagtacatttgtatcatttaatctaaaaaatgtagttttattgaggtgaaatactgcatttcttttaatcaagaatagcaattaagttggcttatggtctcaaccttcctttaaccaagtgtacgtatggaatatgcgcatacaatgcggctattaaataggattatcatggtaaattatatttgttgctaatctgtctttaatttattttgaaatgtaattattttgtgatatagtagcacgataacatttttcatactagtgaaagaaaattaaacaggcatatgaattaaaacttgttagcggagggtcagccggcatccatatcgaattatcaatcgggactctattacgagggtttagtgtcccacgggggatggtgcatgccgggatgtcgcactgctagattgaataatgtcccttgcgcagctctagctagatcgatcacgtacgatcggtacgtacgcacgcgccgcggcagctagcgattcaaccgttccccaacctatcacgcttcacgcctaggtacacagatcaacctgcgggctgagggtcgcattggatcagcggttatgtagaaattgcatgttgctactgtagcggctggctgctatctagtcacaccgaacaggcccgtagtaggtgtcgcctcctccgcgcgcgcgcgcgccccactgtgcagcgaaacgtggctagacgcacggcgcacggcacggcacgtacgagaaaggccacagctaaagccattaggtcgaggagaaccgcgctaaaaccccgccgatctcatccgaatccaaccaaaggaaacaccacgcggcgcacggcgcaccgcgcaccggccgtcctgctcctgcactgcaccacgccgatcgagagtaatcccactcgcccggacgtgtacggcgccccgtccccccatccttatctcgtcgtcgcaagccgcgcccgcgcgcaagcacgtttttctactgcgctagtatccctctccgcgtccagtactaggtaccctgcggctagatcgttacatgaggggaagggttttttgggctcatcctgcatgtacaggcagcacgcgcgcgcgagcccagccgcccacgcatgtgttcctccctatcaccaaagcaaatcgtacgcgagctttcgcttttgtcccttttgttagttaatctacctactactacgagctcttccttccatctactgcgtgcacacgtaagcccgtacgttcacatcacatgctggagccgtctgtgaacagattaatccctggagtttatctggctgacatggcggtagttagcgtacagatccatcatctagacgctctagactctagagctcatcggtcctgtgaatgtgagcgatctgctagcagaaaagcgttgggctctagctagctttccgtcatcgtcgtcggcagatgagatcattgggcgcgccttgcatatttaacttgactccggtttggttcagcgatttgtttaagacgcacttttgacccgagagatatgcggggtggtggtggtggtggtggttgccctgcttggagctgtacttgcgccatttcttttctcctttccatgtgaagtttgttttccacagacggattcctaaacaatggggtagtcttacaaattaattctctggtatttggtgtagtatatcatcagcctactgattgacggtagctagaacacctttcagttctgctttgtgcgtgtgtactggatctgtttgtgaatcactttaatttcggagtttcaatagacaatcttggaggagttaattgttcgcacgcatgaacatggagattctcgtgtagtctttttgaccggtgactacagcactgtggctagttgtagtagatagcacactgttcttgtggttgaacataactagtgtagtgatctgatggcctgaaatgtatattctgacttcagttccctgactgtaatctagcgctggcgagctaattaaagaacgcataggctcagctagcatagtttgattaagaagcgctcttctgacttttgacagtggactctgttttcttgtagttaaacgagacttggaacattttttttcctagttttgagatatagcacatgagattagtaggcactagtaaagaaagacaagccaaggatcctaagagataatctgctggtgtttggactttggacagctacacatgatgatatggacatgcaccaaactatacactagtacttgtgcgtgtgaagtacatgtatccgccactaccagctaaactagctagtgagccaagttagtgcgtcacgcgagaaacaatcgaaaacgtgacagtcacaacaatatggtaatgttaatgtactcggaagtgccaatctatggagcaaaatgtagctagctgttgttgcaacgattgcattggacgcatctacctactatcgtagaaccaaagcagttttagttaagatttcccatgacgcattcactcgtccaggtactagtacatgtttatttcctcgtggtgcaactagctagggccaacgaggcgaacgtgaactgtggtaactaaccattaatttgtacatgtgagacggttctcttgataaatcagagtcagattcaaacagtgtaaacactgtaggctcgttcgtcccgtcgtacaacggatcacaataagcttttgtgaagggcgccgacgagacgaagagtggctagtaaacacgtgctttttttaagccttctgcaccggccgcccacatgaaacctgatgatataggagtaacgagtgtaaacgacatggttctcaaaaaaaaaaaagtgtaacgacatagcaagaaccattgtgttgtctcgccaatcaataataatgccatggagatgtacgcagcccctaaccctaagatcacacatgcgcccaccaagtttactgaaaaaacgcaaacacacaggcgcgcgcacacaagtttaattaggatttgtcttttttacaggcctgtagattgaagttagttgtgtacatttgtgaatcgatagatgattccacatatatgtttgttaatgttttgagaaatttccataaatacagtatttgggtagcatgcaaattaaaagatcgacaaggacatgcatgcaccccgaggtgtacagtagcctagcatgtgttcaagatgtgtgaaaataaccaaataataaaaggatgcacttctagaccagctacctaaattatttcaactagaaagaaagaccgctaagatgtgcgaacaatttatttattgattataaaaaaatcaaaaaaagttatatctcattatattcactatacgaataatagattatttatatcatgaaaaagaacatagactctgatatactaaatgataatatctattatattcaaacaaaaaatcactttatcccagttatgtgtaaactcgtctatcaccattcttcgcaaacatataagttaatatatattttttattatacatttgatccacctgtgtatgtacataggtaatatacaaaataatctatattgccaaaattattgtgctaattgttaattaaaagggatataatattgtggctaccacctgagtaacctaggtctcggtgttcaagcatgagcgaagaatgcagcggcagacggcatcgtggttgagcatgagtggagcagatggtagctggcggcatcggatcatgaatgggagggagtagatgaggtgatgaccgttgatgttcgcaagagagctggagaagaggatgcaatggtcgacaccaatgcggcgatgcgctggaggtagcggtcaatggaggaggcagggaggtggtgtacgagcgtacgagggagatcgggaggtcgctcaatcggaatcgggggaaaggttgatgcaaaattataatcttaccctcccacgaccaaaacacgattggtacacttgctctcgcatgggcgcaatatttggacggtaccgggctctttgagctgttagatcacgcgtaattaacggtcaaggatatggtaccttctcccctaaaggattgtaaaaagctcccacacacacatacacacacatatcatctccacaaatttgcacaaatattaaagtacaggtgaagtatgctcacactgcttatttattcatccactttctctaggatttttcatttttgtagtccacgttgtaaccatgattctcatccgaactccacaattttaaacaacgaacacgcagcgagcaaattggcacttaaaaaagtagttaaaaacaaggaggtcaggtactcactcgggcacatgcattagaatatgatccatttgtgccgaagccgaaccagcgtgcccatctgcccacaccaccggaaaggcggaaagcatcccaagggcaacacacgcatatcccaccccgaataccgagtaagatcgcttgtcccgttgccttgccagccgcgtacgtggtcctccccggccagccaagcccaagtcgacgtttatctcgacgggcgatgcgcgcgccacaaaatctcggccaccacccggccgctttcaatagcagcaacaaatcaacctgattctgcccatagggagatagagatcgtctcctgtctagtactactcgtactactagtatagttacttcttggtagtacagacgcaaatgcatttggacacttccttcctggaagctgcacgagccactgttctacttgggtgggtcaggactggatcagagataagctgttggcttctgggggcattgtattatctgatttctgccagccaagggtgaagaaacatggtaaaaaaaatcaattctgattatattttttatggaatggaggaagtagtaagcaacaaaatgatacaacagttaaaataaaaagccgcgacagcgtacaactatatggtgatagcttttccattagctcatactttctccgcgtcaaaataaaggaactagtatcaaattaaacacaacctaatactacaaaattttaagatgaagagagtaaggtttatggtgttggtcaatcatcaacacaggatcacaatagaaaggaggttcgactccctcgatctccttgtaacctagcacttgtggctagaaagaaacactcgtatcatcaaggggatacttttcacaatggagacagtggctaatcgcattgtgtaaggagagttttgggttgctgcattatctaatcctctaggagatcttttttggcacttacccttttattccacaaaaatccaatcatagctatgaatatgaacaagattcgtagctagaattagttttttttaatggagtagtggtcattggctctttctccttttctcattttttgcttgttgttcttatgagtctggttccttttcctagtctatttagtgtgtcggtgtgtccttcctctcctttgtaacccatgatctacattagcaggttgcagttacaaaattcttttttatgttaatatgccaatgcgtaaggcttttacgagttcaagaaaaaaaattacgtggttaaagaaaccaaggcccttcaatctttcatttgcccttgcccactaaatttcttcagtgtcggcttattcctaacgcgcaactggtgttgccaatgcagatgtaacaatagttcatgatgtgtatctctctctactccctccgttcttaaaaaaaaaaggtaaatctagaactggatatgacacattatacgtactataataaatctggacagatgtatatccagattcgtagtagtagatgtatcacatccaatactagattgtttttttatgagacggagagagtatttcttagcgtagccgtaagcctttaactacagcaccgtcagccatggagaaattacctgcaattcagcggtaggcctcgcaccacgcgctcgctcacacgatactgcatgcattacattatactccctccatttcagattataaaatattttgactttagttaaagttaaactgtttcaagtttgactaagtttatagacaaatataatgatatttataataataaattagtttcatcgaatcaataattgaatatattttcataataaacttgtcttgattgaaaatgttactatctttttctacaaacttggtcaaaattaaaacattttgattttgaccaaagttaaaacgtcttgtaaccttaaacagagggaatagtattctcttcctaaaactcaacctaaatactccctccgtttcgttttatttgacaccgttgactttttagcacatgtttgacctctcgtctaattcaaaaaaattaaataattattaattcttttcctatcatttgatttgttgttaaatatacttttatgcatatgtatagttttacatatttcacaaaagtttttgaataagacgaacggtcaaacatgtgataaaaagtcaacggcgtcagataaaacgaaacggagggagtatgatgtcacctccccgcaaaaaaaaatgatgtcacctatcttcaggttaagtttttttcctttttttttaaaaaaaaaggaatgaaggaagtaatttgcattgacccgatcatctgtcgcgcgcgtcaacgccgcctcttaactcgaccgatgtgtgccatgcgcacaacggaaaatcggtgaccgcttacaatgcaccagtcgtcgttgccccagccgatcactcgctcggtcacatgactagagtggcacagctgcacgtatgtgtgctgtgtgaagcgagtcaggagtcaaagtcttcgcgatgccacttgttcttcttgagagttcaggaagagcagtttccatgtgatttcgcctctatagtacggtgattcttgacctcggaattcgtgagggtactattcagtctcggtgcacacagcggatgatcgtgggaatgcaaagctagcaaactgctctgtcacatgccagcaatgtcatcccaagtattgcatcaacaaacactcccacatttctttcacgtgatcctagcgtaacgagccgcggaccgtcgtttctggaaccacctgtttaaatatagataaaaaaaaaactaattacacagtttagatgtaaatcacgagacaaatcttttgagtctaaggggggtgtttgggagagaggggctaaactaaacataagtctctaagggagggacttatacttttgtgagagggactaatgtttagtccctagttcctaaacaccccttaattaggccatgattaaacataaatgctacaataacccacatgtgctaatggcggattaattcggctcaaaagattcatctcgcggtttccaggcgagttataaaatttgctttttttattcgtgtccaaaaacttcttccaacatccggttaaacgtctgatgtgacactcaaagattttcatttcaccaactaaacagcccctcctaagcaggtaaacgtgcaagacctggtaaaatgatattccatccgtcccaaaaaaaattattaggacagtaattaatcggacagtgaaacggactactaacctgtggccgtctccagaccagctgtcaatcataagagctgtccgtcctacgtggaggacgtactaggcagccgccgtgcttgaacagactagttgacttggatccaacagatagctcacttttactggaatcatctagctttcccaaaattgtcagcataattcttagctttctcatttccgccgtcaattactggtaattaagcatgcatgggaatgcagatgggaatgccagtgagaaaacatgcatggcgacatcacaacatgaaagcgaagtctgctgggatccaatcatctttccatttggtgggccaaagtagcgttcaccgttggatagttagcagattgttataattactcctgttgttgtgaagagaccacaacagaagtcagaaaagaagggaattaatctaagttgtggttgatcatcgccgtcaggctcgaagcaaaatggtactacatccaagtatcattttccatttgggtttcgtctccacctccaaatctccaatgtactcagtggacatgcgctgttactttcttcgtgccttttgtttgataatttcttcatgctatcttttttactagtcccgatagctttacagttcaataaacaaatttcattatactcgaattggctgattttgactgagaaaaaaaatatagggggtgtttggatcatatggattttttttagcccaccccttttagccttaaaatagctcaaggggatccaaacatgagagctattttagggctatttgcaaatagcccaccccagaaaattatcacccccaggggtgctaattggggctatttgctgtgggccccaccgattcccactttcccccacttgtgccggatccagttgcggcagaaatcgtcgctctcacccctcgctctcgccctcgctcgctctccagaaccctcgccgccgcccagccagcttcgcctccccctccccccacccgcgccgccgcccggccccagcttcgcctccccctccccccacccgcgccgccgcccggcccttcacccgcgccgcctctccctcgaatcgcgccgcccttccttcagatccaccgagaggcatccacgccggcgactcaccccacccgcgttgccggccatcagatccgtcgtcgacgcatcgccttgcaccggatccgcgcggagatggaccccaacggcttcgatttcttctcccaagatcccatttcgtccgccgccggcaacatttggtcgtcgcagccgtcggcgtccggcccttcccacggatccgttccccgcgccggcgtggacacgctggacctcaacacccaggcggcgtcgggccaggagttccctcacctccacgagtacggtgccttcctccagggtggcggcgaggaaggagctggccgcggccgaggctccggtctccctcccatccgtgcaccacgctctctgggagtgagggctggtcgagggggcgccgggccatctcgtgctgcaccgcgtgcccgccagctcaacttcggcgcggtaggtggccgtgctggacacggtggaaatggtgggtcgtcgtcgggcatcggcggcggcggccctgggcgaggcagctcctcatcaggggcaacgggtcgccgtcggcagcgcgccatggcaaccaaccgtggccgcgaccgcggacgtgggggccgcggttggcgtgtgccgaggagtgtcggcacccaggaagcacccatcggcgattacgtcgaccttgacgaagaaggtgcatgggacgatgaggtggaggaattaggcagcttcggcggccctccggtgagcattgctgaccgagctaactggactgataggaataatagtattttgttagcattgtgcatagagcaagtaagagcaggccactacaatggtagccaaatgaattctgatggctataatgctatagccgagggctaccatgccaaaactggtttgatgcacagtcgtctgcagctaaagaatcaaattgggattctcaagagcacgtactccttctggcgttacttgcaaacgcacacgggcttaggaagaaaacctgatggaacagtcgatgctgattctgatttctggagtagtcacatagaggtacttttctaccattttttttattgctgatcatgtttttttgggttattatctgtctgcgtttagtgttcttatgtttggattattcttgcaggcaaaccttacctgaagaaggtgcttaaaggacttccagcaaacttggatcagcttgaggagatgttcagtggcagtactgtcgatggtagcactgcttttgctgccggtgatgatttcggtgaggcacaagaaggggctgaagatgagtgggcagaagaaacagaggagttcctgcaaactcctcagagtacaagtagccagaagagcaagaggtccctcgacagcactaccagcacatgtagcactccagtgaagaaaagcaaaagccccatggttaagtatgtgaaggacatatccatgtcattcaaggaggccatgcaaatcaacagccaggaattgaggaagcgtactattgagaagcaggctgcttcagtgagaaattgtatgaagatggccttcgagtgtggaattgagccaccactgagaatatttttgcaatgtccaagatgtttgagaatccctaccaaagggagttcttcgttggactaccaaaccatgagcttaggttcaactacttcagcaaatggagcagggataacaacctggtttagttaggcacctcttttatgtggtccgtttgttgtgtccaggaaccgtttggagcttttgttatgtgctgttaatttgaacctc

SEQ ID NO: 62865 - DNA, 23822 bp, Oryza sativa
gcagcccatcattttgagtacaaccaattatccaaacttccatggggcatatactcaagaactagtgctttgaagtcaagattagagcaagtgctaacaatcctcaccaagttgcggtgatgagccattcgtaacacgcggcactctgtgtcaaagcttttggaagctacttcctgttgcatgtttaggacctttattgtgacaatggactcatcatctagctggcctttgaagactttaccaaagcttccactccctagcaggttatcatcactgaagtttcttgttgcacggacaagttcatggtatgagattaactggtaattcagcaagtctgcatctgagggtagtggcatctttcctggcttattcattttccttcttaccaacatacacaagcaaaatgctaaaataaaaaatgccacaactgcaggtaatatgaattttagtagccgttgtattgaccttgagtgagttttgctctggcatgattctattccttggctcggaaggccacatagtgccttgtttcccatcaatgacttgacagtgatgtttgagaacacacctccttctggtatctgaccctccagtctattgaaagataggttcaaattggcaagataagtgagattggccaaggactttgggatgacacccgaaagcacattggaggaaaggtctaactcctcaatacttagtaacttgccaactgaatctggtattgaaccttggagtagattactggatagattcatatagatcatcatctggagttcaccaaaagaaaatggtatatcacctgatagctggtttcttgatagatccatcttagtaattgctgtcagttttccaacatcagcaggtagagaaccactcaaagagttctgtgataaatcaagctcaataagtttctgaagatgccacaaactaattggtattgttgaagacaacgagttttgggacaataccacaacttgtaactggtttaggctaccgatggtacttggaataggactgacaagttgattgttagcaagattcagcttaactagacttgttaatccagtgatttctactgggatggtgccagacaaggtgttgttggagagattgagttcttggaggttgttcattgatgtgatctgcgtggggatcatcccgcttagctggtttcctctgagagatagcatcagtaggttggtaagcttagccaatgtactggggatgcttccagtgatcctattgttgtctgctacaaaaatttcgatcagtgtgctaaggtttccaacacagggtagtaaactcccttcaaatctattgtatgacatgccaattgtgttcagattactgcaatttgataatgcagctaggaattcaaggttcccactgagctggttcccatcaacatagatgtcacgaagattccacaagttcccaaatgacattggcaccgatccagttaatccgtttacgaacaaatctattgtggtgaggtcagagattgcctatagattcgggaatggtacctgttatttggttgtttgcaaagcttatatacctgaggtttctcagctgtccaaactctggtggtatttctccctctagattgttctcgctaaggtccaaagcaagcagcccagtatgattgctcagttcaactgggatctttccagtgagctcgttggttgacaagtaaattgcagtgaggtttggcattgtcgccagccatgatggcacagaacctgtgaaattatttacagctagggagaacaaatcaaggttttgacatttggaagggcccgatgggataggtccatcgaaccaattttcaccgagagagaaaaattccaacatagggaggtgaaagctctcgtttccaggaatcggacctctgagattgttccgtgtgactgctatggcttgcaggtaggacatattgaagatagcagcaggcatggagcctgagagaagattattttctaggactagcatctccagcttcgacaatgatccaacgctaccaggaattgctcctgttagcctatttgacccgagttgtatcctactcaggttgggtgtgttattgaacaggccttgtggtattggtccgctcaagtcgttatctgacaatcttaatatctgaagattgttaagatttgccaactcttgtggaatccccccaaagaatttgttgctattaagataaagagactcgagccttgtgaggttgccaaggatggaggggatggtacctgacaggctgttgtatgaaagaacaagagtttgcagtcggggcagcctatcgagctcggttggcacaggtccgatgagggtggtgttgctgagtacaaggctggagaggaaggagagattgccaatctgcgggctgatggttccttcaagtgccatgtcttcaaactcaagcccagtgacccacttcccgctgctgtcgcatgagaccccaatccatgagcagaagggtgcactggcagtccaattgctggcaaggatgccattagggtccttgacttgctccttgaagtcgagcagtgcagcgaggtctgtgttgttgtatggaggggtgagtgaagtggcgcatggtgccaataggatgaggagcaccatgctgatgcagagaagagccatggtagtgaaggaatgaaggttgatgatgaggatacacaattacgcatgagcagtgtgctggttctattggtggttttattggaagtgtggccgtgtgggatgtgcaattgacatgtgcattgtgttgaatggtcaaaaagttgttttttttagtggaaatatgtgtgaaaggaagaaagcgttttagactttttcgtttgaaaacaaactttcatttttcagagctggttgtacactgcagtttcttggtacacttcaaagtttcaaaatagaaagaaggaaaaaaatgaattccttccaagaaacaacctcttccagaagtcaaggagcaaagctgtaggagtatgtcatttccgtcattgatagcttcgttttttttctgttctgtttttaataatagattaaaacccggtctctacaccaacatgggtgtacacagccaactttgatgcttcatgcttggcgccagtacttatgtttgtttgattttccaagaataaaacatctggtttaatttttttttcagaaaatcacttaaatagtcgttctacgctagctagatttttttttaaataaaaactgggagataatctaactccaagtatatttttttgaaagcaaactccaagtatattcatatgccatttccatctttgatactatcttggtatgcttggcaccattacttatgccttttcttttcacgaatgaaacatctggtgtgatttttttcaggacaatctttttaaaagtttgttcctggctgttgtttcaggtatcaaagaactgtaaaaatactgaagcgcttctatcctagagatccatttcttattagggcccgtctagttacccaaaattttttttccaaaaacatcacatcgaatctttggacatatgcataaaacattaaatatagattaaaagaaaaactaattgcacaattatgggggaaatcgcgagacgaatcttttaagcctaattagtccgtgattagccataagtgctacagtaacccacatgtgctaatgacggcttaattagtcttaaaagattcgtcttgcggttccgaaatccccttccgacatccggtcaaacgtccgatgtgacatccaaaaattcccttttccccaactaaacacacccttaacccttattcagcagttgactaagagtctaagagaagcaacactttccatgtgtttggtcaatcctgagtagactatgctctgaatcgtgctcaccaacgcaccatttcacaccaaccgccatttcacatgtctattattgaaggcggtcaggttcagcgaagcaagttgatgatagtcgctcttccccatgctagactatccatatccatggagccatcaaacagcgtcatgatcactgataattgatagtagtacattgaatacaagagaagctgtacgtgcacaacttcccttccattaagtatttaattgcttgcttgcattgtttgcttattttctgtacgatggagggtgggctgtgggcatcatgatggaatcgtggacctctcatatattgttgggttaactgaaatttttcagtggtcctttgaaaactagtagaaatattcattgcgttctttggcaggttattggaggattaagccctaaacaactctctaacacgtagtatattactttttgttagatggctgcaaacctgcaactcaactactgttacaggtatcttttcaaggaaggctacagctttcatgatgcagttcagcatttgcaaccaccacagatgacacatggccttgccagctttgggttatcatctgcagggctgcaggacaagactatctaggcttgtaatacctccttgatccgctgcagtttcacagtcacatccttcatcgtcaccctgtcctcaggcaagtctctggtacactgcagccccaaatccagcagctgcgctaagcagctcctgctgccggttgattcaccttgggcatcatcgctgctcaccgtgtcgtcatacagagagatgccaggatgtacgacgtcggcgagccttgacgggagcgctcggttgacccactccctcaagctcagctctccgacgaacatggcgtcggttggcttcttccccgtgaagacctccaggagcatgaccccgtagctgaacacgtcgctctttcgcgatgcttttcctgtcgacccgtactctgtgatgttcatggtaaacaaagatcaagggggatctgcagaaattggcgatttcagtggaaccaaagatgaacggtaaatcgacaagtgattacctggtgccatgtatccgattgttcctggcatgctcctggagaatatggaggtgtcctctcctagcaataaccttgcaattccaaagtctgcgatgcaagccgtcatgtctgcgtcaagcagcacgttgcttggcttcagatcacagtggaggactacctcaaagtgctcatggtgtaggtaagccatagcgagcgccgcatccaacatgatgctcaccctctgcatcaatccaaggcaatgcctgtcactgtacagcaaccattcgtccaggctcccattgggcatgtactgcagcaccaacgccttgaagtccagattcgaacaggtggtgagtatcctcaccaagtttcggtgccgagccatgcgaagtgcacggcactcgacttcaaaactcatggtagctctttccatgtccatgttgaggacttttatcgcgacgatctgctcatcgtctagattgcccttgaagactttgccaaagcttccagctcctagtaggtgatcactattgaagttgtttgtggcacgaaccagctcatagtaggagatagccctatggttgttgtttgactccaaactcatagtaatcggcaggcccttcagtttcttgccagtgcaaaatttaatcgaaaacagcaagcagattgctattattccagtagccaatatgcttggaataagaactacttttagaagccttgattttttaccctgaagaggatggtcatttttgcaatgggggaaaccaaggcgtggaagaccacagagtgctgtgttccctctcaaagattggagggtaatgtttgagaacacaccaccatttgggatttgcccatccaatctattgaaagagagattcagggtagtgagaggactaagatttgcaaaggactttggaattgttccagagaaggagttatatgaaaggtctaagtaggtcagtgtgctaaatagttcaagtgaggctggtaaattaccagaaaatcgattggaagaaaggttcataaatgttgttgctttcagattttcaacttctggcaaagagccagtcaaagcatttccagccagatcaagacccacgatattttgaaggccccataggcccatcggtactgctgaagtgagctgattatttgatagttctaaggtttgtagccgacttagattactaatgctatcaggtatggggccatggagcttgttgtaggcaaggcctagggcaaacagatttgatttgccaatatttgcaggaatggtcccaaccaactcattagaagaaaaatcaatcatttcgagatccttcatctctgtaattgataccggaatttccccggtaaatcggttgttgcgaagatccatgaacaacatgttgctcttatttgtcatatcagggatatttccagtaatttggttcttgaatgctcgaaagatctggagggaggaaaggttgccaatagaacttgggatgctaccagtgaagtagtttgtgttcatcacaagatacttaaggctcttgcaacctgacaggtcagccatgaaatcgacatccccactgagcttattctcgtcaatgtagagttcactaagggctggaccaaatattggccttggcacagatccagtcaatgagttaaaggatatgtcaaggatagagatcatagacatgtttctgatagaggctgggatgctaccggtcaggttattcatctcaaggttcagccaccgcagctgtgtcagctgtcccagctccggtggtatcttcccatgcagattactcctggtgaaatccagatgggtgagacctgtaaggttgcccaagctggcagggatttcaccagaaaggtcattgccacccaaggagacattcaccaactgaggcatagaagccagccacggtggtatgccaccggtgaagccattgctgaatagaatgaactcttgcaggttcttgcatgccccaaagccttgaggcactatgccagttaaatggtttgtgttgagattaactgtttgcagcatgggaaggttgaagcttccgttgtttgggatagagccagagagattgttcttgcccaggtacatccgtaccaagctggacatgttaaacagcgatgcaggtattggccctgaaagctggttccctgacagtacaagcacctgaatgtttggcaagaaaccaatagcaccaggaatgctccctgttagtttgttgtaagcaaggctcaagaaaacaagctgtgacgtgccattgaacatgccacgtggtatctgcccgctcaactcgtttctgcttaatccaaggtacataatgttcttcagattgtgcaggtcgggagggatttcaccggtgaggttgttcgagtcaaggtcgaggatttcaagcacggtgaggttgccgagagacgaggggagattacctgagaggcggttgctggagagatcgagagacaggaggcgtggcaggttgccgatgccatcagggatcgggcccgagagccgggcgtcgctgaggttgagggtggagaggaaggtgagctcgccgagctcgggggccagcgagccggcgagctgcacgccgggcagctccagcgccgtgacgcgcagcgggtggcggtggccgccgcaggtgacgccgagccagccgcagtagggcgcggccgccgtccagttgccgcggcggagcacgccgctcgggtcggacacccgcgccctgaacgccagcagcgccgacagatcgtcggccgtggcgaacgccggcgcgcttgcgagcaggagcgcagccatcagcacggcgaggtggaagacgacgaagaagaagaagacgagcgccattggcaggaggagagctcgatggaatcggaggtggcagctggctgaggctggtagctgtgcatggcgtggtggccaagcttatatcctgggagttgcgatagtggagactggagaagccagaccacgtacatcgggaagaccgaccagagactttgccccccatggaaactaaggctgcacgcaaaatgatgcatcgtattatcatatgattaattaagtattagcttttttaaaaaaataattaatataaaacatactgtttaatagtttaaaaagcgtgcgcacgaaaaacgagaaagctgaattgggaaaactggagaaggaatacaaactaaggatccctttgaatcttaggaatgaaaaaacgaaggaataagaaaaacgtaggattctagagcctctttaatttaaagtaatgccaaatgattttttttaggaatgggatttcaaaggatttttttccttcaagcctctttgatttatagaaaaggcaagtataaattccataggattgcattcctatgagtggattccaaaggaaactaaaaaagaggtaagacctcttggaattcttcctggtgcgaattcctttgttttccctatgcctatatcaaaggatcttcttacgtttttctctgttttctcttcccgtaggatttgaaaatcctaccatttcaaatattgtgtttttcctattcctgtgtttttcatatcctgcgaatcaaaggggccctaataggaatgcaagtgtaaaatagaggattgcaaaacacaggaatgatcgtttgaatgaaccgcggcaaaagggaagaaaatcggatgaaagagatagactaaaaggaaagctttcaagaggttggagctcttgttaaatttcctcaagaaaatctctttagaattatccattccatagaaattccaaaggatatgataggatttgatcatttgtttcaaagggtgttatagaaaatttttctgtaggattaaaatccttcaaaatttctatgttttttctttaaatcaaaggcggcctaaaagttgatgcgagcgagctcgttcacaagctgcttccctgtacgtgcatgttcacgtttgtgaccgtgatgaaagaataggcgaaagaggaaataataaatcttttgccgaaccgatcgatcgagagtgcacagcttaattaatttctttttgcggggacacagcttaattaattagcatgacatttttttcatctcaccaaagaaaacagtgaagggggaacgtagtacggaaacgaaattggcatttgttcctgtgagtgtacagcttaatttgctagtgctaccttgaatacacagcgtagtacgtcatgttcgaatgaaactcatatagatgaagatgaagataaaaattaagtattttatataaaatgagatgatatcaacgtatgactaattaagtttttttattacaaacttgagaaaatatatttatctgatattttagagtaatttttcatatagaaaaattttacatgaaacgtattatttagcagtttgaaaaatatgccacaaatatctaaatttctatctaacttttattggagaaacgtctcatgttattttttctctagttgtggacaaaaagaaggctacggacttgttaatgcttccaatttccaaagattagactagtatgaactaaaactgttgctgccttgtctatttttccttcgggggctgactggtggtagactgatagttagcgccccccactggacacgttcttgctggaaagcgactggactggaagaaacacgaccgctgatcacactggactggtatatctctgctgcacttcatggcatcgtcagtgtgaaaccctgaatacgtgtgtgactcataaagaaccagttgacgggctgggaattagggaaagagtcttgcggtcttgcctaatcgacaggacatcccctgtctagtttgtacatcgtttagagagggatgggagtaataataacgcatgactgtcacattttttgtccgtctcatggagttttcgctaaactgattcatcttctggtgctgcttgagaatgtgcaaacgtacacgttatggcggggaagacttgcaggtctcgcggaaaacatccaccttggcaatagggtttagttcccaaattatttttccaaaaacatcacatccaacttttatttatagacacatgcataaagtattaaatatagattaaaagaaaaaccaattgcacagttaggggggaaatcgcgagatgaatcttttgagcctaattagtccatgattagccataagtgctacagtaacctgcatgtgctaatgacagactaattaggctcaaaagattcgtctcgcagttttacatgtgagttataaaattagttttttcgttcgtgtttcaaaaacccttcccacatacggttaaacattcgatgtgacaactaaaccgaccctgctgtgcgcagatccaatttctctctgcagagaactgcagaatgcatgacatgctgctttaattttgtcaattcaaatacggagtagctaggattccattagcacatataaaaaagcagtatagctagttcatttttttttcgaaaagaatacaaacagtagcgcgagactactgtttgacaacagcacgaacagttactactagcatggaagagtttgtccctcgtccttttcttatgtttataagtatcagccaaaatttaaatttttaactttatatttagagttgattttggggttttacatcgaagtttattttttcagcttttacttttaaatcgctaagaacacgtatataaaaaatatatttataaattatttttcgtttgtaaatataccgtaacgatgtggccattcatttctgatggcatgaagatagggtggaaatatatgtttaatctaaggagttgaaacaaggtaaatatttgctattcatgtgagaattgtttcttttttccgtgtaatcatgtagctcaaagagagtggctattgtagtaagtaccggttctatcctaaaatatagcaagctaggatgtttagagagcattagtaactagcggttacaactacaagcttagcgcaaaaaaaaagttatggcaatcttttttttaacgtaagttatggcaatctctttgacatggaaaagtgaaggttcaccgccacaacacctgcagttttcggctgtggcctccgacacgggttatgcaggacgcaagaattgaccttctaagagcagttaaaataacactcatagcgccggcgatactgactccacgtaggtttgaggagtaagctggagggtgaatggaaaagagagagaagctcggtgactaatttacagcccggttgtacactgctcccaatattgctgctgctctcagccaattgcaacattcaagtgaagattttaaaaaaaaaaatcaaacctagccatgggaagtgcgtagagatgtatatataggttctgtttggggagagtttctagttgctacagcttctcccagaactagaagtttccccaaacagtctagattttggtctagattttaagaagctatagttatagaatccagaaaataaactaacagtcagactcttagctattttcagattcttataagctggttaacaatcagctgcttctcatgattttaacctccccaaataaacccgcactctattattgtattgattagcttgtgtcattcgctagaatagaatgatgtggttatttttggaggtaacaagtagctgtactattagcctagctgtaacgatagcggcctagtcgccgacgatggcggctggctcctccggcctacgggctcgcttcggccgaacgctacgccagtgaccgtcgctttgcgcccttgcgcccaccgcgtagcgagagagagagaacagagaagggactcgagcccgtgccgcacggggcatttccaccgtcggattctgaagcctcgcggccgagatcgagggctcggaggcaaccgtcggattccgatcctgggttactcatagccgtccgatcagagtagacgatggaaaagcgctcctggttccgagccggccgccaattcgtggttcctcctcctcacgggcggcggcgacggcggcgactacggcgatgcggctgctctccggcgcctctgcttcccgaatcccctgccccctcctctcactcgcccgcgcgagggcaagatgcttgccggtccccgcctctgccaccgcgtgccgagcggcctcctcgtcagccgcggcggccgcgggcgacggcggcgcgctgaagccgtggttgttcgtcgggctcgggaaccccgggaaagtgtaccaagggactcgccacaacgtaagttgcctgattttgagctgcttgtactagactccctgtagttattagggtcgaatactcgaactggtagttgttcaaagacgaaataaacaaaactgcaacctttctgactgttgaagagctcaaacccattctgcaagtatggaaatggccacatgttagatgaagtatttgaaaagaacatttcaatgtgtagttgtcaagtttttgttgacagtatatattacaaaggagatctcactttgagggcagcaaaattcattatgcgttgctttttgaggcatctaattcatacaatgttttttcgtctgattctcagtttctatgtcttcagtatcagtttcgtggaatatatatattgcacataacttcagtcctttgttcaataaatggtcacgcatgacacagtcccaatatgagtgcaccaatgcattatgtatctaatttagttgctaaccttgaggtcgctcatattgttcacaggttggattcgagatgattgatgttatagcagaagctgaaggtatatccctcagcagtatgcagttcaaggcaatggtaggaaaaggtaatattgacaattaatataattcttttcaactgatacatcttgtgttgaaagaagccatgctatctggattcccagagctgtactttgttcctcaagtcttgcacattaccttttcaactctaacaatatttatgcggttttcataaatattacctataaacaaatgctatttgtttaagatactctatgcttgaatattaaacatgagcaggtgcatatacttatttgaaattctgaaggtagtgctatcaaacattcataacagaaaataatatttaggtcgtattggagatgcccctatcatgctggccaagccacaaacttttatgaatgcaagtggtgagtctgtaagtatactgattccaaaacaaccttcactactagttgttccttcttttttttacctttttcgtttgacaaatcgagttatacaggtggggcagttggtctcatatttcaagataccacttaatcaagttcttgtggtaaagtgctatcctcgagtttctggttgctgttttttttaacagattgctatattttgattcttcattcattttttattctctgcagatgtatgatgatctagacttgccctttgcaaaattgcgtctactgccgaaaggtggacatggcggtcataatgggtactccagctctcttctacttcttttacaaaatggtcgaaactcattacctgcatgtgttaactcagtgattattttactaactttatgctgaagacctaacttttggaggtagataactctgaagttcacctaagcaaaaggatattcttaatttctcagctctcttctacttcttttacaaaatggtcgaaactcattacctgcatgtgttaactcagtgattattttactaactttatgctgaagacctaacttttggaggtagataactctgaagttcacctaagcaaaaggatattcttaatttctcatcatataccgttggcaccatctttctacttgtcctaatgcaatgcattatccattgttacttaagaactgatctaaggtgcatagttgtgagaaaatgcatcagacaaactttaggatgttcaattgtacatttgtttctcccacatcttctcttggggaacctctcatccatatgttcaccacttgcagggtgagaagcattatcaaccatttgaagcagaaccgtgatttcccacgtctaagaattggtatagcgcttctctcctttttcaactcagttaccatgtctgaaaatattcttgcggtgatatcttgcaggcattggacgaccacctgggaagatggatcctgccaattttgttctccgaccatttaacagaaaagaacaggaagaggttttaattagaatgctttcaagaaacccttttttttttcatatttacctcattttctgttctgggcatagcactgtttgtttaagatgtacacatctctttttgcagcttgatttcgctttccataggggcttggaggcagttagaataatggcacttgagggattcaacaagagcgcaacttatgtgaacaccgcacagtcctctgaaatgttgaatagatgataaagtgttcaatttattcttataacataaagattcttatgtcagatctgaatgtttcctatccagtagacacttgcacacatggtggtcattttactctcaggaaatcctgagctcccgaggacggaagagattatttgagctgcagcaacttggtacggtgattttcaccagcagcttaaatacagggaagttagagacgtcacactacatgcgtacttctgttccttacatttgtagccttgtattgatttcaaaaaacaattgtagcactgtaatttggtgacctggtagggggagagagagagagaagcctttttgtcttggtaatctatactttggaaatcgtcagcatactgttaaacaggatttcagtgttccacagtaccttgtctcactttctatatgtatatacaagtgttgattaagtaatcactcatttgaatacgttgttacttgcacacactgaattgagccataccgggtgcattctcctcttgttcttgcaaggccgctgcacgccatgagctcataaacccgtagcaacggcggcacaagatattgttttgcagcacggcaggagccggctggaccgctggaatatgctgctgaaccgccgttcgctttcgccactatttgttgcgtagaaatgtagaatcgcgtccattttcagagatatggtgatcttgtgtgggagcagtgctgcagcggctctggtggggtccccgacgattcctccagcccgtagttactatccatccaaaatcattttgcatgacgttgtcctctcgatctcgattttccacgttccaaatatgcgatggtagttcgctcttgtcccaaaaatggaggatagcgtacagctcagtggatattcactttttttaaaagaaatacacagtacaacagacactcacaatgcacgcatactcacccctataaaaacgcgtaagcaacagtggcggattcaggaaatcgattcgttggtgtcataatgtgtctatcggtgctatagtatgctaatcatgcttagattatggtgttataacatatgggtaaacaattttgctatagttttgccaaaagtcgtcggtgtcgcctgacaccggtccttcttctactgtatatccgccccttgtacgcaaaccctacccctataagcatcttcaaagactggaccagcaaatcaaatcctagagattggtgaagtcactttaggcgtctcactgtcgacgggcacgtcgcctactactgaaagcacaataccgttaaatcctgaaaaatttgctcccatggggagtcgaccccagcacctaaggtgctaaaatttcaatgcaatatgaatggaatgcgaacagtaagctgctacctacatccataaatataagcaattttagaatgagtacacgtttatcgatctaaatggaagaaaaccgataattgagccttgcaatatccattaaagggaaccggatcatttcataaaaagtgaatcgggattttttttttcttagtgctataagattgaaataatgatcttccgatgcttcacgaccaattttgcatgaagttgcttactctctctgttccactgtaagtatatttttaaaaagtgtgtgaggaaaataatagagagattacctaagtatccctattaaataagagctggtagggactgagagggtaattgaaggtatgatggagaaaattttgagatgtaatgcgattaattaatgtgagcaagtaatatgtgggattgtatttattttaggataaaagttaaatttaaaattacatttatcttgggatgggggagtatatagaatatgaatgttgcaaaattgcgattgttgtccatggtattagcattatttatagatgacatggtatctacattagtagcaagccaaaactagcttgactactgttactgtatttggatttaagctcacggagagagtaaaaaaactaaacgcaaatataccatcacaaagaatctgccccacctgtcggcctcctaacggctgcgcgcccaattaacgtccagatcaatcgaatcatccctcccctaaagcctaaaacctccccatccacgtcacccatcctcctccctaattactccccccatcccctcctcctccgccgccaagcacctcgcctcctccgccatggcgaccgccaccgcgtcgtccctctctctcctcttcgcccacccacactcgtccaaccccaggcccttcgccggcgggcctcacctccgccgcccgctgcgcgccgcgccccaccgcgcgcgatgcgcctccgacgccgccacgacggccacgaggcaccgccgccccgcggaggagaacatccgggaggaggccgcgcggctccgcggccccgggaacgacttctcggcgtggtacgtgccgttccccccgacgcccgaggacgaccccgacgagcgctactcgctggacgaggtggtctaccgctccagctccggggggctcctcgacgtgtgccacgacatggaggcgctcgcgcgcttcccgggctcctactggcgcgacctcttcgactcccgcgtggggcgcaccgcgtggccctacggctccggggtgtggtccaagaaggagttcgtgctcccggagatcgactccgaccacatcgtctccctcttcgagggcaactccaacctcttctgggcggagcgcctcggccgcgagcacctcggcgggatgaccgacctctgggttaagcactgcggcatctcgcacacgggctccttcaaggacctcggcatgacggtgctcgtcagccaggtgaaccgcctccgccgcgcgccgctctcacgccccatcaacggcgtcggctgcgcgtccacgggcgacacctccgccgcgctttccgcgtactgcgccgccgcaggtatccccgccatcgtgttcctccccgccgaccgcatctctctgcagcagctcatccagccaatcgccaacggcgccaccgtgctctcgctggacacggactttgacgggtgcatgcggctcatcagggaggtgaccgccgagctaccgatttaccttgccaactcgctgaactcccttcggcttgagggccagaagacggcagccatcgagatattgcagcagttcgattggcaggtgccggattgggtcattgttccaggaggcaatcttgggaatatctatgccttctacaaggggtttgagatgtgccgtgttcttgggcttgttgatcgtgtgccgcgtcttgtatgcgcacaagctgcaaacgcaaatccgttgtatcggttctacaagtcagggtggactgatttccagccacgtgtagccgaaactacatttgcatctgccatacagattggtgatccagtatctgtcgaccgtgcagtggtcgccctgaaggcaactgacggtattgttgaggaagctacggaggaagaactcatggatgcaatgtcacttgctgaccgcaccggaatgtttgcctgcccacacaccggggttgcacttgctgctttgttcaagcttcgagaccagcgcataatcgggcctaatgaccgcacagtggttgttagtacagcgcatgggcttaagttcacacaatcgaagatagactaccatgacaggaacatcaaggacatgctgtgccagtacgctaatccaccaatcaatgtgaaggctgactttgcttctgtgatggatgttctccagaacaagctgaatggtaagatctgagctttagttaaccccccatggccgttatcttgcttattgtcaccatgaactcctttttctgcatcttattcaactgcagttgatgaacttggtgtgtcacagtaatctttaatttgtagtactaggttttgaggctcttctaactatacacataagtggatagagctgttccttgtactttatatatgtatcatataatatgacaataagtggttatgccctagcacttaattgaataattgtttcgaatggatacctgtgactgcctttccgattgcttttactcactattgtctgtcaaattgtcaatgacaataagaaaccctctttggttgcatggtttgaagtctgaactgatagaatttattaaacatttcagttgctgcaaatcgctttagttttgttagtcaagaattcttttctgaaaagcataatataatccttgttctcaagacagcaagtgttatatagcaccgttgtaagtatataagaaaatagttttattagaactacatagcaatgttccatgttcagagtaaactataagtggatatcctaaatttagttcggttaaaactgtaaaatctctagtgtgctggacctatcactatttctgaatagattgtcatataggttgactgcagtaccacagtctttccatttagtagctttaagcctttaagctagattgtgttacaaactgaccaatcattctaggtggtttgaatatcctgtgacaacaaataaaatgtgagattgatctttttgagttattatcatcacggcataatgtttctagtatagcctttcagcttgattctgagttggagtttttataccctatgatattggataacattgagtttcgtctccctgtaacttactactactactacctctcttttttttatttggcgttggttagttcaaattgaaactaaccaacgtcatctaaataaaaatggagggagtaccatttagtgtttgcataactcttccttaatttggttgtttgtggcttccacttcagtttactgtgcctaaaacagtaaaggtaataatggtttcccatcagaaaccggatgctacgttcctcactggagactacattgcccccatagacccaatagttatccttgttacgtgtttatcactgcaagtttgctttgcatgtcttactcagaacataggcacattgtatattgtttcttaatcaagacacacaatcttgtataatactcacaactgtttgttctgctaaaagtcgaaggccttctcgtcagtctacagaacttcggtgagcatgatacgatggtagacttagtttatcttcgctgtgagtcgtgaactgcacaaggggaagcgaaatatttgctaaccaggtcaggtcctcgttgatctgaagccactgttattaccacataaaagtcaggtcctcgttggtctgaatccactttcctttcgcaaaacggttgtctgttgagggcacacaaggaggagatgcagttatctcaacaatgtccgtcacttgagctagagctatggagtcttctgctaaccctcttactgatagttgattccttcccttccctatgttaattgtcaaggcgaggaaccgaggaatgagttgttggactgaatccagcttcacaaattgtagaattctttagatttgggctatctgttccatgtcaccttagttctaaccagtcagacatattgtgggctttgacactttgaccatgttagtgggcttatactactagtactctataggaataagttcatcggaggtctcttaacttgtcagtgaatccgatttccgtccttcaaccattcaaccagaaaaccagatataaagggtccctcaactatcaaaaccggtgcaatataggtcattcaaccagaaaaccagatataaagggtccctcaactatcaaaaccggtgcaatataggtcctatggcggttttcactgacgtggtgcctacgtggctaatttgactcggttttcatatgacgtagctagtgacgtggcgcttacgcggtaatttttatttggaaaattgctatttgtggtcccacatgtcagttacaccaaaaaaattcattcaaaaatggtgggacccatatgggccccacatgtcattcttaccccctcctcttcttcctcctctctccccaactcccctctcctttgtcctctctccaggccgggcgaggctaggcggcgcgcggtagtcgggagaggagggcggtgcgaagcggccgggcagggcggcgcgcgacggccgggagaggtgggcgggcgcgcgacggccaggagaggcgggtggcgcgcggcggccgggcgaggtggggaggcacccatgaccccgctccgccgcagcacgtcacgcagatgcgcgccacgccacacgaaggttgagatggcgctggcagttgaagccgacggtctggcgcaccatgttctgctccttgtgttggttgcccgcgcaaaccaacgtgacggggaactccacggtcaagctgttccatggtggcgagcaatgagtcgtcgagcaacatcgacttgttcccatccaccggcgacaaccgtcggttgggctccaagaccgactccgacgacgatgacgacataccaccggactgaaggtagttgtaccactcgcgcctcgaggtggagcctcccgtcaatgacccatgcgacgaggccacctctgacgcagtgacgcgtgggtgcgtcggcacccggtgctcgtctggctcaccggcaagcacccctttaactccgagccgctgctgccgtgcctcatgcttgacggtttcatcacgccgacgccagtccactacgtgtgcaaccacggcgccgtgcccaaggcggactggtcgacaaggatcgtggaggtgaccgggctcgtcaagcgccccgcgaggctccaccggcgcggagccaacttttattcaaccgagtcagccattgttgccgaagaggggagagagaggagaggagatggggagaagggaaaaggaagacgagagtgttaaccattggacgagagtgttggggcctgcgtgggtcccatgctaactaagcttatcatgtcagctaaaaccagacgtaaatactgcctaggacctcatatgatccggttttgtaaattgtgagggactcgttatatctggtattttggtatagggacgaatttcagactcgacaataatttgagggacgactcgacaataatttgagggacccaaagtgaacttattcctaccatatattggttaggaataagtccactttgagtccctcaaaatatatgtataatctaactcgtatccccaaactgtaataccggatatcttaacccctcaactattaaaatcaatgtattttgactccctcagtggcttcaaagcagtttttacaaaggtgtcatgtttacctcggttgacttagcatatggaaccatttgtcagtcacccttctctttcttctcttcatttccttacccatatttcctcactctctcacccatatttcctcatgacggcaaaatggcagcatggcagcggcgagataatagggtggtccggcaacagagggtgggagttggggactccgttgttttggcacccagagacgggcacagtagccatcgagcggcagcaagttgagggagatgggtggcagtggcttgtgagcttgtctaacgctggggatccaacttccaaggagggcaaatgaaggtggcaacctgtagatctcgctgccctcgatcgacacctatagctccatgccgttgtcgcctcaaccagttgaacgagcttttccttccaaattagttgcataaacggatttctctcgatttcctctcctttccccccaagaaaaccccatcaatattgtgttaaatcccgtgaatttcggccccgttctaatcccgaagaactcaggatgaaccctagtttttcgccactgaatccatctgtttctagcccggtctctttctcctccacctatatatagcttgcctaaggtcccctcttccgattctaaccctagtccgagctcgtcccatgccctagccgcctccttgcgcactcttcgccgaaggccaccgctccagccgagccaaccgtgccaccacgtccgtcgtcatcactgtttggttcgtaagacgaaagagaatctcaactgcaccttcgcttcacttggacatcaccggagcgccgccgtcgacatcaacccgaggccaccgccttttcaagcttgttgccgcttgccgtcgtaattgcatcagtaaggatcgtcgtgttcccctcttctcgcttgtgccctcaatttccgctgtcgcaccttcgtttgccgtcacgcatggccaccgccgcgcaccaccaccaggcactgccactgtctacaagacactgacatatggggtccatgtgctaactcagctagttaacggggtcaaagatgccacattggacgaaaccacctcccaaaccgttcgaggagtcgatttgcaacggtcttatgagttggaggatgggttgtatcggttttgcggtagagcaaggtttacgattccgacaggcccttccgttccgggcatcggcggaattcggaatttcgcgaaatccggtggaaaatcggtaaattccgaacaaattttataaaccaaaatttgaatataaattccctaagttgccgacaagttctcgaaaatcggtcggttttggcgaaattctgatcgaaatcatcgaaatttcgatcattaatttgtaatagaggtaattttctgaatttttttttcattatgtaagttttagtaaatacacataatacatcttttttttcataaatttatatcccaataagttatatgaataccatagtatttataagattttattttattttttcttttttatcaatttaaatttaaatttagatgaaactcctcggaatctcaaacggtttctactttcgagcctcgttggaacgtcgaaatttcgcgaaatccgaccggatttcgtcggaatcgtaaaccctgaggttgagggatgcgattcaaccaggggcataagttgagggagtcaatgtagacttgttctctctggatatgacatattgtgggctttgaccatgctattgggcttgtagcaaagttgttacactttatacccttcaaacatgataccatgcaaatatagcagtatatcgagtaggctagctaaagtttatctgcccttgctcttataaagccataaagctgcctttgatttttatttttcttttccttttctgggcgagacttccactgaaaaagttcctatgggcctgtttggagaactatcccagggatattttttgggctaaagattatcccaccaaaatagccccctaacaaaatagccctcttgctgtttggatccaaaggctatttagctattattgtaccatcccaatcatttgcctccactaaaagtatacagcagccggatcttctatggctaatccaatacaggcacatacaagcatacacaattccttacaagcacaaacacataatttgtctcaaatatataagcaagtatgtaaaacaatcgtgtcacataaaagatacaattccatacaataatcgtctcacataaatatacaattacataaaacaattgtctcacataaatattaaaatccatacaacaattgtctcacataaatattaaagtccatacaacaattgtctcacataaatattaaagtcc

SEQ ID NO: 62866 - DNA, 4617 bp, Oryza sativa
  unsure (1)..(4617): unsure at all n locations
gaatgattgatagttaatgatacatcgttcatcgttataggttgatagaggattggtgattgatcgtatatatagatactcattagattgagtatggttctcttcgtcatactctctctaacattatgaatcgatgttggtcaatgacgaatagtatgattgatatacgtcattatctaggcggtatttgtataatgacatgtgcgtcgatcgtcatcatcgtcgatgtgatgttgtaatagtagttatgatatcgagctcgtagtatgtattcgtgagcgtgttttatgataatgtattatttatatgtggtagtattatattattttgacacgtgttttctcgttttttattttcaagcattccaatacgacgtaagtgatgttgcccggttccaactgccaggtcagcgaaacccgctcgcaaanctgccatgggagtcgggttgcccaggatttcaaagtttaggggtcaagatatctggttttgcggtttagggtcatgaattagattccgatcacttttgagggtcatgaagtgaacttattcaaactggtcatcccccgcccaggcaggccgcgtccgtgacgtaccactcttggcgcctgcgctcacgcaggccgacgcggcagtcgttctccatgtatggagtacgggaccctcatcccgctaggccggcggatgcggccgcctcctcgtcacccgcgcggccgtgctcggcgcaacgtacgcgcacacgcagtggccactgctcggccaatgcccaggcccaagtgctcaactcctgccgcttcacacgccgacgatggcgacgagccgacgacgaggatgatcgaagagcaagggcgccaccgcgccagcgacagtggtagtatcaacatgtgctatgacggtgagtgaagccagatccattgccattccagatgacaaacaagttagaagtcggccctcgaaatcccgacgcgtactgtgcatatgatctagccgcgctggacggcaggggtggctccagcagaattttggcccaggagcgccccccccccccccgacggcccacacaaaaaaaagagcccaccaaatgtgttagggttagctcagctggcagaggagaggcgcacgtaggcggcagacgctcggctctccaatcctccccaaatcgtgccgcctctcggtctcccgtcgccgtctcccgctcctctcgctctcccgtcagtcggccagcgctgctgcgccggaggccatcgcctggccacctgctgcccctcccaccctcgcctgacgcctgcagccgccgcccgtcgaccgccacagcccgggcctggcgcagcactcggcagcactccggccggcggcggccagctgatgaccccgccacaccgcacggcggcggcgggtttgcggcgcgacggctgatccctcctgctggccgagactgacgagccggcgagccgccctgcccccggccggccggcccctgcctgccgactgcctactgcctgtctgcctagtgcattggcaatttggcatatgtgagtcactcatttagtcattcgtagtcttttgtatttcttttgaatagaccggtcattgtgatggtgaatgaaaaatatgaatgaaaaaatgtgaataaaaactgaactttagattttttttaagcaacaacttagttagtagtcaatacgacttagtttctcattaatttgtggtgtaaattgcagtggcacgtgaaaaggaatagagacattgtaagatatttgaattatttatgttgtaataacttccgtaacttcgaacttaaatgttggttttaattaatttgtaatgttctgagctatattgcaatatttgaattatattaccactgtatttgataattttgacttgattttataacattatgacaatttggcacgccaagtaggaccacccaacgaattgatcctggagccgccgctgctgacgcggtaccgtacgccgccggccgcgtacgttgcacccgtaacacgtcaagacaagcagacagcggcggcgtccgaccgacggcatattaccgggccccccttgcagacgacggatggagagatcgttcacgtggcgcacgcgagcagtgcctcctcccacgggcggctgtgctgtcgatcgagcgggctgggcaggggcaaccctgtggtgtccgactgtccgagccacgtgcaacggcgccctccgcccccgtcgtccccgtgaccctccggccgggcacccagcgcgccacgcatggacatgccgatgcgtccatggccgcctcctctcctcgccacgcgtggccagagcggcacggcggcgggtgggcgggcgggggaagttcgctgtctcaggtgccgaggagacaacgaggcgacaacgtgcatgacgtacgcgttcctctctctgcacagaaggcactactgttccaccctacggccggaggacaataatgttgagagtggattttaaactataggtcattccttcgttatttgtatatttgagttatgagaaaatttaaaatatgtattaatatatgatatatcactccacaaatatgaaagttaaaattcaatttccacaattcacaacgaaaaaaacaaattagactacaactatttaatgtgtattcaaaaataaatttcttttttcgttgcaatacttaaaagttaagtttaattttgcatgcttgcggagtgatttattacatgttaatatattttttagaattttttacataacaatttaagtaacacgtaaacaacgagtgacacgttcactcgagagttaatagtttcccaataatgtccttccgcgctagcatcatatggaaacaagcgcagagctgtttgtccgtctacgctgctgatctactccaaagatcatcttttctaccggtgttcttgcacctattgaatgcagtttcagacgctgggaagaaatgatatgtttcaccagcaattctgcagaattcctgtagcttccatgttctcaacagagcctagctaagcacctaatcattttttttaagatcaacggatctgaaagacttattataacacgtggaggattcactctgacaactcgacagaaaaagacgctgcatttgcgagttgcgacacgagcagttaggctgagcgcatctaccccgtgtaccaaaacaacgagaattcatcgttacatcgtcgtgttgtcgtgacaagacgtatagccaccaaagcaatacgttcccaacacatacacaccatgacactactgtaaatttgactgctaagatgttaatcaagagtacattaaaggatgttgataatgaaaatacgactggaagggcggccaggacaaggttcacatgcctgctacaacaaatttcgcttcggtgaagcagcatcgtcgtttttcttttctttgagaggccagcatcatcgttgagcctgcacgtatccactttatcttttgaacctaataatgcacagataaacaggttacgacctgcccagaaaagtatatacgtacaaacgaaggcgatgcgactaatattaggagtgcgacatttcagtaatcaacctaaacaaggttgttgcgttagaaaccaggtgtctgacatttctagtatatatcacacatattaggcatgtaccaacctttaaagacatcatcatgtaaagacttatataaaacaaaatcattgaaatttatactgtcgtaaaaggataagctaatgtgatggtgatatgcccccactccttcactaaaggtagataagcttgtgttgtgttctttgtaatgtgcatatgtagatggctaattgaccgcatgtgatcaagtatacaatttttagatatgggaataacttttcttttgcattttcatttggatcttatagcatgtttatttgtcatccatcgtgcgtcttcacacaggaaaaacaaaactgtactagctaattcaggctatgggaacctgctcctgcctttaccttcaacacagttgcagtcatgtgaactacggtttcctatatttttacctaggaaactggtaggcatcaaaaaaatcatattatctttcttattctttcacgaggtagtacactgttgaagatactatgggtctgggcaaatctcaaaatttcaataacataccaagctaaacaagccaatccaaaaggaaggagaggtctacaaaaattatccacacaagcagcaacctagtcctgaactccatactgtttccttctatttgccttctcccaccttctttctccttctctactcccatgcatctactattgttcttttagtcctctttccatcaggcatcagcattgaagatggacattgaatcagtgaggtgtgcgtgctgtggcctggaagaggattgcacccaggaatacatagagaatgtcaaggcaaacttcggagggaaatggctttgtggcttatgctcagaggcggtaggggatgagctcagtaaagacagaagagaacaggatggcatcgaagatgctatcaaagctcatatggcattctgcaggatggcactatcaagccctgcagtcaaggtggcggatggcatgaaggagatgctcagaaagaggtcaaaggataaggtaaa

SEQ ID NO: 62867 - DNA, 589 bp, Oryza sativa
ataaatgcccgggtcgttttgccgttgcccgtccagcacgttagccaccacatacaccgcccagcgcgcctgcacaacgtgcggatgttcgcccggtacatgcccgagccacactacataggcggcaggcggattgcgcacaatatggcgcacggcggaatcgtcccaatgtccggggtgcgtgccgacttcgcgcaactggtcgccgcatagctcacggattcgcgcttgtagggcttcactggttttcgcaatgttgctcatcagatataccccgtagatttatcacgcgcccacaccgagcctgcggattcgattatcgccacattgtcaccctcgacggtctcgccgctttcggcaatgccgagcgagattgtcccgttcgccactttctcaagataacgtaagctatcttcataatcgcggcgcgcctgatccgtggcgcggtttttttccaaaaaatagcgggcaatgtagcaacaatggcgttctaacaccgcaggcacgtttttaatcggcaagctataacgaccggcaagatagctatcaatggtctgcgacgcgtcctctaacgcctcttggatttttg

SEQ ID NO: 62868 - DNA, 662 bp, Oryza sativa
tcacaatcagtatcgaaatattcaattaagtaataaaagtttatatcccaattcatttattaatattgacggtatggcgggtagattagaatcgaaatgcctttatttacgtttaaatcaggagaatgaaatattacagctagatcaatgggggcgaatttatgttataccgaaaactaaacggagtaattgtaagcagacagaaagcctttagtttaattgaattattattagccttaacattatccgttttattgttatttccactatcaaccttatacaccaatttttatcgaaatagcgttaaacaacaagaattactttttctgcaaaaagaaagtcatcaactacttaattatcttaaacaacatagccaacatatcggctatcaaggtgtgaatcggcagggaagcaatttttcattattttcacagcaagataaacgatacaaaatagcgaataatcagcagtgtttaatctttttttatgatttaaatggcgatggttgtttaggtaaaagaaccactaagaaatcggcgtgtgttaaacaaaataaaaatactagcaaagaattagtaaaagaagtctttggtattaaagtcgaaaataaacagctttatatttttgataaaaataaattagagcattgtattggatcacaa

SEQ ID NO: 62869 - DNA, 44763 bp, Oryza sativa
acccgatagttggcctggttgttttttgttgggggggggggggggggggcgaggggcggaggtcagtacatggttcaaaagcactatggagttgcctttacattttaaaacaaacaccgtcactagctttagatgacgcgatgtggatgtaggtcgttgaagcgatggtaaatcaacctatggcataactgcttgcggtatttcatggtgtctctctggggaaaaaaatgaaacaatatgagaaccaatgagcatttctctagagatggaacaaacaaccgatttttggtagcaaaaaaaccagtaccgtcgtatatccaacaagactcctgccactgtgacactcgagcatcctcataacacagaacccgcagtcgtgtctacataaaaaatgaaagtgtgaagtaaaaaaaaaacatgtacagaaaaggatgtgactgtgagtgagataaatcaaaaaaaaattgttgatacttacaatgtatcttggtgaggcgattcaggatactcaactatgaagatgtcaccaaatccaaaagggctactgtttgttcgtgtgtcaagggcaacatggagattgctactctgaaaaacatatggaagaaagaatgaaaagaaaaagaatgatacctagtaaaaatacaatgaaaaagaggaatagtaaaaaaaaaaagcttaatcacaaagaagacaattgaaaaaaatatgatacctccgtttcagtttccatcttcttccttttgttgctgccacttatggcatttgatttatctggtaggaatttgttaacgaccaaatttggtagtgtcagcatcggagaagaaggttagatcgaagtggagtccaggacgaagatcgttgcggaaacagagaaagaatcggctgtatccaacggatacggtcaggatcgacagagtttgagtcggacggggttagccaatatagccgattccgataatacgacttggtgtgcgatatcgggttgagttaatgtgcttcatggtgattgccacgcaaggatagagtcctgagaaggcaattatatctattaattaggatattttatgtaatttccttagagatatgtttgggcaaaagtctgccgtaaagacttatggtattttagagtttgttagagataatagtcatgtccggtatggacacatcttagaattctcgggtataaatagaccccgagcctcatgtaaaaaaaaaacagacgttcaatacaatctcggcgcatcgccatcctttttgctttagttttattttgacaagttcttgctttcgggttgagctgcatcggtttcgatcttcaacaagaggtaaaacttgttatggcggtttgcattctcgggattggtgcttccatcttcatgacactctaatcttgtttatgtaattcgtcgagttatcatatatcttacataatttttagcaatatcgttatctaacctacaattggctaacatctgttggtagaggacagccgattaggttaaatatcgatgttgattcaaattatatcggatatccaccactctatgaaactttcagcggtttgattgtctagatattgttcttcttttcatacttaatgctgcatcagttgagtttgatctattaagtcgtgtttagaatatcaatctctagcctgccttctggttgcctattagggtagtatcggggtttcagccgatcttacctgatttaactacttttattccatatgcttgattgatatgttaaatgtgccctttatgttaagatcttgttgcatttaagtatattaggcttctgtttgatatatttttcttactttaatatattgatatagagtggtatcggagtattagccgatacacgctagatctatttgatcggctatgctataaacatatatatagtcccattattagtatatatttcgatataaatgatttatactgtctcggcatggcgtccgatctatctcaatcacttgatttaagtatatatcgatatagggaatatatatattgttaatatctacagccgatcgagtagatttagtttcttcttatttattcatgattgccgatcgatacatatatgacatcggctcaaagataaatgatatgtcatcggcacctagccgatcgactatcgtttataggattaattgtggtttctttgtctttatttcttgttgattgcaggatcaaatcaactggcacgctcacacgtccgaaggcgagttttggacctgcactaaagttaagcagatctcccaggcctcgtgttttctgtcaacacgcttttggcacgcccggtgagactgattagaagtcagaaaacaaccttcctcatggccgagaagctgccgctgtcgccatcctcggctagtccaggttctgttaaggagaaaatccagatgctgggcctcagatacatcaatgaagggaacgttgtgactgttgatccggaaaagttcacacctgatcaaaagaaggacttcgaagcaatgatgcaacaagcgcgggatcaattcttaaaatcattcacgcagactcgcaaaggaacattggttcagaagtataagataaaggtagttcctgatgagcctgagaccagtatttctaaggaatgagaagggaagagaggctcagaatcggctcaaccaagtgacaaaggtgctaccgacggctcggctcaagagaatcagggtgaaaactctcaaggggtacatggagttcaaggtgatggtgttcatgggccacaaggaggaaatcttaatcaagacggcgagacagtgcaggatttcttcaacaatttccaagatcgggttgattatgttgtgcacaatgctttgatcaatcagtctggggtattagtcaataccttgtcaaacatgatgaaatcaatagccgatggatcaataaccgagcatcaggctgcaggcccggtttatttgcaagggggtgtcttcccaaattatcggcctttgatcactggtgctcaactgtctgcccaaccagttcctcccattgcaccttcagctcagccgacggtaccgccgttgactcctttacctgctccagcagcattggcaccaggccagccgattaatcctcggctgttgatgagggagcagccatagcatagtgggcaggtgacaaatcggctgacacaagaccaggttgctgctatgtttttaccccctcaacctactgttgatccggtccagcaacagccgattcaacaaacgccgtctagacagcaaactatccagccgattcaccagcaaggcttgatgaatcaatcggccggacaattggctagacacgtcctgaatcaggttgttccagagggtttggttcaccatatgcagccagatcatacggtaatgccccagattgtacctgagcacttggtgcaaaatattcaaccgaattaccagaactaccaagggggcaatttgaattatcaatatcgacctccttccccgcaagcccaatatcagcaaggggggctaactcaacctcagttcactcctcagtgtaatcagttcgagccaatgcagcaacaatcgcaaggagcagctcagcaacgaccatgggccgatgtgattgctgacgtgatgagggaacagttcgggcttaaaccaaaagatactggaaacttatatcggcaaccttaccctgagtggtttgaaagagttcctcttcctatccgatttaaagttccagatttctccaagttttcgggacaagatggtgtatcaacttatgaacacattagctgatttctagctcaatgtggtgaagcatcggctgtagacgctctgagagttaggttgttccggttgtccttgtctggatcggcttttacttggttttcttctttgccgtatgggtcaatcaacagttgggtcgacttggagaaacaatttcacagctatttctacagcggagttcatgagatgaaattatccgatttgacagtgattaagcaaaggcataatgaacctgtgcatgagtatattcagagattcaaggagatgaggaataagtgcttcagcttaagtttgactgatgcccaattagccgatttagcctttcagggcatgattggtctgattagggagaaattctcatctgaagactttgatagcttgtcacatcttatacagaaggtaacattgcacgaacagaggtttgcggaagctaggaagagctctaagagggttaatcatgtgtgtccttacatgtatgggtcggatgacgatgatgatgactctgaaatagctgcagccgaatgggtaaggagtaaaaaggttataccgtgccaatgggtaaagaattctgggaaagaagagaggtatgattttgatattaccaaggctgacaaaatttttgatctgctgcttcgagaaaagcaaatccatcttcctcctggtcatacgattccatcggctgaggagttaggcaaaaagaggtattgcaaatggcataattctggatctcattctactaacgattgcaaagttttcagacagcagattcaggtggctattgagggaggcaagattaagtttgatgattccaagcggccgatgaaggttgatggccgaacagccgatgctagacgtacgagaggttttcagatgaattcggccaaggttataaataagtatcagaggaaatatgacaagcaacaagagagatgttataaagaggatgatggtagttttgatcctcattggggctgtgagttctttaggttctgctagaacgagggtatgaggttaccaactatcgaggattgtcctggatgcggtgatgttgcggaaagttcgagccgatcatacaatggaaacaatcggctgaagcaaacaagagtccctgttcatcaaagattgggcccagtaaaccaacatagttacttggaggatgatgaagataggaagactcagtggtgtccttctggtatttttacaaagaatcagaagagaagggttcaaaggttggggaatagggaacgctttcaggaggtcgagcaagaaattaatcatcggctgaggaaggcaaaaccgaagcaggagtggcatgttaagggtcaagctcctggggccaatgatgtcgcagccgatgatgcaaagaggttggcaaaagggaagagtgtggtaacagcgtcaattaacatggtttttaccttgccggccgaattttggatcgatcaagccgatgtcgacgaggtggaagaggaatcggctaagttggttctattgccagaacaggcagtctttgaaaagcctagggggacagagaatcgacaccttaaaccattatatataaatggctatgtcaatgggaagctgatgtctaagatgatggtcgatggtggggctgcggtaaatttgatgccttatactaccgttcaggaaattgggtagaaatgccgaggatctcatcaagacaaacatggtgctcaaagattttggtggcaatccattagaaacaaagggtgttctaaacatggaactgacagtcagcagtaaaacaattcctaccacattttttgtcatcgatgggaaatgttcttacagcttgttgcttggaagggattggattcatgccaattgttgcattccttcgaccatgcatccatgcttgattcaatggcaaggcgacaagattgagattgtgccagccgacaggtcagttaatgttgccagtgctgatttagctctttgggagatggatggccttgattgtttatctggaaaggtttgggatggagattttctaaaagtgtccgattctgatatacaaccaattaaagatggagaacccaacctattactttgagggcgtcgtggagggttcaaacgtctacaccaaggatacagtagatgatctcaatgacaagcaaggtcaaggtttcatgtcggctgatgatttagaagaaatagatataggtccgggtgatcgaccaaggtagacatttattagtaagaatttatcttcagaatttagaaccaagctgatagagtttttgaaagagtttaaagactgcttcgtttgggaatattatgagatgctaggactcagccgatcaatcgttgaacatcggctacctctcaaaccaggggttagaccgcactagcagcccctgagaagatgcaaagccgatatgcttgaacctgtcaaggctgaaatcaaacgtttgtatgatgctggttttattcgtccttgccgatatgctgagtgggtttctagtatagtttctgttatcaagaaaaatggtaaggtgagggtatgcattgattttagagatttgaataaagctaccccaaaggacgaatatccaatgctagtggccgatcagttggttgatgctgcttcaggacataagatattaagttttatggatggaaacgcggggtataatcagattttcatggctgaagaagatatccataagacagctttcaggtgtcctggtgcgatcggcttgtttgaatgggttgtaatgactttcggcttgaagagtgctggagctacgtaccaaagggccatgaattatatatatcatgatttgatcggctggttggttgaagtctacattgatgatgtggttgttaaatctaaagaaatagaggatcacatagccgatttgagaaaagttttcgagaggaccaggaaatacggcttgaagatgaatccgacaaagtgtgcttttggtgtatcggctggccagttcttgggatttcttgttcataagagggggattgagattgctcagaggagtattaatgctattcaaaagattcaacctccagaggacaagaagttacaggagttgatcggcaagataaatttcgtcaggaggtttatttctaatttatttggaagattagagccttttacaccattattaagattgaaggccaatcagcaatttacttggggggcagaacaacagaaagctttggataatatcaaggaatatcttagttccccaccagttttaattcctccacaaaaagggatacctttcaggttatacttatcggttggtgacaagtcaattggttcggtgttgattcaagagcttgaaggaaaagagagggcagtgttctatttaagttgtcggctcttggatgcagaaacaaggtattctcctgtggaaaaattgtgcttgtgtttgtatttcttttgcactaagttcaggcattacctattgtccaatgaatgcactgtggtatgtaaagccgatgtgatcaagtacatgctatcggctccgattttaaaagggagagttggtaagtggatattttccttaacggagtttgatcttcggtacgagtcaccaaaggcgattaagggataggctatagccgattttattgtggatcatcgtgatggttcaatcggcttggttgacattatgccttggacattattctttgatggatctatatgcactcatggttgtggtattggcttggttataatttcgccttggggggcaagttttgagtttgcctatactattaaacattatgtaactaatgatcaggctgagtatgaagcagttttaaaagggttacagttgctttaggaagttgaagccgatgctattgaaattatgggtgattcgttgttggtgatcagtcaattggcaggagagtatgaatgcaaggacgatcattgatgatttaccacagaaaatgctgaaagttgatgaatgagtttcggctagtaactttgaagcacatatctcgagatcagaatatagaggctaatgacttggctcaaggagcgtcaggatacaagccgatgacaaaagatattgagatagagattgctacggttacagccgatgattggagatatgatgtgtttcaatacttacaaaatccatctcaatcggcttcgcggaaattgcgttataaggctttgaaatacaccttgttggatgatgagctctattatcggacgattgatggggtgttgcttaaatgtttgagtgccgattaggcaaaagttgcaatcggcgaagttatgtggcactcatcagtcggctcataaaatgaagtggttgcttcgacgtgccgggtattttttgctgacgatgctcgaggattgtttcagatattataaaggttgtcaagattgtcagaagtttggagcgatgcagagagcgccggcatcggctatgaatcctattataaaaccatggccttttagaggttggggaattgatatgatcggcatgattaatccaccatcgagcaaaggtcacaagtttatattggtggcaacagattattttaccaagtgggtagaggcgattcctttaaagaaagttgattctggggatgctatacagtttgttgaagagcatataatctatcgatttggtatccctcaaactattacgaccgaccagggttcgattttcgtatctgatgagtttgttcagtttgccgatagcatgggaattaaattgttgaattcttcaccatattatgcacaagctaatgggcaagccgaggcatctaataagagcttgatcaagttgattaagaggaaaatttctgattttcctcggcaatggcatactcggttagctgaggcgttatggtcttatcggatggcttgtcatggatcgatacaggtttctccttataaacttgtttatggtcatgaggccgttttgccatgggaggttagaatcggctcaagaagaacggagctgcaagttactttaacagccgatgagtattataaccttatggccgatgaaagggaggatctggttcaatcacggttacgagctcttgcaaaagttacttaggataaggagcgagttgcccggcattataataagaaagtagtgcccaaagatttttcggaaggtgaactcgtatggaagttgattttgccgattgggactcgagatagcaaattcggcaagtggtcgccgaattgggaagaaccgttccagattcataaggtggtatctaagggagcttacatgttgcgaggactcgatggagaagtttatggcagagcactaaatggcaaatacttgaagaaatattaccctagtgtttgtgttaacgcatgatcggctgatgttgccgatacatgatagccgatgtgtttacatcgccttgagatggccgatatggttatatcgcccttagttttttttattgtaatcggttgcaggttgccgatgtgcaatggccgatatggttatattgcccttagtcgtttttataattttatcaatgttttggacattttaaaattaggggggcacatacatggaaaatcgcaaatttttaagcgtatttgggaaatatgttaatcggcacaaggattatacagacaacaaagttactagggtatcttagccgattacaaaagttttctaaagtttgttacatagaaagtcactgagacaaatatcgctggatagccgatatagccctttgtctaatctgttctacttcttctatggcttgggaatcttgagcgtcggttacagggatgactctcaaggatttggtcatatcagcgacgttcttgatagccgatttcagctttgccttctgttcttcgacagcttgcgggagatcggctagtttcttgtgctccatatccagctcagcattgcattcttggagttgtgccatgagatcaatcttacgagcttcaagccgatcgatatttgatttgatcgggccctcagacaactgatcaagtttggatttctctgcatgcacaagctgccgattgtgctggattgtagcttcgatgtttttgcgctcccggcgatcggctaacctctgcctggccttctccagcttgaattggtgttgctcaagatagacggctagagtaagggcatcggctaaattatctggaaggagagcttggatatctgtgaatcttacccggatcgagccacagttggtcaccaggttatctagtgttgcttctagccgattagagatatcctcaagagttctcttcacattatcagacagaggagctgttgccttgctggtggtgtcttcttccgtttcatcgaggtaatctttgatgtcgaaggagaacagatcggctaaaacctgcaaaagataatatcatggatggttaaggatcaagacatgattggccgatctcaaatttatgtcaacaaaacttactggaatagcaggagtagctggttgttcttcctcttcaacatgatgactgtctgcagccgatggggtgcggtcgcctgattcgatctgcacaagaggtgaagaagaaggaggaggctgcaaaagggacaaatgttagacataattggcccagatcagttaatgagatgattgagagcatcttactggtggaaccggtttaggagttggcgcagccgatttcttcttcatagcagttttctttttctgtaattactaaaactgtgaggaatcggccataaggtaaaacgattacaaaaggagtcaaagaaagctgcttactcttaagaagtggactggggcagaagcagttggaggggtctacttgggtgaagccgatggtgttttttctgtgtcacttatttcggctgcagcttgatcgacatcatctccaattacttcttcatccagagcttgttcgatggatggatctagagcaggcagatcgtcagctggtgtggtcttcttcggcttaattttcttctttaaagctgggactaaagtatcctcagccgatgatctggttttccgcttcttgccggcatcggctagttctctgataagccctcggagaagcgctgaagtcttgggggcgttgtagccgatgacggaaggagatggcgcacctccatttggaattagacctggcgcatatttaatgaccttgccactgttactttggtgaggaggagaggattctgttgtctgcagatcagaagaaaaggttagtcaaggttcaaatcggttaccagtcattcaagcaagattgataaagtgaagatttacctgaggaatggcatcggggaacaggtctgtcatatacatggaagccgattgatggaacaaatgcagcttccattcactccaccatctgtcaaatgcccggttcctggaccttgccaactctatgttctcaatgcttccaagttggggtcctgggatgttcagcaaccgatccattattaaggttgaagagatgtcacctctacactggatcttgtcagcaaagtacaggccgattggcagctgtcccattccaaattgtctagccgaagtcattgggtgataaaactcgtaggagacctgaatatttcttccttgatggatgccaacagggagaatacatgggctgatagcagtagtgaaaacttctctagattgctgaaatttttcatgattaatgtcttcaaatctaaaatcggctggtagttcaaaatccattgagtcagcatagaagaaccaaactcgggcatccttttgaaatccatcataaaaactgaagaaccaatccttcagaagttcagccgatagcttcgctcccgcatcggctggcgtagatgcatattctccgtatgacatgcatctacgatgagtgtgttcttctccatcatcttccatgatcggctccaaccttggaaattcggcttctatcacaaatgaccgattgacaactttcatgactaccaagttcagccaagtttgcagtaaccaccatggtccacctgccccaactactgagccgacgatcactttagctgatgcattattcaacatttgatataggtagccgaggaggattttgcccaagggaaattgtttcttcgattctagggcctcggctaagaattaccaattggttgtaggaccatagcttaacccgcagaagaggaatttttccaaccacatcaacaggaaggccacatgttctctaggggtaactggtcctttgcccatatatgctgcaatatatcctgaccagcctccaatgcttttagtcttgaactcgaaggtgttcttggtattcaagttcatggggttagccgacgaggtcacatctaagccagtgagcatgatgatatccagtagagttagggccatcggcccttggttgaagaggaaggcattgagggtgttggaccaaaaataagtagcagcagctatcaggggttcatctttggccgagtttgctattgtaagggctagggcttggccgattccaatctcatcccaatgggcttgcttgttagccgacatccgtttgtaccatacaggccagcttttctcaagagaaggccaggatttaaaagtatttttccaatgacttatatttggattggccgacctaaaaggggttctattggtttcggctatgatgaattcagtgggatcaagattgccgattggaccaagaaagtattgttgatcgtgcaacaaactgggaaccgcaacaagattggaaagatgctacaagtacagaagaagtagagaagaagaaaacaagatgagatgaggaaaatcaatctactgtgtaggaaaagggcatctagccaatggatacatacctctgcgtactcggctgatggtgtagcagacgggctggttgatggcgcagcggacgggtcggcggaagtcgacattgccgcgggtggagatttggccgaggaggaaatcgccttgcgcgtcgggggaatcgccggagagagagaggacggaattcgcttaagcggtgaaaacggaagtcacggtgtgaagattctcgggggcaacggttggtatttaaagcactgtgtaacggtcagaaaacagcaagtgcgatatttactcatagtcgatgtatgtcaaatccgaaacattaccaaatattccggacttggggggcatgtgttaacgaccaaatttggttcaaaagcactatggagttgcctttacattttaaaacaaacaccatcactagctttagatgacgcgatgtggatgtaggtcgttgaagcgatggtaaatcaacctatggcataactgcttgcggtatttcatggtgtctctctggggaaaaaatgaaacaatatgagaaccaatgagcatttctctagagatggaacaaacaaccgatttttggtagcaaaaaaaccagtaccgtcgtatatccaacaagactcctgccattgtgacactcgagcatcctcataacacagaacccgcagtcgtgtctacataaaaaaatgaaggtgtgaagtaaaaaaaaacatgtacagaaaaggatgtgactgtgagtgagataaatcaaaaaaaaattgttgatacttacaatgtatcttggtgaggcgattcaggatactcaactatgaagatgtcaccaaatccaaaagggctactgtttgttcgtgtgtcaagggcaacatggagattgctactctgaaaaacatatggaagaaagaatgaaaagaaaaagaatgatacctagtaaaaatacaatgaaaaagaggaatagtaaaaaaaaaagcttaatcacaaattatctaacataatttttagcaatatcgttatctaacctacaattggctaacataagttggtagaggacagccgattaggttaaatatcgatgttgattcaaattatatcggatatccaccactctatgaaactttcagcggcttgattgtctagatattgttcttcttttcatacttaatgctgcatcagttgagtttgatctattaagtcgtgtttagaatatcaatctctagcctgtcttctggttgctgattagggtagtatcggggtttcagccgatcttacctgatttaactacttttattccatatgcttgattgatatgttaaatctgtcctttatgttaagatcttgttgcatttaagtatattaggcttctgtttgatatatttttcttactttaatatattgatatagagtggtatcggagtattagccgatacacgctagatctatttgatcggctatgctataaacatatatatagtcccattattagtatatatttcgatataaatgatttatactgtctcggcatggcgtccgatctatctcaatcacttgatttaagtatatatcgatatagggaatatatatattgttaatatctacagccgatcgagtagatttagtttcttcttatttattcatgattgccgatcgatacatatatgacatcggctcaaagataaatgatatgtcatcggcacctagccgatcagctatcgtttataggattaattgtggtttctttgtctttatttcttgttgattgcaggatcaaatcaactggcacgctcacacatccgaaggcgagttttggacctgcactggagttaagcagatctcccaggcctcgtgttttctgtcaacagaatttaagcttggtacaaggtttcgagttacatttcttcctctgttctccagcattacattggttggatttcttaacccgtggtgagcgacttggaccactaggcgcaaaatgtacaaaatctgaattatctgaatatgtagccatatagactctgtgcaccaaaacaaataaaggaaaacatgacaattagtccgctttcaatcattgttactctatccctgtaatgtcagatttatagtgatgcatgttgcaaaatcaagttaaaaaaaatcagtagatgccattcctcccatggtatcaacaaaaaaaatgtctatttatcactatacagagtaatagaaggtacatttatcgcttcatttcaatagcttcctctagtgcaatgcttcagagtagtatatattgtgtgcaagatatatgtttatagtacactagtatccccgggaccatgtaaactgggcaaaaatattggcctgtcagataaattttggtgaaaccaatactagtaagcagtgagtagatgcagttcatgcatctcatctcccctcttatcaaaccagaaaaatcaaaacacaatgtatgtctgtaatctacctgatacctagtacaataaagtagtgcatcttaggtatcaaccccttctaataaaaattgctggaaacaaaatgtatgtgtgtccatattgtactagcgcatcacaaaaaatagattccaaccacaaacaaaaaagtttcatgagatgagtaactaacctgttaattttaacagctcaggtatcaaacatgactccccccatccgcttcagcctcactacctgtaaaccctagaacacaaatgtagatagggagctgaatcagtaagttgcaaagttggggtgcgagaagacataggaaatgggacttagaaattaagatgaatcagatacctgcagttttgagtctgctgcacgagaggggattgcgcgtgaaggatctcgccaccgatgcagcgccatcagcgtggggagaggggagaaatcagccagagcacgatgggtaccagcggaaagaaacgaagggaaccgaacgatgatgcagccctgccggcgtggaggatggaggaatcggccaaagtggagtgcgccgagtggaggagccgattccgatcggaggaaggatgtgatgggagcggcgccgcagcaccgccggcgtgggggattgagggaggaagaggagcggcggcacaggctcgccggtgtggggaggcggagggagggaggggagtggctgcgcacgccggcgagcgctgtgaacaaggttgtcggtatcccgatacgtatcctagtatcttacgatactacgatcctaccaagtcgaaacgataccgatcccacatagtatcctaattttcatagtatctcgatcctactattcattagtatatgatcctacaaaattttaggtggtatcctgattctacgatccctatgatactataaaatattatttaaaataacatggtatgaaaataatgtaaataaatatgttcaaatttatataaaatcagttaaatatatcaaaaccaacgtggtttctcttaataaatgcctctgtttgcatgatatatatcattactacatttttttatatagaatggctacatataattaatataaatattaattaaacttaaaaaagaaaatcttatagtacccgatactacgatacgactctacgatacgatattactttgagtaaaacgatactaactagtatcccgatcctgacaaccttggctgtgaattgaggggaaaaagcacagagagaggaaggaagctgtgagctgcaagctgtaagccgtggcggagaaaacgttttggacgccgtgcgatagattttctgttgaaggatatatacatgctatcttaggcattttacaatgcacctcgatatatttttcagtaggacacactaaggatgtgtttggttgctcgcatccttctagcctggcccatctcccagattcgggctgagcttagcctggttaaggacatacacatgcaggtatttgtttgtctgattggaactaaactggatatggctagatattgtttggttggttgcattgaagatactggatgtagaagattttgtttggtaggtagtatgaacttccagtgcagtcacctttttatttgatagggtgagattaccccccacaatatcatatatattaaaaaactatactaatatctaatttaagcaattagttatattttgaccacataataaaaaagtgcatttactagactttaagcacggtatacattatttttttctgaagactacagtaattcacttggatatacagagccggtgaattaaaaaaaaggggaaaagaaaaggggaaaaaaaaaagagaaaacactaagcttcgtggtctcggtgagctcgcggcggtgcaaaaatagaaaagaaaatgaaaaaaaaacaaaaaagaaagcacgaagcttcgtggtctgggcgagctcacggcggccgtgaactcgggaccgccggatctggctgcctggccgctggagggaaaacggatggtgttggtgaggggatggatggcgatggcgaggaggggattaagggcgacagtgcgacacagaggaagaaagggagcgcaatggcggcgacggtggcacgctgttggccaccaaatctggcaaagaagagaggaggaggaagacgatggcggcgcgctgttgaccgccgaatctgactgtggagattatggataccccatacctacacggcatgtatagtccgactgggtatggagtgccatgtatagatagaatttctttaggaagactcgggttaaattctaaacttgtgtatcaaggaaatacccgagatcctagtcggttacgattgtattttatctgtaactatatatttcgttagggatatggactgtattttgtaatacggacccctttccctatttaaggaggggtccgggtgcctctaggggcataactttctcccagatcatactatcaataacacactcggtggatcaatcctcggacaggagtagggtattacttcttaaataagaaggcctgaacctgtataaaattccttgtctcttaacccatccacttttccagcttgatagccactcccttttagtattgccgaaatcttgtttcgacagttggcgcgccaggtaggggtagcgtcaagttttttgccgactagtgcgatgggtttcgtctccggcatcgacgacttcgtcttcccttccgggtaggcgttccggttcggcagcctcgacttcatcaccaacgacttcggcaagatttctctcctcgactcggatccaaaccaatcgggaagaggccaggtctccgccccgttcggtgtcccaaactcggccgagatctaccccaagatcatctcgatcgagtcggcttcaatccactcggacgagatccaatctactccaacacgacctgatcaagacgatgggtcctatccctcaatcttaatgagacttcccgatgatctggctgctgtcttcacgaccaaggcgtttcccacccgaagacctagatgggatccagcttcggctccgatccgatctagctctagggaggtcggcgttatactccaacctctcgggacggtctcgacggaagaattggacagctacctcagctccctcggtgtcagttctcgaccaacagagatcctcgagtacgacgacttcggctatcgttacgactacactaacttcgacgaaagctacgaggacaactacacgcctctcttcttcggtgtattcatggccgacaacgagacggcagaacagcgccgagcccgagaagcagaagaagaacgcacgcgacaagaagctgaacgtcgccgactggaggaagaacgacaacgacaagaacaagaacgactgcagcgtgaacaacaagatcgcgaacgggctgccaaggaggctgaggaccaacgacagcgcgccttggaacccggacgactagcacgagagctcatcgggcaagacgacgttgacgggacgacggtttttcgtgccccacaacagaacgcggttgtagcgatcaccctcctcgacaccctcctcactgaagatgcgctcaaccaagctgatcacgtcgtcaacatcttgaactagaccaagaccatgatcgccgcctcggtcccggctaactgcgcaagcacccgcacgccgactggcagccgagttccacctcttcggtctcaagactatcatcagccaagcctcaatgtcgtcgccgagggatccaatcgtaggagcagggatcatggtgaacgatccgttcattcaccccctgaccggcacagggagcgtcaagctgaacgcccccgctccccccaccgcaggcgtcccatcgatcttcgcgagaccattaaccagcgacgcgcggcgagaggccacaatcctcatcattcaccagatcgctccgacgacaacgtggatggagtagctgccttcacaaacgacctacgttaagtggattggccagctggcttcaagccgctagaatcgagaagtatgacggcaccactaaccctgagtcttggctcaccgtctacggtctcgccatccatgcagcaggaggagacagcaaagccatggcaaactatctacccgtggctctagcggattctgcccggtcctggcttcacgggttaccccgtggcacaatcggatcatgggcggaacttcgcgaccacttcatcgccaacttccagggtacctttgaacgccctggtacacagtttgatctctacaacgtcattcagaagtcgggagaatcccttcaagattacatccgacgcttctccgagcaacgcaacaagatatccgacattaccgacgacgtcatcatcgccgccttcaccaagggcatttgccacgaggacctagtcggcaagttcgggcgcaagcctcccaagacggtcaagcagatgttcgaaaaagccaatgagtatgccaaagccgaagatgctattaccgcgtccaagcaatcgggcaccacttggaagccgaagaaagatacgccgactacaggggggagtggaagtaccaatcacaaggaccgcaagcgtaagcccgaggaacttgtggcaaccactacaccatcctcccgacagcgttcccgcgtcaacacttttgacaatatcatgaactccccatgtccgcatcatcccaattccaatcacgcggccaaagattgcttcgtctacaaacagtttgcagaacaatacgccaagaatgcacgcaaggcctccgacggagatcaaagcacgtcaaagaagaaggatgatgaagatgatgccccgactggttttcaagaccatcgcaaggaactcaaccacatcttcggcggacccctggcttatgaatccaagagaaagcaaaagctgaccgaacgggagatcaacgctgttcagcccgacacgccccaatatctttggtggtcagagacaacaattaagtttgaccactcggatcatcctgaccgagtggtccacccggggcggtaccccctggtactagacccagtggttcgtaacgtcaagcttcgaagatccctcatcgatggtggcagtgcactcaacatccttttcgccaagactctggacgacatgcagatccctcgcacggaattaaagctgagtaatgcgccctttcacagagtcattccagggctatccgcaacaccactcggccagatcactcttccggtcactttcggcactcgggagaacttccgtacagagaacatttgtttcgaggtcgctgacttcgagacagcatatcatgtcatactcggacgcccggcgttagccaagttcatggccgtcccgcactatacctacatgatgatgaagatgcccggtccccgaggagtcatatccctacggagtgacatcaagcaagccgtcacgtgtgacaaggaaagttgcgagatggcccacacccgcgagatcacgctcgcccgagaagaaatccgactggctgcgtccacagcaagcgaaggagaagtgcctgcgaccaagacgccaaagaccggagaaagcgacgccaagaccaagaagatttcactagatccctctgatcctaccaagactgctgtaataggcgttgagttagactgtaaataggaaagtgcgctcatcacctttcttcaaaataataaagatatctttgcgtggaaaccatccgatatgcctggtattcctagagaggtgattgagcactctttacatgtcaaggaagacgcaaaacctattaagcaacgactccgccggttcgcacaagataggaaggacgcgatcaaggaaaaattgaccaagctgttagcagcaggcttcatcaaagaagtccttcatcccgactggctggctaacccagtcctggtccggaagaagacggggcaatggcgcatgtctgttgattataccgaccttaacaagtcttgccctaaagatccttttgggttacctcacattgaccaggtagttgactcaacggccgactgcgagttactcagctttttggattgctactctggatatcatcagatccgactaaaggaatccgactgcttaaagacttcattcatcacgcccttcggggcttactgttacatcaccatgccttttggattgaagaatgcaggagcaacttatcaacgcatgatccagagatgtttttcaactcagatcggccgcaacgttgaagcctatgtagatgacgtagtcgtcaagaccaagtagaaggatgatttgattgcggatctagaagaaacttttgcgagcatccgcgctttcaagatgaaactaaaccctgaaaagtgcatcttcggagtaccgtcagagaagctgcttggatttatggtgtcccatagaggcatacaagccaacccagagaaaatcaatgccatcctcaacatgaaaccgccaagctcctagaaaggtgttcaaaagctaaccggctgcatggtggcgctcagccgattcgtttcacaactcggcgagcgggggatgccctttttcaagctgttgaagaaaaccgacaatttccaatgggggcccgaagcacaaaaagcctttgaagacttcaaaaaacttcttactaccccaccagtcttagcttcaccacactcgcaagagccactgttgttataagtgtcgacaacttcctaggtggtaagcacaatcctggttgttgagcgtgtagaagaaggccacgttcaaaaagtccaacgaccaatctacttcgttagcaaggttttggctgactccaaaacaagatatcctcaggttcaaaagctactatatggtgttttaattaccgtcaggaaattatcccactacttccaaggtcactcggtcacggtggtcacatcgtttccactcggggatatacttcataatcacgaagcaaatgggcggatcgcaaagtgggccttagagttgatgtccttggatatatccctcaagccgcgaacttcgatcaagtcccaagctttagccgactttgttgtcgagtggactgagtgccaagaaggcgtgcctgtagagaagatggagtattggaccatgcattttgacgggtcaaagaggctttcaggcaccggagcaggggttgttctgatttccccgactggagaaaggctgagctacatattgtggatatatttttctacatcccataacatggcagaatatgaggcgctccttcacggactaaggccccgtttggtagagctcctaactccaactcccaactccaaactccaactccagtgagagctagctcctctaggagctgaggtaggtaaaaaagtgtttggctagattactcagctccatatttctacatcctttgtcgccatttcatcgaacaccttctaggcgtcgccttgacgttgccgccgtagccagtcagcccacgagccaccgccgccgagaagcccacgcatctccgccgcctcccaagccgctgcgcaagcgccgccgcacaggccgccgccgtcgcccaggctgcctcctgccgacgcccccgcacgcgactcgcctgccgacgccgccgccgcgtgccgcccgtcgcggccaccgcaacaccgcccgcagccaccgccaccgcctgccgccgccgatgcgccgcggcctgctgcccccgtatgctgccaacgcagacgccgccacaaccggttgtggccgtcgtcggaggatggggaagaagatgggccatcgtcccccaacagccgctctccgccgctgccgcagccccccgccgccagcctccggccgcgcgtgcgtgccgcccgtcgtcatcccgcagccgccgccgcccgccgctgtcgctgcccgtcgccgtcaacgctgccgcagcccgccgatgccgccgcactagctcgggattgggaggaagattgggggaggagagagaacgggaggaaagaaggggtgaaagggtagttgagtggcattttcgtgtaaatacactaaaatattagagggtagtgggtcttttggggtggagtggagctgtgtagcagcaaaaacccagctccacccccgtagttcattttctaggagtagctctgccaactccactccaaaaaaaggtgaatctggaccatttggcacagctcccgctccaggtaagttggagttgggagctagagttgtgccaaacggggcctaaggattgcaatctctttgggaatccggcatctgatagtctgtgtagattttcagttggttgttaatcaagtcatgaaagaatggtcctgccttgatgataatatgaccgcttaccggcaggaggtacgcaagttggaagacaaattcgacggacttgagctcacccatgttcttcggcataataacgaggtgtcgcgaccgagaaaattgccttttcccgaacgctagtgtattaatccccgtcccaggaaatgccggggtacaccaaacaaacatgatacaaaaggcacatctttattatatcgattatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaagggggggaaaagattgagcaagagtgagtacaaccacagtactcagcaagccacaccggcagatgcatgattaatgcaaggggggtacaaggggataataatatcggggttaagttttgcagtaaacagcatttaaaagtcacttagttgcccaaagctattttgtaaacacgatcctagagctatacaatattattaatcaaggtcgtgaaccctcacgaacctgccttaacccaaggcctacgatgattcagaccgaactggcaacccgaccctgggtcccagctcgtcccaagccaacccaggccaaccattccacattttagttgttaagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggtaggcaggactgagcccccagcagcaggacaccagccctgtaccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactagcaaaacccaaccacgcacctcgagcccagcctaaaaccattttgggggttttgaatagagggggaggtgtgtgtccaattgcaacaaaagccaaccattccaaagtatccaagtgatatgaatattcccaaagtctaaagttataaaaccacctaatgttgcctaattaaacagcgaagcatctacctaaattcatactagtggaaccatgaatagagtacccactagttggggttttgtttattccagggtgaacaaggtaataataacaatagcaataataataaggtcataacaaaggtaaataggcatggctaaataaaacagtgataacgcaggaatttaaataaagcgataatgcattaatttaaatcagaataattttataaactgggattcaatatgctcaaggatgatgtgacttgccttgctcagagagaacggccttccgaaccttcggcgacgaccgcgaaccacgcttcgggaacctccggaacgacagaagctacgcgaagcacacaagcaaagctacaagcctataaagaagcaataacaatacataaaaagaaagcacagggttctttaggttataacaaacattaggagacttgaacgggtcgattcagagttcgtatgaccaagatatgatcatccgaagtttaatgctgttatatggagatttgcggattattataattaagctttgcaattataaaacatgtgtaagcgctagcctagaaaagacaggaaggctgcgccgttgacatgcggacctcacatgtcaacaaaaaggaccgcggtagaccgagtacacagagacggtccacgggtcgacggaaacggatcccgtgtgtcaaccgaggcgagtggccgacaaacggactccagtagacaccacacgggttgcacacgtggaaaccatgcggctaccgagtgggcacactaacacggtcaccacacgcacacctggacgactaccgacaccggtacacgggtaccggggccgacaaccgcacaacgagcacgggcgacaccgaaaggacgaggacggggcagcgagggagagggacccttaccaccacgcaacgaggcgagggaacgacaatgacgaacgggcgcggcggaggcggccgggaacgacggagacgaacggcgaggggacgacttcggcggcgatccttggacgaaggcgagacgcggccggcgcaacgcttgacgatgcggagccgaggacgaagacgacgacggggctgcagcggctcgcttgacgaacgcggacgacggacgagaacggctcgatggagggacgaacgccacgacgaccgggaacgacgagaggacgacgacgacgacgaccggggccggcgaggagacgacgagggcagccggcagcggctgcacggaggcgaggatggcgtggaacacgccgctgcgatgccgacgacggaggcggcgccgcgagacgacgagccggcgaggatgaacggtgaagacgacgacggacaccggcggtgttcggccgaaggggaagcgatgccgaggacgacgtcgcggctgcgatgccgaaggtggtggaggtgcggccgaccggtgcacgggcgaggagggacgggcggccgaaccactccggtgaggcggatggagaggttcgcggcgacgtgcggcggcttccgggcgaaaccgaggggtggacgaggtggagggctacgtcaccgtgccgagagaggggacggcagcgccggctgatgcacgggcgcggcggaagggggctgccggaggagacgtcgacgaggaggaagaagaggccggcgcgggcgacggcgttccggcgaaattcgggcgacgccgtggccttgccgggaaagaggacggcactccggtgccgggagaggtggtggcgacgtcggccggcgcacaggggacgcggcagaggcggccggaggcggaatcgtggcggcaataccacggttgccggcggggaggcacttccggaggtctccgcggaaaacagagggtaggccggcgaagaggaggcggctgcgatgctggaggaggcgacggcgcgaccggacggcgctccggcgaggagggagatgcggctggaggcggccggcggcacgggagagagaggaggacggcggggagaggtgatacgaccacggggaggctcgggatgaggttaaaacgatagaacggaggatggggattccattttatgggatgggggagggagccggccacgggaggagcaggaacggcggcgggaaacacggccggcggcaatggaaggcggccgggaatggcgcggccgttcccggcgattgggggcgccattcaaggggaaattaagggggaaagagagaggagggaaaggggattaattccccccaattaattttggaatccaacgcttaaatcaagcggattcgagggaggaacgaagctagggttcacgggagagagagagaggaggccgggcgggaggaaggagatgaccggcctggcgcgtgggccccacgcggtcgggcgcgcggtcagcgcacgcgcggcgtgcgtgcgcgggaggggagcggctcaggcaggggcgcggcgtgggccgggcggccggcccaggaggagaggaggggaggggtggcccagggagagagggaggaggagggagtgggccggggaaggagggagggaaggagagggagagaaaaagagggaggagagaaggacttcggccgcgggccgggggagagagagggaggctttgggccagacttggcccaaaggagggagagggattatttttaggtttttctttttaataaactttgataattgtttttgttgcttaataattatttccggtgctctggaaattcaagtaaaatttgagggctccttttagaccaaagagaatttaacaaaaattctccaggccacatttgaatttttcttgtatgtattttagtgtttgccaatttcttttcgaattttaattaattctattattccttttagaaaatgatttttatttcgggatgaatttatcaggacgtgacacgaggcagccgacagattggccaacttcggttcaaaacgagaagcagctccttttgacgtattcgtcgagcatctctatgagccaaccgtaccaaggaaagaaataatcgaggccacggtcactcaagatgtaagcatgattgaagctgactggagagagccccttataagatttttgcccaaacaagaactccctcaagataaagatgaagccgagcggatctccaggcatagcagacactatgtcattcacgagaccgagctgtacataaaaagtccatcgggaatcctgcaacgctgtgtgtctctcgaggagggaaggcaatttctaaaggacatacatttaggcatctgtggcaatcacgctgctgcacgaaccattgttggcaaggcataccagcagggtttcttctggcccacggctgtgtccgacgccgacaaaattgtgcgaacatgtgagggttgtcaattttttgcccgacaaactcatctaccggctcaggagttgcaaaccatcccgttgtcttggccgttcgtggttcgggggctcgacatggttggcccgtttaaaaaggctgtcggtagatatactcatctctttgtagctgttgacaaattctccgagtggatcgaagctaaaccggtcattacaatcacggtagacaaagccagagatttcttcatcaacattgtgcaccggttcagggtacccaatcggatcatcactgataacggcactcaatttacaggcggagtatttaaagatttttgtgaggacttcggcatcaaaatttgttatgtctccgtagcacaccccatgagcaatggacaagtcgaacgtgccaatggtatgatacttcaaggaataaaagcgcgagtttttgaccgactgcatccctatgccggcaagtgggtagaacagctgccgtctgtactttggtccatgcgcaccactcccagtcgggctacgggccagtcgccgttcttcctactctatggagcggaagcaatgttgctgttcttccgagtagatgacctcaaccgactggaagaagttcgtgaagcagcattaattcagtcggctcggtacttgcaagggatgcgccgttatcacaatcgcaatgttcgatcaagagcttttttagtcggcgacctggttctgagaaaaatccagactacacgggattggcacaagttatctcccttgtgggaaggaccgttcataatttccgaagtcactcggcaaggttcttaccgactcaagcgtgaagacggtactaatatcgacaactcttggaatattgaacatcttcgccatttttatgcttaggcgttacttttgtatttccctctttgactgctaacatcaagtttttccttgagttatcagtcgggggctactataataataatggagtgtgatttttatcaattcaatttgcttacttgatttgtcattgccctgtttgattttttgacttggttgatgaggactgaaagtttttaataacttttgcgggttctaagctcaataaggtttgacaaaaacttttaagaaatcagaagctaagtctaaatcatcaagcatagcatacatttatcagtattgtacaaattgtccctccatcatcatccaaacacaatgttagtcagctttttcatcatcagagttagttgatccagtcggcctgaggtcagtgtcctggaacctttcaacaacatcagccgctatcttgtcggcagcattttgagcttcactgatgagatcaagagcagcttcttcacttgtcccatctgcaaagccgtcaacagcttcaatgtctatcttcgggtacaaggacttggtcatcgccagcgacaggccagctcccatacttccagcctccttgatattcttaaaatatgtatccggagcaattctcagcttgtcgaagatctcgtcagcatcaaatgaactcggaccattgttattgaagaacatggcttggacgagtagtgtggcggcgttggcaacctcatctctagctccctcaagcttcttgattttgctgaccaagacgtcaaattgagcttgggatttgattttgcgatctgcacagatatacctacatcaatgagtggtcatgaagaggtgaatattttttagtgcttcggccgtcggtaccttcgacgtctttttgggcccagtccctttgcttagtcagttcggccttgtccttttccagagctttaactcgcctttccagctcggaaatcttggcagcttgcgctatatcgttcccttttggttagtcgcacatgaacaacaacatgaagcaagtcaggcaatgagaagagttaccttttgatgagccgctcagctcaaagttggaatcttggagctcggcgatccggtctctcaggtcatgctcagtcttcttggcaagctccttggcttcgtgcagctgatctctggtagctttcagagttccaagatagggaactaatttttcaagagttgcagtcttcgcctctttcctgagatggattctctgtaatacaaaagtatccttattcagcaaagtggccgacaggatgataagagacatgtatgagaagacttacatttacaagacgagtggcttggccgagagcctttttcagcatacacaattcctcgtcttctttttgcttgttgattacaatcccttgaggttgcatttcatcatcccaccatttgatcaatatgggtgggcgagaatcttcagccgatcatatccggaggacttcttcttcttcaccgataattgggccttatatattcatggacgatgattagacggatgaagaaggtttatcggatcaaaatggatttagaagagtagctttacctgttattatctctggtcggggacgagaagatccttgaaccttaacaggagacttggatcccgggtcagcgttggcatccttcttaggagggctatcggcttgggcctctgctttcgggatatcttcgctctgagttgtgcccgactggtttccagttgggggctcctgttcagcactgacgttagcttcggccgactagtttccagtcgggggctcattgctagcttgtgcattatcagatgctggttgatctttactcgggtgatcttcggtagtcggcccggtttcaactgaggggccagtctctgtgccgatcggcgtggggtcttttccagaaggatctatatcagatggctttctgcaaattcgatacacgttgtcagctctgctacaatgatgagcgactaatgatacagaggcattttgttagatgatacacacctggatgacttccttatttttggcatgggacgaccggatgttttcttcctcgggttagtgtcacgccccgaactagtcccgagcagaactagcccgtgacgctccaaattaacctgttaaccgataccagtcccagaaaacagtgctggtatcacaggaagacagaatatcacagcaacagaggtctctttattatagagtaggagtacagtcatgttgggctgcggatagatcccgagctcacaactgcattacaaaaggggaacggaagccagacttggaccaaacatcacaggcgcgacttgggaactaggccgaaaccctaaaactcatcgtagccagcttgctcctagaagaactcctcgtcagtgggatccgcttcatcttcttcagcaactgggggggattatttatatagagcaagggtgagtacgggagtactcagcaagccatgggaaataagtgtttaatgcaggcttcaaagaaaggctgttgtttttgcaattgattttatttgaactcttttctgaaacaactaagggagtgcttctcaaacgacatgggtgagacagtgcgtctcgtccggtcggagtatgtgcaatgtatcagtcttttgaattgattaagattgactcccggccaacagctttcaaacggccacccgggcctggctgatcccatcagccgcagattttccaaacatcaaacccattcaacaacagcaaatttcacaaggcagtagtcaaacaaactacgctaggaatcacctcacatccgcccatgaccgtgggcacggctgttcgaacagttttaacaacctctgcagagggtgtacactttacccacacgacattactaacccggatcatccagttcgtgcagaacggccacgactagagaccttaaggctttcatgacaaggcatttcgaaagccgacacaggttcaccatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcatatgttcggatgaaattccaaggaaacggtccttaagtgcaagagcgggaaaccgtacacccggtacgttccccggtccgcggttttggaaattcatttagttcgcaagcaccgacctaggtgtcgggttttccaagtcttttgtaaaacccaagttttacccaagatgtttctcagattttaagtttgaaggcgaccgtcgatacccgtgcagagtgcatgattaccgaggcgcgactaggtgggtacaagggagcatggtataacaattacaatgggagggtcaaaagcaacaaattaggtaggtctgccaatctgccttgcagatgggacaagcagattgagtgcgatcctatcaatccataatatttttcaagcaacataattaagttcaaatataggctcaagatgttcaaaggtggcttgcctcgctcgagatcatgagcttgatcctcgaaatcctcgcactgcgggtcttcgggctccgaaactacacgcgaaacgggacaactcagcaaacggcgaaaataaagccctattattgacctctaagtgtgccattagatagatctcgagatttgatgaattttggaagttgaacggagtcaaacggacttactgttgggaagatattgaatttctaagattattggatttttggtctaaaggaaaaggatttatttaaatcctttttgaaaaagaaaagaaaagaaaagaaggcaggagggaaattagacttttctcgggcggctagggcgcggcccgagagaaaggggcggctcggccgagcttaatgggccggccggcccaagaaggcggcccaaggcgcgcgcgcgggcggggagggagagagagagccggtgggctaggtccatcccgcgtggtcccgggtgggacccgcttgtcggcgactcggctcaccgtgaccaaggtgcacgcggggcgagctagggtttggggagggaggcgcggcgcatgcgcgcggttcgcggaggacgcggtgcggcgggcccacgcgcagcctcacggctcgcggtggaccgcgcgcgcgagggggcggagggaagcggcggaccggggtctacttgacccagtcgcggccgaggtggtgccgacgtggcgcctacgttgctgccacgcgggccggcgggaggtagatgacgacgccggccggaacggatggcggacggcagcggagtgatctctccggcctcgggccagggaagaggaagaaggcgagctcccggagtccccttccgcgtccacgaacgcaccggctctcccggtgcttggcgatgaacggcggaggcgagacagaggggcagcaatggcgcggtggcagcgagcaaaacgagaggaatcaatgggagggcgccttggtttataggacgacgatgtcggtttggaaaccaaccttgggcggtcaaggcgcgagctggcactcggcgctcgcggccaaaacagcgatagaggcggatgacgccggctgggaggggaaaaggaaaaaaaagaagggagaaagggggcttgccccttgccactttgggaaaaggaggaggggatgggggcgacgcggcagagggaggaggagctctgcctccatcccttggaggctagcgcggggagaggcggggccgaggcgatgacgacgacgatgacggccaggcggtttggagcggagcgacgacacgggcggcaggcgcgggcaggtgcggcaggcgctgacggcggcggcgactggccggtcggccaccatggcgtgcccgcgcgggaagcaacgggcggcgtggcgatttgggcggcgtcggcgagaaacggcagcgagagcggagggcgctcggctcggcgcggctcacgcgcacgcgtgcgcagcgcacgggcagagcgggggagagggagagagagagagagagagagagccagggagggaggggaagatgggccgagagggattcggcccatcgaacccgagggaggcgaaaaagacttttgtggagggatttgatttgggaaggatttggattcgggattgaactcgacgatagatcggggatttgaggtctgagatggcacggacactagacaacaagcaaagaaacggaattcgcaaatagggtttttaagagatagttttcccgctaggcgccacgacggaacgggcgctacagttagccagctttggctgtctctcagctccttcctttttgctgccggattttttggcgtcatgaccctcatcgtcggtcagcactgatttcctcttccgagagtctgactgagtggttcatcttgaggggccgggttgtacaaccgaccgattttttggccccccactagcttgaccagtcggttggcgtgatgagcgtcgttgaacagttggaggatcagactttatcaaggtgaattcctgtgcatgatgattcacattttcaattacttttaaagaagaccaaaggatgtaacttgtaaaggctgagacgagtgatacataccggagaaggagggttgaaagcgttgtacggcaccactggtagtgcatgagagtaactgactacaatggcattagagaagattttatacattctctcctgcataatcttgtattcaagagcctctgggtcctctcggttgggatcatgcagtgcgggatctctccttgattggggctaaccgggtcttgatgaagtgccgagtgatttgctctccttgcagaccttgctctttcagtttcagcatgcagtccattagagtaagcacctgggcggcctcgtctcccattgggagtgaattccaagtgtcttgatatactggagggagacaggagtactcgggaagagctggctcgaggttttgtacataaaaccagttggcatgccatcctttgtttgaagtcttgaagagcatagagaagtatttttgtcccaaagttcccctcaactgaaatccggctccaccaactacgcatggtttgctcttattcggctggggcttgaggaagaacatgcggtgaaaaagcgcaaaatgcatgaatgaagttggcgatgtggactatggaattgggatttaggtgatgtaagctgatgccgtaaaaatccaagatgccccggaagaaacttgaagttggaagggaaaatccaccataaaagaagagagaaaataccaccgtctcgtgtgtatcggaggttggaaatgcttccccaaatgctggacgccatccgatgatctccttcgccggaagaacgccatgcgccaccatctccttcagattctcctccgttacatcggaaggcgcccactggttctcaaagctttctctttcttccgccatggatgcgaactagatggcgagatttggtctgaaatgcggttgagaatgaaggggagattgatgcggtgggtgcacggatgatttctgtggaattttggaaggtggatttgagcgaatcggttaaccctagtttcgccggagcagcctttgcactgtagcgggaaatggggaaagtggcgagagtctcggtgaggaagacgaagagacattctgtttctctttggtgttattagggtatcggaagtactaatgggcctgggcctaaaatagtacttcagcccaattttgctaatcggcgtggctaagtggtgatccgtagggacttaggcattttttgtttcggcaatttttgctcaccacaatatggcccgatgctgttaaattcctttttgatgtagttagataattccttggaattactacgatgcaaataaaaaggtaccctacagaaaggtattatactacttttgtaagcttttttaagctgcaaaagctgtttgggtttggttgagatgactggttttttaatggtcattctctcggcatgttatatgcttattttttattatggcgtgggtcatagcctaggctatttagactcattaattgccatgatttctatcatatttggtggatcatcttaagagtttttactcggattcttatcaaatatggtcatttgtagaccttttgaagtgtttttcactcaggtttctttatatcttctttcttggtatattaaagctaaagcagtcggttggatgttttgctgaacgtcatatctgctgagctacataactactcggattggatgatatttgttccttaactatatgtttagtttttaactaatcacatattcgggggctacacctaattaggtgcatctagccgatgcacctggttatttatatttttcagcccttcgcagtctttgattttggtactcgggagatcgatgcagaagaaattgaagcactcggattatcattttacgctaagagaaaaggttatttcgtcgactgcaaaggtctcaggggctactgtggagattatggataccccatatctacacggcatgtatagtccgactgggtatggggtgccatgtatagatagaatatctttaggaagactcgggttaaattctaaacttgtgtatcaaggaaatatttgagatcctagtcagttacgattgtattttatctgtaactatatattctgttagggatatggacagtattttgtaatacggaccccttcccctatataagtagcggtccaggtgcctctagcggcagcgagtcggcgatgtccgacaggatcacctccacctccacctccatgacgcctgcagagctccccgctccgccgcctttcaccatcaccggtgccggcgccggcggcagcaggttggccaccatcatcttgagctggttggtcgacttctgcgccttgaggatgtgctttaccgtcgccgccgcgccgccgccccggccgccgccagccatctcacaatgagaaatttatgtgttctctcttcctcttgtgctgctgatttgtgatactaagtctcactgactaatcatgcaagtgtgtgctttcaagggtaaaggactaggatactcaaatatctacgaaagagatacttcaaatgcatatcatttttttagggtaaaagcagaagctctgcctatttcatataaggagaagagagagggaccaaagtttttacaaacaaggttaaaaaagatcctaagaggaccctcctctgagagtgacaggtcggaacaagaattttaggtaatgtaaagaaactaatgtgaggatacgagaactactaatctaaattgtgagctccgtcataggctcatcttcaaatgcatatcatatacgcactttattccttttcaagactgccaaatcgaattcactttgttgaattaacaacttcttgaagtcgggtcaagacggtgacaggtgaccagttagcatctcactaattaatcacagcttatgtagtatatggcctatcttatccatcatgagcatcatggtgacagctcggtgtcaaatatttagcattattttagtacaagtcaagtcttcattcctactatgtggtcggtttgtttcacagatcagaacatgtgcctgcgtcagtttaatctattcttgtcttgttgagaattagccaacattaatttgataatctaaccacgtctcgttgcaggaacaacttttgatcaatatttgattctacttcttgttcactgtatttacctgcaaaacaaggtgtttaaactgtaaatatattgtcacaaagaattaattcctcttctagcaaacaaagtacaccctacttcttaaactaagaaaataattttctgatcatgaaccaacgtggaaagttcgtagttaaaaatggctaaaagtttaatgcttttagtacggggagtgcgttctgtcatgcatggttctctcttatatgttcttgttagaataactgaataagagatttatgtaatatgctgttgttgctgttaatcagattgatagccactttggttgctcacccctgacctgagcaggatcgatttagttctgttttctttttcttctgtaggaaaataaaatggtcttcattcagtttgtccaatttgcgatcttttgccacaagtttttcgttcccctggacatatgtacattgttcttttaggtattgcaagtttgcatgattggcttggctctctttctcggatcatacagcatggattttgaaatttataaaactctcaacggaacatcccctcatttagctgactcaaaaaaaatctggtcaacagcatggatcttcaatttattaattggccatcataaggcactttagtacagccatacggagtaccaactatatatgtatgcagcgaataactcaattgttgtcagattatgagctgataatcttcagtgccaaaagtgttccattggattcgtaactttgcattttgctttgctagtcgcattcttctttggatttcgtatgcatgtagcagctgactggaagatacgatctgaaatcagtcaacctgctagttaatttatgcagcgccaaactctgctcatactctgtttcctctgttcttcagttattgtaacagttggacagagttaagagttcttcagttttgcatccacagacagcgtgagcgcgcatgagtgcattttgatcgtaagcatgagtgtgttttgctgacatcgcttatgttccttacggtggaacctattacctagtcttcgatccagcgtaagtgctttggttgatctttgattattttttcaatggtgtatcaagtgttcaatgacaacaagatgcctatagactatagtgtgaaaaaggggcactatatgtgtactcactccatttgaaggatatatacatgctatcttaggcattttacaatgcacctcaacagattttcagtaggttttgtccagttggacacattactcagagctgactatacgatgaaacacacgctgactagtcactcggcagcggaccaaaagggatgagtctcctatgacgtaaagtcagagggacattgtcacttactgacatgtgggacccacaaagattagacccccgtgtgggtctctctgactttacctcatagtatcgcgatccgaccaaaagaactttctcctgcgatttgctacataaaatccggcacgacggagttgtggagggcgagggagtcctcgtcggcgtcgctcggcttcttgtgctcctccaccagctccaccggatcatacggctcctgccgcaccacccgcagctccggaacctccccctccgacagaagctccgactgcgagcacgccggcgagggtatgaacagccacgacggcgtgcaggccatcatcatgtcgtccgacgccgccgggacatgttcctccagcttctgctgcagagctgacggcagaagacggtgactactggttgctgcgtcgcaacgcgggccgtcggcggggttggtgggagccggcgacgacggccggtcgccgccgcaggtgtgcaggccgatgtaggtgatctccagccgggacgggtcgtcgtcggattgctgcacctgcttcctcgccgtgcagcccaacatctgggcgcatctgtagtagctcctgtaagcacagacagcttcagatcactttcaagctcaatttattatgattattctttattttgttgcttttgacccaaaaaaaaacacagattcctattgatcctcaacgaaaaaagttgcgttgcgttttatgaaaaaaattgcagccggagattgcaaggtttctcacaagtcatcacaagttcacaacccaaaccaaacgttcttcaaaggtttactgaaaccgtcaatctagacttgtcgtgttataccttgcaaacctggcgccaagaatgtccttctgcccgtacttcctccagggataggaatcgtcacgatctccaagctctagtataattcttcgggatgaaccatctgccctgctgcattcaaaatcacaagctcaaattcagtattcatttatttgtaattgtgacaatttttcatgacatcactgctgaatacaacaaattaatgattcgtgacaactgacagcactgccaggcgatgattatcggggcttttttctggttcatttctaatatgttaattgaatcttgaacaatttagattttgggggcaacagaatcctaagagcatctccagcagggacctcaaatccagcccctattcaatttttgagtgttaagataaaaaaactagatccagcagggaccctactacagcccccaaagtgaggaggccctcaaatcctccccccaaggccccagtcctgggggactccggagcacgcccccatcgtcattttttttggcgcggatataattttgcttcgcgcattttcttgttattcccgcacggctgcgatgacagatcttctccggcgagtactgacgaattcccagcacctccatcaagactgccctagaaaggtaagacttttccatacctttcttgcccaccgttctcaaggccttcggcggcagtccatgcgcatgcccggccgccgatctcccgccatctgcctggccacacgccggccgtcgcgtgccctccgaggctgcccgcacacacgtcgtccacctgcacgccgtctgcccccacgctggcctcctgcccccattgatttttctggagaaactctaagtaggtcatgtggtgcgggggttcagtggtagagtactaatcaattttctgaataactctgttcttgacacctgtggacatgtggtggtagatggttctggtggagactgacttgtttttaatattttttttggagaattgtagtggactttgtcggcaagaaaaatctaaattctcagctagtaatggttgtgtttagttcacactaaaattagaagtttagttgaaattgaaacgatgtgatgaaaaagttagaagtttatatgtgtaagaaagttttgatgtgatagaaaagttggaagtttgaagaaaaactggatctaaacacggtgaatatatcactgtatttatacttagtagcactgtacaattgttgcaatggatcgattagaaccatatatatatatacaggagtaagtggtactgtactagtacgattccactgcttttcatagattgaatgttgcatactgtatatggggtatactctgtaccgtgtatgtgtagttggatgtgtgcatatgctctaaattttcttattaattttatgatcttgtgatggcagtgttttttacatggacttctacgacgacgatgatctcattaccgattggtgggatcaggaggagttgtctgacgatgatgactactacattgcagctgctcttcttacagacatagagcataagaggaccaaaagaaagcatcgtggttcagtcccaggtcgtgagataattaatagggacaggtttgctggcaatttacgcatagtggctgattattttgcagatcctcctgtatatagtgcaaaattatttaggaggaggttcagaatgtcaagggagctcttcttgcgcatcgtggctagtgtggaggctcatgatgactacttcaggcagagaccaaatgcagtgggtcttctcggtgccactgcattgcagaaggtgtatggtgcaattcgcatgcttgcatatgatattccagccgatagtcttgatgaagtcgtgaggatttcagagagcaccatgatagaagctttcaagcactttgtcaaggctgtggtggatgtgtttgctgatcaatacttgagagcaccaactgctgaggacactacaaggttgatggctataaacactccaagggggttcccagggatgctaggttgtattgactgtatgcattggaggtggaagaattgaccaacaggctggaaaggacaatactcagggcatgtggatgggccaaccatgattcttgaagctgttgcatctaaagatttgtggatttggcattccttctttggactaccaggttctcttaatgatatcattgtactacagagatcaccactctttcaaaggcttacattagggacagctccagagttggagtttatggtgaatggaaataaatacaccatgggttactatcttgctgttggcatatacccttcttgggccacttttgtgaagaccatttctaatccacaaggtaacaagagaatacattatgcaaaagttcaagaaggagtgagaaaggatgttgaaagagcatttggtgttctacaagcccgctttgcaatggtgaggggtcctgctagattttgagatacagagaccctatggtacataatgacagcttgtgtaatcatgcacaacatgatcattgacaatgagcgagatgaagatgtagattttgactatgatcaggaggacagtgaggtgttgaggaaggaggaataccaacgacgtaataaacctgtgttagaaaaatttctaaagatacataaagaaattgaagaccgacgggtacataagcaacttcgagatgatcttgtggaacatttgtgggcgcttcatggtgctcggtagtttgtttcattgcattttctatcatgtgtgggttatgttcattatttacttctaggatatatcatttccatgtttgaaaattttgaattcaattttgaatcgtggtgtttgaaattgcaaatttgaatatggttgaactccatgcgctagaattatttatgtttaaattactatgtgttaaactagatataaatataaattctataataaaataaaagagaaaaaaaataggggctaagatatggaggctactactagacataaagacatatttagggtctagaacattgagggcagcccccatttaacttttagggactcgaaagtaggggctactgctagagatgctctaaccctctccaaatccaaatacacaaccatttccttttccggagaaaatctagaggaaaaaaaaaagaccttttcagtatcctccctcgacatctgaaatgtcaaatcggaagagacataaacagaatttgcagacacagcaatcaaacttaatgaagaccacaagatatataattaatttataccttctccgttgagctttcctcttcgagactgaccggccgccgctgttcgccaccacacactgcccataggacggcaacaagctcgcctccggcggcggcggcggccgccgccgccgggagcgactggtcgtcgcacgccgcgcggagcatgagagacgcgagcgcctgagacagcgagtcggagatgtccgccaggatcacctccacggcgccggagctcctccctccgccgccgccgcctcccgctagcatcgccttgagctggttggtcgacttctgcgcgctgcggatgagcctctccgtcgccgccgtgccgcctccggcgccgctagccatgtcaaaatgaggggaataaagtcaagtgtttctctccttctcgtgccaatggtttttgatgctggtcgatcgatggtggcgagtgtgcgctagtacagagggtaactattaggataatcaatgtatcttgcactttattccttttcgatactgtcagactcacttttgtctttgttaattactccctattatacattgacttttcctagctaacttcttaaatttaatttaatcaagtttataaaaaaaaatagtagacgtattcaatacaaaacaagatcctttaaaactaatttggtgttataagcgtgtggttaaatttttatataaacttaattaatcttgaactaattaattagagaaaaaaatttaaaacatatatagtactaatccgagtgatacccttttaaatcagtgaagatataccgtaacatatagagatggtaatgggcgatatgaactgatacccgacagattttactctattactagtcacatattatctaatttttgtactcattggtctattagcggctaaaaatccttagctgttgagtacatgggacctgttctttagtcagtcatacctataaatctatgtgtaaaaaaatgtgtgccattaatgtattgtctaattcttatatggtttgtttatttgctttgaatgttattaatgttagaattacggtcttctgtgatgaagctggtatcaccatcaagctcagaggactaatgctacctctattttttaatttgtaggacgctgactagttaatgtttaaactaaccagtgtcatataaaaaacaggagggagtattatttttgaatgatcgattaatttttatggatgtcgatagctattgatcatagaggtgacaggaacggtgaagccaggcggcggccgcctgaccttgcccggaaggtggatccgccgcgcggaccatcttatgcaccagctgaaagctacgtggcaattttttactagtaatttaattcttacgtgtttatcaaatttcagctgagtcgacgtgtacaacggcagaccatttgtatcaattttcatgagcacacgcgtcaaatgttttctacggtcaaaaaacgcaagaggataagcgcgcgtctaagttctgacactccgaagcctggtatgttattctcttcgtccaataatatacgttctaatataaatgaattgtttatctagatttattctactaggatatactaaatccacctaaagtgccttatattatgagacagaggaagtattgtatagcatatattttataaataatgtcgaatagcaagtcaagtacataaccactcgatcttaattaggacccatttggtaaagttctaactcctaaatttagcttcaggagttaagggtctatttgacacagctccagctccacctctcctggagctagagcgtagccaaacagtttca

SEQ ID NO: 62870 - DNA, 66864 bp, Oryza sativa
cacttatttggtcgcacgcccttgtgtttgctaatgagaaaaaacttggcatttgccttggtcctgaagatgtaaatactgttgatgcaaatacttctgtaaggcttatatgacatctagttattttccggacgtgaacgcatcatatccttttttttttacagaacatcaatttatatactccctccgttttttaatagatgacgccgttgactttttctcacatgtttgaccattcgtcttattcaaaaaatttatgtaattataatttattttgctatgagttattttatcactcatagtattttaagtgtgatttatatcttatacatctacataaaatttttaaataagacgaatggttaaacatgtaagaaaaggtcaacagcgtcatctatttaaaaaacggttatctaaggtagtataaatcagtgacatcagaattatgctgatgaggtgagatgcaggttgctacacacaagtagtctggtgaggtgttagtactgcatcgtcgtccgttgacaatttcttgctgctcttctttttttaaaatgtttcctatttcttttcttaggacaaagatgttatgaatggaccggtttaaaacagactattgacaagattattttatcttacatggttatagatataaattaaatattttaataaataaacttcacagatagctcataacaagggattggaagaaagttcggactttaaagcaaagtgagtttagatcaactgactaggttgcttgtggtagaaccagatcaccccgttcaagttataaagttgacacatgtgtttgtatttacagctaattattatttcagtgatagacggtgtacctgttgatagtgaggcgttcgtagtgactttcggtagtgaggcgtcgttgtattgtgtttctgaaaaaaattctttctttaaaaagacgtcgagcaaataatttacgataataatctacttgagtagttaaaaataatacgagggccagttacccctttgatcgctaaatttttctgttccatgtgaataaagccactactcggacgccaaagggcctgtagcctagtggttataaaagcctcagaaagatgtcgagcaactaatttacgataataatctactggagtagttaaaaataacatggggcccagttacccctttgaacgctagattttttttccatgtgaataaaggcattactaagatgcgaaaaaggatatagcccctagtgattacaagagtctcagtagcccctgtttccatttgaggtttcataacgagcctgaaaggacgtaaatacggttgtgtttagatttaggggtgtaaagttttggtgtgtcacatcggatatgccggtacacatttaaagtattaaatatagactaataaaagaactaattacataatccgttagtaaaccacgagatgaatttattaaacctaattaatccgtcattagcaaatatttactgtagcaccacattgtcaaatcatgtactaattaggcttaaaagattcgtctcgcaaattagtcgcaatctgtgcacttaattattttttagcctatatttaatacttcatactccctccgtcccataatataagggattttgagtttttatttgtactgtttgaccgctagtcatattcaaaaaaatttgaaattattatttatattttttgtgacttactttattatccagagtactttaagtacaacttttcgggttttatatttgcacaaaatttttgaataagacgagtgatcaaacagtgcaagtaaaaactcaaaatcccttatattatgggatggagggagtacatgtgtacaaacattatacgtgactgcgtgctgctcttgaagcgagagcgggtctgcgtgctgctcctgaggctcgcacggctctgattcgcaggggggctaataaggtggctcatgagcttgctcagctagctattcggaatagggaggcagtggttttgcgcctgcaggcgccggtgtgtgttgctaagcaacttgctaagaattgtaatccttattctgaagtttaataaaacctctatcttaaaaaaaacattagacgtgatagagtgtaaagttttacaggatctaaacagtgcctacatcctaatcgaatcaaaatctcaaaataaaaagacaaaagagtcaggttctgcatcaatcagagccgcacgtccaccctaaacgccgtcccgtctcccgtgtggtcgcgaggccgtgtgtgaggcagcgagccagccagccagccaagccaaggcactcgagatttcttcctgctccagcgcccaaagcccggcgcaaatcacaaccttagtattatttcctcctctctcttcccctccctcccttccctcttcgtccctcctcccctcccccccgccgcgatcgagacggcggcgaaaccaacaccggaatccgaggggggatccgccgcggcttcgctaccctagcccccgccccttctcgaatccgcgccctaaaatcccctttgcctccccaccccacccccgggcgcgccgccatccccccccgcccccgcgagcccctcccgatggatttggatctgtggatctctaaggtgaaggagggccagcacctcgccgagcacgagctccagtccctctgcgaatacgtgagctttcctcccccccgccctgtcccccgattggttcggttattagggtttttgccatgccccgtgctctcgcgcggcggcggcggcggcggcgcgcgtgcggttgctagggttcgttggtagggggtggacgtggggggaaaccgttgccttttgctttccgtactgaacttgagttttgttatgtatatggggtcgcgtgtaaccgcggctgattttccgctgatccttccaggtgaaggagatcctcatcgaggagtccaacgtgcagccagtgaacagcccggtgaccgtgtgcggagacatccatgggcagttccatgacctgatgaagctcttcgcgactggggggcatgtgcccgagacgaattatattttcatggtgtggcttctggagcattttgtgtttatgtgtttctgtgtgtgtgagcttgttggttgagatggttctggatgatgctgtgttcctgaattcagctgtgcttcacgtgcagggtgattttgtagaccgcggcttcaacagtctggaggtcttcaccattctgttgctactaaaagcgaggtatttgcctacctttttgtttgggatcgtgaatgttctgtttgtttgttcgaaagctttgacctttctggcacatagctgcagctgcttcactgttccgtttggtattacagtacttcgatgttatattacctttttctacagggacattacatgaaaaaatatgtgaatggttgcagcagtagtttaccttccttagatgtgaatcatgttgttgtatggtcctgcctgtcgtttgattatatgccaaatcctgttgtcttttcattactgccttctccccttattttgcctggataaccttgagcaatgtatggggtcaatgtgttgttctatacttctatataatacaaatagctcccaggagttgaactgaaatgctgaatagttgtaggatgagacacactgtgatctaattgtggctcgtgcaattgagcctagttggctgaattttgaaattggtattcctgttgttgtttcacaacttggactgctaatttgagtagaatggttgcactgttaagtagtgaacaattcctgtaagactccctagtccttgctagtttcatttgttcttggttgcactcattttctcaaggattctgatttatagtttgtacccaagtgttactatctgtggctcattcttgctattgggtttcctgattgtgattaggtaccctgcacacataacgcttctgcgtggaaatcatgaaagcagacagttgacacaggtatttcctggtgcggacaatgttttcatttattatccaatttatttcttttcttgagatttgagatacttatgttgcacttttaagtgttgtatctcaactgctctgatgatttatatgttgtatctcaactgttgcatccaagaggtcctgttttagttgtttgttggcctgtacatgcatgtatgctcatatcaaacatttgtaggttttgtattaattatctatgagggtatcatgcgttggacataaatatgcatagctccattacatacaattctgattctggagatgtattaactcgtattgcttttctgcctgagcaatgtcaaataatccggtcattatatctatgattttcccttggtttcatgttcgtttcagtgtatgcacattggaatgaaatacacgcacatgttgcatactagtgtatctttagttcctaatcagcaccatatgatgagcaacctgtgttgtcatccttagattttgtttaatgagttggaatatgttttttacatggttccttacgtttcctttatttgtacagttcatcctcctgacagactttgtgctcatatatctgcactacacatgtatttggtgcttatgatgcagtaacacatagtatttttctaattttaggtgtatggtttctacgatgagtgccaaaggaagtatgggaatgggaatgcatggcggtattgcaccgatgtttttgactaccttactctttcagcaatcattaatggcacggtaagtttgtttggacattttgtaagttgtcggtttataatttttgtgccaaataatcatcaaaccatatgctaaaaatccaggttctttgtgttcatggtggactttctcctgatgtgcgcactgttgatcaggtttgctgaactttttttcttgaagtttcataagcatcattaagtctaagtgttgtttatcaaactctaattaattgtaatactaacattattattttgagttactgtactacaccttgtcgatgcaacaattagtaggtctggcactaagttcaaaagaattagataattctgccttttaagtatgaatatcctcagttgatcaggtgatatccgttgaaccttttgaaggggtaaacaactgggtgttgccattttagataatttgttgaaatagtgtatgctattttcagtgacacatatatctctgacccatcctttaaagaaaaaataaatggttgttcgctaacttagttgtggtatacttttctttgtcgttaaaatatatactttatatctgactgtgtactattagaaattagttggttcatagctttgcatgttcacaattttttagtaagacatgattctgtgatttgttttatcttaagatatattgttgtcagataagaattaaaaaccgtctcaacgcaatattacaatgaaattaatcatgtgattgaatatccttgttaattctattgaccagattcggacgattgatcgcaattgtgaaattcctcatgaaggtcctttctgtgatctaatgtggagtgaccctgaagaaatagagacatgggctgttagccctcgtggagctggttggctttttggatcacgagtgacagctgaggtatgtacagtcatttgatgatttcttactctatttttcagagagtgtgtacagtcactacattctggatcatctattaattgtttccttgtaaatgtttttcatctaccttttgcagttcaaccatattaacaatctcgatctagtttgccgagctcaccagctggttcaggaaggcttaaagtacatgtttcaggacaaaggccttgtaactgtaagtttctgttcacatgtcagtccagataatcatagcattgtactaagcttgtatttcttttttcaatactgttatattgatgctcacataccctgcaataccttttttccaggtgtggtccgctcctaattattgctacagatgtggaaatgttgcttctatactaagcttcagtgagacaatggtatgttgtgcacctgtggtggaagcattatgtaattgcatcaaacttcatataggagtactaggatttgctagtgcacttgtgcacacacaatacagagatgaaacagcgctaggcacccaactgcttttgtgtgctcaacaataacaaatgccaccccatgctatctataatctactcagcaatgaattaacgatacacagcactttggtttgactactgattgggggaaacttaagttggactcaagagcaactagcatattcgtttctagttgtgtaactgtggccacctcaataaaccattcctcagggaatagaagttccaattgaacttagctcatctacaagtactggaagatttcttgctactagtgtgaaattgttatcttatctgtggtctgactcttgcattagttgatctgaatatgttaacatgtcttcttttgcaaatactgctgtgaagtatctgatttgtttcatgagctctaaggctcgcagctgattctgatcttttatatcctttgtctaaaacatcaggaaagagaggtcaaattcttcacagagacagaggagaataaccagatgcgaggaccgaggactgctgtcccatatttcctctgacttcatcaattgtacaattttagaagtcatgtttttatctgtaagggttaaagatgaagcagacctatttattgttgtaggtccaggtcatagtgcaatctaatgcgtatgatttttctgttcttttaaccacatgtacaatagaccatttggagtgtcatcactcctgtattccttctgtggcgttgtcaagttttgtttctgatttatttcgggtcgacacagtttgccacacaggaggtttgggccgttattgtgttatatttgcagctacagcttcccactcacgtgatcagataggcctgccccgtgacttcaaaatttgcatgcgatttgcgcgtaggtcgtatcatgtactactttaatattataagttattttgacttttttagtttagcattttaagttttattaaatttatagataaatttagtaacattgagaacactaaattagattcaatgaatatacattggtaatatgtttgttctgtgttggaaatgctactttatctataaactcaatcaaactttaaaaatttttattagaaaaaagtcaaaatgatttatgaaatgaaacggagtacactatcctatctcgtcgattatgtaagattgaccacttacattcggacacgtttatctcattgaacttgttaacggatgatgaaataagttgcatttgtgcaagtcacgttgattctctacatgatttatagtacgatagtacattatttgcacggtaaacttgtggcaaatccaaatattttctcaatctcaaaatataaagctctaaacacaaataccataagagaattattatcatttcttcgctttggtcacctcaaggctcaagcacccaatggtattagaaatattaagagtgaaggatttaaaaaaaaaatcacctaatggtatcaaaggtactaaaggattaaaaaaacaaatttacagtagagggatgtgctagttaattatacgtgtatataccatatgttatgagacattgtgaaaaggttattcgtcttatattttgagatgaagggagaagaagcgcctcatcttttcgcttacacttatccttatcatccaaaatttgaattttcaaccttaaaatttgaaggtgattttaaagtttctttatcaaagtttatttttcagcatttgcttttagatcactaagaacacgtatataaaagttttattcacgtattatttttcgtttgtaaatatgtcgttggtcttattctgtaggccacaaaactttaaaataacctggttgctattgctatcaccgttagcaatccaccaacgaaataatcatggctttctcttgaaatgacgttccctcgttgtttgcgtgtaaactcaaatagttatggaatggaaaattttgagaagatctattaatatatgatatatcactcctccacaaatatgtaagttaaaattttacttttacaagttgaaaaaaaattaaactacaaatattcaccgtaaaatttgtttttttcattgtaatacataaaagttaaattttaccttgtatatttttgattgatttactacgtattaacctatccttttttttcatgaccattactttgagtgatatgtagataatgagagatgtctcctggagagttccctttttctcattcgagccgaagcccacttcccattgcctcccgtggaggaagcggtggagccactcagccatgggatgacgggaagccgctgccgccgcctccgacgtcgcgctcgcattcttcaggttcgggggcatcgccttccctaccgctcgtgtgtctttctgttcttgattacacgtgatatcgctgaagattttacagtacaaccaccgtatatatagctcccacgtaccatattctcctgtgctggttccactgcaatctggtataggatggagccgagcatctggaagtggcagtcttggtcgcggcgggcggtggcggcaagcctgataactatagtggtatacctggtagtagtagttgcttgttcgcaacaaaaccagcgcatatgcccggggcgacgcgaccctccattgcgccggtcgcgggctcgcggcaacgaaaagatccctcacgacgcacgtgacgtgagccatcgcccgtgcccgtgccgcttttccaacggcgcggagaaggcatgcccttccgccgccggtctccctcgtccacccgtaacgaacaaaagaatctcgcacgcacgcacgggcggaggtgcaacgagtgcattgtggggggttggcacgcggccgcctcgttgccgcccgcgcgcaccgtagagtcaccgagccgacagctaccgcgtgcggctgcgtgactgcgtccccgccctgccgtgattccgcagcgttcgctgcttcgcccatcctctgcctgtgcctggttggggtggtttggccggcgcgcccgcgggcagcggcctcggatcatcctcacgtgatctcacatccgtggtgctggttcgctgctgagcctgatctcacgtcgcttacctgtctgtcagggtcgggtcgcgccggctgcccggttgctcacgacaagtcaaacaccatgtgttaggctgtgtttagatttaaaatttggatccaaacttcaaacttcagttcttttccatcacattaacctgtcatgcacacataacttttcaatcatatcattttcaattttaatcaaaatccaaactttgcgctgaaagccttagtaccgctgtgccaaccatcggttcggttgccatcatattccaggttcgagcattttttttgcaaaggacattctcctttgcaaccgttcaaaactctcaaatcatgcaaactcgaaccgtgccagacatattcctcctgatattgattcctgaagaaggggggcatcgcatctttcggcaccctgatttttttccctcgatactcatgatcattcaggtaggggcggcggtaggaaactatttcactgttcggcttgtctgctccccatgatttaattattcattggtctttgattaaaaacgaattaaaagctcaccatgttcgcaactgcccaaagtgcacgtatgtttgactagcaacggattactctgaacggtaagcagtttaacccgctgttttccaatttccagcctgtaatcaagagagagaaagaaaaccagtgatccactgttcttacggaacagttacatccagcgaaatattggggatcagttatgatggaagaagcagccgataatgcagtgctatcgtctcgtacgatccgcttgtgtgcgcgcgcgcgcgcgtgtgcaacgatcgaacaatctggaaccagaggaaaatgatgacaatcggatgtgcattgattagcaacctggccttgtttgattggggtgtgatacattgggggtggccctcttccttggcaaaaaatcatcttcttttttttctcctaatcatgagcttaggcactaaccaaagatcgatccacttggtggacgatctggtgatagttgcagcaaaattggtgcgaaatgatgggagaaataaaaatgctaactaacttgcactatcttctccgatcatgagggggtggttgctgctgctgcggatgcggtggcgccggcgacggggatcggcggctgccgcttggagttggagacgtcccccgtggccggaactcctggtccgccattgcgcgcctgggccgtccgggccggaagtcaccgagctcggcgtcggagaacgacgacgaccccccgggcgcgaggcgccgctgcggcctccgcctcctccaccgccaccgccagcaccgccgcgcgacgcggacgggcgcgcgcgccacgcagcagagcgccgccaggggcaggcacgcgcacagcacgcagcacgccgccgcgcactccgcgagcgccgcgtccttccctccaccggcgcccacgggtggcgccgccggagacaggtcgcgcccgcgcccgcgcccgcgctcccgctcgtcccctcccccccgccgcttcttcgccgccgccgccttcttcttcctccgcggcgagccggctgcgtccatgcctttgccctgccctctctgccagtctactaccacctcgcgctcccttccctctgccttcgtcgtggggagattcgattgggttgtgagttgggacgaggcgtgggaggtggagacgagaggagggagtgcttctcgcctcggttgccaatactcctccacgtttgaacgacaaacgcctccacgcaagttttttttttctttaaaaacttttttaaactgatcttaacaacactggtcagagatagaatgggatatcggtctctttttaattgagcaaccgaaagcctcacttaagtgagaatagacctggatatcttttctcaaagtagtctcattttgaagaatctggtttattaatacgaccatgggtatgtgtatgtcacttgtttaattaggtttggcttgtttatgccgaacaatttggagtttggtattttcctgcctgcagtggatcgatcggttatagatatccggtcaaaacgcagtcacctttcagaacggcacaagtgcggttactatttgcaggaccgcgtgacgactggctgccacgctactaggcgctccacttggccggcccccggcgctttgctttaaggcagtgtcagtgtgtcacagggtggttagttcaggggtcctatcttttcttttccagctgcaacaaaagtagggttgcacacttgcactagcttcagagaaaagctgatagcgatcagcaactagcaacttgagcgaggtgttaccgtgttaacactttgataattgatagagaagcaaaatggcttcgctaacgagaaaggaggtccattacgaagatccatggtccgatggccaacaaaattcgattggcctaaaattagaaaccagagctactcacatctattttacgtaatatttgtgagaaccatgatttaaatccttgtgaaggtagtcatacatcaaggtatagtccgtaacaaatcatgttgagaaatggccacgtctagataggaatggccaatggcccaactggcccaattaatttttagttttctactccgaacgttgtattctagcatgtgttggtttggagataagatggaataggttagactcatccttgttctgacggtctcatctattcgtttggcatgagggatgagattatcctactttttaaggaacgatccacatgtctgtgagagagaaaaaatgggtgggattgatccattagtttttaggtaccagatcaaccttaggggaatattctctgttagggatcatcccatcccacatgtccctaacctaaacagtctaaaaaataggttcaacccaatctgacccatcccaacctttgaaccaaatgcatagtaactaaattgatccactacttaaaaatcctaatatgatatcctcatatgtgccatcggttcatctaaaatcagcacatatggggtttttcacgtcctattgatcccttatatgggtctaaaattaaaaacctgcaccaacaacacttgtaaatgccattttttaaaagaagacatttatacgtgtgatatcattgccttttccttaaaagaaaaactaacacattcgagggagttgaaccaacgaaccaagcctggcactagtttttatgcctcggaatctccccctccgcctcattctctctcttaactgccgcgagctcaggagcagccccctccctttcccctagcctagctgtgccgcacttccatctccctgtcgagcaattgtggcctccttgatgtccccacgcctccctcgctcccttggcctccttatcaccatgggttgctggttcctgtgagctcggcgctagattcgatcaccgagaacttggggatggctagatccacgcgcaagtgggtcactcgatgtcagtgagcgagcgggcagacttcacctatagcgagtggcggcacggatgggaccacgactacggaggtgaccactagcagaatcggtggctccctcccccatacccttggcaagttgattttttatggattcggtaatgatttgttggtttttccgatctcccttgttgatgttgttttctcctttgatgctgaaatggataggtaatacttggatattagatggattctgatttgagtagtaatgcatttgtgccaaaaatttgtgattcactttctgtgatttgcgatgttgataaataatttgtgattgatgaagagcaatttgcgaaaaaaaaaacttgaagcaatcgactcgagtcgattcgtcttttttttaaaaaaaaaatcgtgcacctcatctatgccccctcatatctgtacccttgtgatcacactgctgattgagcaaaattatacttgtacacactaaaagtcgcctcactattttgctctccttttattcaagatgtacacatttgcattctgaacaccgctcaacagagactaacaaaatattttcacatgacacagtaccaaacaacttcttcatcgtcaaagcaggcgagcaaggcagatagattgccattaggtagaaccagctggcgaagccaatttagccagaaatcccttgtagtgctccaggagcttcccggcgtcgggcatcgcctcccggacggcgtccaccgccaagaaccgctccgcccacgccgccaggcccgggaacttggcctcgtcgaggaggctggagccggccacctcgtccaccaccttgaaccacaccacgaagccgccgaccacgacgtcgacgagcccgacggcgtcgccgccgaagaacgccttccccttggagcactccacgaacgctcgctccagcacctccacctgaggtacggcgttcatgaaggcctccgctctctgctccgccgtcgtcgccctcatcagcgccctccacggcgggaagaacttaatacagtatcaaaacaaaaatgtcgatctctctaatattgatttctcaatcaccgacatgaacgttgctatctatctaaggttgatttcttcaggaagatgccatcgattaccgtgctgtcgaagtaggtcgcccagaagcgagcggtggcgcggtcgtgggggtcggccgggaggagcggcggcgcggccccgggccaggcctcgtcgacgtactcgagaaccacgcgcgactcgcacaccggccggccggcatggatgaggacggggaccttcttgtgcaccgggttgctcttgagcaggagctcgctcttgccgaagaggtcctgctcgatgtactcgtagctcaggcccttgagccccagcgcgattttcgcgcgcatagcgtacgggctgtaccatgtgcccagcagctgcagctcgcctcctcctcctcctcctcctcttcccgccattgctgccgcgaactgtgtgagtatgatgctgttgttgtctggatcggttttacggtttgtgtacaagatgggtataactgtatgtctttataaggacatggcgaatttgttaagttcatctatcaggtgattagtgtgaggtttgagtgtttgactgattttagttaagctgtgtaagcaaagttggaatcggccggcgagtgcgcggcgataggagattgctccgtgccgttgctggcttggagaaggggccacaggccacttgattccgtcagtgttgattgcgatgttgtacatgcgtcgaccaaacgtgacagcagatgatggagttggtatggccttgactagtggatgaatgattgagcttgacgaggtgattagttgaagtttatttttactgttgtagcagtagtagctacgtacttactccgtcccattttaattgcaaccatagtttttcgcgttcaactttcaccattcgtcttatttaaatttttttaaaaaaatttaaaaacataagtcacgagtaaaatactatttatattttattatctcataaaatttatttaaataagacagatgatcaaagttagggcgtcctatctgcggcagcgctgcggctgcaaaccttgtgttgtgcggctgcagctgtgctgcttgcagctgcagctcgctgtcgtgtggcttcaaaaagggcagccgagcaggcccttggacgcagaaatttatggttgcgctcaaaatagaacggagggagtaagataatacagtatatatcgtatattggtgtctgtaactacttccagtccacgatttcaaacatggagaaccattttgtcatcctccaaaaatgtcttcggacgcttaaaaggaacaggaagtggatttttatctcttaacagaagacatacgctcgttttgtacgtgtcatcaaaaaagttttaaaatttttgacatgatagatcaatctgtcataccaattctttttttaagactttagatgattttttgggtgacatgcaaagcgaggggatgtaccttaaggatgaaatatagttttccaaaagaatgcaacttaatggaacgatacgaatttcgtgacaaggaagaacgatatttgccgtttaaaagtgtgcttagcaaatcaactaagtggttcgtctagaaacactaaagtagttcactgaacagcgtgtcaacatttccctccttttatgaaacaaaaaagaaaactgttattcatcacgcgtgtcaacgtactcctcaaagtacagatccccgaagcagaaagtattttctacacctagaaaatccacgaagacgaaagcaggcaacgccgttgtgttcaggttcagctcgaaccagcgcctgcagtccatttggccaggaaccccttgtactgcttcagaacatcgccggcgtcgggcatcacctgcctgacagcgtcgacggccaagaaccgctccgcccacgccgccaagcccgggaacttggcctcgtcgagcaggttggcgccggccacctcgtccaccaccttgatccacaccagatggctcccgagcgcgacgtcgacgagccccgcgtcgtccccgccgaagaaggccttccccttggagcactccccgaacgctcgctccagcgcctccacgcgagggacgacgttcttgaacgcctcagctctctgctccgccgccgtcgacctgaacagcactttccacgacgggaaaaactgcagaaaaaattgcaaaggaaatcaaccaatcaaacagaattcctatctgccgttctgatgtccagtcattataccgtgtcgttgacgtagttggtccagaaacgcgcggtggcgcggtcgtagggatcggcagggaggagctgcggcgtcccggtggctccccaggtctcgtcgatgtactccaggacgacgagcgactcgcacaccggccggccgccgtggatgaggacggggaccttctcgtgcaccgggttggacctgagcaggtggtcgctcttgctggagaggtcctcctcggtgtactcgtagctcagccccttcatccccagcgccactctcacccggatcacccacgggctcgaccacgtccccagcagccgcagctctcctcctccaccacgtcctgccatcgcggactcgtgaatcgtgatcttgcactgaagtctgaagagaacgagtgtatatattggctcagttgatcatcgggtatgagtagcaagttgagtggccagtgagtgattccgtcagcgctgccgtgtgccgtggaaaggaagaagacgagatcgacggagtggaccagctggccagtgggcattgggccactgcatccataggttgattcagctttggtcgcgtcgggctagtagtccaaaggagtaggaagacgagaaacaggttacaggggatcgagagttcgagacggagcacggcagcaggcattgcgcagctgggccaacgggcctgcgttcggagacagagggattgcaggttgaataagttcactttgactgccttgactaaccgggtatcttgaccctccaactattaaaactgatgcaatttgtcttcctcggtggttttgaagagcagtttcgctgtcgtgcgtctacatggtggtgttgaccagttttcgtcctacgtgacattgacgtgatgcttatgtggcatataaaaattaaaaaaacataaatgtgggcccactaacattctctctctactacgtcatggagctcgagctcctccttcgccgcgaccattactccgctttcatctgctccttacccacccctcctctcctcagtgcacctcctccgctgccacggcaatgccccaacccccaacccctagtgctggcggcacgccagttccctagccccctctccgcctctccggcacttgctggtggctatcgccgccacctgccaccccaggcccatgccaccgctccctcgttcgccaatcggcattgtcgatcagggagagcaggagagggaagggagatataaggggtacagtgtcaacgagtatgacaaatgggtcatagttttttctctctctagtcacttacatatgggcccacttctaatttgtgactgggctgccacattatcgtaggggttgaccaagtcaacgagccacgtcagcgaaaacactggttccaatatagtttaagggtcaagaatcaagatatatggtattgtggttgaggggtatgaatcagattggagcagtatttgagggactcaaagtgaacttattccattgcaggttggggacgcccggaagtctggaacgcagagggcatatataaatagatgcataacaccaagatagtacatgtgcaaaacgagtacgcaatgttggttgatgtctggccaccgagccagaaaggagagcgttgggcttagcccaccaaagcccacgcgatccctaacattgaggaacgagtctcacgcattctctcacacgtttctctctttagctttatgatcggaagcgtcattttcctcgagaaggaatcacccctgatcccctcaatacgcataaaaagggaaccttaaccccgtgcacgagcgacgactcatgtacgctaagccaattctccaaaccctcaaactaccgattttaaggcgtgttgaaggggagtgaagggcgaattcccatcgccgtcactgcatggtgatcttcatcaccgtcgcctcacaactactacaccgacgcatctaaggcaaccatatggcttcttcatccggtcagtacaccatcaaattctgtataagagaaattaggtgatcgtgcatagcctaagatcatgattttaagatttaactccaatacgcaaaagtagaagaaatgttacatgatacgacgatattttaacgaagcccctgtgtgaatgtgcaatgaaccgatgattcaatggtcactccgagttcacagttttgatcgatgaatctcatgtactgacgcacgtgatccaatttttgctctaatctatctctgcaaaagacacatgcgtgaacttcaaactacagcatcctcatcgacgaaacgaaatacaaaccactcgcaaggcagtggccggaaaatatctgaaagataccgtttgtcgtactccttttcttctctattcttctcagtacttctaaacttgtactctaatagtattcaacaatccacgtcaaggttcgtttggtaaaactctaattcctaaaatcaggagttagatttaaaggagagttatgaaggagcctaaacctatgagggttttttactgttgaggttgtgcaataccaaatcctgaccgttgatctagcatcattcaacggttagaaatcatccgtacctcatggtactgcacctcctcattgaagtggtaccattggtggaagggtatttctatcctttcctgtttcacgagaggaaaaatcggggagagcagcgagattgcggcgagaggcgcggcggctcggtgcgacggcaatcggcgagaggcgcgacggtggcggcagcggcgggctcgatggccgacgccggcagcagcggcggtggcggcgacggctggatgcacgacgacagcggctggatgcgtgacgcgtgacggcgacggcaacctcgatgggcgacgacggcggagggttcgatgcgtgacggcggcgctggatgcgcgacggcggcggcgggctcgattcgcgacggcggaggtcgatgcgtggcggcggcgatcaatgcgcgacggcggaggtcgatgcgcggcggtggaggtcgatgcccgacggcagcggtcgatgcgcgatggcgggggtcgatgcccgacggtgggctcgatgcgccggcggcggtcgatgcccgacggcggcagcgagctcgatgggcgacgacggcggcggcgagctcgatgggcaacgacggcggcggcggcgagctcgatgggcgatgacggcggcggtcgatgcccgacggcaagggcggcgacgagctcgatgggcgacgacggcgccggcctcgatgcgggacggccctcgatgggcgacgacgacatggaagaatggaagagagacctaatttttgttagcccaattatacccctgttaaatcaacggttagattagattggtacctcatgttacctcgtacctcatggtacttccttaaggatgggaaagatgctctaaacctatttctatctctctagtttattttgtgagagcgttttatccagctccattcctattttggatgagctgaaactatttagctgacctccaactctaagagatgcttttatttggcgtaaattgagcgttgtaagttattggctagtcagtttcaaaataataacaaaaaattattggctagtgaaaaccaacaactgcgaagttcagacaagaacaaggtggataatataacgggatcgacatgttgtgtacttgtgtggtagtgagctcctctagtcatgcaagcaggatagacccgcgagctgctacacttgtcctcatttaccaacacacaagctctcccttgtcttaactgttctccaaacaaataagtacttccaagaatttttcgttcgaaagattcagccttggtgcaattcaccttttctttggtgcgataaaatggaggccgccatcaccatggatgagaacttgggacgaagtgggtcatttcgagctgcgatgagcatctttggcgaaagcatcaacgggaggaaggcagacaagaacagaggaactgttccagcccaagaggtagtgtctgaattcacacgcttttctgattcttgtgaacaaacctcaagttcaacagttctcaatttcattgtatttttatacgatttctgtaaaaacgcactgtatctgtatctttatatccatttcggtatatatatgtgcagaatctgtcttctgaaatgaagcagctagcacaatccggtctggacaagctgaatgaacgcaaggcgtacgtggataaagagagagccggcgccgagtccgagctgtcgagagcgcgagccatggcgaaggagcttgagcgccaaatcgagcagacaacggccaaagccacgtcccagaggtcggagctccaagcaatgtgggcagcgaggacgaggaggaagggcaccgacgcaccgggcgcggagcgcgacgcgcggtacgcggaggtggtgcaggagctggaccaagccaagaaggagctgctccggctgcggctcgaggtgcggtccgcggcggaggccaaggcgaaggccgagcgcgacatcgtggcgtcggcgtgcacgatccagtccagcctccgcgccatcgacgagatgaagcggcgggtggacgaggcgaacgaggagcacgtgctggtggagctggcgcgcatcgaggccgagcgggagcgccgcgagatcgaggcccagcgcggcgccgaggccgagcggttcgccgcggacatcgaggccgcgagggccagggtcagggcgctgcagaaggaggcgagccgcgcgagggagatggaggcgaagctcgccgtgacgaactccgacgtggaggtgcttcaggccgagatggagctggtgcgcgccatggagaagagccacgccaagagcgacgaggcggcggaggacgcagcgaggaggaagaaggaggaggcgcaggacaaggcgctgctgaagaccgcggaggccgagctggacgcggcgaagaaggagctggagacgatcaaggccgggagcttccagttcatgacgtccatggactgcacgcgcaccgagatcatgcgcgtcgccgaggagatccgcctgctcaaggcgaaggaaaagaaagcggacgcgcaggtgcaacagctgaacaccaagctcctcaaggcgaaggcgcggttggaggccgtcacggcggccgacgagaggtcgaaggcgatcgtgtccaacttggcggcggcgatgaagcaactgaaagccgagacggaggcggcgaggatggaggaggacctcaccaagctggagaaacggtgcgtgatcgcggaggccgagaacatcgagaaggagatcgccacgaccgagggacggatcaagcagtcggtgaaggagctggatgcggcgaaagcgttggaggccgaggcgatgaggaagctcagggacaccgtggagagcacgatgcaggccagggcgtcgtcggcggcacggcggcaggggacgatgaccatctcccggttcgagtacgagtacctgaccgggcgcgcggcgctggtccgggtggtgaccgacaagaaggtggccgcggcgcaggcgtgggtgcaggcgctgaaggccagcgagaaggaggccgcggcgcgcgccgaggcggcggagcgggaggtgagggagatggaggccagggcggcgcaggtggcggcggaggcggagaagacggcggcggagcagaaggagctggagcaggagctgtacgacctgaacgcggcggcggagagggacggcctgcagtgcgcgtacccgcggcggcggtcgagcagggtgtcggcgacgtcgaggaggtccaagccccggcggtcgtcggtgtccgcgggcgcatggaacccgcgctcgccgtcgttcaccatcaagaggaagaggaaggtgatgcccaacctcctgaagctgatcaagaataaaagaggcggcaaaaagaacaccaactgatcgagctgcgtagattgtcatgaccgctcgcgacgctgcgaccgtttttcttgttctgatttccggcggcgcagcacaagaatgttttgatcatcagtttcgcgggattaatggcactgatactgtatacttgggctagatgtaagtacatattaagctggccatccgttcactacataatgtaacctgcacgttcctaaatggatggctggacgtcaacaagtgacgagttttgtgtggtctgttggataggatggatggcttggatcagttgttggttattgccctagcagagttaaaattaaactcgtgttcatcagctttaagggggctttgttgaccttgttacccaaatcaaccataccatattttggtaatctatttttttttcacattttggcattatcgaatttcgatagtgttggttttatttactttgttttgatgtatttgttaaattctggagggctgctatacaacggaatcccgttttcgaacgggctgctatacatgtatcgtgtcttgaaacttaaccggtatcaagtgatacatataaagtatcaaatgatttctaccacgtatcggatgatactcgtgatatatcatgtgatacctatcagatatcagacgatttctaccatgtattgggtgatactcgtgaggtatcatgtgatacctatcaggtatcagacgatttctcccacgtatcgagtgatacttgcgaggtatcagatgatacctaccagatatcaggtaattcctactaggtatcaggagctgagcaccgaggcgtcgttgccggcagccccaccctccacgccccatgtcggaggttgtcgccggcggccgcgtcctctgtcgtcgacgccttatgtcagaggtcgtcgccggcagccgtgtccttcgtcatccacgccccacgtcggagctcgtcgccggtagccgcgtccttcgctaccacgccccacaccaggcttgttgctggcggtagcatcctctgccgccacgcgccacgccgggctcgtcgccggtggccacgtcctccgctgtccacgcgctgcaccacgtcggagctcgtcgccggcggccacaccgaagctcgtcactggaggctgcatcttccgccgtccatagccatgcgccggagctcgttgtcggaggttgcatcctccgccgtccacagccatgccacgttgggagctcgtcgccggcggccacgccggagctcgtcgcttgcgaccgtgtcctccgccatccacaccccggggtgtgccgcaccgagctcgtgcagcagtcatgctttgagagagatgtggtaatatggtagaatagataaggtagaagaagatagaatcgatggattggttggttgctaacttatcccatccatcatggttgggacgggatcccgtcatatagcacttctgtaaattctgatagagtttttaagagaggaagcttctagaactgcaaaatttagtaaggactctagcgctagcccgggcgtgcttctttccggaccatgcgtgcagcacgacaggtcgacgacagctgcaaattaggcaaattttgttggcttatttccgcattccttcccgttttaatgacctcacacaaactgttcacacaaagatgctcctcgcgaacacagatttccggcccgatctgtacagctacttcatacgtgttgcttgttaaggcggtgaacgtgtcacgaaattcctttcccgttagatggcgactgccacatagacgagaaaattgacatttagctattgtcaaaacagggtttcgctggaatgctaccctcaaacagggggcaacatgttgcaatgctattccatccatttcttctcagtttaatgttttttattgctgagatgaccaaaatatccttgatcctatctcatctctcctctctgtcttcctcctctccgttcggctcggcgacgcagccagaaacggggatggtggtggcgcggccagggacggggacggcggcggcgcgcccggggacggggaacgcggcggtgtggatggggacggtagcgacgcaactggggatgagaaggcggcgttgcggatggggacggggacggggacggcggcgacgcggctagggacggggacggcggtagcgccgacatggttggggcaggtgggatgttctcctacgccgatgcagatggcgccgctgagccgagcagccttccccaacccacgccggtgccgtccctgtccccagccgcgccggcacctcatcgccgacccccatctccatcctcctcgacgacctcctccttgagtgcctcgccggcatcccctatgcctccctcccatagctccccaccactccaccacgcccatcgcctaagtcgcgcccacggcgagctccgcccctccctcctcgccctctccgtcgcgtccacggcgagccgacggatgttggcgtggtggtggtgacgaggatgaggagctggcggccaccgactcgtagctacgccccgtcgtcgctgccgctgctacactccaccgccggcgaccggatggggatcgatcccttttctcctttcccctgcaaagtcaacaaaatgactaggggcaaatatgtcagagcacgataaaaaacatttggaaatcagttaaaatggttgaaatggcattctagcaagttggcttcatttgacaatgacattataacaaaaccatattcgggactagcattccagcgaaaccccatcccgaacatggttaaatgtcaattttctccacatagactggcccatcggtcagtgtcaccaccggccttcgatgttgaagcggcgcaaccaaagccggagaacgcagcagaggcggccagagcgcgagggactccaactccaaccgccatgccgctcctccacgcggccaacctccgcgtcctcctcgccggcgccgccttcgcgcacctctcctcccccgccgccaccgcgcgcgcctcctccccgtccgcccctccccctccggctcccccgccgccgccgcgcgtccgggccttcgcctcctaccgcgcctcgccgcctcccccgccgccgccccaaccatcctcgccgtcgccatcccgcgccctcgcctccgcggccgccgcgtgcgagcagggggcgaagcccgcgatctgcacggcggatgagctgcactacgtgcccgtgcccggcacagagtggcggctcgcgctctggcggtaccgcccgccgcctgaggtgcgcgtgcttattcccctcccagcggagagggtggcggctggttagtggttatggttgttgatttggttctagcttggtttgtgcaggcgcccaagaggaatcacccgctgatgctgctctcgggagtggccaccaatgcgattggatttgacctgtctcctggggttagtatatctatatgatcctaacttgtggagttgtgtgcataatcgatcggcaatgagtacttttctattcttttttgacaaaaaaaatatgaggtttagttaatcgctacaaatcgcttaccgcttagttccagataggatgaatgatttaatctgagtataaattagcaattatcttgggaattagggattaaaattcggaaagagctgatcattgttgttacaattttatagttctgtacacttaatgtggagaagtaactatgttttggaacaacagagaatttactccatgctgtaaatacactgaacaaaaataagttggaaaacaaatcgctgcagtaaacagaactttctggaccaactagtgtgacaatgcttccttactttgcaatgtttaggatgcaataaggctccaaatgctgattcaagcatggcacaaagcagatcagcagaactagggaataacgaaaatttaaaaagtttaagtgcatctcttatgtaatttggtggaaaaaaatactccatttttgacagctatgaaatttcatgagaacagaaactggggttttggtgcataaaagatagcattaaagctacaatacagctgggcagaatttcttgagtaagaatctcgcggacatatcacacaattcagaacacgagtttgtgcaagaaaaaaaattgcatagatacattggtaaaattgtacacatcttccagtaaaagttatgctggtgcgccctacttcaggcttcagataaaagatgtagtagttgtgcttttatagcggtaagtttaaaaaaacacatgttttggggcattttgcttactcttattttaaagatacctctgtttatttttttctaaaaaaatgtaaatgtatttcgttttagaagtttgtttactcatgccttggtcactgtctgtttgatattctatattgtttactcataagcaaaaattgtataacgaacttgttattgccggtcatggttatagaattctgtttatattttcccttgattttgactataataattttgtcaggcttcatttgcacgtcatatgtccatgcaagggtttgatacatggattgtcgaagtgcgtggtgcaggcctgagcatgcgtggatctgaactagctgtagctgacaccacatctgacatgtctcgaagttctgcattggatgagattactacacagaaattaaatggcgctggacctgccaaggatgattccacttgtctagctcaaaatttcgaagttccagtagtagaagataaatttgaagttccagtagtagaagataaggatgtaatagagagtaatgcattagaagaaccacagctggtgacaaagttatcaaatactttggcacgattgggtgatacattctcaggttatgtaaaagatagtcgactgagaagtatcgctgatggcttttttaatcaagtgtcagaacttgttcctgatgcctcattaactagtagtcttgaggaagtctcagaaaaaattttgggcttactggaattgccacaaacatcagcaatatcagatcaaataagccatttaagtctacgtcttgtgaatattcttggggaaggtcaacagaatatatcacctcggctatttggttggcaagaacgcctgtctgcaacaatagaagatctacagaaacaattggagctcattattagctatgattgggactttgaccattatttggaggaggatgtacctgccgcggtttgttaacttagccttccatctataaagatcactcgattgatacctgggaaccctggtaaaaagtgttaatcttttctctttttatcatgcagatgaattatattaaacagcaaagcccaacaaaggatggcaaactgcttgccattggtcattcaatggggggaatattattatatgcaatggtttcaaagtgtggtatgtataactggaaatcttcttttgatctgtctcagatagcaagaaaacaacatatttatttaacaatgttgatattccacattttttaggatagtcttaaatatttcttatgctatgaatcagaaatttacattctgttatcaatacatgattcttgttctgtgtttctgcctcaaaaggatgtgaaggtgctgagccagagctggtagcaattgttactttggcctcatcagttgactacacaacatctaactcatcactcaagttgctattgcctcttgtaagttgaccatcgtgcaatttaatttactgtactaatatacatatacaggaacctaatcttcaattttattaggcagacccagctgagatgttacgtgttcctgctatccctgtaggaacattactgtctaccacttaccctatatcgtctcgtgcaccctatattctgtcattgctgcgctctcaaatttcatcaaaggacatgatggatcctgatctgctttcgaagcttgtcttgaataacttctgtaagtttcatatttaagctttgtcatatctgtaagttgtttcataaaaaggtacaacaacctgatattgttcacggaggaacttgccatccaagtgtagtatgatgatatggtcaagcgaacacttctattcctaagaagttgcacattttacaaatatagcctagccaggttaatctttaccttatactgtaagcatatgatagatatacatagcctgaatgttattgcatgatatgctcatatggcactgttccaccatgaagtttctgttaccatctgtaggagtattgattgcactggttcatttttatctgcctgccatctttatgatacatgaatttcaataaggaagcccttgaagttcttgtgatgacttgatgcattattgttcaggcacggtgccagcaaaggttttactacagctgacaactgcattccgtgatggtgggctgcgcaacagggctggtacctttttcttcaagcagcatctgcacaaaatcaaagtgccaatacttgcccttgctggagatgaggatctgatttgccccccggaagctgtttatggtatggtaataagctccatatttgcactgttatttcgcgatgaggacttttttggaattttataaaatgaatacctattcaggttatcatctgaagttagccaagtgaaagtcatttatagtgaactacttaatgcagctgactcttggaccccaaagatctgtagtcacaagattagctcatatcgtactgcctaactgcaattctcaagttctcatctatgggtgtgtttagttcctgaaaaaagttggaagttttaagaaagttgggagtttggaaaaaaagttggaagtttatgtgtgtaggaaagtttttgatgtgatatgatgtgatggaaagttggaaataggggggaaactaaacacggcctatactggtctgggttatatccctagctaaagtaggccatgctattagataatgcatatactatgatctctctttggcttcattgtttgattatgtattttttagtttcttcataaatacatatcacaacaacattttcttgtatttgcagaaacggtgaagttaattcctcagcatttggtgacatataaggtttttggaaagcccgaaggccctcattatgcgcattatgacttggttggagggcgaaaggtatgtttacattaatgagtacttaaaggatataaagctgtttgtttactgtggtatgttttatcatgtaggctgtccacgaagtgtacccttgtataatagagttcctctcccagcatgatgaagtgtcttcctaagttttgttattggcgtaaatgttagatgttagagctccaacacgctattgcacgagtgcacaatttcatcctatattggaactgaaatcatcaaaatggtaatggaatggtgaggtacaaaagtgtgttattcgtttcgctcccttttctatatccaaggtccaagcttgtagtttattaccacaacagttgatttataacctatatatgtaaatgttttattccttcacaaaaagagacaagaggcttacacgggcacggtggcactgatcatcgcctgcagaaatgccagaaacacatatcactattcactagtaatgtcagataaataagaaaaggtctttttgccaggaagatacaagtatttgtaatggcagcaccgcagcagctagtatcttggctagatagctgctaatacagtattgactacttgccgaatcagcttcattggaaacgtaactgaaaacacgattttgttaaaagaaactcgcagagtggtaatattcagacgtgctcatctgattgtttcaagctaaagcaactaacacgtgaaggatcgaatgaggttgcacaagacactagctgccgtcccggactgtgccaatattgacacctgagataagagtaacatatatttgataaaggatgcctcaatatggcatttctatctgcaaatgcaaaagaatggatgatgtgtttatacaataacatatgtaattgactgtacagagcacaaacaaacatgttttgaaagtttgacccaggtatacaatcgtcgttgcccggagtccggacttcaagtcttggtaacggcagtcttgcaaactgggcaaacgttcttctgagaaagccattgcttaatgcagtaaacatggtagctgtggccgcaatccagcctccccatctcttcattggcttcaaactcttcctgcaacacattgacatgagaatgaagtttgttcacatgccagacactggataccctgtataatgactgaagggaagaagataactcaagagaagaggttgtggcatacttgacaaatactgcatttcttttccatttctgttgaataccggaacgaggagtcaaaggctgggtgtttgaccttcctaaggttgcgaactatctcatcctcacgcaatccagtgttgacataacctattttatctccaagctcaagcaactcctgtaaaacgaagcaattgatgatgatggtggtggtggtggtgaaaagtgatgctacaaggcaaagagacaaacctcgtatgtcatgttatcaacatcaaggcgccaatcctggtaccgatcatacatgctcattcctcccaacagaactcttgtctgaaacatcatgatctgccatatcaaaaacagtttcattaagtatttgaactcgctacctttgataaggctgcttattgagctagcaacatgcataattatgtatatgtctgccaggaagatcacagattaacaactgcaccgcttagcacaagttaaccctcaatcactgaccatcgggctggttattcttccaagtagagtacaaagtgtgcagctaaatatgcttctacagctgcactgacgtatctcttatattctttacgattacatagaaaggttagattgaagcaccagataaatatatagtagctttctttacgactgtttggaatgtgcaccaaaatcaaatatgaattcttatgacagtggaaaacctaagtcagaaaacagaggtatagcacagaagtaaaactagatagaaaaaatgtttataggtaaggaaatggacttccctgaactaggcaccaaagcacattaaagcaaatcccctcaaatatatatcttgataggcaatggcagtgcgggaccgacaatccttgtggatcttgatgttgagctattattaaggagtcatcaccaatcacatgcccacatgaaatccagaaggaccagaaggaatgactacaactctagatctgattatgactgaagcaacaggaacatgataaggagcgttggtcccccttaagcaccaaaagaatagttcagtcaagcagcacagccgagcactaatcataaatggtgaactgctaggactctcgatctgccatcggaggcaaccaatcattcacgcaccataccagcatgcccattcctaccaaccgtacgatccaccacagaacagcatgacagtagatagaataaaccatactattgcttggcattcccaggtgtgctccagcactccttgcccgcatcctgaaatactagcaccgttgagacaacaattgaccattaccggcaacatttctgatcagctcagcaagagtatccagcatttatacttgtagttggcacggtgtatacacacaacgagaagcattcatggaagtgtatgaccatggttgagaggtctctttccaaagctgtggccacatcccactgtctcgttccctcccttctcagccgcattaatcctaaacgagtgtacggccactacgctaaccagcgcgcataatgcaggtgccatggcttgcaactgcaaccgcttatacaattattgtgcgcgcctgtgtaaggctgccgattagttaacctccaagaaggccacgatctcacgtcacgtttagcgcacgaaagatgcaagtcaaccacttccaacgcccacccggccagccggccaccccccaggttcactcgcgcaccaccagacaatcaatctactccacttctaatactactactattaatctatatcacgcgttacagctgcttaatacgcatgtcagatcacgcgctaaactaccctacgcacgggaatcttatgcaggcaggcagcgtgtcgcaccaccaaccgctgtcagcatgcgcacttgttgcgggccgtgtccatctccgacttaggagtacgttggaaaaatgtatctaccgatgcatgcaatgcggtggctcaggacaagtgtgcaagcaagcaaaatgcagtgtgggggcaacgaggaaacgaacgaacgtttgttgcagtgtgcgctactgtgccagtactagtactgctgctactaccgtgagcctgtgacgttttttacctcttcctcgaggccgacgggggagtggcggtacccgcgcatccggcggaggcggccggaggggaggaggtcggcgccgaagaagggcgcgacgtcgaggtgcggcggcggcggcgagtccatgaacgacgacgatatctgctcctgcacggtcaccctcctggacaggcacggtctctgcgcaaaggcaaaaaaaaaaaaaaagcgtagcgggtgagatcatcatcaacttggtgaggagggagagagaatttcagagaaacatggcaaagattccgctcgcgcacagcgcgcatcggtacaggggaattcagtacgcccagaagagatacatgtcacatgtttagataacaagaacttaattagactgaccaaacacgacattaaagactggctttaattggttcgtcaggaactcaggactatacaagtggtagaacagtggcaaatgctacggtttttttaaagccgccagaattgattgtgggaggaaaacagcaacagaagaacggaaaaaaagaacagagtattgaatgttgaatttaaatcttttttcgccaacagacaaaaaggagtggaagaaaaggcacaaagaaacacaagtaaatgagagacgaaaactccgaatcgatcgaccacccaccggaaagcaaagaacaagcaaaaccaatcggttccaagagcacgaacagatccgaacatgaggcgaaatcaacaagtagaagcgaaggatcaacggcatccatccatccacgcacgcaagcgacgaacctctctgtgcggcctctccgcgtcgccgccacggcctctccccaccatctggtgccgcgccaccacgcagtccacggacgacgcctccgcggcgaacggtatcccaggcgcgcaccacacgtcggcgccgatccctccacccacgaggtggccgcctccaccgccccctcctcctcctcccctctccttcctcttctccttccccctcctccgcctccgcccgtgccagtccgccgacgaccgcacggccgccgccgcggccgccccggccccgggcgcgtacgcctgcgaggccgcggccgacgtgcaacccagcccgcgcagcgccgccgacgcgaaccccttccgcctcccctcctccgcctgcagcggcggcggctgcggcggcgaggacgacgacgacccctcgccgcggggcagcagcaggcgccggatcccccgccgtcgctccccgtcggccgagacgacgccgccgccgccgcggcggtcgccggccatcaggcgcgcagagaggtaggtggaggggcagtaatggcagcgcggaagccgggggtgcgtggaggagagaaggggagaggagcgccgcgcctcccgtccgcgcgtgtgcgcttcagcgtttggctttgttgcgtagtgtactagtagaagagtagagagaaagaagtctgtgcgagacagcggagactagagatgttgtagagagagagagagagagcgcgaacgagtggaagggtggcaaactggcaactggcaaggcgacgagggaggggtggaagcagcacgaggaaatgagatgtggtgactggtgagtgaattcttgtcgcgggttcggtgcatcactggatttgatcgagggatggatacgtacgtactagtagtagttgttaaaagaccggaccggtaaatgaaccggtaaagctcttggttaattggtttagggtccctttgaatcacaggaatgaaaaaatgcaggaataggaaaaatatatgattctgacataaataaaagtgtaaaatagaagattgcaaaacacagaaaaaatataggaatgaccgtttgattagaccacaggaaaaacacaggaatttgaggagatataacgactcaaaggatttcttccataaggttctacctcttattaaaattcctcaaaaacttgtatgagaagaggcattccataggaatttcataggattccataaggttcatttcttttattcaaaagactttgtaggaaaaattcctatagaaataaaatcctctaaaattcctatgaatttcctttgaatcaaagggggccttagtggtcggatcactggtttgcccggtcgaaccgtggtttgattggtaatatagaaagtactatgttttaggccgggtttagttcccaactttttcatcacatcaaaactttcctacacatataaatttctagccttttttcttcaaacatccaactttttttcttcaaacttctaattttagtcaaactttcaattttagtgtggaactaaacacacccttactaatggcacaagctgtacaacggtggcttggctagcgcacggtgctctcaaacccacgaccagaggtcgaatccccatctccggtttataaaaaaaacgcccggattaaccggtttcatctggtctgactgcatgcctgatttgttaaggggaccggaccggtgggggctctggttccggttttttccggtcgaaccgctggtctggtccggtcctaataactatggatggatgtcttgatttaccaggccccctcccaaaataaatgtcaaattaaattctttatgaaacactcctactaatactagaatagggtgcagaaaggggaaaaaagctttgatcacttaggccctcttctaacttgattaagatgaagatttttttctgtcttcgttagcatgcttttcaaactactaattagtatatttcgtgtgaaacttatataggagttgctttatagtaattcaattaatcatgtgttaatggttttcttagttgtgtgccatcacttaatcttcatcgtaatcaaattatttttctacatatggagtatcttcatattacataaaatatgtcaaaatgtatttttatagtataatcaaacatatttcatagtactccagtagactatgaaaatgctcctatattttcacattttgagacaaatacacttcacatttggtttttatggatcccaataacatgtgcctccgcaagcatagccaatgcctcgggacaacaaacgaggatcatgtgtacgcatggattttccgtgtttggttggtgacacaggagaaggaacatcagctcaccaataggccgatacggagtgggcagttattgagcagtagtagtaccactgcaagttttggcatatcaaggaggggtatgtggtgtgccatcaaagaaacacattaggagtcctaaaccacaataactgaaagaacatgtaatatctcgctatcgacgaatactcatgtcaagtttataatctgaatttagatgaacaggtttcaccacgagaaacataaccaagttcataacttagaccgttttagactgatgttaaaaatactcattatcaatattttggtagtttgaatattgcatatgatgattttggttagaagataaactttgattctaccaaaaatttggtttctaatatatcaaatcaaataggaaaaagtatgaattacccccgaactatcgcggtcgaccgaattactcccctaaacctgaaaaccaaacatcattcaccctaaactttcaataccggacaaattaccccctcgacccaatccagagtggttttgtcctacgtggcgtacgcgtggtagtccagtcagcattttatttataaaaaaatatgggacccacctgtcatactcctctctcactcttcctctctctcacttttcctctctctcttctctctcactcttcctctctctttctcgccggttggtggcaggcagaggatacggagcggctgcgggtgacgcggcggcggcggcggcgggggacaaggagacggcgacgaccgcagccacgacgagcagcgggccctctgcgcggggacggatggaggcgggtgtgggtggcgacacgggacgcggcaacaaccaagacgagcagccaccgcctcggtgcagggaattccatccggcgcaagtaggtttccgccgccccgtgcgtgccgcctccgtgtccgccgtccacgctcacccactacctgtccctggctccatccgttcgtcccgcgctgccgctgcctcctcgctgtggcctctattcgtccgtcccgcgccgtcactgcctccatgtccccctgtcgccgccgcctcgtcgtcctgcgtcactcgccgcagccacctccgttaaccctaccgagccaccgcttccgcgtgccccgttgccgttgcctccgtccgtctccacgctgaggggggcagttgctcgtcgtggctgccgccgccgccgcgtctcgcgctaccgcccacacccatctccatccgtccctgcgccgaggggcggctgctcgtcatggccgcagccgccgccgcctcctcgtccccagctgtcaccgccgctgtcgctctgcgtcccctgcctaccgccgaccggcgagaaagagagaggaagagtgagagagtgagagagaagagacagaggaaaagtgagagagaggaagagtgagataggagtatgacagatgagttccatttttttttataaataaaatgctgactggactgccacgtatacgctacgtagaacaaaaccgctttggattgggtcgagaggggtaatttgtctggtagtaaaagttcagggtaaacgatgtctggttttcgagtttaggggggtaattcggtggaccgcgataattcagagggtgggggtgagggggtgtaattcgtactttttccaatcaaatatgaccaatgtaccaaatattggtaatcttaaaacttgccatgtttcaactcttgcaacgttttggcagggtactttgaatcgaaataccctttagggcccctttgaatcgcagggttgaaaaaatagaggaataagaaaaacacaggattctgataggaattgaagtgtaaaacagaggattgcaaaacataggaaaaacatatgaatggtcgtttgattagagcacgagaaaaacgcaggaatcggatgagagagatagactcaaaggaaattttccaagaggttgaagctcttgctatatttcctccaaaaaccacatgcaatgtgccattccataggaatttcataggatttgaaaagcttcaatcatttgaatcaaaggatcaaataggaaaatttcctatagaatttgaatcctataaaatttctacataaatcctttaattcaaaggcccttactcagtttggggatccaccagcacgtaaaaggccttgacaaattcatttcgctccatcactcatccacgttagctaacagcgtgtacgtgaactgttcataggtgtgtacaagcaatcgagtgcacacacgccgcacaggcgcacagcgtcgtttgccttggatcctgccagagtgcgcagggaggagatccccgagtcaaaggggacaagcttgcaagaatacaagataccctgcttcctttttcgtttccatctcgctcttttactcatgcaccgatgcatgcaaagacaagcagaggtccccttgattggggaatttgtactgatcttgtttcttaatcaaacctaaagggaaaaaaagaaaaaccctctccactgccgaatgctgatggaccctctttggatggcttcaaattttggactgtatagtagtagtggattctctactcgatctttctggattctttttttctgtgatggacattgggcagcgtttgctgttgattctactacagaatgaagtgctaacctaaagagattacagtacacagtaatttaccctacatttcctctcttattggagtgggaccgtgggactgatatacttgtacggtcttacggatgggtgtcgttttttggttttgcccatgcaggtttaagcagcagagagaagtcagcaggtcgtcacgttaaagtattcagctgtaccagcatcgctcaatcaaaagtccactattgacgacgagcttgactccaacggagcgctcttctccatgggagaaatattctttgcttttttatctagtgggcgcgcatctaaaacctaaacgatgggaatacagttcgcagccgcttttggcagccaaagagaagcgacgaggcagtagaaagaaagaggagatgcctcctatctcagctatcactcactgtgggcctgtggtcactggtcgcgacctcaagcaagcaagcaagcgacggagggcagggatggagggttaagtatcattcctgcacttgggcttcagctcacctcatctttattcttcacttccttgtcttcagatgcgtggtgtaattgactccctacttctaattatactttggtttgctgtgtgtcctttgcctaaacaaaggtagcacgctgtatggttcaattcatggaggaagattagaaagaaaaaggcagcagtgtccagtggatggtgaccagcaggaagctataggcagtagtgactagtgacgctgagcagcatcggctttctttcttcagactgcgctgtaaaatggactaaattgagctttcacccttctttgtcgaggctgatgttttccgtattctggccgtgctttcaatatgaattgtcaaagacaaaaggtattgtttcccataacaggggaagctgtttcagatttttagttacacaaggaatagaccacacgattacacaagaactggccagctatatatatactcctatatatcttttggctaatctgtccaatagggtgatgtatgtaagcaaatactactagtaccatttaagggcagctttcagtactcacacatgcatgacacatcggtaggacagtaggttactcggtgcatccaaaaatccaaaacactactgatggttgagaggtcatggatcatagatgatcacaaggatggatataaaaccgactgtagaaaatatgcagccgttatcttaatggaattatacaaagaaatttaaagcacaaacccggagccatcaggcattcaggctcatccaaagctagctccttggataaggaggagctgaggattattagcagcagacagagagattggtagctcgggttgagctttccatctcgcatctctccctttcgatggatgaccaaccgaaagaacacgagacgttggacgttgcgagacggcgcatccattaaaacgggctcgatcatttcgctgcagccaattagccatgcatatattgatatatatctcccgtgggaatctcatcatgcaagcgattggaggaaagcaacatttctgtactctatcttaatatcttatggtgtgatgctatatgcattttcaaattttcagtttggcgttttgtagcatgcctactctaacttctgatgatttcatcagcgtacattcttttctttttaaaaaagacatatcattgtgcggacagatattcagatgatgacgctgctagtagaatacctttacattgattaatcatgttaggatgaggctgacgaaatttctctctggcattactagtagaagaaacatgagacactggcaagtggcaacggatactgctacagcatctacctctcacgagcagttcaaacttcattttttttactgaatggtaatgaggctttacaggttggaagcaaagcaacgccgaaaagcccagtcaaactcagaagtgagacatgcatatgaaaatgctctctacacctgaatagtgaacagtgcctgcctgcctacttttttacggtatgggcctgtactgctgtacatgatctacgaaggacaatgcaaccaggcaagcatagcattcggcatcctgagaaaagaaaatatatagggtgaaaaaaatacaatgattaaagatggttgaggaggggtatgtgcaatgaaaacgagttcatgattcatagtctccttgccgaaatgatggggcataattgtacgttgtcctgctccttttacgtaaagatcgacatcttgagagcgtccaaaacgctacacatgctttgatatagattgacacgcatttgtctattcattctttcgtgagaaagaggtgggatattttaatgtgtcgaaacaacatttggcagcatcccggccttcctcaggtgtttctcgtggcacttacaccagtatctctacccttgatctgtcactaataataagtggtggtttactgccggtgagaaaatgcaactatcaatctaccaataggagtgctttttttttttttttaacctggatagagaccgaacattcgctggaagacgagaggtcgacgccacgcagtgatgcagagcggccggtagcacaaaaaaaatgggtactcctccacctccactaaaaacttgccaacgtcctcgcatctgcaaaagccggcggtggaggaggagggaggcctcgttttgtccgcgtctgcgtggcggcgccctcccagaccggtccgcgcgtgccgctgccctgccagacagacagccatccgatccgtggatgggatcgcaaggcagccgcgcgcgcgcccgcgggggcggggcatatgcgcacggctcgagagcccgtgcagtgcagctgccaccggccaccgccgcccgtgcgtgccccggtgcgacgcggcctcttcctttcctcccctcgctggcgccgtggcgcgtggccgggtttgtgctccccgacgagaggcgacgctgcgacgccacgcgatgacgagttgtattgatccggtcagctcaaccgttcttttgccgaggccgcgctttgggccttggtggcgtggcgcctcgacttgttgttgtctagctagcgcgcgcgtgcgtgcgtgctgggcctcgggcttgatggagttgttgccttgtttggtcctggcaatttcatgggctgaatggaggggtacgcttaaaatacataggaatgaactgaaagtggtacaaacactttcagtctacacctttgtactctttattagattttttgcgaacgcttgtactcttgattagattggcgctctaaaaaaactcgaaacaaattgaaagtggtaaaaacacttttggtctaaccctccgtgctcttccctagattaacgctctaaaatggtagaaataaattggaagtggtacaaacactactgctatgagtccacgacggtagcaactagcaccaaagctaacaaaccaagatagtaagactagatttgcatcacttaagctatgaaatgtatatgagtaggggtgggcagaaaaagaccgaaccgaaatgactgagaccgaaaaattcggtcagcactttctactaaccgaatttagtttggtcaattcggttttggggctcggttaatcgaattgaaaaaaaccgaaatataacactggcccattaggcccaatacctcctcagcaaaagcaaaaccttatccactccacgaccttatctaacccactaccaccatcatcctcctctccatccaccgggcccttcccatccctatcccctcctcccccgtgctggtgatgccgatcgcgatggtgaagctcccggatggcctcccgcagccgctccttcgccttccgtaggtcgccgccgccctgtgcgccgcctccgcctccagtgccggcaccacctctgcctccgtcctccgcctccagcaccggcagtgcctctgcctccattgcgctgttgtcgcgggcacccatcgatcatcgcgccgcctctgccttggtgtcgcctccgtctctactctccaacggctgtgaaaaaattcggtctgaccgagaccgagaacgaatttgttggtcctgagtttccaaagaccaaactaaccgaaaaaccgaagaccgagaccgaatttgtcggtccaaccgaacgcccacccctatatacgaggagccaatataagtattgtcctgatgatctaaattctcacaaattgtttggtcaaacgtgaaatgtgagccaagcatgtttttctacaacatgtaaccctcttcgtgcacaaatcaacatcaaacctacaaccatcacaattttatgaaatcttctacataaaaacttagtatgcacccttgtcctgatcgatggactgctggtccgactagtgaaccgtcggacgcaccagttcaatcaccggtatgtttttaataactattcaaaagatcgatatggcatggatatatctaaattagcaaaaaatagaagaaatctagtctatcgttgggaaggaaccaaatccttctacgccagagggacacaccgtctttgtcttaggcccagaagacagattgttcgattcatctcattcgtagatgtccacaacatctaggagctttgaccactagagccaccatgcgtcggggtatgtgataccgtttcaggcttcctgtcgctcttgctggtgttcgtcggcctcagctgttagcctcgtcaaatggtggtgctgccagcaaaaatgccttgagcatgtcaagtgctgcgtggaagcaatccttgtcctttcgcctgcgaagaagtagggaagcgagcatagatgaagcaggaattgtccggcgcgtcgtagtcctttgcaaggtttggacaacctggctccttgttgcctaggttcagtaaagcgttacgactatcgagaaagaagcagacgcaaggcatcgaatgatggctctttatgcagaaaaagaaagagcagggcaatatttcgatgagatccatgtagctattctgagatagcaagacatcgatatgttgtcgacctgcagtagcagcagagatgaagatgaagagtgtggctgggttgcccaatttgaagccaacatcgatgataggaccaacaacaagcattgagatgtcacccctgccatcgctgtcagctgcaccacgtatccctgtgcatggggaatatcaacggcgaatgcgtttcaccagcgagagaggagcttgagcaggtcgagcgacaacttcaacgacagccgttcagggagagtgacatgaagccactagcgtgccacataccctaacaaccgtagatccccaatgatgtggacgactgcaaatgggatgaaccaagcaggcagttgcttttgggccaaagacgaaaaaacaaagttagactaatgctattgttggaaatgcaaaggatgattatctagcgctggacatatgcctgatgttctacatcaaaggatttggttttcattgggttttgtcacttctaaaaccatccaatatagtagttcaatgaacaccgaacattggatcaaagtaaactgctaacaagacccctcaggaaattttactttacattgtagtcctccagcctctcaaaatttgaacgtgtccgtgcttttgagttcaggtatgtggaatgtatttataacacattataactaacggttgatagcaaattagttgttacaacaaaaagaccaacattccaaatgaaccgtgttgaaaattgggcaacatttaaatgcggcttttggggcttgtttggtcatgacccaaatgaatcattccaaaaatttggcagcattcaaagtagtccatttggtgtgtagaagaaagaagggcattgacaaatattttggtttagatgaaatgaaaataatccactagaatgcttttttggtagcaaagcaaataaaacctttgcccacctttatcagtaatttgataagtttactgtttttagttgttacaaaccaaacagagcgtgactgacatgtggaaaaccaaggtctcgctagctccatgcataccgtcttaagcgaaatatgcagcgagactacactagaattagatttttttccctcgtatcccgtgagatcagttgaagatgcgtcattttggtaatagagattgatttaattaaatgcaggcaacatatatggtcagaatgacgtctatactactattttgccacggtttgttatagttttctccacgagacaaggcgtgaccataggtggacgcaaacacacccctgctacttctgtggtatgatatcttgatttgtgttcatgtcgacgcggccaaccatccaatctgcctgtcttgcctctaacatgtccttaaaacctagctcttcaggggttaaggcagcaagcggaacaacaagagaagggatgccatggaggcaacaacgtcgatgatcccctctccctcggatccatctactccagcgtccccacgccacctctctcactgtccctattcgtggaccccgcgctgcttccctcgccaacgccagtggtcatccccacattgtctcatttgccgacgcagctagtggtctcctccacgcagcctcacttcatcatcatccccgctctctcttcctcattatcacaggtgccacaacctccttccccgctctctgtactagctcaagttcttatgtatgaataccaggaatcacctcactgtgtcactggcactaagaaccacgtgttgtactatgcttacattgagatgtgtcggcagctcgacccacaggggctattcaatgtctaatcaatcaatgcatctatgcataatttaattttgacgggtgaacttaacggatgacacaatatgagattatccttccttcattttagtatcaatagttaaaaatattttattggtcttgatgaattacattttgttggaaaattgaaggaccggttatgttcttttatgggacatgcactttttatacacttatcgtgtgttacatttattaccaatatatgttccgtacacttttgttttgtagttttgatgtggcctatttatttcatgattgcattccacattatatatgctcgtaaaacttcactgtgtaaagaccattcatttaattgagccgctctaaactgctcgaaatgggtagtttattttgtgaatcggcaaaataaactgctaaagctatccaatagaacacaaaacattgaattaaggtaaactgctaacaagatccctcagaaaacttttgtttacattgtagtcctcccgccccttgtaagtttgaacgcgtccgtcccgttgagttcggttatgtggaatgtatttataacgcatcataacttgttgttgaattggctgtttcaacaaagggaaattgacatttcaaatgaaccatgccaaaaatttgacaacatttaaatgcggttattaggacttgttcagttcatgacctaaatgaattacaccgaaaattcagcaacatttaaagtagtccatttggtttgtggaaaaaagaaaggcattgccaaatatgttggtttatatgaattgaaagtaatccattggatggtagcaaaccaaataaaacctttgtgccaaatatgttttgtgttcgttagttgttacaaggtctcaccagttccattcataccatcttcagcgaaatatgtggcaagacttcactcgaattggattgttttccttcgtattcgtgagaccaattgaacatgtaccgtttcggtaatagagattaatttaaatgcatacgagagatatggtcaaaatgccgtctatactattttgtcacggtttgttagaatcttcttcgggagacgaggtgtgaccccgtgtggacgcaagcaaacacctgctatttctgtggtttgatatcttagatttgtgttcatgtggacgcggccaaccttccgatctgcctgcctcggctctaacctgtccttaaaaccctagctctttaggctttaaatgcagcaaataaaataggttagtagctactataggaggggaatggatgggaagggacgccatggtggcggcggcggcggcgaagatcccctcaccctcaccctcggatccatctactctagcgcccccacgccgcctccctcaccgtccctggtggtggcccctacgccgcctccctcatcattcctagttgcggcccccacgttgctttcctcaccaactcctgtggtcgtccccatgctgcttccctcgccaacacggccggtggtcttctcgatgcagcctcactttgacctcgtccccgcgctccctccctcgtcaccgcaggtgccacaatcttctctttcctcgctctctgctccgggttcgactcgccactaccgtaatagtcctcgttcctcgctgcttgctccaccttcgaatcgtcgccgcctcaacaaccccgatgaaggccagtccccacgaggccgcggtgaggaggcgaatggggacaatggagtgctagtcatggcgacatcattcccatgggtgacatcggctgatctgccagtgttgcattgcaccctagagagcatgttgctgaagggcatcacgtctgtggagggcaaagccacctgcaatcgttgcagtgcggaggtgcccatcgcgtacgatctggacgcaaagttccgggaggtgcgcgactatgttgcagccaacatccacatcatggatgaccgtgccccggagcactggatgtgcccgcggctgccagactgcggctcgtgcggcaagaaggcctgcatgtggccacagatcccaaacgagaagcgtgagatcaactggttgttcctcttccttggccagatgctgggctgttgcacactagaaggcctcaagttcttctgcaagaataccaagaatcactgcactggcgccaagacccgcgtgttgtactatgcttacattgagatgtgccggcagctcgacccacaggggccgttcaatatctgattgatccatgcatgcgtgtgcatccgtgtgtctagatatgttggatattatgttattttgtttctgtttgcttgattatccggtacttttaaggggtgaatgtaacagatgaatagatggctaggaaagagataaattttcctttcttttagctctgattgttaagaattcatccatttatcaatttgataattagtttttgcaggaaaaaggactggttatgttcttttgtaggacgtgcacttttcatacaaccattcacatttgttaccaatatgtgttccgtacacttttttctaacacttctgtttaattgtgatgttgcctatttatttcatccgtacatgcaggttccattatactgtacccataaaactttgcctggaatgtaatatcttgaagtacttgcttcccaatgaggtctgtatatcacccacgattttagctaggtattaacctttttgagttcaatcttctatacggttcactctatggaccatcttccaattggtgtatttttttttatgttacaaattacccttcatgattcctaactatacgagaccttgttcggtttggaggggattgaggaggaatgattccacaccagaattgttatgaaataaatctcctccaatatatctctttggccttattcagtttggagggtattaagggagaataaatccacagtacaatagatgtgaaatagatcccctccaatccctcactcttagggataataatcgtacatggttttacaggcattagatgaacacaatttgaaagaacaaaatccttattttttttcatgccaccggaaatttatttttcataaaattcaaagttttaggtgtcaagttaagtttccatagatttaaatggaacatcattgagtctgaactattctttattaatattagtgtgcaatggtttggagaaatcttagataatttagtgactattggatgattggagtcttaataaattgctagtcctttgcatttggattttattgtgttgatactaaaaactctgcctattttgtgtagttgtgtgataaccttaatctcatattaatttttagatgttttgtcaatgggattgactctgataaatctatgaccgacaattgccactatcttagtatgttatgaagtattttgatggatataagtttatataaaattgttcctatatatagggtagtacatcactacattgtactagagcctttgcttcatactgtaacatttgtttttggaaaaagtacgaattactcccccgaactatcgcggtcgaccgacttacctccctgaaccacaaaaccggacattcttcaccccccaactatgcaaaccggacgaattacccccctcgacccaatttgcggtggttttggtctacgtggcatacgcgtggcagcccagtcagcattatatttataaaaaaatgtgggacccacatgtcatactctctcattcttcctctctctctcttctctctctcgctctctgtctcactcttcctctctctctctctctctctctcacggtcatgggtcggcggcgggcgggggacgaggaggaggtggcggcggcgccgacgggggacgaggaggccgcagtggcacgggacggatggacagaggccatgacgaggaggcggcggcaacgcgggatggacggacgaaggcggggacggcgggggacgaggaggccgtggcggcgcgggacggacggacggaggcgggggtaggttgtgggcgggtgtggacggtgccgagagatgcgtgctggtggcggagctggtgcagatgcaaggcatcttgaggcaactggaggtggaaatgggcacacatgggggcgttggcggcaggggtagggcggcgatgtcgtgtaccacggcgaccacacctgcgcgcacggagcaacatcagcagccgacgctgccacagaagtagaacgccgtcggtcgcattcacctccatggccgtcaacgcatgtcgtcgtcccccttcgtcgtcgtcctccactcctccgtcgccatcctccactcctcatcccccgccaccaccgacccgtgagagagaaagaggaagagtgagacagagagtgagtgagagagaaagagtgtaagagtatggcatgtgggtcccatatttttttatataaatagaatagaatgctgactagactgccacgcgtacgccacgtagaccaaaaccaccgcggattgggtcgagggggtaatttgtctagtttgcatagttgggggtgaagaatgtctggttttgtggttcagggggtaattcggtcgactgcgatagttgggggggggtaattcgtacttttccctttttgttatgtgttcttctactagaaccttattgcttttagtttgaaacagattattgagcagattgttgcggcaaattatctacttgattacacggataaattaaatattttacaaacaaacaaatagattgaacaagtggcctgatagaattaatttttagaaaatgtattttttggaagtgggaagcaaatattccatttcattaatccggtacataatctgaaaagagttgactcacatgtagtttctaaactttgtattgtggtaaaatctttagctcttttataaaaattgaatatgattctatactcatcgcgcacttcatccatcgtcgtgctggtttttcatccgattttatttcagtttcatgcgaccgacttcgtctcgtctcgcatcgcatcgcgccgtccgtcaaacagaagtgaacgagtccgcatagatcgtgtgtggtcccactcgcaccaatcctgttctattacgatttgctccatggctggcgattcgatcgcctgcatggctgcatggctgcatcgcctgacatagcgggagacaggttaatccacgcgccaccgcccgtcacgagccacgccgctgccgctgccgcctgggagaatcgggtttccgcgctcgccgctggaagctgccggcaacgggctccatcccgctatgacggttcaattccattccctcaccgcaactgcccggggaggatgcaacccgcgtcacctgcggcgagtttctctgacccagccgattccgtctaaaattaatcagaaagtgagtagcctcatcctactatactactacccatcctccgcctgatttctcttatggaaggggaacctactaccgatctcacattcacatatttgtgattgattggtcgagcgtggagatggcagccgggagcccgggaatgatagcacgggacgaccttcacttataatcatatagcggttcgaaatggtatgcatgtttaattgccattgcttccccttcgcattcatctaatgttcttcatttcagtgtgggcgaatcaaagaaatatgtggtcagggtcagggacgacagttctgtgtgggggagaaaagccgatgatggattgagacatccctcttcaagctgaggagtgattcctcaagtatgctataatcaacctcctatttcaatctattcagagacaggaggaactgtgctgctccgaactattctgctcatgatcctacgaaaaggtgcggacttgttagcctgccttgagaaggttcagcacattaagcctccacaagtcaaaccacacgataagctcctatgatttgttaacatccaggtaagtccttaagaaaaactaggtatgtattgctaaatttttcatattctgatattccgtcttgtttcaatcacagattccccacctatcatgtcattgtgctgtacatcaaaaatctcggagtacatagacaagggggtttcatagcatttcaaggagcctattatggttagacttttcgattcaaaatcttattatactttctaattaagttgaatttgttcctgtgaactaataatagaatgtatctgaccaggccttccaagggggaaaaaaagatttatgtatctgactgcgaaagaaagtgagaaggtgaaaaggttgcatcagaatcaacaatcacttagacaggttaaaaatcatgacaaatctatattagctttttccgttgtaacttgcgggcattgtctttagtagttctctccgttgcaactcacaggcattttgctagttaaaaaaagaaaacaaagcaatatcatttttgcatcaaatacttgatatccatgcaaattttagctgcaaacttgtttattttctatgaaaacttattgagtttaactttgataattgttctcgttttttctaaactctagtaataatgaatcccccccctccccccctaaaatgtctaatactacagatattcgaacagattttcaaagtacaaaaacgcacccattatgcccgttttcaaattgcatgatctgtaggacaccttgtatatatatatcaatatcaatgtcaaaattttcacaatcaatactgaaaccgattatattttgaaatagttggctgcaattttttttggtgcccctgttacaggatatgcaccaaactcaaaaccatacctgggatggggggcttggcaattgttctccctcgtgggcttgtggcccggccaacaacccaaccaaactcagccaaatccatctggaagcacgcgctttcccccttccccagataacaaattcaccaaattcccccgcctcgaggaggaagctaacgaccgtccggtcaatttccaaccgccctctacgactgccgatccttcctactaattcctatgcttggacagttggacatccttgaattccaagagtcagccgcgccgccggccggtgccctctcccactcgtcttcaaacgtcccaactaaattatagcagccaagagcgaatcgcctctggcctctgctactttttcatcccccgcacggaaggatatctcaattgtgaatcgtatcgcatggtgtccggggaaaaggagaagtggaagagaagccagaagggagacgacgagagatttgtccgggcggcaagccaaggcggccgttctttccgtcgtgaacgcttcgtgtaaggttcggtgtcccatctctcatgtccgtttcagaagaaaaccgtattgctgtgttgatgctaattactgatgatgctgaggttcggctatcctggatgcatggctagttcttagagttctagggacaagtacaactattgttaaatagcacgaattcaaggttctgagtatgatttctgtacttcttttgatggacaggcaaaacatccatctgatttatcttgcgaattggattgcttaacctaatctgggaattcaagtcagtacgtacgatatgccggcaccatcggcatccatccatctgggagttccaactccgtacataacatctcatggatccaaaattgctcgcctacacatgtatgactggattgtgctgattcttctagtcgtagtagatggaatactgaacataatagaaccattccatcgatttgttggatcggatatgatgacagacctcagataccccatgaaagacaacacagtcccattttgggcggtcccggtaaacatcttacccttctagttctatccaacagatttcctttggcctgtacaggtaattaaagtttcttgaaaattcatgctttcgtagataattggtatcattggaccaatgattatcatcactggaatatacttcaagaagaggaatgtgtatgatttccatcatgccatactaggtgagctcatgttctttctattctgttttgttttgctagtctacacattttgtaatttcttatctgaaacctagcaatgcccttgcaggtctcctattttcagttcttatcacggcggtaataactgatgccattaaagatggggttggtcgaccgcgtccagatttcttttggcgctgttttcctgacggagtacctgtaaatttctagctctcaattggattctctaagcatgattttatcggagccggcctttgttgcatctgtcatgtatgtggaacttatggattttcttggattgcaggcttatgataatttcactacaggagtgctttgtcatggtaaggcgagcgttatcaaagaaggtcacaagagttttccgagtggccatacttcttgtaagtgaattctgtcagttgataatttcgtatgtatttctctaccttgttactacgaaatctcagtggaatttcagttagcattatcaaacacataggattggtcatactctagactgcaagagcttttacgtgctgcctgctcttgtggagtactgtggatcgctgacgaatttatttttgtttcttcagggtcttttgctggccttggtttcctgtcatggtatctggctggtaaaataaaagtttttgacagaagaggccatgttgcaaaactctgcattattattctccctctgctccttgcagccttggttgctgtttctcgggtagatgactattggcatcattggcaagatgtgttcaccggtggaattttgggtaggttaattttatagtgttacctttgcagattatacctcgcaacaagtaaaggaggtactgacaagtgtgctgcatgtaattcttggaaggttctaactttactgttaaaactttgcagggttggtggtttcttcattttgctacctccaattttttccaatgccatctgatgaaaacggtatgcttcatagttcagactacttttcttcatgattattgcagagatgaaaatcacccccaaagggtcattttgagtagtacatttgatactgtattttgacatatctttcgtactgtaatacgctgacctgaaatttttatggccaatttcctgggcatcgcgtgattgataataccatgttctgtacgaaatatctgaagttgtactgtaattttgtatattctcgagcttcagatatctgtctctcctaatgtttctgacggctttacattgttcaaattttcgatgacaggattatggcctcacgcatacgcccggcacattctcaaccctgatcagctggagaacaacgcgcaacccacgtccgtggatcgccctaactctctgccgaacgggtcctttagaagccctaatggattggaaatgggaaacacgggccaaggccaagcattagatttcatggaagctggtcgtagatatcaataacgagataaaaacctgctactgttgtagcagacatacctgacgtactttttgatagactgagaattatacggagacctttcaggttcactttggtacatataccgtgtagaattgttacttgtacatttcaacatgatgatgttagctatttctcatgtaaatctataccagattaaaataatgcacctacatttgggtatccggaagtatgcctgacagtagatggtcacattgtcgcttggcttatcatacagaatagggtttggacctctggccggcttgtgaccagggggttggaaaaataatggcaggtgccctctctgcatataagagaagatgatacggctttgcacctcgtcgccgagtgcaggtatacgagaaggatttgaaacctcgttgcgacatgggtagggtttcaccagctagaactccgacgctgggggtggtgcaaccggtcaaagattggtggaaaatactggcctctgtgtctggcgtccctaagaagggactctgcaccctgattctactcatcgtatgggaagtttggaaggtgcgaaataggaggatatttgattataaggaagccacaacctcgtatctcctttcaaagataaaagaagaggctggcatgtgggccttggcaggcgccaagtgtcttggagagatcatcccgcagtttgtatagtgtacagctttccttattttttgctttttctttacccttaggggttgtattttttttcttgctatattcaatgaataagcacattcttgtgctagttcctttcaaaaaaaatgcttgttttaaaattgagcataacacataagtgtgctaatgtgatgatgtgaaacaaacatcagcttgtgttcttaacataaggatccataagaagggctattgcttggagttacagtgatcataggacatgtttcatgaggatccataaaacaagcagctttgagttacaatgatcataaaaaactggaaatgtttcactttcatgaagatctgaacacgtctcaactctgaatagcctggaacggggttgcggcttaacatgcggcccgttaactctaggggcgtctacggatcgtacgttagggtggttaaagtttttaagcaaactttaaactattttttctcctaaattatatatctaattcatgatccgattgcaccattaaattcgttgcaattaaaattttaaaacaagaccacatatggatatattccgacgaaattttttttagcttattattgaattatttttaaatgttgcacgatgttccaccaagtatatcggaattgttttactaagtagatcgaaaatgtttcaatcatttaaattgggcgttgtttcatcttttataaaaacacaaaagaatgtttcagttcactgcaacatttgatccatacatagtgaaacattatgagtacactaggtgaaacattttttttggaaaaaaataaaacgaattcccttaatagagggtttccaaaatatgtgggtgatttgttgcaaaagaatattccaattaactacaacattagatctatacatagtgaaacattgtgagtacattaggtgaaacattttttgtgaaacaaaaaatgaaacgaaatcccttaatagatggtttccaaaatatgtgggtgatttgttgcaatgcggcacgttccataatatcaaaattcactgcaacatttaatccgtacatagtgaaacatcatgggtacactagctgaaacattgtaaaactactggtttgaaacatcaaaagagaccatatgcaacattaaaaaaatcaataaaaaaactaaaatattttttttcgaaatataatcatgtgtggtattgttgtaaagatttaattgtaacgaatttagtggtgcaatcaaatagtagattagataaataatttacgagaaaaaatcttttgaataaataagagatgtgagcatgtgggggaaagattctttgaatgtaatagcaggcacatgtccgatttttctgccctcccgtcggacgtccgacgcccagcattatccgttaactctggatagcgtgtgttctctttttcgttaggccgccgcataattgtggcttacatgcgtgccacgtttattgggccgaaacgggacagtggcttgcgtgcggcccattttaattcgggctgaacgggattgagtgcgaccggcacggcccatttatgcaaacctgctgcctaaaacatccggccgcctgatgcagcgaatcccatcaccggccgccgatggactgagccaggaacgggcagcctcagtcgtcgaagcctgcactgaactgcgatctgttgagcattctgagtttgccgatcaaattgcgactcctgaacaaagtgagttttgggtggataggctatgtcaagctgcaagcatatcaggcttctagcttttgcaagagatttttcattgttccaacatgaacacattctctctgtcgctatgcgtcgtgcaaattccgtgtcacagagcataaaacatgtgataccagtacgtgtaaatgtgagtagaggatcggcatcatatatctaaattatctgtctggtccctgtaatcatgacacgcattttgttttggagcatatatgtgctgatgcagatgcgtcgtctgcagtagtagtactcatgtgacacaaagaaacatgagatcaacatggcctgaacactgaaatgatgcttcattatcttttatcattggtgtcagccaaaagtgccctgatgacctcacccttgaatatgaataatatgattctctgctgtactatatgttcgcctgccatgtgaatcaggtgatgatcatcggaacatttccccctgaatttgcaaggtaatggaggtcgccgacacttgcatttcgtccatctgaatctaccacagtggcacgttgctctgagtttgctcaccttgttccaagaaaaaaccatgttgctctgtctgcctccttggacaggctgtatactttgaataaggtggtaaagtttgaatcaatgaacatattcaggcatcggagcaacatggccaaattgagcctaacctgcccctagttaacttggaacagacaaaaacctgcgagctgaacctgacataccaacgggcaacgggtggctctcgattaatctaagaccgagagatgatcagaaaacttttagtggagatgagccagatatgagctgtttagatgactccgagagaagaattttgttgtgacacgaatgataatgtctttccaacaagatatgggtcgccattatgttgccattactttgactacaccacagctgaaacctactccttttttcctctccacataatcaaccacgttaggcaacaaaaggtggtagattatttcataaatgtaactttcttgtgaacatcacatttgtcttagctctccagaacaccaggtcaaatttgctcaaacttctcacccaagcatgctgttttttttttatatgctggaaccattgaagccgccgcaacagatagatggtccagcgcggggcttcaaattaatcagatttaaatggtggacgatttatggctttttctgacattgagagatttttcttcagcatacttttgaattgtctgtgaccactggatgcacaattcatcaatttctgtggcacccgcccccatcaaaaaattcagtgatgcgtccatctgtggtctgaccagattacagttgatatatggacctgaattaatatatcaacaaccaaatacctgtccccatgctatattgcgaataattcagggatgttgaggagtagtatgtgtcaattctcaggtttcttaggtcgtctccttgccgaaaaacctgggagaacattgtttaattctggtatgaagaaaattgttgattctggtatggattctgtcgtgcatataacagctgattagatggtagtctcactgaactaaagtatgtttgtattgggttctttggtcatctctgctgcacaactgccaaaaacttacgagaagagagaaaagatcactgaccaaattaaagaagcaaaattaggtgaagaaaaaaaaggaatgcagaggggacagtccacaatctagtctcaatctgtgtggcttgaactctttgatctcgtcctccagctgtctgatgcaagctttgtcaaatcacagagcccaccacggaaggcgaagttggcagcaacatgcacatgactttcagagagagtgattattcaatcgatcgatcagccggatgggctacatgatgacaaacgggattgactcggacgctaatccggcgtccaaagtaattaagcctaagtcctaagacaagttgtgttgtgccgatctgtactgtgcacggctgacccaatcgtggcgtgaagtcctcgaattaagccatcgattagattaattactcgtgacttcttgagtctttgtagatgcatttgctgcaaacagtagattgatgtctacgcatgcgtatggttttctgaagtttatagcttttgacggtcaaatgctaaccaccgggacggatgaaaacgctggatagcatagtactcacgggcttgtcggtttgtggtttaatcagcgtggtgcattgtagatgtactattaacttcacgggtagatatgcaaggtttacttgacctaattaatactagtatcaacctgtacgagcccaactatttggtgaaactactttgacagtttgattgagtggaaagactgaccaggtacattgttcagatctagtagacaacttttaattattctgatctaaaaaaattgttatgccaatttgttttggttatgatacaaccatacaaacaactactagcttattgacaatctggtaatatagggctaatcagtactaaaacttaagcggtttaattgttggtgctaaacagagactagcagatgatcgtcgtttttggagcacattttccatctgcagcagcatataaaggtagctagctgactttaaagatttttgtcagttttcatttattctttgcgattatttttgtcacttttctcttttgtacgccaaaactagctacttcctccatttcacaatgtaagtcattttagcattttccacattcatattgatcaatatgaatatgggaaataatagaatgacttacattgtgaaacggagggagtagatcctttggcaattcatacaatccttatctctactttatgtcccttttcttttggaaaaccctcaccatcaccatgtgttgtacttcacttaagtacgttgtatatgtactatagtactactgctaattcattgtcaaattaggacgtcgaacacattatattgtttgattaactgaagatgacggttgatccttgaagatgtgaatggatgggccagcaggttcggccgtcagctctgaacaccaagcactcaaagtaaagtgtaagtactggagtagttgtttaactgaagaaaagtactagtacctatgtgtgcatatctacgtagctttccgttttctcataccatattgtagtataataccacaccattctgactgcttttgatgcgagcatcatttggttactcaaaaattttccggcgatatgtgaatctcaaaacttgtatgcacatcaagtgagaaaacgactggtgatttacgcttcgttgttgtcgtgccgtcatacgtgcaagcctgtaataatgtaatatatgtactctatactccaacatgcatgtgtacagtacagaaaacgcagtgcaagttgtatagtgccttacaactcaacgacgactaaattaaggggaaaagttaactacaaatagctagttaatccggtttgatctctttgctatctaccaagtcagagagagagagagagagagagagagagagagagagatgtgtagctttcagaccggacgtactgaactgggagtgcagctagacacataaaaagaaagataagaaactatccagtgatggtgagctaacctaaacaatgtaaccacttgggcaagttcgcttttgatgcgctacaatagcttatagctacctgcacgttgattaattaggcagcatcagcagcagcaggccggatggcatggcgagatcgacatcgaaatatcgcctgtgaagtttgaccggtgtccaatggccgccaatggcgtcgcaggcgtccatggattacgtataccaaagacgtgcttatccggcccccaatttgcgattaaagtgaaggttgagcacatgtggatgtggcgccatcctcttttgatcccccaagagccacacagaggattaattaactaactaatcgcctaaccggagcagcagcaagcagggcatactgattgatcaattagttggtagttaaatatatcttgcttcttgattcggtaaggggggagaaagagcatgccaatttgtccatttcacaatactactttggtgacaagatagtgtatgtggtagtaggcttggtagctacaaggtgatcttgtaatttagccctaagactttagcataatcccatgttttttttaatttgctccttgtatttatgtacaactcaccagacaagtactccatatgcgggtgtacatttgtacctgcagcaagtacgcatatattttagctgaaattcaggggtagatgccgcgttctacaattcttttatgcatgttgtaagctgctgcaatttggccaacacaccagtacaccaccacacattataatttagctactatagcaaacaacgaacaagacggtaaaaataaaatccccactgtcatttcaggaaaaaaaaccgtagacttgtggactttgaccagtattaccctgactgaacaatttattttttgtgaatcagctggaagaatctacccaggtctactagagtatacacagccacttggccatcgatcgatgtggccagattgtagcccacggtacaccactaggacctgcatttatctacgcaataaacatgcgtatgtatacgtacgtaagcacgaaatgcagcagaaatgcagactattagtactactcgcacattcatgctgaattgctgaagcatcaaccctagctagcggccgggtcttagttttttgtcttcacgtgatcaagtcatacaccacgggaagagtttggctgtcacccaccgtccctttcgcaggtgacattgtagagactttgctgttgctgtatgctgcgacctacgagaaatgaaacgacgatactgtttatgaatcttccaaaagctcaagggcacgcatgcaaaacgccaacgtttggaagacccaggaaaacgacctaaccacagtaggcaatgcaactatgcaagcttcgagatccgagcataaaacattgggttgacttgccataacagccggtcagcaaccatccacatgcatgctagagattgtgcaaaaacccctatctgcgtttagcactagttaatatgtttctcaagcaaggcaaaaagattgtcttgccggtgcatgtttgattgttttccatgattcggcgatcgaccatactaacgcgggagagagagttaaaaaatgagaatcagatgggcagaaacaacacggcaggggctggacctgctgcatgtggccactacgggccctgcattggccagcacgcagcgaggcagcagctacggcgtcagcgagagccgcagggaaagatagaaaaaaagaaaacgattagctgcggcgctgggtcgctggccaccggaaaggagcagctgcttcttgcattgctcgcgtctccactttccacacgcagccgcgtgccggtgatcctgtcgatggatcgatcggtcccccaagtcagacaggctgcctctctggtgtttttgttcctgtgcttgtgtcctttgcgctctctctctctctctctctctctctctctgtctctctgcccaatactgtgcatctgtgtggctgttgagccaaatgactttaaccagaagctagctcgtctaccgcatggtttgcacatttcctgtgtgaccaagtgggaaacttccaggaaggtatgggtgggggctaggcttggggattgaggcagaacgccgatctcaaaagacagctttggttcagggtttcagggcatggagtgcaacaaaagctcttatcacctgcgtacatctatctaacatgaatgcttactggggctgagcagtttagcagcctcgctgctgtgatacgtacagtactgcatacccataactaactgatggtacttcatgatgtaagaagtgtagtagtaggagtataatatggctaactacagtaaatcaatggtgtgcacagcaatattgattaattgaatggtgttggtgtaagtaagttgatatcggcattgcttggtgtttaggtctagggacttaactttagtctctatatttagacactaatttagagtattaaatatatattacttacaaaactaattgcataaatgaaagctaatttgcgagacaaattttttaagcctaattaatctataattagagaatgtttactgtagcatcatataggctaatcatggattaattaggctcaatagattcgtctcacgaattagtccaagattatggatgggttttattaagtctatgtttaatatatataattagtgttcaaacattcgatatgataggtacttaaaagttagacccgtataaacaggatctagtggtataatgtcctgtgctagtgtgtagaaatggagtgtacatgcacgtcgtgatttaaggacactttaacgctatgcagcgtatatgcatgcttatgccttcttaagatgatttgacacttgaccacgaacgattgaaccgttgctgtggttggtaatccattttaattatccttcattaattatatatattcgtttaattcttatgatttttttggaattttaaaattatttatattttgggatggagggaatataagtaaaaaagattctaaattttctttcaaacaatgcactattagtagtatcaacaatttactcatgaacaaatatacagtatactctaggcctacagtttgctcgagtgggtgtcgtgtcggttgttcgtgttacctcgctcgtcaatattgtccattggccattgggacatcactcatcactggtctctcctcgctcccacttactatttcccgtccttaaacataaatgtaaatgattttagtgttaataaactttatccacaaatataagagattttgtaatataattttttaatatgtttcaccattactttgtgagtctcactccgatgctctctactagtagtagaaaacaatctgaaccgttaattttattagattaaagaattcagatatattatactaccattctagttagcgatagtagaaacgcgaagcaacattactgtagaaaattagacgcctcatcggttgcccatattccctaacaagccacttattagggaataaaaacaatttataagtaaaacttttgtacatttgttgatttaaaagccaatggtaaaagaaattatgttgaaaatatctcaaaatcaacaaaatcaagttcgacaatttaaattttgacttttgctttgatttattagaccaaccagtgaggctctaggtgcgaaggggtataaccgttatttagccgtaactaaacctttgtttctttgagcgataccaacataatagatgactacatgttgatctaataaaaaaacataaacgacaaaattagccctaaccaatatattagtaaattactaatttacccttaatgataaatagttcggattatttctgctcgttgtataatgttaagtaaaaagcaccggattgtattgttatacgtgatgttcaagtctttaaatatcaaaataattttaatatcataagatttgttataaataatctaaaatggttataaataatctaaaatcccatatattcgtggagtactatcaagcgagccatcgccattcgccagcaaaattcggtggccaggcgagaagagctactacgacttttcgcgactcccttgcttggcttgtccccatgttgccgccgagtgcagattagaacaggaacaatagcaggctagaacctagccgtaaacatattttaagaaaataaatgagagagaaaagcagcggactatatatttgtagtcagctgtagcacggacttcaagatacagtgtgtatgacaggtgagaccagatattagtagtgtagtatgtaactattgtatgaatgagctattagattagctatagatgaattggagcccgtagttggctatatatactattaaacttgctcttagagcaggtacaatagcaggctattagccagctataaacatattttaatgatataaacgacgagagagaagagcagcggtctacagatctgtagccagctgcagcacagactctaagacacactatatgacaggtgggactatatattaatagtacagtaaacaacaactgtataaattagttattagattgactataaatgaattggagctattagtgggctgacttagctcttattgttgctcaggtcggaggcccccctgatctcctcaagagccgtgcctgccagcaactctctttctttcacacacactataatttctctctctctctctctctccgtacgtggcgacgttggagtctactacctgttggtgactagggcctgacccatcaatcaccagtggatcacctcgcatccgtacgtcgtcgtcgctgatattgcaagctcgtagtagcagcatctccatctcatctcccgtagattttgcacggaccgatcaggaccgatcagtgcaacagtactagagagaggcgtatcattgccggcctcctgctccaagctatagtacccgatctgatactactcctactactacaagtctccaccaattattcttccagaaaccccagcgccgtgttccaatcaaagattccaccggctgcctggacgccgttttcgcctggccgggagggccggtcgtcgaaacaacgttgattccgctgggttttcgttttcgcccaggccggccgggtcgtcgtcaagacaacattaaacggtgcggtttaatgtcgtgacatgatgggttctcgtcagtctcctcgtgacatgatggtgtgtgcatatgccgcatcagcgcagcagcttgattccaatggccgtatcaattcgagatcgatcacagcaagattcagatatggccggtaccattgccaacaatcctacctcaggctgagctggaggtagctgctagcctgctagtggtagtgtactcactaccatggctagttactcctagtatcaagcatgatatactggcactctgatcacctctcgacgtcaatgtgttgcacatgccaaaagatcacgccttgcatgcacagctgattaaactaatcaaggcacgaacaggcacctaaccgggctcatctggatagctagagaccaccacccaccataccataccattccttccccccagcttgcgatttgttgcaatgcggcgccaggaccagcaaaagcatgcgcgataagcttagatgccgtgggaacagagcagtagtacttgcaacgcgttgcttttgttcatttccagatctctctctctctctctcactctctctctccttttcttttaaattttcttttttatcttctctattggcgagcatatccctgcaaaagtcactgtttccggcttcccacctgttgctgataagtttagcatatcatgtctacagctacgtgtgtcagtgtgtgcaatttgtgcatgcataccgccatgggcgcgcccatcagatagctccaggccaccacgagctttccctttccaatcaaacaacaaacatagggcaccccccgggacatgcatgcacctggggcaaaggtgcaggtagagagagagatcatcggtctcggcacacaacacgtcacgtctcgcggactgcacaaacgcatcagagaagctaaaggagaaaaagaagctgcagatggggaaatatctccattggttgtggttaattgacatttgacagatatgatgatggataatttcaaatgtttcttcttcttcttgtgtgtcagttggtctagccttctagggctatgcttcattagtgtacacttgggatgaaaagatttacagcaaagcaagcaagaacatgggcgaataaattaacaaaaaaaaccaagtgagattagtagataggatcaacaagggactaagctagctaccacctgaattatgatgcatgggagcaaaaaagacactagctagagaagatcgagctaatagtgctaactctatactagtgccagctctatgcattgcttcttgaacgccgccgcttgtggaggcgtcgtcgccgccaagtccctggctctcttgcacccggccatctgttcgaccggcgccggcgccgtgagcaggtccacgccgaagagcctgacggccttcaccggcgacggcgctggctgatcagcgggcgacgcgagggcggcgccggtcgaccgtactaacttgcagtcgatgaagagcttgccgtcgtcgccggcactggcggcggagcggtagaagccgacgacgtcgccggcgtggagacccttctccttgacgaagcggctccagcccttggttagcacgtagctctggctgctgttccagtacgagtaccggaaccgccacaccttgccggcggcgtcctcgaagttgaggaggacacccttgctctcgccgccggcggacgggagctgtagcgggaagtgcttctcggcgtgctgcttcggtatgacgagcctgttcagcttgcccacgtcgctcggggtgaccgtcttgtcgaacaggtggtcgcgcgccgcggcgggcgcgaagggggagcggggcgacgagaggtggccgttggagagggaggcggtggtggtcgcggccgacggcgtggaggcggcgaaggtgcgcttgctctgcgcgagctc

SEQ ID NO: 62871 - DNA, 674 bp, Oryza sativa
  unsure (1)..(674): unsure at all n locations
aacgaagcacaaacaatcacaaagcaaccattgagagtaatgaataaaatatttgttgttcataggaacaccacaaataaagtatcttaaccaatgtttttttcacttaaaaatagagacgccaaataaatcaagaatatacctctggctggtcagtttcttgcaccagcgcctttagtgcccaattgggctgtctttcaaaaagcttgaatataatattttccagttccctgcgatccctacgtattctttttgcatcagatggtttggttggtgtttgcttcttcttctcctgaagagcacaaaattaaatgtgttatgagaaactttaactgatgatgagtagttcaagatgaagaggccgaccacatgattggcatttggcaacatggtaaagataaaaaaaaaagtagaggaaatcaagtactgaactcattttataagccataatcagagagaaatcagaaaacatgtatgcagatccttactacctagatagcactctattaacttgaaataacatcctccacagaaattaaacacctagagttattaagaatgtgtgatctatatcattaatgataccagaagaccaaaagggaatctcaatcttcatttccggaaatgaaagcaccttagacccaaaaggtatgagnaccaccatgccaagcaac

SEQ ID NO: 62872 - DNA, 1786 bp, Oryza sativa
  unsure (1)..(1786): unsure at all n locations
atcgaaccttgggtctatatgattaagtgttttactttatgtcgtccttctaacatttcctgngggtcttaattgtgnnctaannnnnnnncnnnnggcgganatgattgtgatcgactcgtaccccctctttttcctctctctcactcttcctctctctttctcgccagacgacggcaggcggtggacgcgaagctgcggtggggttgggggacgaggaggcagcggcagccgggggcactatgagcagccaccccttggcgcatggatggatggaggtgggtgcgggcggcggcgcggcatgcggagacggagaagcgcaccggcggcgtgctccgcctccccgtcattgacggggttctagcgcctgcgccagcccttctacgccggcgaccttctttccgtgccgccgccgatcagaccattttctgcaacaccgttgccgccctgctcaccatgcaagaggtccgcagcggcagctccacttttccctcccgccgatgaccccgctgccggacttcgactagctcattccagtccgtccagccgcggccaccggcgtcgacgttaatccccacgtagtcatcttactgtgtcacggcaaatgccaatattgcgacgagctgcaaccgttgtcaaaaaatttattggcaaacgcaaggtggagctatgcctctgctcgccattgatgctgtcgacgcggtcgtgcgcaaccgatggcgccgacaggcagcaaagtgcgcccaagatgctgtgcggtccacctgcagcaaaatcaattcattcactagtggcaagaaaactttctgttctgcaactcatgctctctgtgaatgtgcgaattaagtagtagagttgctagtgtcttacgcttgaacccgtcgttgctggcctcgaggtggttcgacacagcgtcgccggtgacgctggccttgaggaagtactcctccaaccaagccgtgacctccgcaaggctacggcgcctcaccaccatcctcagctcctcaccaccgctgccgccgccttcttctcacgtgactgacggcacctagggatgcaagcggggtaggctagcgggctttttttttcccgcttatcccacttctacttcattttttcttctaaattttatactatcatacgagaaataaactagcaagcaggtttttatacgggtagcgggacaacccacttgcatccctaacgacacccccgccccgccaccaacaagatgatgatcatcaacagtagcgccatcctcctcctcctgcgtgcgccgacgccgctgatgctcgatggagagcaggtcggtggcgtagaagggctggcgcaggacaccggcgatgatggggaggcggagcatgccgccggtgtgcttgtccgtcttcgcgttccgcaccaccggccgcacccggcttcatccatccccgcgccgagggacggctacttgtcgtggtcgcggccgccagcgccttctcgtcccccgccgacgcagctccgtgtcccccgcctgccgctgaccggcaagaaagagagaggaagagtgagagagagataggagagaggaaaagagagagagaaagagtgagagaggagtatgacaggtgggtcccacatttctttataaataaaatgcttactgaaccgctgcccatacgccatgtangacaaaaccgctctggattgggtcgatggggataattcgtccggtattgatgtaaacgatgtctgggtttcgaagttaagggggtaattcggccgacacaatagttcggggcggtattcg

SEQ ID NO: 62873 - DNA, 739 bp, Oryza sativa
  unsure (1)..(739): unsure at all n locations
gccccgtgatganttcanatctnatacgccangcctgcagtctactttatagatccccctttatcaatacatactacgctctgcatccagatagtgcgcacatattactatttgttctccaaagaccacagatgaaattaaggggatgttggatgttacaaaatcaaggagcgactgcaggcatgtaaacatgagtatttagatgactccttgggctctaatcaaacatttaatttatctctttatttaagtcttagatgcataaagactacaaataggaacaacttatttggaaaaagttaaatgtgaaatatatctaacttttgtggatggaaggaggagtaaactacatcaaccacgaaacacaaaggctcaggtaaccacactaatcccctccttcctcctcctatctgggagctagggttaggaggcagcagagcaccttcgacaccgtcttcgaccgaccgatcgaccgaatccacgaacggaacaccgaaatcgggagggatccggatgctgcgaagcggctcgcccgtggagctaggacggcgagcactaacctgctgcgaggagtcgtctgcggtgcgggggcggacgtgtactacgaggtggggagggaagcctctcaccacgcggcaatcgtttgcgttcaccgacgccaccggcttcacctcttgacgaatctccttctcagtcttccgcgccgcgtcattgcctttcgtgaagatttttcttttta

SEQ ID NO: 62874 - DNA, 947 bp, Oryza sativa
ctggctcggccattgggctgaacatgaaaagcttggcgcacacgaaagagtgcgagagctcagaaaatccctggcagagtcccctacctggcgcgccagatgacggagcgtggggctcctcactgggagaccgcacaggcccccctttgccagttcggccggggactcagggtgagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatgagccagcctctcccttgttctgggttccccatctggaaaagtccagtcccccctcccagtgggcaaggtcctccttttatatcttaaggggataccacatgcaccatttctctcttttttgtggggacttaccccaccttttcataaatggacggagatttgtatagttgccgtccgagtcaccatctgatgagacggcccacaactacctccactttcgccgggagcagatgcgacgtggaatcgtggctgtctgctgacgacatgaccggtgtcagaccagtcacgtcggtcattcttgtccaccacgtgtcagcttagcaatctacatgttcgcccttcttcacacaacatcttgcctgtaatggttaggatgaagcctggcatatatctgactaggactaacgtgccatctctgggaggtaacacgctagctccagctggggacgagcgcctagaagccctcgtcctgacgggatggggcgaggcgtgcgtcagatcgcctgtcgccaccaaacccgcgatctgacctctgtgactggtcacagaccggataaacgagtgcactgcactgcgttacatgcggcatgacgcgctcagccaaaccgcaataaatgtggttaggt

SEQ ID NO: 62875 - DNA, 820 bp, Oryza sativa
tttatggtattgaaatactttccgagtatatgaatgcctactttatattatgttcatgttatactgaatatactgctagcttatctgggagatgctttggtgcaggtataatgtttgtgtatgcaattactctatgtcatgacgatgatattagagtagtatctggtagtttagacgtggtgtctagattacaggatatcattatttggggttatatgctgcggatgagaggtgggccgctgatggcaatagctcagtacgggtattcctccgcgtgtgtatataatcctatgttaattcactggggagggtattcctccttatttagccccggttgtatggtcataatgggctgtcgtaaggaactcgacagtcaggggtggcttctcagagtaccaggagagcatcggatagagggtactagctagtatatcagataacaagaatgtatgtatactatatatattagaagtataggaatagattatctttctcttttctttccacttagcttagataatatattatgagaataagtagctaatgcttgtgtgtcactctacccttggattattctaacccctgcttagaatatgattatcacaagtaatatataaattattagtcaagttctctctacatgatcttcccacgggataaaataaatatgatacccttggaatactctcgggtgaattgctacaatggtatatccgtgcgcttgcggataaactctataaccataatataccataagtatttttgcgccattgctgggaattatatttctaataatgttgttaagaaataccaacaagca

SEQ ID NO: 62876 - DNA, 37483 bp, Oryza sativa
  unsure (1)..(37483): unsure at all n locations
ttggacgtcaggccacattttgccttattccgtcgcatcttcttcctcaagccccaaccaaacaagagtaaaccatgcgtagttgggggggctggatttcaattgaggggaactctgagccaaaagtatttctccatgcccttcaaaacctcaaacaaaggctggcatgcaaattggttctatgtacaaaaccccgagcctgcactccccgagtactcctgtctccctccagtttatcaggactcttggaactcacttccaatgggagaggaagccgctcaggcgcttgccctgatggaccgtatgctgaagctgaaggagcaaggtctgcaaggagaacagatcacccggcattttatcaagagccggctagctccaattaaagagagatcctgtacagccttcaaatttgatggcaaacatgacaccaaccgtgaagatcctgaatctcttgaattcaaggttatgaaggaaagaatgtataaaatcttctcgaatgcaattgtagtcagttattcgcacttgctgccagtggtgccatacaacgccttcaatccttctccaccggtatgtattcaaacatttcagcctttctcaaaagcatgcctttatctactgttaagctaattgaaaactcgaaatgttatacccaggaattcgctttgatgaagtcggatcctccaattgctcaacgccgatcaccccgctggcgaactggtcaggcgagtggaggaccaaaaattcagtctgacactcaaacaaacacctcgaaatcaatcagtcagtcggactcccgcaagaggaaattggttctgagtgatgatgaaggcgataatgctagaaaatctggcaataaagaggtgaccgggaaacaaccaagggaaaccaatccgaagaagaaaacatccagtcgtcccatgccgatttggtccgagatatggctggaaatggatggggattcggtccggtggttgcgtgaagggtttttgtgcagctcaggaggatggattggagtggatttgttaacccttgcttccgccggtgtgcttgcttccgccggtgtggttttgcactgtagcgggaaatggggaaagtggcgagagtctcggcggggaagacgaaacgacgctccgattttggcgtttatttcgctagggtatcgggagtactaatgggcctaggcctaaacagtacttcagcccagttttgctatcagcgtgattaagttgtgatccatagggacttaggcatttgtttttgtttcgtcaacacttgctcacaacagtatagcccaatgctgttaaaatcctttttgacgcagttagataattctttggaattactacgatgcaaataaaaaggtgcataacataaaagtgttatactaattttgtaggcctttttaggctgcaaaggttgtttgggttttcttgagatgactggttttaatacagtcatccactcggcatgttatatgcttattttgattatgtcatgagtcatagcctaggctatttagactcgtcttttatcagattttatgccacatttgataggtcttttgagagtttttactcggacttttatcatctgtgctgatttatgaacctttggagtgcttctcacttgggtttttctttatatttctttggcacattaaagcagtcggcgggaggtttaccagatgctgcatatgcttggccttgagatatttatcctggaatcctttaaagggtgtcgaaggcatattttttggcctaggcctaatatgtctgcagcccatattttcaggtgtggcctatcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttacatagctgccctactgacttttttatatagtcaaggtgttgtttgggtttataaagcagttgattggatataatatcattgctttttgccacgtaagtgtgcatttttattaactaatattatggctttggctgattatatattgtggtcattttccaggcggttggtaaatcgtttacgagtttatttactcggatgttacaccacatatgccatatattttcaggtgtggtgaaatcatgtgtcttttagggacttaagcacatctgttaaagaagtgtgctcatggtgtatgcccaatactttggaaatttctttattcacaacatcaagctcttctttatagctgttttgctatgtgaatttccaaaaatgttgtcaactttaggttgcacgcatcatattctgcaaagcagtcggtatatcacttggatcatattatttgggggattcacactgcatatgctatatattgatatcaagtcacttggttgataacaattatcaaaaaccactcggttggttggattatttattccttgactatatgcttagtttgttcaactaaccatatagtcgagggctacacctaattaggtgcatctagtcgatgcacctgattttttctatttttcagcccttcacagtctttgattatattactcgggagatcaaaacagatgaagctaaagcactcggattgtcttttcggattatgagagaagattattccgtcgactgtaaaggtctcaggggctactgtggagattatggataccccattcctacacggcatgtatatccgactgggtatggggtgtcatgtatagatagaatatctttaaaaggactcgggttaattaccaaacttgtatgtcaaggaaatacccgggatcctagtcggttacgattgtattttatctgtaattacctattccgttagggatatggtttgtactttgtaatacggaccccttcccctatataaggaggggtccgggtgcctctaggggcacgattttctcccagatcatacgatcaataatacactcggcggatcaatccccggacaggagtagggtattacttcttgattaagaaggcctgaacctgtataaaatcccttgtctctgaacccatccacttttctagcttgatagccacccccttttagtattgccaaaatcttgtttcgacaaaaaggtaaagcttgttatagcggcttgcgttctcgggattagtgcttacatcttcatgacactctaatcctgtttatataaatcgtcgagttatcatatatgctatgtaatctaggtcgatcttgctacctaacctcagcggctagcctctatcatcgaaaacagtcgacatggttagatactgacttcgaattagattacatagtgcatctaccatcttcaaaaggttgccatcgacttgtttaaattttatgcttctttctatgtttaatgttgtatcagttaagtttgatccattaaagcattacctggaatcgtaatatctagcttgtttcatgactgctactagagatactattggggtttcagccgatcttgcctgatttagttgtctcgttacttatatgcttactcgacatactgaatctaccctttatattaagatctcttttgaatgaaatatattaaatttgttggtttattctaatgagtaacgagtggtatcggagtattagtcgatacgcattagatttaccctatcagctatgctatgaatatgtataatctttactccaaagcacttttaagcgcaagtaatttatactgtctcggcacactgcccgatctatcccaatcgcttagcttaaatatattcttggaatatagattatatatcattgatatctacagccgatcgagtggatctaactcttttctcgttacttacttcattgccgatctgacctgcgttacatcggcttggtgctaaatgatatgtcatcggcagtccagccgatgggctatcgtttatggatttaactttggattctttgtttcttgttggttgcaggatcaaactaactagcacgccctgaacctgaaggcaaatctttggacctgcactagagtaaagcaaacctcgccagtgtgtgtttttcacatcaacaccttccaatccttgtacacatgtatgattagcaggaggttcattttatcgcatgtcgggtgcatttttatccgtaaatggcctgcatacgtatatttaccaaaactagtggaaggggcagtgatgtcgacgcataatgggcgtagctgccaacatgaatttgccgcgttgaacgacggacttgacgcatgcattgcgaacggcacgggtgcagccgcaactacaagccatagctcctttcctttcttcttcttcttcttcttcttccttctttcttctttcttccttctttcttttcttctctctccctccatggctgatgccaaaaagtggctcggtcggccaatgacagcgtgacgaccgatggctcgatgcacgaaggtgcactcgaccatgatgggatgagctcgcacgggcttgtgtctcgcgaacgacgaggccacaagacgagcgtggaggccgactgctagtgcgtgatggcttgctcttttgcctgtccctgtctggaacgatacgacacatcttgtgtggagataccccaatcggcttgcgccggcgactccaagtcgacagttgcggtgttcaccaggaacggcaaaaacaaaacgggatggagagagtatttcattttcgtaattagatcagcgaatgcaaaacggatctacgagttgtcatccttctatgtgaattagaaaaatgtgacggtgatgtcatagatctaattttacaaaatttcagtggcacccagccaatatcacgaatagtagtggtatttttctaatatagaaaatttacgatgatatggatccaatctatactttttataaagttaaagttatagtccactaagttcaacatgctaccacgccacatcattacccactaccaaaaattacatattcaacctcatgcaaatatacaacatcatttacaatttatttaattctacaaatcaacatgcaatcatatccagttatcacctctcacaaatctatctatcatttttatagtattaaacatatagttatcaatatgtttcacattaaaacgcaggtatcatctgtttgttttatgataagtactgataaactctaatgttttattattttttttcttttacttttagcttaattgtcgaaaaaaatattgagaaatacttagtaattttcgtggcaaaacgtgagaaatcatacagttaacccatccaaacagtccgtaaagcccgtaagaaaaatggcatatgagaatacacattcggggaggatatggcacagggttttaaaagaaaaaccatcaaattaactcaactcgccccaaattttcgaggggagattttttttttcctttttaacgtttttacacctcatcatcatcaggcctttcccttccctttctcctttctcgttgtgtgggttctttctaggccctaggacaagccaagaagcggcggaggggaagggaggaagagggcaccagccgcaccggccggcggaatggcggcgccgcccaaggcctggaaggcggagtacgccaagtccgggcggtcctcgtgcaagtcgtgcaggtcccccatcgggaaggaccagctccggctcggcaagatggtccaggccacgcagttcgacggattaatgcccgtccgtatcctctccctccacccgctctcctcgccgacgatctttctccgttcagttgatgaatcttgctttgatctttagggtctgggagggtagggttttggtgtggcaggcatcgtgttcttgagggttttttgtaggttggtttggattctgagaattttctggattgatgggtgatcggttttcatcctgatttgcattgcgggtgtgggttttgtggtcatctgccacaagaatcttctgctttcatgggtggttggttttcatcttgatgtgcattgctaatgtgggttttgcgggcatttgccataagaatcttctgctttggtgggtggttggttttaaatcttgatgcccgaaaaaaatatgtttctgagggtaatttcgcatgattttgtggggtatgatcgaaccaatcttcttcgaatgcggagttcttgatgcatttggtttggtgctctgtcgatttgtcgatgatccgtcaattccagcatggggtttattgctgtttctaatccattatgcaatctatatgtgtaacgagctcgaattcgctagaggtgcttttgtgggcaccaactttgacatatgcaatttaactggtatttctcctaagttgtttgatatattagttattatgcggacctgccagttggttgtgctgttttaggcttttagcatggcaatggggcataccaatgacaatgttagtaatctagtgtgttcgctaatctgtttttgttcttatctgatgtgtagtttgcaaattataatctaggtattcgtttgcccgctttattttctagtttgcctcttgtaattgttttgtgggtgcatgtgtattataagtgcttacctgtattaggcaagataaaacttggaggggagtccttattctatttttcattttttatattgcacatttggataatgaatctttatttcttttggtcggatcaactcagtactcatgtggttatgtggactagacactcaaattatttcactgggaaatgtaggatcgtttagggcaacttagggggtacttttggatctgcatgccatttttcacctgaccatatctttttattttctgtgatggcccttattttttacctgaccatgttctttaatatggagtgtttataacgttgtaccttttctatgtttatagtaattgttttattcaagaactataactgtttggaacttttttttggtcatggtagattctcgatggtgcagaagagaaaactcgatggttatatgacatatctttccatatcaattttacgaattgaccacttccaattaattttagtgcccttttctctttttcagatgtggaaccatgccagttgcatcctcagtaagaaaaaccagataaaatcgtatgcaactttatcttttactgtttgcatgagtttcacgctatagtattatggtttattaatctttattgcatctattggaaatctgacctaactcaaagtgtcgattcttcatttcaaattagtgttgatgatgttgaaggaatagacacactcagatgggatgaccaagagaagataagaaattatgttggaagtgcaccagctactgcaagttctgcagctgctatttcagataaatgcaccattgaggttgctaaatctgcccgtacttcctgtagacggtgtggtgaaaagataaaaaagggaacggtctgtatcttttgatctattaattttttatatgctttctaattcgtcccttgaggataggaagttttatgccatgaaaattttatgtttgtactttgttgcttttcaaattatagtcatgaaaataacctcctcttgatgattaacaccttacagtcttatatgagcattcagctaacaatcatagataatcagaagtttcacattcttgaatgaaccttgatgcagcatgtaagaataattaatcataacatgtttcctattccttatagttactccctgggaaaaatactgtattgtccaaaattctgcatgttactttgttgttctatactttatttatttagaacatgaactttagcgctcactaaggatgaaatggatacccgacttggtcctagcacttgaacacttgtagctggggaggttaaatagcttccctaccactatgccattggcatgttcttttattttctgaacttgcatctgggaaatgtatggttctgatacgcagggacaccataggttcttttctgtaccctattccctgtggcctgcatcatgttgcatataatgcccaagcttttgcactggaattccaagtgaccagaaagcctaaaggccacagtttcccatttattttgtagttactctgctacgtgccactagcaagcattagaactctgaattttgtgttaagtttactttatcaaatgaagtaacctgcaaatgtattaattggaagagtatttattatgttcatatttcttattcatccacactcctagttgagtactcctaatgaattacaataattaccgtggagaattatatacaggaaaatgtttgatgatccagaagtactattagtcatgcacttagctaataatgtatgttttgaaaacatatgaattgtaactgtgatatggcaacttgtaatgtaaaaacatggtctttgtcttcactctaagttgtttctgtaatagtattattatttgtttgtctaggttcgtgtttcatctaagcttgaaggcaaaggttggtatcacgccagctgttttctggagatgtccccagctgcaactggtgagaatttctcaggctgggagatcctgtcgcatgaggataaaagagctgttcttgatcttgttaagaaagatgcccccagctcaggtaatgaaacatgggcatcaaattttcttcgcgccacttcgtaatctgacttgatattttgtattgttgtttctcaaggacaaacatcttctaagggttccaagcgcaagaataatcagaatgatatacacgactgcaaagctcccaagataatcaggagtatatcagaaggcacagcagaagataaagggaaagctgttgtatcacatgattccaatgctaattcttctgatcttcaagaaaagcttaaagagcagagtgacacactttggaaattgaaggatgaacttaagaagcatgtgtcaactgctgaactaaggaacatgctcgaagcaaatgggcaggatacatctgggccagagcggcatctattagaccgttggtaatattgcatgctatttgtgaaatggtttttaacttcctggcttcctgcactacattatttccatccaatgagtaattgatatttaaacaaactgcactacaaggatcccgcatataaatatatccttggccagttggccgatgctacttgatagaggagggtacgattataactgatgatgaatggtactagtgtacgaaatttgtcaggatagttgttccccaagaccccaattggtcatctatgtaattttttgtcgctagatttattttctgcttgctttctggatcccaaatcccagttgtaacatcctggttatagggtttgtgatactgatcgcttagtggaattcagaattgtcaccgtaacctaatgattgcacactatttgctttggttcttttgtaatctggttcatgtatacaattattatttccttaaaagtggctataccttttctttctaaaaaacacattttaaaaatttgatgtgtgcagagaaatttcaaagtcaggcagcacttaagatatttgttttcaggcaaaaattgttcaatagtatttaggtctgaattttttatgtataattcaaggaagacaaacattattgattgcataataagctttacaatattgttggttgcgtagacctgcttgtggcatttccttgtttcatctcacatagaagtcagtacacttcgtcgctaactttcttcctcgtctggcagtgctgatgggatgctttttggagcattgggtacttgcccagtttgttctagcttcctttactatcatggtggccagtatcattgcagtggctatgtgtcagaatggtccaaggtcatactctacgacagaacccgtgcgcagtaaaaagaaatggaaaattcctgacgaaatggataatggttatcttacaaaggtatgactatggctccccacccccacccccacccccacccaaacccaaaagaatatcgttcttaatgcttggtttctacagttgaggtaagcaaatatgtatgtatcttgcagtggttcaagtctcaaaaggctaagaaaccagagagagttcttccgccaatgtcacctgagaaatcattgtgccaatcaacccagcaaaaccgatctttccttagtgaaggactggataaattgagagtttctatagtaggacaatctaaagatgtggttgtaagtgatcttttactttttggtacagttatcctcaggttctcttgtgagttgtgttcgttaaagcaagcaccaattatgccatgaccttgctgcatgttgtggcatgcaccagacgccctttattttttccaatcacagttactttgcttacattgttatccagattgattcttaccatattatacagattatatatattatgcatatttgttgtgtggcttgttgacatgaaattggaaagtgctcaactgtacatgcttcatatatttgtttgtttaagtcaattccttgaagatagctagtttagtttgttaatttattccttgagttcctcgattatttctttaatctccaaaaattttaatccatggaatatgcagagtgaccacatttagattgcagagcaaaggttaggagagtgtaggttttttccctatgtacttgattcagttcatgttaaattcatgtcatttgttgaataatagatcaaattttatatgatctagcatgctgcttttgcatcaagtggtaagatagatttgcaattatttgcatgggatactgttttcttttattttttcttctctgctgatcagttattgggctatacatttttctttttcttgttttttggtttgtactttgtacattcctctaaactaatcatgtaatccaactactgtaggatggatggaaacagaagctgaaagatgctggtgccaactttaatgccacagttaccaaaggtttttcctcgtgttatcttttttttttctgaactacacaggatttcctcgtgttatccagaactggaactatcttgttcagacatttgaacctttcatatttggttacgtatgacattggaacctatatcttcacccaagtgggtgagcagtttgacaccaccccatgaccaaaagccaccactcaaattcctaaaattggctggctctcacgtatgtgtaattttagactaatacatgacacttaatctaactgatgttttgaaagtataagtaaaatgcattgtctaactcatgattttttatgggagagatggattatggatcacttatgtgcaggtgataattttatgttatctatctgactgtctctatttctgtaagaacatatgggcattgagccagtatttttgtgcagctgatataatgaactgagtcatgtgacttggtcattgtttcataggttaggtaagctcttagtgtttggtgaaatcttttcgcattattttcacatggaagtcttgcactgcagacagcagctgcttagttttatgtagtgagcttgagagtgagaatgctgaagtcaagaaagcaaggtatcacattttactttgcccttatccttttacacttacagtttgacctattgttttgcgaactactgtgttacctattgttttgcgaactactgtgttaaaataccattatatatgctacttcatttcaggaggttgaagataccaattctgcgagaaggttaccttggagaatgcattagaaaaaacagagtgcttccatttgatttgtataaagtagaagctgcattggaatcttcgaaaggaggcacaatgactgttaaagttaaagggcgaagtgctgttcatgagtcctctggtttgcaagatacaggtcatattcttgaagatggaaaaagcatatacaatacaaccctgaacatgtctgacctgacacgaggtgtgaacaggcaaggattttgctcacagcatttcttgtcaaattcaggatttgcacttttaggagtgattgtcaaggcatatttcatatgagtgatatggataaaccgataaaccctccagcaattttagtcaccaaacaaagaacgtggattgcttctcaaatccaacttcccggtcttcccttgaactaacagaatgatataatgctaaatttcccatggttgttaagttataatgttgagtcaagtgcaaccatataaaatagcatgaacattttggaagtactttggtctggtttggtttggtttggttttcattacatatgcccctgaagtcatagccctcgtctcttgttcaagcccaacttagctttggttgtcaatcattccacgatgtctcgtatacatatatgaatcacccgatctagaatgtcttatttactgccattctgcaataaaaaatgttggagcttgcacaaatttctgtttcctttcctctcaatttatgttcgggagcataacacactgttgaaatgagggggaacttttcttctgtagtattaccagttgctaaatttctgttaggttattgcaaataatggtgaccctgcttgccctacttaatcttttaacagntctctctctctctctttttgtctgtgaagctattatatacttcaggtcattgaagaggataatgggtctgattgttatgtattccgaaagtggggacgagttgggaatgaaaaaattggaggcactaagttggaggagatgtcgaaaattcatgctattcaggaatttagaagattgtttcttgagaagactggaaacccctgggaagcatgggaacaaaaaacaaatttccaaaagcagcctgggaaattttatccacttgacattgtatgttgtgggataatgtttttacctgctggatttttttcccctttttagtggatcatgtggattcaatctgatgtgtttaatatattgcaggactatggtgtaaggcaaggaccaaagcggaaagacattgacaaaatgaaaagttcacttcctccccagttgctggagctcatgaatatgcttttcaatattgaaacatacaggtgcgattttactgttctattttcaggttttgcatgtgcacatgctttgtttttagtattagaaaagaatttcacattattttgtaccagggctgctatgctggaattcaaaattaacatgtctgagatgcccctgggtaaactaagcaaggaaaatatccaaaaaggtgtgatactttgctcattgtggaactcattttgttgatctgtaagtccaaacatatcatgattctcttgcctgcactgcatgcaggttttgaagcattaactgagatacagaatctattgggtaacactaataatcaagaactggcggttagagagagcttgatcgttgccgcgagcaatcgtttcttcacccttattccttctattcatcctcacattatacaagatgaggatgatttgatggtgaaagtatgtgttcattaccttgtgttatattcctgtatattgggaagatattccatgactattcttattttttaaaatcacgacagttttaagtgaaatattttgctataaaaccttccttttgcaaaagaataaaggcgttctatgatcattgctgaaattgaaatgggtccattccacgcacagatcgtacatgacttgtaatgatatcttggcagttaggcatgttccataatgctcaaatggaatcgaaggaacacaaaattgttatttattttgtcatatataaatttggcttccagtaaactatgttattgaagtaaaaaaatgtattttcgcactactttcatttatggttcaagttctcaatgactctcattttgctatctagttggaacattttagaggatgttataataaaaaactaacatacctatggcatttttccttttcttttcctttgggtcttcacatgttctccttgccattagatacagtgctgttcttaaatgcaatgatatctcctgcatattcaaggaaaaatgtgttataactgtccaccgtttaaagggctgttttgggatcttggggtattttcattcttattttctttgactgatcagatgtatttcttattgccaattgtaactttattcagagacccaattgactgtaactttggtgcaatggtgcaggtgaaaatgcttgaagctctgcaagatattgaaattgcttctaaacttgttggcttcgatagtgacaatgatgagtctcttgatgacaagtacaagaaacttcgatgtgccattacgccactccctcatgattgtgaagattacaagctagttgagaagtatcttcttaacactcatgctcctacccacaaggtctgtattttcttctgtatacaaaaaccttatagttttttttttctcttttgtagatagtacaatacagacgattgtttctgttttcttctgtataggtattgacatgtcctctttttaaatcttttttgaaggagtggtcactggaattagaggaagtcttttcgcttgatcgagatggagaattcagcaagtactcaagatataagaataatctacataacaagatgttgttatggcatggtaagcaatctatccaagtaatgcaaacacatttggcttacgcaatatttgaaaaggtttttatactctcagtatttagtgccaaaatctaggtttgagatgaaacttattatccatgcgcagtctttgccatggcagtgcgtaggtgaacagagggttcacagtcaatccaacagttgtaaatgtttattttactagttcttcgtgtggtttactcgtgttgtatgttatgttgttatgtcagtatttaaaaggctactttttttgtaattgtactggagatctacttaacgtccctaagtaactctttccttcctaccatttgaatgattccatgattgcaaaacttaatttataggttcaaggttgaccaattatgttggaatacttagtcaaggactaagaatagcacctcctgaggctcccgtgacaggctatatggtttgctctttgttcacttcataaatggttcaactgtagcactggcaaaagattggttgaatttgattaagctattttcctttcaatcaacagtttgggaaaggcctctactttgcagatttagtaagcaagagtgcacaatattgttacgtggataggaagaatccagttggtttgatgcttctttccgaggttgctctaggtgacatgtatgaactgaagaaagccacggttagatataaagcctctcactaccaaaagagaaattctggttataacattaacttgaacttctatctttgctttgaaatatgatcctgctttaaggaattgaccatggcatttctttcctgatttttttattgtgatctatatttctttgctgattcataattataagaaaaagctcaacgagttactcgagtgcaattacttgttttttttccccatgtttatcttggcttggcaccacactcactggcttactgctggctgctgcagtccatggacaaacctccaagagggaaacactcgaccaagggcttaggcaaaaccgtgccgctcgagtccgagtttgcgaaatggagggatgatgttgtggtgccatgcggaaagccagtgccagcatctatcaagacatctgagcttatgtacaatgagtatattgtctacaatacatcccaggttcagtcaaattgttatccatactcttttgcgcgcttctgttcatcagaagttcagttccttacctttcacgaaaccttatctctggcaggtgaagatgcagtacttgttgaaggttaggttccatcacaagaggtgactagaagacttgaggtaggagtagaaatgtagaattaatcagtggaagtatctccatcgttatcagtagtctgtggtggctacgcttttgatgtgttagaatgatttatccagtagtttcaggttggtaggaggttatgtgctgctcgcgtatgatccgttttggggtatgttgcatgggcatcgcgcgagtggcgcaagtaaatcccctgcgcatgccatgggcatttgatagatgtttgcctaattttctgtggcaatgtgcgcatttggcatctctgtttagcttgctattttatcatcactcgcgttatttgtgcgttgttgcgttttggctatctttctttgtattttgattcgaggtctatgttaggatactgcaatcgaaataaactgaacagcattagtgaatagtgccgtctgtaggatcaaagatagaggcgtgtgactgtctagcggaagtaatattcttctatcctataagtaacggttagtctagcacgacaattcgatgagcatagattgcaatagtttttccccaggtattagtgatttggtaatctccgcttgttttgtgcccttctttcactctggtttgtcgtcgtccttcacccttcgctcggggtgctcccacttcctcttagagagatcacttgacttgatagccacaaagacacgttatgaccagcatttagcctcaaagtaatatttaaccatatgatcaacaatatatagaacttatcattcttgaggtgtggccgtcatgagtttattccaatcatattattagaaaacagtaggcaccgcacgtgaggctcaggcgtccacgggaactgccgacggcgcagcaggggcatgcaggatggccttgggctcgtgctcttccttctcctcgtcctcctccgcctcggcctcatacgcgtcacgttcctggacccagagctccgcgaactcgcagttcttgtactgctcgaaccacggcccgccggaagtgtagtggatggcgcgcggcgccgtcccggccgtgtcggcggggtcgacgcggttgtgccccacgaggaagttccacacgaagggcacctcgccgatgtcggcgtcgtccagccacatgaagcggtgcaggtacgcgccgctctgcgtgctcacggcctcgggcgtcagcgcggcgcggttctttgggtgggcgcagttgaagagcaccatggacgaccagttcttgcgcgggtacaccgtctgcacggcgccgtccatcttggtggcctccttgggcgcgtagtcgtggtgcacgcacagcaccgcgtagcgcgggtcggccatgcgcgccagctccgcgacgtcggcgacgaagaggaagtcgcagtcgacgaagagcgcccagccgcggtagccggccaggtggggcgtcagaaagcgggtgaaggagaactcggtgctctccgtgggcccgcgctcccgccagtacagccccgcagaccggagctcctgctgcacgatcgggatcacggccaccggcacggaggagcgctgcagcagggagcgccggcacacgcggtacgcgatgtcctcgcgcgagtcgtacccgacgaacacgcggaacgtctcagcggcctgcacgtcgccggcgccagctacagggccagtcatcacgacgtcgttggtaggcgtgaccgacatagtatttgttggtgatatataagcagaaggttagtagtactgtttgctagcttccccgcaaaaaaagaaaaaaagagtagtgtttgctagctcctggtgctacgtacgcataggccgtgcgagttatcacaaactcctccgcctttttaataagagcctaagagccctttgtcctttgagtgtggggagcgaattgaaacgaggacatgcgtatatgacgacatgtacgtcaacagcgttacgcttgcattattaggcccagggagatcgatgtccagaattatgcatatgtgtttctcttcttttgttgccaaaatcaacaaaattagataaaggaatcctatagctaaccgattgctgtgtggtccggcgccggcggatgcatggcgacactgcactgtggtgtgggcagcgcgcgggcgggaccgacgacagcgcgcgcgcggttgctaatttgtacgggtaatacgtggtcctgtcgtgtgaactaccacagcagcacggcaggaacacgcgcagctgcatgggcagttgggcactctgcctccctgcgtcgattgctccacagtcgtcgtcatgtcccgatcctaattatcacgtcaaaacagctaggcaagtgttgcttgtttttttttttagataataagtgttgcttgttgctccatcgttttcctttttcaattatatatgttattattcacattttcactcagtattttattactaccttgtagaagtttatcgagaatgcatatagtcaaaaatgtcttattttggatgtccagaaatgtttataatttgagaagatgtagtaaaatttacatccaaaatggacaattataccttcctttcgtggcttcacttccatgtgtataccttatggttgtaaatatttaacatttagaaaaaatattggttaaacctccaattttacaatagcataagtttataaaatatactacatcctattcttttttacttgccgttttagacattgatacggatataatttacatattttatcattactttttctaaacatattttttacaagctataaaaacaataattatatgaaagttttttttacaaatatctactgataccattttcacgtgtcaactcctaatattttagaattaactaattaattaatatttgattttaccattaattttaagacatcatctacttgagaatctacttgagaaacggatagtaataagtttaaagaatggtggtggttttgaaatcgggatcctctggattacagtttgtaatgcatatgaccaagagcagatcatgtcatgcgcttcggtactcaatagtggattacaataaatacagttcgcatgaataatgagcctctgcattactgcagaggatccagatctatggctttgacgcacgtttatgcatgcatactaattttttaaacctaaacatttgataaactattattaatagtgagattacaccagtaccaggcttattttttggtactaacctccgcctcatggaatttttttttcttgtagcacgcatgtaattttttttcttgtcccgagatggctgcgttgcctctcgtacgtttggatggatccgcgagggagaagcgtgaccctcgtggtagcatcccgatgatggaggagcgatgccagttgcttcccttgtcaccatcggaaaacaggtgtgtggtttgagctagggatgacaacgggtcagatcgggcacggcagagtaaaatcatgcctgaacccatgcccatcgtcgcttgtccaaaccttacccactagggttagcgggcaaaactctgtgcccgtacccatgcccgacggacacgggtatacccggcgggtacttaatggatctcatatgaatagtaactcgaaagatatacagtttaacaaagagaaataaaatcaacaatttaacaatttattagttatcaacaataatttgaattacatcataacttattacagtggcgaatccagaatgaaaatagaggcggtgctctaatgaccagtgtcaacgttgggaactagaatatatcgataagtgaaccatgtatatctcactatgtttgtagaaaaatctcacttttttagctctaagaccgtcaatcaaagatcattcatatttgctaatatgaaattaatggtgaagaaccacgttgtctcgttgatttcacacctctctctagccatcaggtctctgcccccatatataactacagctaaaataatttgaaatgtgccatatcatagcaactgtgactggagcacaaaacatccgagaaaacaaagcatgaaagcagtagtccaagtaccatctagtcattttcttcctccaaacggtagctagtcataactactgcagcattagtgacatagggatacttaggacctagtagatggagctggggcttgcgccccaacaagccccaatactaaattcgcccctgacttattattagttagtatcacaaatgaaccaagagaaaggggcataacaattaagagataagtcgaaattagctaatacatatgtatcgggtcgaacatgggttacccagaggcaaaaaaatgaaacccggttgttacccacgatgtctacgggtttcgggcggacgtgcccacgggtaaaaattcacacccacgcccatgcccattgggtcaggtatccgcggatacccggacccataggcaaaattaccatccctagtgcccacgggtaaaaattcacacccacgcccatacctattgggtcaggtatctgcggatacccgggcccatgggcaaaattgtcatccctagtttgagctatactcctagttaacaaacaattataggttagcctggtgatcactcgatcagatatactagtaccgcatatgccacctaccacacacgtacggccgcacccgaccgattgatctttaactgtgttgaggactcggcgacgacatgtcgctgtgggaccacttcgattgatcgatacccggttgttggtcagatcagtttcagcgtcttatcttgatagtcatctttaatttgatagctcgtatgtaggatcaaatcaagtgaactaagctagaggtgaatagtaggaacaccgaaaattagtttttagtgtaactaaaagttacgctcaaaatccgatgacgttaattaactggtatgaccggtctaatcaccctctaaaccactgtcatcgatcgccaccgctggtctagccgctgtgaagccactggtgtgaccaccgtgccctcacaggtgtgatcaccgaaactgagaaaaacacaaatcgaaaaactcttgaaactagatcaactttattgtttctaattgtttttacaaagtgcaacaacagtactactctctcaagtttcgactaaacttgaaatttatactaaactctattttttctctcaactaaactctcaaaattgataccaatagatctcaacccatcttctatttatccccgaaagtagcaacccaaaagccataaatccacattaataagtagtcctaatccactagggaacctacccatatgcacgtacacacactacgccagatcaattcatgtgacggaccaaaatatctcgtcacaaacaatatcacctttgacgggttaaataaatctcgtcatagatgaggctaaaaaaaatgacccgtcacaggtaaatagtatttacctgtgacgggtatatataaggacacgacacatgacgtttgtgacatgtccacgtataaacccatcattgatgagtacttatatgtgacgggttttaagtttgcacccgtcaaaggtgagtaacctcacctcagatattccatcaattttgacttataaataaggaaaccccaaccctcccccactgcccactgccccatctcttttctctcttctctcttctctcttttctcttcctccaccatcgcctctccccccaattgtgcaccagctgccgcggtctccttcccatagcagcgtcgccgcctcctttgcccgccgtcgtcctctaggagctcagggtcgccgcctccttcgcccgccatcggcctccaggaggtcgggcccggtggccttcaacatcgacgccgccgccacctcctgaccgccagtcaccagattcgactgccggtgccttctcccgcctcccggtcgctgacgccgtcgcctcccgaccgccggccttcaacactgacgccgtcaccgcctcctgaccgccgatcgccagatctggcccccgagaagccggatctggccgccggcgccttccctcgcctcccggccgccgacgccgccaagtctggcctccaggacgcggatccagccgccgacactttcgccacctccgcaacctcttcctcgactgccggacaccgcctctttcgccgccaaccgctgaccaccagatccgacctccacgaggttgtgggatgcggatccagcatccgcagcctttccttgactgccggacgccgctgcctccgccaccgaccgccggccgccggatttgtttgtgcttgatgtcgtttgtgcttgatttgctaatgtttgttgcttgtgtggatgtgtagtttgttaaaattgatatgggtacttgtgtgatgtatattgttagattgcttcatgtgtagttttttgttgagatgtatttgatttaaaatacaaagttgttgtatcgtgtgcatcttgagatgtatttgatttttcttcatttcgtacatttggggtgaggaacttctttttttctgggtggtttttgacatctgtgacgggtgggaattaaaaccagtcacagctgttttgtcacctttgatgagttggaaagagtcatccgtcacaggtgtgagtcacgtgtgacgggctatatttttctgcccgtcaaaggttttaattaccagtgacgggctttcacccgtcaaagatgaagtgtagtcattagtgaccactaatctctgaccaggactaaatccgtcaaaggtgagggttagaacccatcacagatgaccggatctggcctagtgacaacttatccctttacaattcaaactttaatcttcctacatttggactctttccaaatttgactctgcttttcattcgcacataatctctcttgtatgccgtatggaatcttcacaaccacgcgtattgttattcagtctgagcattccacatgatctcctgatcatccgaacattaacgtctcccaagtcggctttcaatccatcaccgccaatgttctttcgaggcatcaagacacacctgcacatgaatcaaataacaaaccatattcgagcacaagttatttcccaacttgactcaacattaagataaaacagtattacacacgtatagaaatcataaacatgagataatcgcgagtatccaaagaaaacataaaaccgactctaaacaaagtccaaccgatcttaccgtagccacaacaccagtctaaccggcacaccctagtcgatctgatcgcaagagccaaacaaaaatccctgttttcgtactatcactattcaatatattgcataacagaacttcaccaattatccaccaaatttcaaaaccaatataaatcacatatcaattgttcatcacagaatatataaatgaaaaacattgattttacacgcacgtctacgattcatgagctgccagcaacagatgcacatggaaatatagaaggaaaggatccggtcgatcgaagttttcactaaaacttcaaagtcgttcatgtgaatatatacaatcataaatcatgtagcaaagtcccttcataaatttatgtcatgatgatatatagccacgttgccaacgcactgtgcaactactatatatagtgttattacagccatttttatacgttttatttttgctatttatcattaattagttgaccttttttttctcttgtctgttattcaccccgactgtagtttagacatgcaacttaattttgaatacagataaattgccatttttgtttgctttattttttaataccctaaatttatctagatgtatttatagttatatagataatattctaagtgcttttgtatcactttggtgtaattggttaagttcaacaaaatctttcattatttaaaaagagtaaaatgtgcgggtggtctctaaagttatacatgggtgtcatctaggtctctaaactcttctcaatatatatttttggatccacaaacttatcatgtgtgtcatataggtccaaacgggtttcaacccactctctgtgcactgacgtgacatgacatgaagtatatagatgttctgcatagcacatagacaacaataaattgtttcaaatgggactttctttttttccccttaaagggatatcggcatatctacttttacgagcccacaacaaatcgggacctccacattcatgcatcattagattccccacccacatatgcactttattagcaaattataaactattttttcttacgaattaattatccgatatgtgatctgattgtattattaaatttattgcaattaaattttacagagagatcccacatgaaaatattttggataaaaaatattcgtaacagaaatatttttatatgatatatgaaacattgagttataaccgatgaaacatcacaaaatacttgctgaaacatccaaagaatagcacgtgtaacaatctaaaatgacccattaaagcatcacaaaatacatcccgagacatccccaaaaatagcacgtgcaacattctgaaatgatatagtgaaacatcagctacaattaaacatcgcgaaatacctcctacaacatccaaagaacaccctgtgcaacattcaataatgacatagtgaaacatcctaaaatacttattgtaacattttaaatccattgcaacaaaaaaaaacttctaaaagcaaatcatcaaaatatagtcatgtgagatctaaaaatgtttgtgcggtgcagttgaatggtaccattgcaattgtgaatgatgactccgaccctaggtctttcgagtaggacgggcagtagggagatatcgatgactattcatcactatcttccttagatgatgaaggcccaacttcattttataccgaggaagagttgcagaatcttaagaggacgaaagatgtcttggttgaaattcctattttaggtgattgcttacaatggatttagccatttctgtccttttaaattgcagtgaaaacaaagaacaaggaatcgaatatgcttgaaccattcatatcttcaacagataaatcaagtccatcaaaaccactctaaaatggattcctccaaaccattcattactatggagtttactaatagtaccaattttctaaatacaaacttgttatgttcatcataaaccacaatggtcatgaaattaataaacaaataatcctaacacatgaaattttctaagtgaacaatggaaattatttcttgaaagacacaaaataaatggggctagctgaactgccacggcaacgagctgggcgtggcagttttcagctgccatgtcacggagcctgacgtggcaataggtgctacgtcgaagccggcttgaccttgtcaatgccaatgattgccatggggcaccgttgcccatgccaagaccggtggtgtggcaaggtagtttggccacaccggttacaaatggcatggcaaaaaggttcatttttgaaaataagttcctgggaggccgttaaggttcatttatgttatgttgaaataagtgaaaattatttattaaaatggtctaaaataaaaagattccaccacatgccacctaccacatttttcgtgggatatactagcatccgacgccatttaattaatctaagcatcatgctcacattaataaataatgatactaattaccccgggactccaaccctttagatagactagttagaactagtgcaacatattaaaataattagaccgaagccgtggcatagatcagctagtccaatcaagtgaagcacaaactattcctataacacataactaataaagtagtatatgaactataaacactaataagtgcaaaagataattcctttatgaaactcatagtcttacaaagagagtaaagtactaagaacatacccgaatctccaagaagactatggaaccgaagactattctaagcttatctccactactaaagagaaaacaagtatatgaataagaaaactgctctctgagtgtgtattttgagagtgaaggagtgatttctatttataggctgcttatggcgattgttaagtcggtaatcaagtgcaaccgcctttgagaagaaatcatgagttgccacgtggaggatggagatgagaggtggcgatggtgttggtttgagtgacccatgcatgggccccatctctctctaccacctttctccaaggattgacatgtgggcctctaaggaggtgcacggtggtttggcctcactttaagtcggtttgagctgacttatggggcatcaatccatgtgctcacacatgattcaccggagatgtgtttctttgtatgccggtttatttctccttcactttattgtacaattactgcatccgtagtaattctccgagacaagtgaaactacattatttacaactaatattcatgtaagaaatattagttctccttttattatttgaggaaattgatggttgaaatcggtacttaataaccgtcaatgtaaactattattaacagtaatagtaaaagattacaccatactagacttattttttagccacacgtagcatggtacgtactagattcgttttaaaataaagctatttttaagtatagtactttgtcgtaaaaaagaagaaattttctagcccagtctctcatctaaaccaatgataacattttctatttgatttcttcattcactctcttttcttaatcattcaatcacaatcttactctaaccattaagacctatatttctaatagttatgtttatattaaaatacctatattttagaatattttagaacaaaggtagtagtgagagggattgttgcagcacgcatggaattatttttttctcatcccgacatggctgcgttgcctctcgtttggatggatccgctagggaaagtgtgaccggcgtgtgtggtgcatcccacgatgatggagctagccatgccagttgcttccctaccttgtcaccgtcagaaaaggtgtgtggttcgagctatacgactaattaactgaagtactgtaacaattataggttaccctggtgatcactcgatcagatctactagatcacaccacacgtccgcacccggtcgattctttaactgtgtagaggtctccgacatgtcggtgggaacaactgaccacatcgatcgatccccggccagtcggtcagagatcagtttcagcatcttatcatggtgtgtaatcagtgttatggaaacggaatacggatgtcggatgaagaagatactgacaaacgattaatagaaatacggatgattaatcaaaatttgacgaaaattcaatgtttgtgaatatgtaaatattgttatgcatattatagactcatatattgggaattcactacatataatacgctagaattaattaggaaaaggtgaaaacgatgagagctactatatatatagatatagaaatctgactagtattagtattagtgcattggaaaaatattctataaagattacgaagagaaatttccgctccctgtcgtccacgcgggcgcagggagcgaaccctagtcccaaccgacaccatcctcccttcctctcccctgcctcactgccgctagaaaccgcgcggccgctaggatggcagcgatagggctgaaaccccagcggtggcccattcttcggcgtgaggaggcggcacgcgcggcggatccaccgccgcgggatgtagccccctccccctgcccccgcggatggatctggtgctcctaccgccagatctgaccggagtgcactagcgacgacgtggacgatggcggagggacgacgactggaggcgctagcaatgggaggccgcgaggttattggcttgctgtggccggtaggaggcacaggagatgacgggaggagcgggtgacgactccagctgcccaacgggaggcgccgacgacaacagtggtcggctgatgggaggcgtgggcaacagcagcggttcaccggagggaggtgcgactggtgccggcggacgatggcgcgacacaacgaggagcggctggaggcggtggtggagctcctggtatcagcgcatgcgagcggcagtggtggttgcactctcggtagttgttgggggtggttgcggtcggtgaagcgatggccgatgtaggtcgcaccgggggctatgaggccaacccggcaacgggctaaccgctggtgcgcagcggtggagaagctgccgtgatgggaggacggaggcgacggtgatgcgactaggcagctggttgtgaacacgagcagcctggtcgaggcggcgacaatggtagcgccatgaggggtatgttgaagcctgcaacgagcttcctttccaatcgtttgtccttttgcagcgctggcttgccaccgtaagatggccacgctggacgggctagtgcagggcagaggggatccttctctctcaccattttctatctccaacccaacaacatggatggagttgaagcgcgatgggtgttgagattcttcttagatggctggccaacggtgaggtgtcggcgcagtggctgtgcatcgaaggtggattagcgggtggttttgctgaagctgacatgcactctttggcgcgggagagtataacaatgggtgaaggcctagccttcgggccggcaatggcgatgactgtgggcgcgttttccccttggggtgttgtcgtgttttctgtcctctcccatgggttcttcaggtgaaaactgttaacggtcgttatcaatcagtttcgaccgtcaatattaccaaaacaggagagaactagtgatgcttgcaatgcataaatatgttagaataataatattccactagtacaggtctactgaccttttgcaaagaatgatcataaagtggaggagaatcgacatcaacaccaacgataaatcaatcagacgatgtcgaggatcagacttatgtatgaatgggccaagaacacagaattgacacgatgaattgggccaaaattcacaagtctgcggagtggagcaatagaggaggccaccagccgaaattgggctggattgggccagccccgggttcggctgaacctggtggtttggccgaaccaatcctggcgccgttggatccaggttttggcgtggacgtccaggattgcatcccaatgacggttggagggtacttcggacaattccccttccacaaccgccatacctacctctatataaggagctcactctcttcacttcaacacacacctcaagcaagagctctctcattcctcttaagtttagtttagtagtatctagctgggggaatagaattagaataggaatcaggagtccggaagtcttcgaaagagttcaggtatggctctagtagctttcctttcctctttttgaagctttgtacttttattagaatactcttctaaatacatttctggtattgaaatactttccgagtatatgagtaccaactttacattatgttcttgttatactgaatatacggctagtttatctgggagatgctttggtgcgggtataatgtttctttatgcaattactctttgtcatgacgatggtattagagtagtatctagtagtttaggcgtggtgtctagattacgggatatcattatttggggttatatattgcggatgagaggtgggccgctgatggtgacagcttagtacgggtattcctccgcgcctatatataatcctaagttaatttcctaggggggtattcctctgtatttagccccggttggatggccatgacgggctgtcgtaaggaactcggcagtcaggggtggtttctcgaagtaccaggagagcatcggatatagggtattagctagtatatcaattaactagaatgtatgtatactatgtatattagaagtataggaattgattctctttctcttttctttccacctagcttagattatttattataaggatgagtagaaatgcttgtgtgccattcctcccttggattattttaacccctgcttagaatatgattatcacatgtaatatataaattattagttgagttctctctacatgatcttcccatgggataaaataaatatgatacccttggaatactctcgggtgaaatgctacaatggtatatccgtgcgcttgcggatgaactctgtaaccataatataccagaagtatttctgcgccattgctgggaattatatttctagtaatgtcgttaagaaataccaacaaaaaccacgtcctggatctctaggacaggcggtgacgaagctattggcatcgtttcctccttggaggcgtcgtttagaagacttatttcttaggggtattgtgtgcttgtcctgtatttagcagtaagatcagacatagacgagtggtgtggatgcatattttcttttttcttactatagtcttccaagattatagacttgtgttttattcctactttattaatataaatgtcgcactatcttgtatgggttgttttaaaaaaatatatatggattatcttctgttcttctatttgagtggattgtctatacatttgtcaacaaattttcttctaaaattttgtcagatgtaaatatagtataacaatactataattacattctaactaacttacatgtaataactacagtgtaataactttcgcgtaattttgaaatcgttagatttgctttaagattggtgcaagctgagaagatatataaaagtcgcaacgcacacaagtgaggggatttggtctcgtgacctccgcttcatgaaaatagcaatgttatcgtaagatttttgaaagttgcatacaaattatactgtgttatatgcaagttacaatgtacgtaattacactaccattacactatatttacatttgtaaaaaaatttggagaatttgttgataaatgtatagcaaaactgctatttgagatatacatgaaacatcaaaatgaattttgagatcaagaaaatatggtagattggatttgaaagaggattagatggaaagaactaaccctaacaggttgcagcgacatcagaggaatttagaagggtaatcaacaacgtactggtacagctagcctttatactagaggacaacaaatatgctgggatagtcgttgtgggttggttcggccttttgatcaggccgattagacggaagcggccggggagattatcggaggtgacgggaattttacgttctggaatgattaacgaaggacgccgttttgcaaaaacgtgaccggcttatcaccatcaacgtttcaatggctgtatcaagcgttttccacaacactgtatgtaatcagtgggagtacgttttagacgtgctggtgctaccgaaattgcgactgctaccatcccggctgtacgtctttgatagtcatctttaattcaatttatagcccgtatgtctacgtcgtaattaattcatgaaaatcgatcggtttttttgaaccatgagctttcgatccaggcacatggaaatataaaaggaaaggatccggtcgatcgaagttttcgatataacttcatgtcgttcatgtgaatatataatcataaatcacgtacagcaaagtcctttcataaatttatgtcatgataactgcacataaggtgtagtttagacatgcaaaactttagtatacaaatagattgccatttttgtttgctttattattttaacaccctgattttatctaaatgtatttatagttacatggatcatatttttgtgtgctcagtgttttttttattactttagtgtaattgattgagttcaataaaagctttctaggtttctgaactgttacaatatatttttctggtctctgaacttatcatgagtgttatataggaccaaacgggctccaagccattctatacgctaacgcacacagacagtaatatctatcaaatgtgaacttctattttttttcccattagaggggatgccgtcatatatatttttagctctaaaatacaatacaaatagtattgaaaatctgtaaaaatttatagatagtattaacatctaccactcgaaaaaaataaagtctaagaagggccaatctacaacatcagaacctaaaagataagcgaacttttaccattcttgagaaggtaccaccactccacccggtgctagataccaagaagtaccttttagggcattggcaccgaatgcggtgatgagctggcataaggccagatttgaggcgtctcaattcattcttgatttgcagccgcggcgaggtacacttgaggctgtggtggataaaccgatagaagcaagggtatatgcgaaagttcaattttaccctctcacccacaacacctcctctctcgggagagcagtaccacccggtacaaagcaattctagctcttagattgtacgagatggatggtctagattagtaccatctccactcaaggatgataaaaactctcaaaagataaatacattacatgtacttggtcgtatcattttcatttctcaatgtgcgcattgatttaatttaggcttccatttttagatagtagatacgtactccctccgttttttaatagatgacgccgttgacttttgaacatatatttgaccattcgttttattaaaaaattatatacaaatgtataagatataaattatgcttaaagtactttgagtgataaaacaactcacaacaaaataaattataattatgggtttttttaataaaacgaatggtcaaacgtgtgaaaaaaaagtatattgtatcgatgatcaattttgaaaaaaagaagattgtaactatatatttagatctacttttagaaaatgaaagaacgaattaaccacgtagtgtggtccattaatctgcaccatctaggcatctattggtcctctccagtctccaggactcagctaggaaggaaagaacagagccagatacccagcaaacaggaggcaacaaaacaatttgctggagtacgagtcattcggccacaagcccacaacatgacgctagggccactaattcaccccgtgaccgtcctagagcaatgccatgtctcgccatctccggcgccggcggccggccagccacggtcgctgccgctcacgttcttcgacctcgtcttcttggacttcccgcccgtgcagcgcctcttcttctacgacaacgccgacctccgcgacgcccatgacttcctcctccgcgagcttcccctcttcagggagtccctggccgctgccctgcaccatttctaccccttggtcgggaagctgccgtgcgggatacgggagcgcatgtcgccgccggaggtcgcgtactcggatggctactccgtctgcctgaccgtcgccgtcagcagcgacgacttccaggacctcgccggcgaccacccgcgcgacaccgcgaggctacgcccgctgctgcctccgctgcccaagcatggtagctcgcaggacgtgctcgccgtccaggtcaccgtgttccctcgcgccggcatctgcgtcggcacgacgctgcaccacgccgtggccgacggttcaagatacgtgcactacatcaagacgtgggcccgcattcaccccctcggcgacgagcgcaggaaagcggtggtggtggaccacacgccgccgctgttcgaccgtggcgtcgtgcaggacggcgacggactccggaggccgtttatccgcgaccaccgggatctcgtggagtccggtgacaagcggctcgacgactgggacctcagccggaggccggacaccgtgctcgcgacgttcaggttcacggacgagctgctccgcaagctgggaggacatgtcgagcaggagacctcggcgcggtgctcgccatacgcgctggcgtcaggcnccgcgtggcacggcatcgtgcgcgcgcgaggcgtggcagcagacgacgtcgcgcggttcgggttcgtgaccgggtgcaagccccgcgtgagcccgccgataccgtcgagctacttcggcaactgcctgggggctgtgcttcgtgaaggccaagcgaagacacctcaccgcggcaagcgcatcggcggccatctggcgcgtgatcgcggggctcgccgagcaggggcgggcgctccgtgacgcccacggctgggtgcccggcgcgcgggagtacgcgccggcgcgcgcggttacggtggcgggttcaccgaagctgggcgtgtacgcgacggcggatctcggcgcgacgtgggggggtcggccccggaaggtgcagatagcgtcggtggagcggacgggcgcgctggcgctggcgaagagcggccgccgtggcgaccgggacggcggcggcatcgaggtcggggtggcgctgccgcgcgcggagatgcaggcgttccgcgcgttccacgtcgagctggtccggctgctagacgccactacccactagtgctgagtggtgacgcggcctcccccttgccgccagtgtaaaaaaatcgtgccattattccctctgcttcggtgtttctggaactgggaccattttgggaagcagaggtacggaaggtcctttgccttctgctgtttctgtttgccagttgccatgtgtccgtagtagactagtagtacggttcgtctactccctccgttattaaaaaaacaaatcatgagttttcgtgtccaacgtttgactgtttatcttatataaatttttttataattagtattttcattattgttagatgataaaacatgattaatactttatacgtgactgtctttttaatttttttcttaattttttacaaataagacggacgatcaaacactggacacggaaacctagagtttgtctttttttttggacggaagaagtattactctactactccattagtcccataatataatgtaggaacttaataccggatgtgatatttcatagtataatgaatctagacaccctcctgtccagatttgttgtactataaaatatcccatccggtattagattgctatattatgagacggaaggagtactagttactcccgttctagaatatattttaaagacctgcttgggagcaatcaaaaaaatattgacttgtaattttatttcgcccgtaattgtcgggcaccaaaaataaagtgaaattaaaacccgtgcattcatggtgtttgggaaggaacatcaagaagttcgaattctgatttgacgaaatagggtatcttacgaattcaatcaatggatcaaatcagcatgaccaatcgaggaatcaaatctgaacaaacaatttagaccaaaacatcaaacagaaatcgattggaaaaaaacaacaaaattgatccgatcctgaataaaaatgagctgttcgtgcattattcatcaaacagttccgagcacaacatgaaagagaaaaacaacagagagattgatgagaaatattggccaaaattatcaaaacgatatacactgatctcttctcactacccccaacgagaaatttagaagaagcagaagctgtactcagattgaaagctgtacttaacgagaaatcaaatcaagggcctctttgaagagtttctggcagctgtagctttttccgaaatcagaagctcatcaaaacagtttagcttttcgtttagattctaagaaactgtagttgttgaatccagaaaataaactagagttaggaaactcagttttttcatattctcaaaatctggctatgaacggaggtatttttataagacccaagactacatctagaagtaggtcgtttcaatttggagagagctgatgccaacagcatgcactgaggttgcgatgacgccagaaactgtgaagatgtcggtcgcatgtgagggtgagacggtgccggaaatgcagatcaacagtaggggctgatctacagtagaatggtcggtgtcaggcgacactgacgactttcggcaaaatctatagcaaaactgtttatctatatgttataacaccatgatctaaatataattagcatactgtgacaccgatagatatgttatgataccaattctctgatccgccactgatcggcagtcgagaagatgttgtagatgcagatcgagactgacaccatgacgagaagaggaggccaacgacctggacggattccggccgacccactgggcaaggtcgtagcggcggtgcatggagacggagctaagttcacggtggcggcgcgtggagccggagttgagttcacggggacaacatgtggagctaggtggagcggactgcggagtacggctgaagctgagaacaagcccgactttcgtcgttttctagtgtgattgataggagataatctatttcccggtgtaatgggcctctacgaacgaatttcaatctgacatccggcccatccaagcgcgcaatttcagtccggctcaacaaattttatgggcctgtgaattacacctgttttggaccaaatacaagccttccaaggaggttctaacttcaaccttcaaaatatatttttttctcaatcgatcacaatatttttatcattcaaattccacagttagatttttcttctcaactaatcataacattcttctatttaattccttcaactttcttgatactcatatggaacctaaaactcgtatatgttttggaaggtatttgaaggcggaggaaggtgacgaggagcggatgctacgaggtaggtttgggagaaatcgaaacgcaagtggagattggatagatacttgagctagagagatcagcaaaatggtcgggaagaagaatacagactctagagtaagagcggggatggccatccaaactactcccctccgtttcacaatgtaagtcattctagcatttttcacattcatattaatgttaatgaatctagacatatatatctatctagaatcattaatatcaatacgaatgtgggaaatactagaatgacttacattatgaaatggaggaaggagttgggtttgctcaggtgcacaactaacagcattatcaatatttcgttcaaccaaatatgtttcttaggccttttttagaacgcaagaatttcatagacattttatagtatttttcacgagaacaattcagttccccggaattcacaaacaaaaggctcaccttcggaaggtggccttgaccattaaaaattttaacgttcaaaacagtaagtttacctgcagcaagctttgtagttacagtgtctcaatttcaataagtttaccaggccacgatttctcctctcagggcccacaggaaacaaacggcaagatctaaaaccctacaatctaagttgccttagcattactacatgtactggcggtagttatcatatcaacttaacaactttagggtttttgaaatttgccatgcacccaaacccgttgcatcttcttccccttttttctattcactgatatgacacaacaataccccagttccaactgcacaatgataggcaaatgcaagtcaatggtttcataagttacagacatacaaggaaactggaccaaagcaccaagatgacacaaactgaaatttttacatttttggtccttttttaaaacttattttacaaatggccccttgaaaaacttattacaggaatgatcctttctggtgcaccagagtggctggcgccgtatttcaacatggcggcgccagccaccctggcgccgtgaccgtgccaccgtggcacaaaggcgagcgtggaagggtgacctggcaaaggggg

SEQ ID NO: 62877 - DNA, 1675 bp, Oryza sativa
  unsure (1)..(1675): unsure at all n locations
ccgttnccaggngtgcangnacnaggcnngngangnnntggannnggattgatgcttgaatgatgtttatatccagtttcaatagttgctaggcccctaacgagctttaatcccggttgatgataccaaccggggaataaatatctctattcccgtgtcatctccatctctcgcgcgctctctctttccttatctcctcgtatcgcgcgcgctcagcctcctctcttatcttctttctattccacccctcccctccacactctccttcgtcgatccctatatcatttggaattccacctgttaactggttgagtgacaaggcaacgataaccatataagaaatttcagctgcaccatactttagttcttgatgcttcattacttgagaaaaaatttccatgggtacatattttcctatgacatcttggtaccaactaacctccgttaatatcatgtgacgttttggtgtcattgatgttaattttatcaaatgttgaggatgaccctgatatgttgttgcctgctaaattcaagaatcgaatgctgtcaagatttgtaatactgtttggaatatccccatagaacatgttataacttaactgcagatattgcaagttcaccaagtctccaatccatactggtaatgctccatagaacttgttccttgaaagatctaggaaagttagtaatgatatactttggaggcataacgggaattctcctgaaattctgttgttacttaagagtaggagaaataagtttggcattctaaaacagagggggaagttctccgtcaattaaattatttgactagtccaatatatacaagttttacaacttgcaaacagtaatatgattgcaggacagtattagatctttaatacatggagaaccaaatttttatggcaaattccctgacaagaagttcatggagacatccaatttccggagtcttctcggcagctctggtatctgcccagttagtttgtttgaattgagaaataatgaatccaaccaagtcagattctgtatacctactgctataggtccactaatgctgttgtttttaagattgagaaagcttatgctctttaagtgagatatctcatttggcaacattccagtcatgttgttgccttgcaaactcaagtatttcaatgggcttaaataacatcgtggcaacttctcaacaagctccgttatgttcccagatgatagccccccatcaagtaacagtgttgtcaattcacaaagattttgcaagtctactgtcattgtggctctgttaccgttatcgaaaaaatatagctcttggagggacctcattcctcctagtgcctcaggaaagggaccatcaagataggtttgagagaggtcaaggatcttaaggcttgttactttctgttggcggatggcatgaggcccttcgactaaatctgccgaaacccgtggcgaaggctatggagcaagaacggcgtgaggcgaagagtcgtacgagtgccttgccaggccagaggcgtctcaagcgaagggtgcaaggcgaagactatctgccgaaggaagacgacttcgccatagcaagttcgcccccacgagggccgaggaagcctttccggcccatcaagcctaaggcctacagggccggcgatcaccagatggcccatcaggggcccat

SEQ ID NO: 62878 - DNA, 2862 bp, Oryza sativa
agcccataatctaagtcggccatccttttctgaactctgatgctagtacactctttaatttgttggctcattaatcagtggctgcccctcgtgtgtgtgcatcattgaaatgatccaaagtcaatctggagagaattaagaaaaagcttaaatttttattggcgtttcaaagctattcggatagaaattaaacaaaaagtagttgaagggtgaacattcatacacacatggggagaattttcagttacaacagccgtcatcctgaaaatttaattattctgcctccttaatttgcaattgaattaatcaacttctgttcttcaaaagaaaatgtctgctagcttacaaattagatatatataatcaatggcacctagtaaggttcaagcttccaacagactaggagattattcatatttttgttcatttttttacactgctttaccaaagcaaggggaaaagaagcagcaactagctgattgactggagagccaacattatttttctctctgaagtatctcatgaactgacgcccattgcattgctttcatatatttataagaaccagcaaaccagatacattaactttgttcctcacaaaaaaataagacataacaacatataactttgcaatatataggtcaaaaccgtacgggttttacctaataatttaacagatcacaagcagagttggataagaaagatacaacacatgcatgtgttctttgttagtggttagctgacaaccaattgcaatttgcaagcaaaacgaaacaattaataatgatcttggtacggactacggacagaaacatgagtgtacttaaaattgatcaacctgcttcatgccaataagtacgatatatatctactaagattttcaaggctgcatgcatattacatcatatagcataatacaattatatttgtactgcacattacagtactgagtaataatctgttcctttttttttcagaaacaaacattccttcatatatattgacaacattgtaaaaggaactggatagtccttttttttcttatttgttaaaaatataattgtgttccacttaagatggagacacatatatatactagttcatgtgaaaaatactgttcttgatggacagaaaagtaagagggggagtgctttctcattggctgcaagtagctgaaataaaaattcaaggctagggctggttttgtttagttgggatgtcggagttttgagaaaaggacatgcatgcacccggctacctgccatctgcacacagtcccacacacacaaaaaccctaatcttttcactggagacagtagtacatttccatcgggcctaatcctaattatcatccacaacaaaactacatccacccactctcatcaccatcctaatttaggaccaacatcacaccaataagttaaaagtagtggaacagtaggacgccgtatatgtctcttcttaaaaagtaggtatcgtgtgtaaaatggtcatttcagatgaggttgtcactgctgtagatcgacatgttagattcttactagtcgcgttcgataaatattaacaaaatgcgggtaccagttctcatccacgactaaagagagcgattatttttttacaccagtcatcagcacaccaaacagagcaccactagctcaatagggggaccagtctaagcttgtgatcttaaatagaaaataaacaaataaatgaagccttcaccgaaacaagttaatatgctaacctgcaacgtacatgataaactatatttccaacatttgaattcacatggcaaacggggacccaaagtcaaaataaaaccgcaaataaccccggggaggagcatgcaggggaggatgggggtaagaagaggggtgtgctccttgggaagaaaggccacctaattaattaagtttttgcttagtttatagtggcacccaaagtctctctctctctctctctctctctctctctctcctctccatcaagtcttcatgcttacatgtccacctttctccctcccctctcttcctttcttataccccacttgccctcctcttctcagtttctaattaagcagaagctactcttcttcttcctcctcttcttcttgagctgtccaagctagctacacctactaaacctccacttcacatacaagcagctaggttcaaacctagcttgcctagctaagcttgagaggaagagggtttcacacagagtgagcttctacctctgaatcactctacctaagacaagttagaagagagatacatcaaggtatgcagatatatgtgtgtgaattcagatctcctcaaatttatgcatgcagcaatctccttttcttgatttaagttgatctcttgttgatttcttgtgttctactgcaattgcatacactaatatactattagaggtagattgattatgttgtattattagcaggcagctgacatgtgtctctgcagcagcagagaagcaattagttgagagattaagcatgcagtgcattaattgtgcttctcctggagcagggtcaagctggcgaacaggtcgtggtggtcgggccccatgggcttgccggagcagccgtccggctcgtcgggccccaaggcggagctcccggtggccaaggagccggaggcgagcccgacggggggcgcggcggcggaccacgccgacgagaacaacgaatccggcggcggcgagccgcgggagggcgccgtggtggcggcgcccaaccggcgcccccgcgggcccccgccgggctccaagaacaagccgaagccgcccatcttcgtgacgcgcgacagccccaacgcgctgcgcagccacgtcatggaggtggccggcggcgcccac

SEQ ID NO: 62879 - DNA, 849 bp, Oryza sativa
  unsure (1)..(849): unsure at all n locations
tgaaaccgaggttaaggtgttgtagatttgaaaggttaccaagctgaggaggcactctaccaaacaatatggatgtttcagacacatcaagatatcttatgttcttcattgaaccaaagtactctgggacatggctggcttcaactggatagccaaacttgttaatagagacatcaagctccacaagttttgcgaggtttcgttgtgtcaatgactgagttttgcctggaagcgaggagcaagaaatatggagggccaccaaagatacccaagtatcacaatggtggagcgacaaggaatcagggtagtacaacctacacgaattagtgcgactactgggtaggtccgtcggtttggcacgcaaaccgaggccaagcaagttaacgtgtgattctaataaagcaagttgcaaacaaaataataatgattttctaattataggggcaattggtcaaagggtgacttgccttgctcaaggtcttcacgaagcttcacgaatcttcgagaaatccacgattgacgaaaatccggtaaccgcaactatacgcaaacaatcgaaatcctaaacaaaagagcaaaagaaagatcctatttagactaattaatagttccattggatagatctcaattttacggaattattggaagtggaacggagtcaatcggtgttacgaatcgggagacatgaattttctaaggattatttgattttctgtctaaaggaaaaggaattattaattcccttgaaaaagataatggaggagggaccggaatcagacttttaggccaagcgtgaggcgcagcccaaggaattgcgtgcgcngtcnaggcgagtgggtcngcgcgcgg

SEQ ID NO: 62880 - DNA, 737 bp, Oryza sativa
  unsure (1)..(737): unsure at all n locations
gctgtgcattganagtcgagctcggcacccatataagattactttatttgtaattagacttagtatgtaattattgactacggaattggtgcgacaagtagcaattgactattgtagtcttaattagacttagcatatacgcacgaaacacttagcatatacatgactattttagtcttagcatgcatgtaatattatttgagttttaatataagattattttatttgtaattagacttagtatataattatttactagctagggttgtataatatacgtcacctagacttagcttatatcatgatttgtaattagacttagcacgtaaggttgtgtagggttctaatgtacgacatttacacttagcatacatgacttagattgttaaaacataaatgtctcgtaacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaacagggcacgcgggcaacgaggtgcagcgaagaagcttgagggtcagcacatcataacggaagtggaagaagatggacct

SEQ ID NO: 62881 - DNA, 8252 bp, Oryza sativa
cccgctcaccgacttgccctgcttccgcctgatctgctgctccttgatcgagttccacagcttcgtgatggcgtccctctgctgcgtcgtgaaccggttcatgttgtcgtaggcgtgcttcgcaaagatgtcaatggcggtctgtgtcctgataacataaaaaaggagaattagaacacaaaattgttgaatatgtgttgataacataaaaaaaaggagaatttagaataggaaattgtagtgtatgtgccgctaacagcataaccacatgatgttctatctcaagagaactcaccacggaatcctatagcgccgagcagctatttctagacatttcaggagggcttctcgttgtgacttcagaaatctctttgattcatcctcatctgctttcctatttagagcggcgaccgtcttctctcgagccttttcagacttctttgacttgtgctcaagtagaccatccaaaccaaaaggatcagaggattcctcacttgagttggaggctgcagcatgagtgctatcatctggcaacgagttggatgccgcagcttgcgggttatcatctgtgttattactttcaacagctgctagagctgctgcttcatcattgtcatcatccactgttgtgattggcagggctgagatggcatctttgatcttccctacagcctttgagaactacaaaacagtatcaagtacgttagtcaagcactcaaatcacaagctgtgtcatagacatgagcccagaaacaataataatgcatttttcacatttgatagagaaaataagcagcgcaggcaccaccacaatacactcaccacaaaactgtcatccgtaaaaagatcatttgccaccactgcatgcagcacccatatatcaaactgatttttctgttgttggttgaaacactgcaaatccaccacaagttataagtacaagatacaatggtataatggaactgcataaaacagagaacactaagacttaataaaaatcttcacctctgttacaccctgggctgcattaaacaaagcctggtaatcagcacgtacagaaggctcattacaagctcctggtgaagacattgcagcctctaatatagcaaagaagtgactgattgtccctggcttgacactcccagcctcaataagctgtagagctagttttgatgccttgctgaattttgaaggattccgtatgtgtgaagttatcttgtgcatagcatcaatgacttgcgtttctgaggcatcaacagtagttctaaacctaagtcgcttctcaggagctacaagaaaaaaataatgaatattagaagtttagaacatgagcatgaagcaagtaaaatatctctgctgttgttataggaatatagcgagactgtaaaagtcgctcgcaattaaaaaaaatcatgtggaaaataattggatgataaaaaaccttcagatataaggagtcattacaactttcaatcacccataaatcttgtcagcaggactagatattcagtgctagcacactaacgaaactaacgaaactagagttagtagtaaaacatgatggcattttgcagatggaagagttgtcatataagccaaacttataagagatgtcaccagattctgttaacgttccaacttccaatcaacacataacatagcgaaacattaatctttgcaagacacaatctcgcaaacaaagcacaaaaaatcccagtgaattacctggtggtgataatatcaacaatactcactatattcccaattgagttactccaagggaccaaggcagcagtaaaccctggcactaagatttttttaaaaaagggcaagcaaagcttatctgaaccagatcaaatgtgtataatcttcataactgaactaatttaacatcttctgttttaagttatgtcacaccttacatactcggagcttattttgagttcatattggtgaacaatgttaagccaaacatatgtaagagaagaggttgttatcctaaaaggaaacattaacacttgatttgacagggagtctcagggctaagagcttcaactatttataccttagttctgcaaaagacacaagtaatttgcacagctaacatattctggctgatgcagtcattgatctcaagccacacagaccaaacattaacaattggaacatccctgcatctgtatgctatggttaatctccttgtgagatgtggcaaatgagaactgggaaaccctaataccgatctagaaaatattcctatgaacaaagttcgcatcaggatatcaccacacaaaattcataaattaagccatgaatttctagccagatgaaaaacctttcaatttctcagctcctaggcgatgaaaaatcagcaactaatcgttgacaaaatgtacaacaaagaacacaagctagtcgtactcgtacgaacaggagtgcatccgaattcccaaagccgaccacgcagagcaggggacgcagcggcagtagcagtaagcatctatctaatttcgcacggagtacaagagcgcgagaggagagctcaccacgtccttcggctgcggcatccgtggcggcggcggcagcgggtgaggaagcggcagcatctgaggaagagagcttgtcccgcttgagagcgctcttcagcgcgggcagtctcggaggcggaggcggcgatggtgaaggcgcgcgctctcctccggcggccggcgcggcggcggcggcgggaggtggtaggccctcgaagaggtcgtcggaagccatggccggtgtcttggtctcctcctgcttctgtctgctcgagatgtcctaaattaatgggcctcaaactaatgggcctagttggtctgctatccaaattgagatggcccatagcccataggggagaactatttatgaaaatactcttggagttggactgaaattacgcgcctgccatgcagcaaaacctccaacgccccacactgcgtgcacttctcgatcattcgatcgcttccccaaatcgctctcctctcctctcctctccaccgccgccgatctcctcctcctccggcgccgtcgccgcgtcgcctcccggagctccggtgctgccaccagcctacgcagcgccgcctcctcctcctcctccggcatccgccaatcgccgccgcctggttcgtcggggagccccgcgccctaacgttttctagaggcgccgcggatccagcgcgaatcgatcgagaggtaaagggtaaggactcgactccagatcatctctcgatttgtcgttttcttcccctccatttttagtccattatttttttttgttttgtttttttatggctgggtggcgtctttgttctgatcagcgcggcgttgtctctcttgcagggaagttgatttgagtcggcggccgaagaaggaagccatgaactcgagaaggcaagtactgcacactaacttttcgatgtgttttcgattttgatgctatgggtgaatggagttaccgggttagggttgatgagcacggatgatttggtaggactgactgactagctggttgagctatttgtatatttgcattagggttctatatctactataactgtgtgctgaaattctctcaggaaaaaaaactataatgtgaaattatcgtgtgattacagcaattctgatgtatgctaggaaggtcaatactccttcgtgggattttatctgttagttgtgagattgcatcctttgatgtaagacatttgccaggggaaagctcccatgattccgtagttagcaacttattgatatgaatcaccggaaacaattacttatttttgctggccagctctagctttgcatcctttataacatgtttgaacattgatgtgcttccaccaaagattgatgaaatgttgtgcaaggcaatttggttcaacctgaaagaatgcctcatgcttttcaattgccattagtcactatccaaaagtttgatttcggaaggcatgtgctatgctgctgtatatttactttgctcatatgtgattatgtgtatactaccattaaatgagctttaggtctgtgactttttactcttaaaagcaactagttatatgccatttcatcctgctgccagttgatacttatagtagcgagaatcttgtggcctaagaagtcgacttcctgcattgtgtcagtttaataaaacaaagaagaaaactcaaataataactttttgtgtaaatgaatagaaggagaacaaaacacctggtagattgaccaactcatgatcattggatcacatttctatttttatcactcctgctctgtcccaagctctctatcttagttttgtaaacagtggaagtgtataaggaatcaaagaaaagggaaggccctaacaaggatctgtacagtgggatagcttgttctaaacttctactacttgatattgacattttgacatttggttgcagatggagtttatgtccagctgcaagcctttgtctgctctaaaagcttgttactcactatgcacagtttccagtttaggaatggcctgtgatcatctacctgctaacactaagaacttactaactcacacatgctgtttatccaagtcaaaagtacacagtattagctttgtcagtcaaatatatttgataacaagtattaaccttttcatgatattcataactataaattcgagttgaacattattaagatgaatagaacttgttagtattgtggaaggtatctatagaaatcagtagtatgtacctgtttatttatggcttgagattgttttggctcatagtttttcttcagttaatttgttgaatgcatattctctttctgtttttaattctttgatacatgtgtcaaaagctattgtttttgtgaacttgggagattttagtaatgtcgtcccttcatacttgacatatataaatgcattcatgaattatgattgctcagtgtatatccatgtagactaccacggtaaatgtttctatgtaacagattgaatatttatttatatggtttgcttagtttgcatgtgtctttgcattttatttccatcatatgctttgcgcacgctgattatttcatggaaattttagcaactaccgcagcaccagaacttctctttttgatggcattgaggagggcagaatccgtgcaacatcctattcttcacatgagatagatgagaatgagaatgatcaagctattgatggattgcaggatcgagtcagcattctcaagcgggtaagttgctgcgttattattggacgtctgatttgccctaagttttgccagtaaacttgtgaagaattactgttttgattttttgacataatcactcgtattagtatatttgtattaagccgtgctgcacagatggatcattaaagcaactactacatttgtaatagcgaaaacgaaagattttgttgattgtgacttcattcgtggccacctattagataactgtgaaccatgtgcttcttggaccattttcatttgaagtgttggaaagtgctacagcgcagcttttgatcatgagatttatgcttaaatatggccaagaaggaatctgagtaatctaatgggccttgtgataacttttggaagcagctccaatgccaatgattttattaatctttttggtattcatctgatccatgtttctaacatgcgactgatttacctctaaaggttttagtgctagaaattagctaatgaatggactatagaagattttgtttcaactgcaagtagccagcaaaacagaagattttaataaatctttggatagaggacacgatgtaattcttatgtaactgtgggcctcttcacacctaatcaattttctttgtagtcttaccaagacatttcaaaggtctgagccttgaattaacgaatgaaatgagtaataatatcttcagtagtttatggtgttttgctcctgcttatggatcaacagactgctggactgctggtcccgttccagtgtttggttgtgtctagtttttatagctatgcgaatcttctaccctgtcatttctttggagagatctacagacaatcatatatggatggttactgaggttattttacgtacttgcagttgtctggtgatatccatgaagaggtggaaactcataaccgtatgctagaccgaatggtattttatatttatccttttaacttttgcttccttgaaaaatatccttctagagttctattatgttgacatcttgcctgatccagggcaatgatatggattcgtcaaggggttttctgtctggaacagtggacaagttcaagatggtaaacactcacacagtacaatcttccttccatcataccatccgtatattctgctgagaccgcaattgatgtctacgatataggtttttgagaccaaatcaagtcggaggatgggaaccctcgtagcatcattcgttgcgctttttctgctggtatactacttgaccaggtagaagaggaccatgcatcacttgcctactgttgtgaagcgatgtgaactgggttgggtactcaagaacacgctgaaaatgtctgtgtcaatttaccgtggtgtcgtatatacctccaatatctcgctgtcataaagcaaaatatgttgaccagaatgtttctaactctgcactgtgtgaggattacaacatgttcgtcgtttgctctggtgctgtaattacctttacagaaaatgtttcctgctgtgttctgtaacatctgtttctgtatgcggtcatgctatctgtattatattataacttcacaagagattgtactttggagtcttaattgccatatataagacgctattagtatgtggttaatttgctgctactaccttgtaggcttgtttagcagagcttgtttgggcagttctggagtcgacacctgtcatggaacaaatccaaatcgaaggaataatgtggctgcagcgtaagccatttgtgttgtatattataaagttaacgactgctagtcagcgactggttaatcacactgatcacaactaacgcaattatcaatggagcaattattgagtgaagatgccttaatcgtgcgggagctagcaccaaacacctgtaattatcatagataattacgtcaaccgatcttaatcacatgcatgcatgtaccccaatacaatactcctactcatggctcgtatttctataccgtcttgctcgaatagctatactaaccaatcaagacggtttttctaatcatgcaacttaatttgcccatgtcgttaactgataatcgaagtctgatgattgttgtgtagagacctctctctctacttcaaaatataaaacataatcaccctaaatccaaaaacaaaaaaataattgttatcatcaacaataaatcatcgtaataaatacatgctcccaataaaattaaagattttaagagtaagtgattttaaaaattaatttagtacagatgagattttagttatttttttaataatggaatgaaacatctcagcctttgctcagaagattttagttaattacatgcatatatgtacgttttgtattatgaaacatctaaaaatagttgtgcattatactttggaatagagtgagtatatttcttctattccgggttttgttatagatttttatgtcgaccttgctcctagatactcaaaataatgagggttgtaataggtgcctatatacgtagatacttaactttttatacattaatgtgattcattcagtttgattctaagaagacatatatttcctactacctgatttgggagtgacttaattatttcccgtcaccagatgatctgggaatgggaggccatgataatattccaattaatgcttttgctactaacagagaatctatgcgagattcctttaattcatctatgagcagatttaaaaaaaaggaacttggctctgttcttgtgatcaaacacctacctgtacaacagctgtactcttgtgcagtttaattagtacgcactaattaatcaatctgctgctttgtttggggtgtgttagagatgtcatgcacaccaccccatcaatgtttgacaaagcttaggttatccatctctgggagatgtgccactagtttaattagtgggcaaatgctttgttaaaaaaaagcttaggggttcatatactttaattggttgcacttaacttttgttttgtccctttcttttttagactggagtggaggcatgagcatgacaggatcttttatttggg

SEQ ID NO: 62882 - DNA, 682 bp, Oryza sativa
  unsure (1)..(682): unsure at all n locations
tcagaaatcttgactaaactcgaagtcctaactttctctaaactcaacttactaaaaatcaatactgggaggcctcactttatatttatactcgaggtaggcagcataagcctataatctaacttatacaagaagccctaatatcctaggaaaccttcctgtataaaaaaacaaacttttacaaactctaatggtaccaaatttggactcactccaaatttaactcctcatcccacacgaacacaatatctccatcacatgccatatggaatctccatctaccacgtgcattgatcttcagcctaagcaccccgcaagatatcctgatcgttcagacgtaatcttcccccaagttgactactgatccatctccgacaatgctctccaaaggcatcaagactcacctacacatgaatcaaataagaaaccatatttgagcacaagttcactctaactttactcaacatgagcacacaacaacattacatatgcataggaatcatctaaaagtcataaacacgaattaatcacgagtatccaattaaacgacccgaaaccaaaaccgacgcagagccggtctgtcataccggcaggttggtcggtctaactaatgcacacaccgcccaaattcnttggaacccggggaacccaagggggggccaaaccacccctccttttgggg

SEQ ID NO: 62883 - DNA, 1376 bp, Oryza sativa
  unsure (1)..(1376): unsure at all n locations
ctgaataagctccctttagtagatcaatttccttacccaaatatagcaagaatccgaacactgatgacttgacaactctcatcgactaatctcaagacttcgaagttgatactgactctaagccgatgactactctgtgcttaacaaatttcactattaacacatgccccccagatttggagtattaaaattcatgcttcaaaatttcttgtccagataactacaaaaccgatctttctttgcttactgcagtcggctttcatgatccatgacagagcgtggggctcctcaccgggagaccgcgcacacccccctttgccggttccgccggggacgctaagtgaagttataagctctcaatctgtgaaatgttcgcgaaagtggaaacgcgcaagacacgggcgatgtatacaggttcgggccgcttagaagcataataccctactcctgtgttctgatggatctgtgtatgaaggagctacaaagagctggagagcaagagagttcaaactctagagaccctcttcctccttctctcctctaccagctccggttatccccccccacccttaagtgggcaaggtcctccttttatatctcaaggggatcccacatgcaccacttctaccttcttttctatagggtggggacccatcctatctttactaaaacttggctcgccttctcttggaagctaaaacactgcttgtttttgagtgcggccacgcgtcctcattcgtctgacctcggggatcaccctgtcatctctttttaattgggcggagacttgcaatggctgctgtccgagtgatccttctgatgggacggcccatacctacctccactccgccggaagcaggtgcaacgtggggacacggtcgtctgccgacgacataaccagtgtcagaccggtcgcaaaccagtcattcttgtccaccacgcgtcagattagcaatctgcatgttcgcccttcttcatacaatgtcttgcttgtaatggttgcgatgaagcctggcatgtatctagccgggactgacgtgccaacttcgggagttagcacgccggctccggctagtgacgagcgcctggaggctctcatcattccgacgggacggggcaaggcgtgtgacaggccgcctgttaccacctaaccagcaatctgaccgatcggtgaccggtcacacactgctaccggttacggaccggataagcgagcgtgctgcgctgcattaaatgcggcgtggcgcgctcgtccacccggcataaatgcggttaggtgagcgccgctgtgcttaccntacccatatactgggggccaaaaaaccaaggggtgtcgggcccccanccttngnaccaaaaaaggggcgtgccttcct

SEQ ID NO: 62884 - DNA, 4154 bp, Oryza sativa
caagttgcgtaggtagagacgcgtaaggccagcgaatgcatcggtacaggcaccgaaaaatctcatgagttgcttcccattgtggcggagatcataagtagagtaatgttccggcttcttctctggcagaataatgaactcgacgctgtcgaggaggttgttggtggccatggctcgggcgacagctttgccaatggtgagacaatcatagtatttcaagtagaaacaaacgctgagatggcgaagggggatatcctgtcttctgaaattgagaatgttgtctgttgcatcggcgacagcagcgttcatcgggattgtatccttcaaggtggcataaccgcagtcgggcacgaaggaatcaacgctaatttggaatcgcgagagcatgtggcggaggtggatcgtcctcttggaaaggaggcaggttctgacagcatcgggggtgttgagacggtcaaggatgttgagcagcagatcatcaggtagcttggtggacctatccactactagttgggggttattgtgagctgctgatttcttctgcatcaatcaatataattgcaaaacgaaattaattagtgcatgcatacatatccaagagaatacagatagagaaatgcaaaaggaaggaaacaatagtagatgaataaaaggctagttaggcggcttacattgcggttatggcaactacccttcttattcttcatgatggtatggtggttaattccaacgaggtgtaaagtagcttggctgatggattcgatttcttaattggttgtttaatattgcagcagcgcttatatatgcttaattgtttgcgatgaatatataaagaggaggagaaggacggtgacctcgactgccaactagtcctccgtccgtctcctaaacgaaacgaaggagaagaatttccatgtttgttagattgagtcctttacagatttttctttttgggaacaagtccattacagatttaaaaggctactcttagatcaaaggtaaaagcttcttactgtttgtatgaactatctttgtgttttcccccgttgaagaatttagttggtgaaaacagatcttcttactgtttgtatgaagtagcattccaggtttgtagactgccggttcatattgaaaacaaatctccattctctaaacacatctgagagtgttttttgtttattgcttgccaaagccaggagcaagaaccaggcaaatctcaactttcccttaggatttatctctaagtaggacaatacacattacaaacctggaatggacaatacacagtttttacccggaggtagtaccattcactaattctaaaggtcttaaaaaagtgagagtgcgatggcaggtgaaaattaacaaccccatactaagcttaaatagtggggtaaatagtaaccgtaggggaaaggataaacgaatatattttttcactgcaccaaaagaatatcagaatattcagaacattcacatacattactccagttactggtccgaaaccaagttgcaggaaacacgatgagtgaaaaaaaagaacccgaatattcagaaaactcaatatgtattactgtatagcaaaaccaagatttacatttttgcgcatagtaaattcagatttaagaccggaagcgaattatatcagaggaagcaatcccgaatccctctgtaattttcctcctcaccaactcctgctgcttgatggtccgcggaaatcttgacagagcaactttgatcttgatcttgggatcaaggtcactgcagcaatcagagaacctcctgtcgtacagggatatcctcactaggttaaccgcggcttccatcatgcacctgatgtatccaacgaagttgtcatcaggttgaaaaccgtagatgatgagcttaaccagattgtgatgcttgaaaccatcaggttgtgagctttgccactccacgtttgttttgtcacggtaacccagttcttccccgttccacgctgtcagtctccatgtcacaccaatggtcccaaactgtgatggacatcttcaggttaggcgctgcctcgaggaagaatcttgtccaagctatatcacatccctcggggagtctatccagattcaaaacccgcagtttctggagaacaggcgccagaagttttgggcactctggcttaacccaaatctgcaaatacaagtaataaaaaaaaaaggaagaatgtggttttaagttaattaagaatgaggaacaaataacctgacctgacaaagatgcttggcttgcttaaagtaattattattaccttttcacttgcgaagctgaggtgcaggttgcttatgttggggacattagcaaggaagtgacttaacctgaaaaccttctgatatcccgcgcttacattgttgaggcttaggcttgaaagcattgggacgttgccaaaagacaagggttctccgggagagacccacataccaaaaaccagccgcttgaggttgggtagagatttgaggtcgactaggtggaaacctgcatcgtaaatgtcaagctcaacaagccgcgggtgttccagctgcagctgcaacacgctatcctctgaatcacacaccgacatgcacagatactgcagccgtttgcatgtggagaggatgttgggaatgtcagcttcagcaagcctcaagttctggatgaagagctgtgtaaggccggcgaatgcatcaagataagaaccaagaaaggtcatgaactgcttcccattacggcggaaatcatcaacggtgtaacactctggctgcagctccgtcaagatgatgaactcgacgctgtcgatttggttgtaggtggccatggcttgggaaacagctttgccgatggtgagacagtcgtagtatttcaagtagaaacatatgctgagtcggtgaagagggacgtcttggcttctgaaactgaggacattgtctgttgcatcagccacggcgctgttggcctgaataagacgaggcaaagagacaaaacgagaaccgttgaagaaggaaccagcacgtcgggggtgttgagacggtccaggatgttgagcaggacatcgtcaggtaacttagagagcctatccactggtagtggtagggaaccagtggatgctgctgatttctgcatcgattgcaaattgcggaaactaaatatattagtggcaggcaccaggcagcgaaccaatgtagtataacttacgaacaaaacacaaaacaaataacgtaaatgtaaactaaactaaattgatgtttttacagcacataacaataataataaatagtttagaagtagtttatcagagacagcatagcaacatccatggatctgacagacaggcgagagagatgcagatggaagaagataggaggcggcggcggcttacgttgcggttgcggcgacttcccttcttgttcttcatggatgacctgaagcgggcgctggtggatgagatcggaatcagatgtgttggcgatcttcttgtgtttcttctatactagtagatatataaatatggatgaaggcgctcggtcggccgggccggatcctatgcgaaattggctctcggacatcgaaatcccccactcccttttcgactgctatttcggcaagtcatatcaagaaactccattgtggagaagaacaagatcagaatcagaccagatcgccgttcgccgttagcggcggcgtgcgttgccgatggcgatgggatttagggtttttcggcctctcggggacgacggcctagtacactttgctgggccgccgatataaatgggcccactcatcctttctccctcagctatggggaaaagtacaccgaaggtcccacaacttgtcatcgggttacaaaatcgtccccaaaccgcaaaacaaaatactaagatactggaggtccctcaattagcaaaaccgttcgcttgagatcctatgtggttttgaccccggttttgtctgacgttgcggatgagttagcgtggaccccacctgtcagcattgccacatcaatcttctctctcttttcctctcttctctattctttctcatcctcatctctctctctctcctctccgacagcgagtctgtgaggtgggagaggaggagggcgtcggcgaccggcgacgcggcggcggaggaaggggcggcgcgcgggc

SEQ ID NO: 62885 - DNA, 676 bp, Oryza sativa
  unsure (1)..(676): unsure at all n locations
atattttgtacaacgtattttgaatttaaatttttcatgaccaactgttcatatcattacagtacacgtctgaaaatggcatgttttgtcgacatttttacttgtttcgaggcaataagaacagatcaaccataatgagtgactaatgaacatgaggtatgtttacgtttttatttttcctgcaggtcaggtccttccgttttaaaatataaaatatattagcttattcaccgtcttcaacattgtacatttaccactatattcttttgtaatacttgaggcatttctttttttttgggtgatttttgacatctgtgacgggtgagaactaaaaccagtcacagctgtttcgtcacctttgacgggttgcaaagagtcacccgtcacaagtgtgagtcacctgtgacgggtatattttttagcccgtcaaaggttttaattaccagtgacgggctttcacccgtcaaaagtgaggtgttggtattagtgaccactagtctctaaccagaccaaaatncgtaaaagtgaggggtaagggcccgtcacaaatggacgggatccggctagtggttattggtctttttgcaaggacaantnttgttcttccattccaattcgggtgaaatttttaaaaaaacccgcgggggggggggagaaacacccccccccccctttt

SEQ ID NO: 62886 - DNA, 2876 bp, Oryza sativa
tgagggattcaattcaaactgcagcaggaggaggaggcgtggttggtggtacgtacccagggggagaggaggaggcgattgcgagacgaactcgacgacggcgacgacgaggcggagcagcagcagcgaatcgaatggcgatctggagggaatccctccggtggatgcggttgtgatttggttggttggttggagcggaagcctcgccgtcgccgtcgccgtcgtcctcctccggccggcgtgcgtcgccgacgagaggcccctctccgctgctgcttcgtctcgtgtggtggtgtatgcggcgctagatcttttactactactagtactagtagtggcctgcctgccccctgcccgcgacgccgctcgatcacttgacttattaacaacaacaaaaccaatcaacttatactaacaaacttgagtagtattagtactagtacggagtatattaccttttcttttttatctttcctttttgcgattcctatagtattcttcttttccgttgatgacgatggtcgatacgaactaatttctctctctctctctctgccttttttttttcaaaatgcccttcttttctcttaataacaagtttaatattatacctaactagactttaaatcatctatattcaatttaatagccggttcatacaatataaacatatactacataatttataactggttcaacctgtcatacatacatgtatcttagagtccgtattgcaactagctacaaatctatggcacgttgtttttctctctcctattttatcttctcgaaatatatttatatctagcttataatctgctattgtacttgctacggaaaacaaagtgcgcgattatagtgagattaattaagtattagctaaaaacttaaaaaatggattaatataattttttaaagtaactttcatatataaaacttttataaaaaaatataccgtttagcggtttgaaaaacgtgccgcgaaaaatgaaggaagtgagttgagaaagaggggaaaagaacatagcttgatggttttcactgtctctagtcccgatctaccgtctccgtctaaaatataagaatcgagtactatatgtaatatatattttaaatatgttcagatagtaaatatattttactagaaaatatccgtagtatacttgtggcggttaatcaacgtatctgtctgcacaagttaattacatccttccttttaattctctccattttaattgacaggcactgccatcgcttcagttgaggtcaacgtactcggcacaaatcacaggtcaaacctttaattaattaccctctcttacgtgcaccaatcatgtcctccgcatcattatcgatctattagcacgcaacacaccacagtactcgtagtagtagtgcttcatcattaggttaatttatttactcctgcatcgttagattagatctcgggtgaagtacgttattaagtagtactaattacttatctgcggatcgattagattacagctatctagtgctggtccagtgatccagtctcgattgcgagcaacatgaacgctttaattccacaatccacacttacatccatcttgcatgtaaatatacaaccgcaacttgcacaacagaagcaataaccttaagatctactgtacgtactatacctctgttttcaaatatacttcaaacgtgtgtttacatttacaactttacaactgattattcttttatatggtagagagtgtgcgcgtgttttatacgagcatctgcgtttataatttgttttaaaaaattaacaacatcatatactactttactttttttaagtatatgatgttattgacattttaataaatatttgatcattcatattatttaattttttatacataaataaattttaagtcacactaaaagaatatttgatgatgaattaaatcatgataattaaatgataattatatattttttaataagataaatgctcaaatatatcttgaaaaaatcaacagcgttatatattaaaaaattaaaaaaaacagatagagtatttatttagggggtaacatagaggggatatttacattcgtttgagcaagtgacagtaaagaaacaaaaagaaggaacaaaccaacaaggtcattttcgataggctacgcaggccggccggccggccgaaacaaatgggtcacaattaagcacgaatttaattggggaaacgccatcatgtcattcactggatcgaatctgcaagatttaattaagccgtactccgttccgttccaatccatacaacgatttttttggttgctcggttcggtcggttgttcatgtgtcccaatatctcctctccttttcttcttttttttcccttcttcttttaacgatgcagtagtgtactgcccacatcacaaattataaatgttttgacgtctctgcctcaatatacttgtccattgacaaatttggaagtatgtttagttagttcaacattcccgttccatacctccacttgcagtattttatatacgtcatttcttttctatatatacatgtcatttcatatatagacatctgtactccttattaggaggttatgttggtgacagtgaatctaataccctatttactctatgaacttcataatagaaaacaatcaaatctaaataaatagtcatatataaaatcatatttagatgaatatcccctaaattaaaaatatacataacgcattttatgaacaaaagtatattgctatttattttaggtaatattattacattatattttctttttttgagtaaagtatgggtatttagctagtacgtgaaaaacaaggaaaaaaaactggggttttttaaggcagaagtgagtccgat

SEQ ID NO: 62887 - DNA, 1802 bp, Oryza sativa
agtcatccatcccctcaggcgcattatgggctccctttttccggaggggcagccgtcgcttcaaatcggcgcttgccattgatgatcgatcatcgccggtgcccaacggtacaccggggtcgttgtcctagcctcacctcgcctcctccgatttcctccgcgtcgctataactcggtcgtctccctcaccggtctgtagtggccattcggcatgccatgaacgtatgtcaacttccccggcaagatgacattggtgaaccgcacacgccggctttgcgcacatggcgaggggcagcggtccggccaagctcttggtgaatgctggcaacaccggcatactacgcagggacccgtttggggagggagaggagataagaagtaggggaggagaaagaaaggagacgagataaggtaagaactactgacatatggaacctatatgttttgttttcatttctttcttcttttgtttaatttagttttcagtggcacgtcaatgttacgtgggacaagaagcaagacaaatcattcacgtaagtcggttctatgagttaagagacgttatatcttagtattgcgggtttaaggacatgattcaaactacaatagccacgtcatgctgaaaacataggccgtccaatttttcctccaagcattgtgagcggttggatcctacaattggtgaaagctcttttcggtccttccagaaacttgttttgcaaacatgtcctcccacatcccaagtcccagtagaccacccccatccaccgccgcctcctccccattccccacggcaaccgcttcctaaaccctccccaccgccatcgcttcgtcctcaccggcgtgatggatggtgttgggggagtcgccaaatgtgtcagctgtctcatcgagcacaccgactctgccttgttgaggaaaggagacacggatgatgaggagaagacgtctccttcctctcactatacacacgggcagcataacctgcgccatgtggtgccgcctcctcttcgtaccaacaagcccacgcccctttcgccaccaatgtcatcttccctgattcactgccggggcgattggagtggagaatcccatcttcgtcctcctccatccaggtatgaaagcccaaatcgacgagcactgacttagggccctgtttctttcagcttaggattattataacctagattattgagtcagattactataagctagattgttataatcagtagtagaataagcggttagttgtttcttttctagattattagagcttagattattgggtttgcaagtctaaagagggagtggggtagcatggtgggtaatttttcacccaataatctagaaaaagctcacctaaatgagcttatcagattataataagctgggctccagattataataagctacttcaataagttgtctgtttctttcagcttactcttaataatctggattataataattccaagctaaaagaaagaaacagggccttaaaaggcttaaaaggcttaaagctgacgcgatcacctcttcctacctctcatcggcatcacgcactcctctctcccccatcccgactgccctcgtgaccatcagatgctcgataaattgcttgcatggacattaggcaaggtaccccttcttattgtactaatggaagtgtgctctacgtgtacaacttttgtagctaataaatcaagcaccaaaatatgcacacattttaacatctcactgctgattaagcttgattacggatgaaaagaaaatccagcgatcagctcacagtattctagttt

SEQ ID NO: 62888 - DNA, 2380 bp, Oryza sativa
cgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatctttgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagttgtcgcgcagcctcttgtatcttatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatcaacaaacctcgtcccagtaatccctaagtttgggaatgtgtcgaacttcggtgtctgccccttcagtataaacttctgggacagatctcctttaaagctctgaaactgttctgccattttcttcagagtccaccttttcactttgtcctctgtacccgcagaaagggtgaatgtctcgagcattgtggtccacagcatctctttctccgaatctgggacaaagctctcatgatctccgcttgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaatggagggttgactaccactagcctcctcctcctggttcccctccacatccctttccacgtgcccctgttggttcccctccgcatccctctccacgttcccttcctcgttcaagtactggtttggatcctcgttcccctcttcttcattccagtactggctgcttccctccgcgattgtatcgtacaatatctgttcctcatcacggtcagccatctgttgatacaagaaacatctgttaagtcacgagacatttatgttttaacaatctaagtcatgtatgctaagtgtaaatgttgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaaatgtattaggataaatgcgaagtaacatatatatatatatatatatatatacatatatatacatgtatatacatatatatacatgtatatatatatatacatgtatatatatatatatatatatatatattgcatttcacgttaacgttcgtcctcgttcgttcgctcgttgacgttccctagctcgttcacgttcgttcgctcgttctcattcacgttcgttcgcttgttctcattcacgttcgttccctcgtt

SEQ ID NO: 62889 - DNA, 1308 bp, Oryza sativa
ggcgaattcgagctcggtacccccatatgtgcaattccgaagcattgccaaacaaaggtctcgtcttctatccttgcccatccaagtcttctcgtaccaactcagtcttacttgcaccccctcaacgacgagaagaatatgtcacaaaattattcttaatgtaatgaggagacttgtttaggtgaagaacttctttcactcgtgaccttagcttccacctctccagtggtgagtggtgagatgaccatcactcttcaagatgtggctatgatcttggccctcccaatacagggacatggggtgacgggcaagacagagaatcctggatggcgtgcacaagtggagcagttgtttggcattgcactcaacattgagcagggataagggagcaagaagaagcataacggaatacccgtctcttggcttagccagaacttttcagacctggacgacgacgttgagccatggcgtgttgagtgctatgcccgtgtatacatcttgcacttattgggaggggttctttttctagatgctgggggtgacattgcttcggcaatttggatttctttggtcactaaccttgatgatctgggccgttttagttggggctcagcggtgttggcatggacttatagacagctcttcgaggcctgttgtcgccaggcaccatcatccaacattagtggttgtgtgctggtgattcagatgtggatgtggctaagactaccggttggcaggcctaagtggaggcaaagctttaccctttggccctacaatgagccagacatggagaagacagtggcctacctatttgagagtatagccactgcacatgctcaccgggacgtcgcatacaagcagtacatcaacgtgatggactgcctacagcctacacatataagtacttccactatcacttctaattcgtcatttacttatatgattgaaatactaacctacgacaactcttcaacatttatagattgagtggttaccataccacaccactgaggctacaagtcttacactgatctcgttgtgcaatcgaggctccgattacttcatgtaccagtgccaattgatttgtttctgggcagttgagtaccaccttccgtaccatgtcatgcgatagtttgggaagagacaagaatgtcttgttaaggacatctcaactagagttgatctacacaagtaatattttttatctctgcttgctttcattgtcaatgttcaattttgcaccatttgacccttatttgacacatcatcaccttccatttgtcaaggtacgacagggtgagaacaaag

SEQ ID NO: 62890 - DNA, 8242 bp, Oryza sativa
aagaaccaggactaaagattatagccctgcatattattttcgcttacatatgtgtttctaaaatagaagttaatgcattaacattatttaaagtacaaagattaatgacaattaggccgaaaaattatttgtgtctgtaataaattaagtggataaatcgtaataagcaaatatatgacttaaaattaataaaaattccaataatcatatatacttagcatatgaatgatattattaaattggtaaaaactctaattaagatatgtatgtacatactgcatgatttaaaattaataaaaattgtaattatcatatatacttagcgtaggaattatattaaattaaatgttaaaaactctaattaacatatgtaaatgccacatgcatgatttaaaccttttaaaaattcgaatagtcatatataagtagcatatgaaagatagtaaattaaattgtgaaaaactctaattaacatctataaatgccacatgaatgatttaatacttttaaaaattctctagtcaattataattagcatatgaatgatagtcaattaaatgtagcatatgaatgatagtaaattatgccatacatcaattgatttatatggataatcaatacatccaaaatagtttacatcgtgtacacaataattacggcattacatcgccggtgacggttgactgcacataccttttcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgactggtagaaccacttgacgttaggctcgtcaggccctctgcccttctttcctttgatagacatgtccttcacgaaaaagacttgcgttacatcattggcaaggacaaaaggttcgtccgagtatccaaccttgttaaggtcaacagttgtcataccactgtcatcaatcattacgcctccaccagtcaacctaacccattggcaccggaacagaggaaccttgagaggaccatagtcaagttcccatatatcctcgatggcaccgtaatacgtggcagttgttccatcgtgtcccatggcatcgacacgaacaacgctgttttggttcgtgctcttcatgtcttgggctctcgtgtagaatgtgtacccattgatctcatatccctggaatgtcgcgattgacccagacggtcccctcgccaggaaggcaagttgttggttgatctccggcgtgcccatgagatgttgtcgtagccacgtggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctatcgtcattattactttccttccaagagttccctttccccgtagtctcccttcatggcgtgattcaggtacctcgattgggcgaaggtcttcgataaattctacgcaaaattcaatgacctcctctgttccataacccttggcgatgcttgcctctggacgagcacggttacgaacatacttttttagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgatgagacattgcaccacttcattctgaagggcttctaatctatccggatcgatgaccttctacgaaattctgttcatgaatgcacatagctttgttattgttgcccggacattgtctggaatgataccccttattacaactggtagcagttgtgtcatcaacacgtgatagtcatgagactttaggtttgtgaacttcttctccttcgtgcttattattcgcttgatattcgtggagtatccagacggtacctttatgctctccaagcattcaaacatactttccttctctgccttgctaagagtgtagctggttggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcatgtcgattgcgtggcgtacgtccaagaattcccaatatggtaactcccaaaatatagagttctttttccacatcgccgcgtgaccatcttcgctctctataggctggcttccaagcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacaatgacccatgtatacaaccttcctacagtgcttaagatacgtactttctgtttcatccatacagtgagtgcaagccttgtaccccttgttggactgtccagataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacatcgatgtcgttaccaggttgcttggggccttgaataataatcggcatcattatgtacttcctcttcatgtatagccaggggggaggttgtagatacacatcgtaatgggccaagtgctatggccgctgctcatctctccaaaaggattcatgccattcgtactcaaaccaaaccgtatgtttcgggcgtcctttcctaattctttaaattttctgtcgatgtttcgccactgcgaaccatcggcggggtgtctcagcatcccgtcctgttgacgctcttcagcgtgccatcgcaacattctaacattccccttgttcctgaacaaacgccttagccgtggtattatagggaaataccacatcaccttagcaggaattctcttcttttgtagctgcccgtcaacttctcctggatcgtctcgtctaatcttgtatcgtagtgttttgcaaacaaggcatgcttctaggttctcatactcctcaccgcgatataggatacaatcgttcggacatgcgtgaatcttatgaacttccagtcctaacgggcagactatcttcttagcctcgtacgttgtctcgggcaatttgtttctccccggaagaatgttcttgacgagtttcaataaatcgccaaatgccttgtcactaacctcattttttgccttccattgcaagaactccagagtggtatccaactttttgtgcccctgctcgcaacctgggtacaacgaagttctgtggtcctccaacatcttgtccaatttatgggcctccttttcactttcgcagtcctccctggcgtcctgcaacatttgaccaagatcatccgcaacgtcgttaccatcagcagctatttcctcctcgcccgtttgattttcttcaaatccaacatactaagcaaagtccggaatattgtcgtcttccacttcatcttcttccatttcaacaccttgctctccgtgggatgtccaacaattatagcttggcatgaaccccgactcaaacaagtggaaatgaatagttctggatgcagaatactccttctgattcttacacttattgcatggacaacaaataaaacccctttgcctgttagcttcggtcactctcaaaaaatagtgcacgccgtcaataaactctttggaccgccggtcagcgtacatccattgccgatccatctacatgagtcaaaaaaaaccgtacacaaataattattcttacaataatgacagtcatacaataattataagatatctttattcatacaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacatacaactaaattttggagacaaaaaaagtgtgcaaaacataggtgcaaatgtagtatgacaaaaaaaacattggaggatgaagttgcaaaccttttaggcacctccgatttgcatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagccccggttggtaataccaaccgggactaagatctttagccccggttggtaataccaaccgggactaaagttacgatctttagtcccggttggtaataccaaccattaccaaccgggactaaagatcctagaggggcctgacatgccctgacagcattcgaaccgggactaaagatgatccttagtcccggttggtgtgttaccaaccaggactaaagatcaaatatgcccgttacccttttgaaccgggactaaagatcatctttagccccggtttttattgcatccgggactattgtggaaatcgggcgaccgacgaaagatggtttctccaccagtgattatatgcatatctagattgtatattctaatcgtctagtgttgatgtgtttgtacttcatatatgcatatggttctaggcgacaaagtctaactacaatggattacgcaactgcatgtaaacatatatattactaatgtcaaagagaaaatagccaaaatattcaatgattgaagtgtgactccaagagcaatgaacccgggcttgtttgatcaactatttttcacttactaattcgaggaggacgcaatcaacttatgaaagttattttaagagcttgctctcgtctaataaacgaagatagttatgttttggagcctatatataatatcggaatatgtatatatgtagtgttgcatgcgtacggtctagccgtctaggcggctaggcctacaccagtacgtacaacacggcagtcaaacaagcatattatagtcccgataataaaatactactccttccatctgatgaagatttcatttttcagttttcgaaatgaatcttcgtcttatttaaaaaatttctatgattagtactttaattgtcataaataatattttacgcgcgactaatttgtttaaaaaattcaaatatgacgaacggtcaaacgagtactactggagagatgcacatctctcccggtttgtaaccccctttatttctaggtaacgaactgtgagaaagaatctgggaataaagatcgtcatctttagtcccggttaaaatacctagtactaaagatgaatccttagtccctgttggagtcaccaaccgggagtaaaaataaaagcaccacatggagctttctctttctcttttctttttttatttttttttgcttctttcatattgatttcgcaccgaactcaacaacaaattcatccacagacaaaatcattcaacatcacagattcatttgcaacttcatagaaacatctaaaaatcatccataaatttacatcacaaaatcaaccacaaattcacaaaaacatctaaaaatcactcacaaatttacatcacagaattatctccaaaatcatcccagaatcatcacaaagtcatcgcctccggattgcccgccgcttgccacctctcctctgtgtacgccgcctgcggccgcctcccatccgcgccacctccaccgccgcgcggggccgccgcccgctcccgcgcgcaggccgccgcctccctccgccgccgctagccatggccggcacgctgccgccagccacagccatgagcgcctgccgccgctcaccccgccgggcacggccccgccgccgctggccgcctgcctgccatcgtcggccgccaaaattattatttattttcattggaccagattttgttctgttcataaaaatatttttattttgtatagattgtaaatggcttaaaaataataattataattttcactggttacctaggaaaagtatttagtacaaatataaaaaaatataataatgataataacaatataggaccaaacataatattattcggaattaaataaaactgtacttaatcataaaattatattttatttcaaattggaaaaattttatctaggatttgaatatcttggacaattataagcctttcaaaatttaaaaatcatatatacacaagggctccaaaactattttagatttttacaattatgaaattagttcaacaaattatagcacaattcttagtttactattagagtatttaggaactaaataaatcttaactataatcaataatacttatttgtttaacaaaagatgacaaatgcaatttttatttgccaatatatttttttgtgcttgtataaaaattttattacgaaatctccaagattgaataaggattttttttatgaaattgtttaaaatagtttaataaggtgccgcctacgaagatgaattttgcagccggacgatataacgcgccgcctgtaaaattgcatcttcgcaggcggatgacctagtccgcgcgggaaggccgatttcggccgtttgcaaaaatatttctagtagtataaaattgagtaagatatatatagaattcaggaaatgaattagtagccatcaagactcatactcatcaactaatggtgcacttatcatattaataaggcatggatgatattattaaactcccacttctttgttgtcgaattaagccaggaaacacattcccgtccgtacatctgcagttagaagtaaaaaattacaaaaatctggccagttatttcattttaaagtgtcaagttgatgaaattaactactcaggttttggtaattttagccagcgtatgtgttgatcttatgagcctaacgtaaaaacaaggtaattaagtaccgtataattaattaggtattaactatttgttagtgcactaattaaaatagtatgccatgcgtggctttatatgtaattatgtatacgtgagttatatttgtgattccgtaataccgtccaatggcgtaagcaatgatgaatatatgcattagataatcaagtacatacagtacaatatatgtaagatacagatggtggcaatataatatatatgcagcaatttttgttatattctactctctagaatatatccgaaatttggctggcctaccatacatgcacgcacatcactaattcattaatcttcaaaagtctccaacaaaaagaacttaaaattatcaaattaagcttgtttgtatttatattctgcgtgcaagtacggcaaggccggtgcaaggaaagcgatgtgatattgtacggtacgagtacgacatcagtgacagcataaccgagatgttatgtttctgatgaatgttcgaaagaaaataaaaatagtcaagttgcaccgatcgatttcaacaaataccaatatttttgtttgtatcagttttactcaactatcaaccgaggtttgttataatatattttggaatacatatatagcatccacatatatctatgcatacccctttaaaataccctaatagtgatgatgaaagataaatccgccactacccaccactatcgatcatatggatacttaaacatatggatacctaagtagtgtgataggtgaacttttaacccttccaaccacaaaccatcaaacaaggaaagtttattttataccactgtaaaaaatgatggcaagcctatagagttgaagctcttatccaccatttctccttagttcagtgatattaaatttcccctactttcatgtgtcaaataagaacgatatcttcgcacaatggcagggagctgaaaggctttcgttccagcctacatccgaattcatgta

SEQ ID NO: 62891 - DNA, 24610 bp, Oryza sativa
  unsure (1)..(24610): unsure at all n locations
cgctcggatcatcctgaccgagtggtccacccggggcggtaccccctggtactagaccctgtaggttcgcaacgtcaagcttcgcagatccctcatcgatggtggcagtgcctcagcatccttttcgccaagactctggacaacatgcagatccctcgcacggaattaaaaccgagtaatgcgccctttcacggagtcatcccagggctatctgctacaccacttggccagatcactcttccggttactttcggcactcgggagaacttccgcacagaaaacgtttgttttgaagttgctgatttcgagacagcgtctcatgccatactcggacgcccggcgttagccaagtttatggctgtcccgcactatacctacatgatgatgaagatgcctggtcctcgaggagtcatatccctgcggagcgacattaaataagccgtcacatgcgacaaggaaagctgcaagatggcccagacccgcgagatcaccctcgctcgagaagaaatccgactggctgcgtccacagcaagcgaaggagaagtgcctgcaaccaaggtgccaaagagcggagaaagcgacgccaagaccaagaaaattcctctagatccctctgatcctactaagactgctgtaataggcgctgagttagattgtaaataggaaagcgcgctcatcacctttcttcaaaataataaagatatctttgcgtggaaaccatctgatatgccaggtattcccagagaggtgattgagcactctttacatgttaaggaagacgctaaacctatcaagcaacaactccaccgtttcgcacaggataggaaggatgcgatcaaggaagaattgactaagctgttagcagcgggcttcatcaaagaagtccttcatcccgactggctggctaacccagtcctggttcggaagaagacggggcaatggcgcatgtgtgtcgattataccgacctcaacaagtctagtcccaaagacccttttgggttacctcgcattgaccaggtagttgactcaacggccggctgcgagctactcagtttttttggattgctactcaggatatcatcagatccgactaaaagaatcctactgcttgaagacttcattcattacgcccttcggggcctactgctacatcaccatgccctttggattaaagaacgcaggagcaacttatcaacgcatgatccagagatgtttttcaactcagatcggccgcaatgatgaagcttatgtggatgatgtaatcgtgaagaccaaacagaaggatgatttgatcgcggatctagaagagacctttgcaagcatccgcgccttcaggatgaaactaaaccctaaaaagtgcatcttcggagtaccgtcagggaagctgcttggatttatggtgtcccatagaggcatacaagccaacccggagaaaatcaacgccatcctcaacatgaaaccgccgagctcacaaaaagatgtccaaaagctgactggttgcatggcggcgcttagcaagtttgtttcgcgactcgacgagcgggggatgccctttttcaagctgttgaagaagacagancaatttcagtggggactcgaagcacataaagcctttgaagacttaaaaaaacttttcactactccaccagtcctagcttcaccacatccgcaagagccgctgttgttatacatgtcggcaacttcccaggttgtaagcacagtcctggtgttgagcgtgaagaagaaggccatgttcaaaaagtccaacgaccaatctacttcgttagcgaggttttggctaattccaagacaagatatcctcgggttcagaagctattatatggtgttttaattaccgtccggaaattatctcactacttctaaggtcactcggtcacggtggtcacatcgtttccactcggggatatacttcataatcgcgaagcaaatggatgaatcgcaaagtgggccttagaattgatgtctttagatatatccttcaagccgcgaacttcgatcaagtcccaagctttagccgaatttgtcgccgagtggactgagtgccaagaagacatgcccgaggagaagatggagtattggaccatgcattttgacaggtcgaagaggctttcaggcactggagccggggttgttttaatctccccgactggagaaaagattgagctacgtattgtggatacatttttccgcgtcccataacgtggcagaatatgagtcgctgcttcacggattaaggatcgcgatctccttgggcattcggcgtctgatagttcgtggagattctcagttggttgttgatcaagtcatgaaagagtggtcctgccttgatgataacatgaccgcttatcggcaggaggtacgtaagttggaagacaaattcgatagacttgaactcactcatgttcttcggcacaataacgaggcagccgacagactggctaattttggttcaaaacgagaagtagctccttccgacgtgttcgttgaacatctttacgaaccaaccgtgccaaggaaagaaacaattgaagccacggatactcaagacgtaagtatgattgaagccgactagagagagcccctcataagatttctgatcaaacaagaactcccccaagataaagatgaagccgagcggatttccaggcgcagcaaactctatgttattcatgagaccgagttgtacaagaaaagtccatcaggaatcctgcaacgctgtgtgtctttggaggagggaaggcaattgctaaaagatatacattcaggcatctgtggtaatcacgctgctgcacgaaccatcgttggcaaggcttatcggcagggttttttctagcccacagctgtgtccgacactgacaaaattgtgtgaacatgtgagggttgtcaatttttcgcccgacaaactcatttaccagctcaggagttgcaaaccatcctgttgtcttggccgtttgcggtttgggggcttgacatggtcggcccattcaaaaaggcagtcggtggttatactcacctctttgtggctgttgacaaattttccaagtggattgaagctaaaccggtcattacaatcatggcagacaaggctagagatttcttcatcaacattgtgcaccggtttggggtacctaatcgtatcatcactgataatggcacttaattcaccggcggagtatttaaagacttttgtgaagacttcggcattaaaatttgttatgcctccgtagcgcaccccatgagcaatggacaggtcgaacgtgccaatggtatggtacttcaaggaataaaagcgcgagttttcgaccgactgcatccttatgccggcaagtgggtagaacagctgtcgtccgtactttggtccctgcgcaccactcccagtcgagctacgggccagtcgccgtttttcctagtctatggagcagaagcaatgtttccgagtgaggtggaatttgaatctctacgatttcgcaacttcagcgaggagcgctacggagaagaccgagtagatgatatcaaccgactggaagaggcccgtgaagcagccttaattcagtcggctcggtacttgcaaggggtgcgtcattatcacaatcgcaatgttcgctcacgagcttttttagtcggcgacctagttctgagaaaaattcaaactacacgggatcggcacaagttatctcccttgtgggaaggaccgttcataatttctgaagtcactcggccaggttcttatcgactcaagcgtgaggacggtactcatatcgacaactcttggaatattgaacatcttcgtcgtttttatgcttaggcattacttttgtatcttcagctttgactgctaacatcaagcttttccttgagttatcagtcgggggctactataataataatggagtgtgacttttatcaattcaatttgcttacttgatttatcattgccttgtttgattttttggcttagtcaatgaggactgaaagttttttaacaacttttgtgggttttaggctcaaaaaggtttgacaaaaacttttaagaaatcgggagctaagtttgaaatatcaagcacaacataaattcatcagtattgtacaaattgtgcctccatcatcatcatcatcatcagaatcactgttacagtataatatcaatcagtatcagttttctcatcatcggaattattagatccagtcggccggaggtcgttgtcctggaatctctcaactacatcaatggctatcttgtcggcggctttctacgcatcgttgatgaggtcaagggcggcttcttcgctcgtcccgtctgcaaatccatcaatggtgtcaacatcaatcttcggttataaagacttggtcattgccaacgccaggcttgctcccatacttccggcctctttgatattcttaaagtatgtatccggagcgattctcagcttgtcgaagatttcggaagcatcaaatgtactcggaccattgttattgaagaacatggcttggacgagtggggtagcagcgttggcgacttcatccctagccccttcaagccttttgattttattgaccaagacatcgaattgagcctgagacttgattttgcgatctgcgtaaatagatttatatcaacgagtaggcataaagataagaggtattagtcaccagtaccttcaacatctttcagagccgaatccctctgtttcgccaatttggccttgtcattctccagagtttggatccgcttttctagttcagatatcttggcggcttgcactgtattgcttcttgattaattgatattacaaggatggcagcataagtaagttagacatagattgtatttaccttttgacgaaccgctcagttcaaagttggattcttgaagctcggcgatccgatccctcagatcatgctcagttttcctggcaagctccttagccttgtgcagctggtttctggtggtctcaagggttccaagatgaggaactaaattctcaagagtcgcggtcttcgcctcgttcctgagatggattctctgcaatgcgaatttatcggcatttgagcaaagtgggaaacaggatagttgaagctatgtataaggagacttatatttacgatgcgagtagcctggctgagtgcctttttcagcaagcatacttcctcatcttccttttgcttgtttatcacgattccctaaggttgcatatcatcgtcccaccatttgactaaaataggtggacgagaatcctcagctgactgtatccggaggacttcttcttcgtcgccgaccattgggccttaggcatttatgaataaaggtgaaacaattgaagaaagtctgtcagatcaaaatgggttcggaggatgtgtttacttgtgattatttccggtcggggacgagtaggcccttgtaatttaacaagagagccggaccctagatcgacgctggcatcctttttaggagggctgtcagcttgagtttctacttcaggaatatctttgtttggttctgtacccgactggtttccagtcgggggctcctgattagcaccaaccccagtttcggccgactggttcccagtcgggggctcgttgctgggttctacattgtcggtcgccggttgattgtcactcgggtgatcttctgcagtcgggtgatcttcttttgaagaacccgtctccatgtcagtcggttcagagtcttttccagaaagatctatgtcagatggcttcctacgagtttgagttatgctatcagtacaaatcggagcgtcgtttcgtcttccccgccgagactctcgccactttccccatttcccgctacagtgcaaaaccacaccggcggaagctagggttaacaaatccactccaatccatcctcctgagctccacaaaaaccctccacgcaaccaccgcaccgaatccccatccatttccagccatatctcggaccaaatcacaccatccagttcgtattcatgacggaagagagagaaagcttcgagagtcagtgggcgccctccgatgtaacagaggagaatttgaaagagatggtggcgcacggcgttcttctggcgaaggagatcattggatggcgtccagcattcggcgaagcattcccgacccccgacacacatgaagtcgtggtattttctcatttcttctatggcggattttctcttccaacctcgagattcttccgggggatttttgatttctatgggattagtttgcatcacttaaacccgaactccatagttcacatcgccaacttcatacacgcctgcgaagcttttttggacgtcaggccacattttgccttattccgtcgcatcttcttcctcaagccccaaccaaacaagagtaaaccatgcgtagttgggggggctggatttcaattgaggggaactctgagccaaaagtatttctccatgcccttcaaaacctcaaacaaaggctggcatgcaaattggttctatgtacaaaaccccgagcctgcactccccgagtactcctgtctccctccagtttatcaggactcttggaactcacttccaatgggagaggaagccgctcaggcgcttgccctgatggaccgtatgctgaagctgaaggagcaaggtctgcaaggagaacagatcacccggcattttatcaagagccggctagctccaattaaagagagatcctgtacagccttcaaatttgatggcaaacatgacaccaaccgtgaagatcctgaatctcttgaattcaaggttatgaaggaaagaatgtataaaatcttctcgaatgcaattgtagttagttattcgcacttgctgccagtggtgccatacaacgccttcaatccttctccaccggtatgtattcaaacatttcagcctttctcaaaagcatgcctttatctgctgttaagctaattgaaaactcgaaatgttatacccaggaattcgctttgatgaagtcggatcctccaattgctcaacgccgatcaccccgctggcgaactggtcaggcgagtggaggaccaaaaattcagtctgacactcaaacaaacacctcgaaatcaaccagtcagtcggactcccgcaagaggaaattggttctgagtgatgatgaaggcgataatgctagaaaatctggcaataaagaggtgaccgggaaacaaccaaggcaaaccaatccgaagaagaaaacatccagtcgtcccatgccgatttggtccgagatatggctggaaatggatggggattcggtgcggtggttgcgtggagggtttttgtggagctcaggaggatggattggagtggatttgttaacccttgcttccgccggtgtgcttgcttctgccggtggtggtttgcactgtagcgggaaatggggaaagtggcgagagtctcggcggggaagacgaaacgacgctccgattttggcgtttatttcgctagggtatcgggagtactaatgggcctaggcctaaacagtacttcagcccagttttgctatcagcgtgattaagttgtgatccatagggacttaggcatttgtttttgtttcgtcaacacttgctcacaacagtatagcccaatgctgttaaaatcctttttgacgcagttagataattctttggaattactacgatgcaaataaaaaggtgcataacataaaagtgttatactaattttgtaggcctttttaggctgcaaagattgtttgggttttcttgagatgactggttttaatacagtcatccactcggcatgttatatgcttattttgattatgtcatgagtcatagcctaggctatttagactcgtcttttatcagattttatgccacatttgataggtcttttgagagtttttactcggacttttatcatctgtgctgatttatgaacctttggagtgcttctcacttgggtttttctttatatttctttggcacattaaagcagtcggcggaggtttaccagatgctgcatatgcttggccttgagatatttatcctggaatcctttaaagggtgtcgaaggcatattttttggcctacgcctaatatgtctgcagcccatattttcaggtgtggcctatcacgttcttttagggacttaagcactttttgcttatgccaaagtgcgcgtgatcaagtgcccaataccttaaattcttttataccgcagttactcaactttttaggagttggtacaatgcatcttaaaaggtgtcaaacagtaaagctttacatagctggcctactgacttttttatatagtcaaggtgctgtttgggtttataaagcagttgattggatataatatcattgctttttgccacgtaagtgtgcatttttattaactaatattatggctttggctgattatatattgtggtcattttccaggcggttggtaaatcgtttacgagtttatttactcggatgttacaccacatatgccatatattttcaggtgtggtgaaatcatgtgtcttttagggacttaagcacatctgttaaagaagtgtgctcatggtgtatgcccaatactttggaaatttctttattcacaacatcaagctcttctttatagctgttttgctatgtgaatttccaaaaatgttgtcaactttaggttgcacgcatcatattctgcaaagcagtcggtatatcacttggatcatattatttgggggattcacactgcatatgctatatattgatatcaagtcacttggttgataacaattatcaaaaaccactcggttggttggattatttattccttgactatatgcttagtttgttcaactaaccatatagtcgagggctacacctaattaggtgcatctagtcgatgcacctgattttttctatttttcagcccttcacagtctttgattatattactcgggagatcaaaacagatgaagctaaagcactcggattgtcttttcggattatgagagaagattattccgtcgactgtaaaggtctcaggggctactgtggagattatggataccccattcctacacggcatgtatatccgactgggtatggggtgtcatgtatagatagaatatctttaaaaggactcgggttaattaccaaacttgtatgtcaaggaaatacccgggatcctagtcggttacgattgtattttatctgtaattacctattccgttagggatatggtttgtactttgtaatacggaccccttcccctatataaggaggggtccgggtgcctctaggggcacgattttctcccagatcatacgatcaataatacactcggcggatcaatccccggacaggagtagggtattacttcttgattaagaaggcctgaacctgtataaaatcccttgtctctgaacccatccacttttctagcttgatagccacccccttttagtattgccaaaatcttgtttcgacaaaaaggtaaagcttgttatagcggcttgcgttctcgggattagtgcttacatcttcatgacactctaatcctgtttatataaatcgtcgagttatcatatatgctatgtaatctaggtcgatcttgctacctaacctcagcggctagcctctatcatcgaaaacagtcgacatggttagatactgacttcgaattagattacatagtgcatctaccatcttcaaaaggttgccatcgacttgtttaaattttatgcttctttctatgtttaatgttgtatcagttaagtttgatccattaaagcattacctggaatcgtaatatctagcttgtttcatgactgctactagagatactattggggtttcagccgatcttgcctgatttagttgtctcgttacttatatgcttactcgacatactgaatctaccctttatattaagatctcttttgaatgaaatatattaaatttgttggtttattctaatgagtaacgagtggtatcggagtattagtcgatacgcattagatttaccctatcagctatgctatgaatatgtataatctttactccaaagcacttttaagcgcaagtaatttatactgtctcggcacactgcccgatctatcccaatcgcttagcttaaatatattcttgaaatatagattatatatcattgatatctacagccgatcgagtggatctaactcttttctcgttacttacttcattgccgatctgacctgcgttacatcggcttggtgctaaatgatatgtcatcggcagtccagccgatcggctatcgtttatggatttaactttggattctttgtttcttgttggttgcaggatcaaactaactagcacgccctgaacctgaaggcaaatctttggacctgcactagagtaaagcaaacctcgccagtgtgtgtttttcacatcaacaccttccaatccttgtacacatgtatgattagcaggaggttcattttatcgcatgtcgggtgcatttttatccgtaaatggcctgcatacgtatatttaccaaaactagtggaaggggcagtgatgtcgacgcataatgggcgtagctgccaacatgaatttgccgcgttgaacgacggacttgacgcatgcattgcgaacggcacgggtgcagccgcaactacaagccatagctcctttcctttcttcttcttcttcttcttcttccttctttcttctttcttccttctttcttttcttctctctccctccatggctgatgccaaaaagtggctcggtcggccaatgacagcgtgacgaccgatggctcgatgcacgaaggtgcactcgaccatgatgggatgagctcgcacgggcttgtgtctcgcgaacgacgaggccacaagacgagcgtggaggccgactgctagtgcgtgatggcttgctcttttgcctgtccctgtctggaacgatacgacacatcttgtgtggagataccccaatcggcttgcgccggcgactccaagtcgacagttgcggtgttcaccaggaacggcaaaaacaaaacgggatggagagagtatttcattttcgtaattagatcagcgaatgcaaaacggatctacgagttgtcatccttctatgtgaattagaaaaatgtgacggtgatgtcatagatctaattttacaaaatttcagtggcacccagccaatatcacgaatagtagtggtatttttctaatatagaaaatttacgatgatatggatccaatctatactttttataaagttaaagttatagtccactaagttcaacatgctaccacgccacatcattacccactaccaaaaattacatattcaacctcatgcaaatatacaacatcatttacaatttatttaattctacaaatcaacatgcaatcatatccagttatcacctctcacaaatctatctatcatttttatagtattaaacatatagttatcaatatgtttcacattaaaacgcaggtatcatctgtttgttttatgataagtactgataaactctgatgttttattattttttttcttttacttttagcttaattgtcgaaaaaaatattgagaaatacttagtaattttcgtggcaaaacgtgagaaatcatacagttaacccatccaaacagtccgtaaagcccgtaagaaaaatggcatatgagaatacacattcggggaggatatggcacagggttttaaaagaaaaaccatcaaattaactcaactcgccccaaattttcgaggggagattttttttttcctttttaacgtttttacacctcatcatcatcaggcctttcccttccctttctcctttctcgttgtgtgggttctttctaggccctaggacaagccaagaagcggcggaggggaagggaggaagagggcaccagccgcaccggccggcggaatggcggcgccgcccaaggcctggaaggcggagtacgccaagtccgggcggtcctcgtgcaagtcgtgcaggtcccccatcgggaaggaccagctccggctcggcaagatggtccaagccacgcagttcgacggattaatgcccgtccgtatcctttccctccacccgctcttctcgccgacgatctttctccgttcagttgatgaatcttgctttgatctttagggtctgggagggtagggttttggtgtggcaggcattttttcttgggggttttttgtaagttggggtggattctgagaattttctggattgatgggtgatcggttttcatcctgatttgcattgcgggtgtgggtcttgtggtcatctgccacaagaatcttctgctttcatgggtggttgggtttcatcttgatgtgcattgctaatgtgggttttgcggacatttgccataagaatcttctgctttggtgggtggttggttttaaatcttgatgcccgaacaaaatatgtttctgagggtaatttcgcatgattttgtggggtatgatcgaaccaatcttcttcgaatgcggagttcttgatgcatttggnttggtgctctgtcgatttgtcgatgatccgtcaattccagcattgggtttattgctgtttctaatccattatgccatctatatgtgtaacgcaagactagatagaggtgcttttgtgggcaccaactttgacatatgcaatttaactggtatttctcctaagttgtttgatatattaattattatgcggacctgccaattggttgtgctgttttaggcttttagcatggcaatggggcataccaatgacaatgttagtaatctagtgtgttcgctaatctgtttttgttcttatctgatgtgtagtttgcaaattataatctaggtattcgtttgcccgctttattttctagtttgcctcttgtaattgttttgtgggtgcatgtgtattataagtgcttacctgtattaggcaagataaaacttggaggggagtccttattctatttttcattttttatattgcacatttggataatgaatctttatttcttttggtcggatcaactcagtactcatgtggttatgtggactagacactcaaattatttcactgggaaatgtaggatcgtttagggcaacttagggggtacttttggatctgcatgccatttttcacctgaccatatctttttattttctgtgatggcccttattttttacctgaccatgttctttaatatggagtgtttataacgttgtaccttttctatgtttatagtaattgttttattcaagaactataactgtttggaacttttttttggtcatggtagattctcgatggtgcagaagagaaaactcgatggttatatgacatatctttccatatcaattttacgaattgaccacttccaattaattttagtgcccttttctctttttcagatgtggaaccatgccagttgcatcctcagtaagaaaaaccagataaaatcgtatgcaactttatcttttactgtttgcatgagtttcacgctatagtattatggtttattaatctttattgcatctattggaaatctgacctaactcaaagtgtcgattcttcatttcaaattagtgttgatgatgttgaaggaatagacacactcagatgggatgaccaagagaagataagaaattatgttggaagtgcaccagctactgcaagttctgcagctgctatttcagataaatgcaccattgaggttgctaaatctgcccgtacttcctgtagacggtgtggtgaaaagataaaaaagggaacggtctgtatcttttgatctattaattttttatatgctttctaattcgtcccttgaggataggaagttttatgccatgaaaattttatgtttgtactttgttgcttttcaaattatagtcatgaaaataacctcctcttgatgattaacaccttacagtcttatatgagcattcagctaacaatcatagataatcagaagtttcacattcttgaatgaaccttgatgcagcatgtaagaataattaatcataacatgtttcctattccttatagttactccctgggaaaaatactgtattgtccaaaattctgcatgttactttgttgttctatactttatttatttagaacatgaactttagcgctcactaaggatgaaatggatacccgacttggtcctagcacttgaacacttgtagctggggaggttaaatagcttccctaccactatgccattggcatgttcttttattttctgaacttgcatctgggaaatgtatggttctgatacgcagggacaccataggttcttttctgtaccctattccctgtggcctgcatcatgttgcatataatgcccaagcttttgcactggaattccaagtgaccagaaagcctaaaggccacagtttcccatttattttgtagttactctgctacgtgccactagcaagcattagaactctgaattttgtgttaagtttactttatcaaatgaagtaacctgcaaatgtattaattggaagagtatttattatgttcatatttcttattcatccacactcctagttgagtactcctaatgaattacaataattaccgtggagaattatatacaggaaaatgtttgatgatccagaagtactattagtcatgcacttagctaataatgtatgttttgaaaacatatgaattgtaactgtgatatggcaacttgtaatgtaaaaacatggtctttgtcttcactctaagttgtttctgtaatagtattattatttgtttgtctaggttcgtgtttcatctaagcttgaagggcaaggttggtatcacgccagctgttctctggagatgtccccagctgcaactgttgagaatttctcaggctgggagatcctgtcgcatgaggataaaagagctgttcttgatcttgttaagaaagatgcccccagctcaggtaatgaaacatgggcatcaaattttcttcgcgccacttcgtaatctgacttgatattttgtattgttgtttctcaagggcaaacatcttctaagggttccaagcgcaagaataatcagaatgatatacacgactgcaaagctcccaagataatcaggagtatatcagaaggcacagcagaagataaagggaaagctgttgtatcacatgattccaatgctaattcttctgatcttcaagaaaagcttaaagagcagagtgacacactttggaaattgaaggatgaacttaagaagcatgtgtcaactgctgaactaaggaacatgctcgaagcaaatgggcaggatacatctgggccagagcggcatctattagaccgttggtaatattgcatgctatttgtgaaatggtttttaacttcctggcttcctgcactacattatttccatccaatgagtaattgatatttaaacaaactgcactacaaggatcccgcatataaatatatccttggccagttggccgatgctacttgatagaggagggtacgattataactgatgatgaatggtactagtgtacgaaatttgtcaggatagttgttccccaagaccccaattggtcatctatgtaattttttgtcgctagatttattttctgcttgctttctggatcccaaatcccagttgtaacatcctggttatagggtttgtgatactgatcgcttagtggaattcagaattgtcaccgtaacctaatgattgcacactatttgctttggttcttttgtaatctggttcatgtatacaattattatttccttaaaagtggctataccttttctttctaaaaaacacattttaaaaatttgatgtgtgcagagaaatttcaaagtcaggcagcacttaagatatttgttttcaggcaaaaattgttcaatagtatttaggtctgaattttttatgtataattcaagggagacaaacattattgattgcataataagctttacaatattgttggttgcgtagacctgctttgggcatttcctttgttcatctcacatagaagtcagtacacttcgtcgctaactttcttcctcgtctggcagtgctgatgggatgctttttggagcattgggtacttgcccagtttgttctagcttcctatactatcatgggggccagtatcattgcagtggctatgtgtcaaaatggtccaagtgtacatactctacgacagaacccgtgcgcagtaaaaagaaatggaaaattcctgacgaaatggataatggttatcttacaaaggtatgactatggctccccacccccacccccacccccacccaaacccaaaagaatatcgttcttaatgcttggtttctacagttgaggtaagcaaatatgtatgtatcttgcagtggttcaagtctcaaaaggctaagaaaccagagagagttcttccgccaatgtcacctgagaaatcattgtgccaatcaacccagcaaaaccgatctttccttagtgaaggactggataaattgagagtttctatagtaggacaatctaaagatgtggttgtaagtgatcttttactttttggtacagttatcctcaggttctcttgtgagttgtgttcgttaaagcaagcaccaattatgccatgaccttgctgcatgttgtggcatgcaccagacgccctttattttttccaatcacagttactttgcttacattgttatccagattgattcttaccatattatacagattatatatattatgcatatttgttgtgtggcttgttgacatgaaattggaaagtgctcaactgtacatgcttcatatatttgtttgtttaagtcaattccttgaagatagctagtttagtttgttaatttattccttgagttcctcgattatttctttaatctccaaaaattttaatccatggaatatgcagagtgaccacatttagattgcagagcaaaggttaggagagtgtaggttttttccctatgtacttgattcagttcatgttaaattcatgtcatttgttgaataatagatcaaattttatatgatctagcatgctgcttttgcatcaagtggtaagatagatttgcaattatttgcatgggatactgttttcttttattttttcttctctgctgatcagttattgggctatacatttttctttttcttgttttttggtttgtactttgtacattcctctaaactaatcatgtaatccaactactgtaggatggatggaaacagaagctgaaagatgctggtgccaactttaatgccacagttaccaaaggtttttcctcgtgttatcttttttttttctgaactacacaggatttcctcgtgttatccagaactggaactatcttgttcagacatttgaacctttcatatttggttacgtatgacattggaacctatatcttcacccaagtgggtgagcagtttgacaccaccccatgaccaaaagccaccactcaaattcctaaaattggctggctctcacgtatgtgtaattttagactaatacatgacacttaatctaactgatgttttgaaagtataagtaaaatgcattgtctaactcatgattttttatgggagagatggattatggatcacttatgtgcaggtgataattttatgttatctatctgactgtctctatttctgtaagaacatatgggcattgagccagtatttttgtgcagctgatataatgaactgagtcatgtgacttggtcattgtttcataggttaggtaagctcttagtgtttggtgaaatcttttcgcattattttcacatggaagtcttgcactgcagacagcagctgcttagttttatgtagtgagcttgagagtgagaatgctgaagtcaagaaagcaaggtatcacattttactttgcccttatccttttacacttacagtttgacctattgttttgcgaactactgtgttacctattgttttgcgaactactgtgttaaaataccattatatatgctacttcatttcaggaggttgaagataccaattctgcgagaaggttaccttggagaatgcattagaaaaaacagagtgcttccatttgatttgtataaagtagaagctgcattggaatcttcgaaaggaggcacaatgactgttaaagttaaagggcgaagtgctgttcatgagtcctctggtttgcaagatacaggtcatattcttgaagatggaaaaagcatatacaatacaaccctgaacatgtctgacctgacacgaggtgtgaacaggcaaggattttgctcacagcatttcttgtcaaattcaggatttgcacttttaggagtgattgtcaaggcatatttcatatgagtgatatggataaaccgataaaccctccagcaattttagtcaccaaacaaagaacgtggattgcttctcaaatccaacttcccggtcttcccttgaactaacagaatgatataatgctaaatttcccatggttgttaagttataatgttgagtcaagtgcaaccatataaaatagcatgaacattttggaagtactttggtctggtttggtttggtttggttttcattacatatgcccctgaagtcatagccctcgtctcttgttcaagcccaacttagctttggttgtcaatcattccacgatgtctcgtatacatatatgaatcacccgatctagaatgtcttatttactgccattctgcaataaaaaatgttggagcttgcacaaatttctgtttcctttcctctcaatttatgttcgggagcataacacactgttgaaatgagggggaacttttcttctgtagtattaccagttgctaaatttctgttaggttattgcaaataatggtgaccctgcttgccctacttaatcttttaacagttctctctctctctctttttggctgggaagctattatatacttcaggtcattgaagaggataatgggtctgattgttatgtattccgaaagtggggacgagttgggaatgaaaaaattggaggcactaagttggaggagatgtcgaaaattcatgctattcaggaatttagaagattgtttcttgagaagactggaaacccctgggaagcatgggaacaaaaaacaaatttccaaaagcagcctgggaaattttatccacttgacattgtatgttgtgggataatgtttttacctgctggatttttttcccctttttagtggatcatgtggattcaatctgatgtgtttaatatattgcaggactatggtgtaaggcaaggaccaaagcggaaagacattgacaaaatgaaaagttcacttcctccccagttgctggagctcatgaatatgcttttcaatattgaaacatacaggtgcgattttactgttctattttcaggttttgcatgtgcacatgctttgtttttagtattagaaaagaatttcacattattttgtaccagggctgctatgctggaattcaaaattaacatgtctgagatgcccctgggtaaactaagcaaggaaaatatccaaaaaggtgtgatactttgctcattgtggaactcattttgttgatctgtaagtccaaacatatcatgattctcttgcctgcactgcatgcaggttttgaagcattaactgagatacagaatctattgggtaacactaataatcaagaactggcggttagagagagcttgatcgttgccgcgagcaatcgtttcttcacccttattccttctattcatcctcacattatacaagatgaggatgatttgatggtgaaagtatgtgttcattaccttgtgttatattcctgtatattgggaagatattccatgactattcttattttttaaaatcacgacagttttaagtgaaatattttgctataaaaccttccttttgcaaaagaataaaggcgttctatgatcattgctgaaattgaaatgggtccattccacgcacagatcgtacatgacttgtaatgatatcttggcagttaggcatgttccataatgctcaaatggaatcgaaggaacacaaaaattgttatttattttgtcatatataaatttggcttccagtaaactatgttattgaagtaaaaaaatgtattttcgcactactttcatttatggttcaagttctcaatgactctcattttgctatctagttggaacattttagaggatgttataataaaaaactaacatacctatggcatttttccttttcttttcctttggttcttcacatgttctccttgccattagatacagtgctgttcttaaatgcaatgatatctcctgcatattcaaggaaaaatgtgttataactgtccaccgtttaaagggctgttttggttcttgtgttattttcattcttattttctttgactgatcagatgtatttcttattgccaattgtaactttattcagagacccaattgactgtaactttggtgcaatggtgcaggtgaaaatgcttgaagctctgcaagatattgaaattgcttctaaacttgttggcttcgatagtgacaatgatgagtctcttgatgacaagtacaagaaacttcgatgtgccattacgccactccctcatgattgtgaagattacaagctagttgagaagtatcttcttaacactcatgctcctacccacaaggcatgtattttcttctgtatacaaaaaccttatagttttttttttctcttttgtagatagtacaatacagacgattgtttctgttttcttctgtataggtattgacatgtcctctttttaaatcttttttgaaggagtggtcactggaattagaggaagtcttttcgcttgatcgagatggagaattcagcaagtactcaagatataagaataatctacataacaagatgttgttatggcatggtaagcaatctatccaagtaatgcaaacacatttggcttacgcaatatttgaaaaggtttttatactctcagtatttagtgccaaaatctaggtttgagatgaaacttattatccatgcgcagtctttgccatggcagtgcgtaggtgaacagagggttcacagtcaatccaacagttgtaaatgtttattttactagttcttcgtgtggtttactcgtgttgtatgttatgttgttatgtcagtatttaaaaggctactttttttgtaattgtactggagatctacttaacgtccctaagtaactctttccttcctaccatttgaatgattccatgattgcaaaacttaatttataggttcaaggttgaccaattatgttggaatacttagtcaaggactaagaatagcacctcctgaggctcccgtgacaggctatatggtttgctctttgttcacttcataaatggttcaactgtagcactggcaaaagattggttgaatttgattaagctattttcctttcaatcaacagtttgggaaaggcctctactttgcagatttagtaagcaagagtgcacaatattgttacgtggataggaagaatccagttggtttgatgcttctttccgaggttgctctaggtgacatgtatgaactgaagaaagccacggtaagatataaagcctctcactaccaaaagagaaattctggttataacattaacttgaacttctatctttgctttgaaatatgatcctgctttaaggaattgaccatggcatttctttcctgatttttttattgtgatctatatttctttgctgattcataattataagaaaaagctcaacgagttactcgagtgcaattacttgttttttttccccatgtttatcttggcttggcaccacactcactggcttactgctggctgctgcagtccatggacaaacctccaagagggaaacactcgaccaagggcttaggcaaaaccgtgccgctcgagtctgagtttgcgaaatggagggatgatgttgtggtgccatgcggaaagccagtgccagcatctatcaagacatctgagcttatgtacaatgagtatattgtctacaatacatcccaggttcagtcaaattgttatccatactcttttgcgcgcttctgttcatcagaagttcagttccttacctttcacgaaaccttatctctggcaggtgaagatgcagtacttgttgaaggttaggttccatcacaagaggtgactagaagacttgaggtaggagtagaaatgtagaattaatcagtggaagtatctccatcgttatcagtagtctgtggtggctacgcttttgatgtgttagaatgatttatccagtagtttcaggttggtaggaggttatgtgctgctcgcgtatgatccgttttggggtatgttgcatgggcatcgcgcgagtggcgcaagtaaatcccctgcgcatgccatgggcatttgatagatgtttgcctaattttctgtggcaatgtgcgcatttggcatctctgtttagcttgctattttatcatcactcgcgttatttgtgcgttgttgcgttttggctatctttctttgtattttgattcgaggtctatgttaggatactgcaatcgaaataaactgaacagcattagtgaatagtgccgtctgtaggatcaaagatagaggcgtgtgactgtctagcggaagtaatattcttctatcctataagtaacggttagtctagcacgacaattcgatgagcatagattgcaatagtttttccccaggtattagtgatttggtaatctccgcttgttttgtgcccttctttcactctggtttgtcgtcgtccttcacccttcgctcggggtgctcccacttcctcttagagagatcacttgacttgatagccacaaagacacgttatgaccagcatttagcctcaaagtaatatttaaccatatgatcaacaatatatagaacttatcattcttgaggtgtggccgtcatgagtttattccaatcatattattagaaaacagtaggcaccgcacgtgaggctcaggcgtccacgggaactgccgacggcgcagcaggggcatgcaggatggccttgggctcgtgctcttccttctcctcgtcctcctccgcctcggcctcatacgcgtcacgttcctggacccagagctccgcgaactcgcagttcttgtactgctcgaaccacggcccgccggaagtgtaatggatggcgcgcggcgccgtccccgccgtgtcggcggggtcgacgcggttgtgccccacgaggaagttccacacgaagggcacctcgccgatgtcggcgtcgtccagccacatgaagcggtgcaggtacgcgccgctctgcgtgctcacggcatcgggcgtcagcgcggcgcggttctttgagtgggcgcttttgaacagcnccatggacgaccagttcttgcgcgggtccaccgtttgcanggcnccgtccatcttggtggcctccttgggcgcgtagtcgtggtgcacgcacagcaccgcgtagcgcgggtcggccatgcgcgccagctccgccgcggggnaaaaccccgggtttttnccgggggcgcccggggnaancggaagagnnnaagttcgccagtcgacgaagagcgcccagccgcggtagccggccaggtggggcgtcaggaagcgggtgaaggagaactcggtgctctccgtgggcccgcgctcccgccagtacagccccgcagaccggagctcctgctgcacgatcgggatcacggccaccggcacggaggagcgctgcagcagggagcgccggcacacgcggtacgcgatgtcctcgcgcgagtcgtacccgacgaacacgcggaacgtctcagcggcctgcacgtcgccggcgccagctacagggccagtcatcacgacgtcgttggtaggcgtgaccgacatagtatttgttggtgatatataagcagaaggttagtagtactgtttgctagcttccccgcaaaaaaagaaaaaaagagtagtgtttgctagctcctggtgctacgtacgcataggccgtgcgagttatcacaaactcctccgcctttttaataagagcctaagagccctttgtcctttgagtgtggggagcgaattgaaacgaggacatgcgtatatgacgacatgtacgtcaacagcgttacgcttgcattattaggcccagggagatcgatgtccagaattatgcatatgtgtttctcttcttttgttgccaaaatcaacaaaattagataaaggaatcctatagctaaccgattgctgtgtggtccggcgccggcggatgcatggcgacactgcactgtggtgtgggcagcgcgcgggcgggaccgacgacagcgcgcgcgcggttgctaatttgtacgggtaatacgtggtcctgtcgtgtgaactaccacagcagcacggcaggaacacgcgcagctgcatgggcagttgggcactctgcctccctgcgtcgattgctccacagtcgtcgtcatgtcccgatcctaattatcacgtcaaaacagctaggcaagtgttgcttgtttttttttttagataataagtgttgcttgttgctccatcgttttcctttttcaattatatatgttattattcacattttcactcagtattttattactaccttgtagaagtttatcgagaatgcatatagtcaagg

SEQ ID NO: 62892 - DNA, 7624 bp, Oryza sativa
ggtttagtttaattaggtggttaattacagcagctagcacaggtgcatgctattgttagaaggtgtaaataggcagtataggagatggagcacaagaagaaaggttaactggtggccaaggaacgggcacgccgagagtgtgtgttaaaaggctcccttttaattacttgtggacgattttgatgcctggctagctccctctactagctgcttttaacttcgtgtgccaaatatgtttttacatcattattagacacccttaatttagccccttgcttgttttccaaatgcttaattacttaccctcttgaattaacccatcaaagtgtatgtgtgtgtgcgtgagtgaggatgaagctgtgcctactcaactattatactagtatctatagttagcatagctgttgttttctttttggtgatgaattcaagtaatatactccctttgtcggcttcatttctagtatttttcagataaattagtaatgatgagaaataactatggtgtctcttattcatactcctggttgtatttactaattaagctccaattaaatgccttagtctgattggtttgaaccctttgaaatctaagtttttttatgggatgaattttaagcaccagaaattaagtctttctagaacggagagagtagacagaatagatagagggagctaggtgacaacatgtttgccactactaatatatgtggacatggacaagagattgaaaaggatccaagtaggagtggcgagtgagtaatttgtgcgtggtaacaggtaggccaagaaagaaaagaaaccatgcaagcaagcccaatattccctgggggatgatgtgcatgtttggatgtgtgattcctggggtgatagtgtcacactgcaaggctgtcttgaaccacaggagaaaaaatactctgctttttgatctgcttctcatgacctatatatggttctttctatttctttgcttgttttaataattagtatgcctttaaatttagtaataaaaggtatatgtgaaagtccaccaaattgtttgatggttcttaataattgagatctttatttacatggagagtagtctttggcagcaattccactgatgatgaagcgctaatagacatgaacagctagttttgcttggcagttggcaactaaaattaggaggtagtgaggtagtggtggtgcagctgcagctgtctctactctccattggccacacaaaaatacctgcaatttgttgtcacttgtcaagtactcacttgcatgtatccccacatacacacagtactttgatttttcttcctttttttttcttgtgaacaaacacaattgttcacctgttctttgattgcattgcattggctaataataatagtcacttgctttttaagctaaaccaaaagctagcaaaattgacatgttctgatgcaaatggcacagctacataactagctaattaattcgattgttcttgatctctctaatctgataccctaagtagttagtggtcacaccagttttgtatgtgattttttttttcatttcttagttcactggatctcactagcttagatttggtttgggcgatactaatagttgctgctgctgtggctgcactgtctcaatcaagtaggtcgtcctcaaatttaattgccacaccctaaccactgttcccgtacaatgtatttgtacacgatgcgcgtctacttatcgcctaagaaccatacaactttcatacatacagtaaacactgacgtggcttagctgataactcaattaactacaccaaagtaattgagtagttatacaatgcatatatctaaatagcaaaccttaatttcatccaattttaatccttcaagttgaagaagctagtagtgaagacgatctttgtgttattgtgtgagatataagtcaacgagtgatcgagggaggaacgggtggtgactggttagtagctgattaatagatgattcttgacgtgatgaattgttgtttgttgtgtggggcaacaaggaacttcattagaaaaaagaaacagagtttaattagtttggagaccaatgccaattggatatgatgctgtggtgtggtgggggcaagcaaggcatcagttggaagctggtctagcttagctagatatagcttcctttctctctctaacacacttcctctctctctggatctctcaacactacacatgcatctacacttgctggtcactcacttgttctgcaatccaaactaccgaggaaattaatgatcagatcagtggctgctacctgcctttgttttctctttgccatacttaagcagtgcagaaaagataagtgcccttgagcttgccatgatcctgcccatgattggcaattagccaagttgtccctcatgtggagaaccctagctttaaggatctaattagtgcatgcaacgctagttggacaactagtacccctgaacgtgatcacttctgttaagctgaccattatttatccaaaagattaacaaatctttgtatacacacggcaagccacctatccttctcttaaaaaaaaacaaaaacttctgagagcagctcaaatgtgctgagagctgatgtcattgcctgatcaagttagcaaggtaagttaattagagagtgcatgacactcctctggataataaagctttaagcaagatttgttactaaaaccttgtgtgcttttgccctggccaaagtgcttagtagcatatttcaagtcactatatagggatctgtaccagcagtgattcgggcacacaccaatgagactgagttggggtgaattaaggaatctgcctgcctgcacagaccaaaaagaacacaaataataagtgaacagaataaaatccaggaaacacacagtggattggaatatactagaagtgatgaaatgaaatatgtggtgcagttgatggacacccaccaagcacacataccataccagccatggatcatccagctgcctgcatatattgttaagtagtagtaggatggagatgagctgcctgactgacctggctcaagtggatgatgagtgaagcagtagtgggacactcgacagtagcagcagcaccatccacaatccatgtataattagcagggggatcactggctgcaagtgactgggccaccactcatcacgtcatactcatgctactagacaagagagatccagtgagaccaccagtataaacgacgagatgatcacaaaaattaaggactgttcagatgattatcatgatggacggaaaaaagaagaagagagaaaagaggagaagaagtgtgacaataaatggagagacgagattcactccacatgacaacagctccccgaaggatcccaagcagaagcagcagctgtatcgtgctgtctgtcatgcttggagaaccgttaatcacgatgcatcatcaggttcaggcctcactgacagagtgacagacatgtcttctccaaacaaacctgcaggccctcaagtcaattactggtagttggtgttactactaagacgtactttgtggatacacatggcaattgacacttgtgcagggtagcaaggaggacataaccacacttccaacttccaagctaggatgggaataattcaatatgtggcaggatgattcttcagacttgttgagaagccattgatccataatatgcccctgctgatggaattgtatgattgccccaagttaaattagtggcgtggagtgaagggagagtcaatgcttcatcacataatagattgctgtggctgccaccttaagagtgtggcaagtgttggctttgctcatgggcaaccactcctcacacactgattggtgggcaaaccttattccgatgccatgtgctagaatcatcttttgttccgtctcaagtcatgcctcctctttgcttcctggctgatgactgcatgttgctaattaaactcaacctcacacatgtacattttctaatgatgtggtacaagtatgcaccgcccaatgctccaagaaacttaaccacctactgctgctgacggacacaagcttaattgcttcctacagatgcttctccactggtgcattaacttaagtagttaactaaaagttctccagctccatcagtttgcatcttcatccaacgaaatggacgtcgccacggtaacaaccaacaagtattgggcaaaagttaattctcactgtcctgtgagagatagggaaaagaggaaaactgagaatgagcaaagagaataacaaaatactccaatgccttgtactagctactagctctttggaaaaaaaaaatccaatgccttaataggccattggtttctgaaaatagttagtattattttggtttatttccactgttgctattaaaaatcatttataatactgtcgtttgattagtcaacattaatgtaaagctaaaaaaagctaatggccaaagctatatttcaaagaccacgaaaaatcgagaacatcaaatagaaaaaatagggagggagtaatagctaagtattatcttacataaagcaaggagaccggaaccttcaggttgctcacagccagtagtaattctccgttcagtacaactcttatccaacagtataggaaaatagattccacgaaaaagaaatgtgggtccctgataatgacttgtaatgaatgtcagataatatccgaaataaccagaccttagataatataatccctaacctttctttgccattctttttggaataataagtctggagtctgggatttggttgaatcgaccatataataataacacagtggtgcatatacagctttagcgaagataaaaaatgacctgatcccaaaagtgcatccacagattctccaagattcacacagcagtatcttatgatggagatcaaattcagattatcaccagagttaacatgcttgccgaacttgcaaggttatagttagttcggtgaccggccaaactataatgcgtctctggcaagttggccatcactcactctctttgtagctcactgctcagctgatgaacactttttgctcgcaccactgataagtaatgaagacatcaccttcatggccaatactttctgctgcaacccaagtgatgcttccaaaattagcaactttggtagctacagagtccctgtttatcgcacgcttatcagctatcacattatgctcacatttacaaatctgccactgagagtatgtactgccgtactggcacttagtttgctagctgcaaaatgcaaattgaagaaaaaactgtatctgtgaattttctttctggtaagagagtcgataccatcatgacccacccctctaagaactaacatatcagaaatgcatccctggtttcaattcaacagaaggtcatcttctaggtgcacagttgccgttctagaccattctattgccctgcaaccttttcactcatctactcatagctatcaacatatatactataaagacatcggtgtcttgaggcagaaattagaatatccacaaaggatatctaaccattttgctagccacaaaaaacacacggtgtcacatgtccacacataatcagctgagcgactagtgtcactacagagtgaagtggctctctctcctctcactccctgccactagggagctgataagtggcaaaagtagtaagtggtactagtagcagtagcaggtgtggcaccagagcagcaggagtacacgctgagggtagcaagggacaacaacaggtagcaccaatccaagcagtagtggctgtagtgaaatttggacactgtacgagcatcagcttgtggaagcgaaggaaagaaagccttttttcaggagaggctgggattgaggcatatgaatggtaccgtattcggtgtgacactagaaccagagcgttccctgagtgcgacgctgcaaccaatctcctgcactcactcaagcaacttttttgcaaggccagctgatctgcttggtccctgtgttgtgtgcatgtgaagtgtcaaagtgtgaatcagtggaatccatcttgtgcactaggtcatcacttcacttcacttcacttaacttgtggcctcataccggtctcgtgaccaccaccatccctctcctttttacaaccatccttctgcttaatttacacctgtattgtaggtaaaatcatattgtatttatttcatctctcaaagagatgatgtatttatttcaagtaagtaaacaagaaagaaggaaatatatgtgtgagcttcctaatttctacataatacgcaagcctcacccactataagccgttgcttgtctataaaaatatataaacggataagtctgggactgggatggtttggtctagtctgcctacttgtgtagtagaggattgtgctcttcaacgcaacttgctgtaccatcaactttagatatatgcctttggcttgggatggatgtgtcgtgttgagttgagttgagtggtgctgctcctctcgtcaatctgtggccgctctcaccttggcttactactactttatagtcatttcatatttttcatcctgggtactgcaggtgttttttcagaatcaatagcctctaatctgcacaacaagtttcatatactcctctgtgaatatgtcaaatgacgtctaaggtgctttcagcatctttggtcaaaatcctagggtgaagaaaggggtaatcagaagtattaattgatcaccatcttttcttccccccatttttaagataagatcacaagtccaatcatactagtagtatacgtttttgtgtgtgtgtgtgtgtgtgagagagagagagagagggagagagagagcataacgaaacttggatgcatgggcctcaaagggggaaaagagcaggcccagatttaaaagccactgtcaagaactaagcccagctcagctcgtcgatcagaagctttacaacctagaagcttttctacaggcaatcagcgatctgcatgtacggatataccctagaactagtcaactagaatgggagggaccaaggggttttgtggttcacaagtcagttactcttatctggttttaacaattatttgtgtggggtctatgtagtctgggcacaattggcattttcgcatgggcttcatctggcaagataaagaccaggtggaaacagcagagtgaacaaatattaacccacataaaaatctaaatgtcatcgaatagagcatgctgtggatcaaacatggccaaatacatggaaagctttggatgactgaatgcacagaacagatagaagtaaacatacctcctttttccttggcttggtaaatgttttgtgcaataacctgataggcacaaacaatatcaatgaagttaacttctgtgttcatatgaacttgcagcagtacatgcacaaaaattggtttgatcaccatctttaatatctcattgcttaagcagtgacctggaaaagtatcactccccctcagtatactgaccttgtattggccataaagaagtgaataaaattgttgaagtccgttcagccaattcatttttggtccattcaaatacaaagacatgaactggaaaatttcatattgttgcaacaaatctgaaatatttcagc

SEQ ID NO: 62893 - DNA, 9789 bp, Oryza sativa
cataaaaccaaaccagcccaacatggcaggtgtactcgaatagttccgagatgggcatacagtatgtgaattcaagcaactaaaacaatacagaattaatcgctacttatatttccaaactgtgaggtgtataatatacagaagagactaggcagcaaacaagccatcgatgtaggtaaacaagcaactcatataatggaaagtgtttacaattcgacaaagaagctagcaactgttaaccagaatttcactagccatactaacgacagagccacttatacctagagacacagggataaaactgttggggtgatcgaagcccgactgaagtatatacaccaactgaagcaagcctatattacaccacagtagatgtaataatacgagtcttgccaagtctaagtacttgctactagcctactagtagagagcaactaatcaaacttgactgatgaagaaatcgctacccgaataacagcacggtgaattaagaaatcgcaaccacaacaacaatcacatagggattaagaactgatcgtcccaactcccaaaaagctagtcgccagcggttgccgagaaacgcgaggagaaacccggaatcgcagatcggcagaggggagaggaagatcggccttaccggcgacgaggagggggggagtcgcgatcgcgagtgaggaaagcaggcgagaatgggaactgaactactctctctctctctctctctctctctctctctctcgcgagaagaaggggaaggaaggattggcgttgcgtgcggagatttttctactctctctctctctctctgcgcttctgaaaccgcctctttctctctcctctccactgcgtccgcgagcggttttccctttggtccaatgggccgcctagcctctctctttcttttcggcccaacagagttccacgtgcaccattttcctatatattactcaaaatatactcctggattattccttgatgattcctctttttatcactctcccttaaaccacttacagcagcaggttttgctgctactttaatccatttatggttgcccaacggaaaattaaatcaaataccgtggtaggagttgccattgcgtgaaacctaccagcacatacaaagcttttgctagtagcacatccatgatgattcgtgatgacattgtgccatatgaaattaagttggccgagaggatagttaatcggtagcgtcgattcaaccaatttcaacttctctgttcgcggtacacatggattgctgtaaaaccagcagcagcatgaactaattaaaatagcttaagcaaaaacgctaacgcttataaaaagttctactagtacatttgagctttgaccgcagatggccgtatccttaaattaagatgtgcccttttgcttcttgggcatcctgtagccaccaacgacgcaggcatggtcacgctcgaagggctccagggtcacctgctccgacggcttgaactgatccgccttcagcttctcaacctcgctagcgaacacagcctcagctggcatggtggagtcgatacagttcgcctgttcaaacagtttgtcagtccaatgctgctatcatcttctgtctccgcaatctcaataaacgtgattaacttcaggtttcaggagcgagaaaaaaagaccaaaagtaccttgattgaaatgacaaaatgcccaccattcttcaggaagtaggatgcgttgagggctaagatcctagcctgcagggtagtagaagattaaaattgcaaacggtttcaaaactgaattctgtgagaaccttcacgatttttaacacagggacatgccaaggaagattccataaaggtaattttatgggatacaaattatctcttaactcgagcagcaaccttatagaaactactgcaagtatgtttattcagtacagaaatatgaaccgtaaacttttatctccacagtattcattactccttacaaagcaaaaacataacaatctggtcctaactagcactatcaaagaggcataaaacataataacaataggagagaacgctataccaggaaacctataaattcctaccacagctgatgtagtcaagaaaataaacaagatcatgccaaggaaatgaatatggacaaaaacatgactattggccaccaataaggcacgcatcaacttcgatactgaaggttttacaactaacgagagaataaaacaggcataaggcaaattgctagcacagtcaaaatattttattcagaatacccataaacgcaaaggaaagaaacaatgaaggcacggcgcattggaaactcgaatttgcatcatccaatttgatgtcctgaaggggaatccgagtaagttcctcatttgctaaagcccctatcaaaacattaaataatgacggacaaggtaaatagtgatggcactaacatgcaaatctgcagatgcgtaacacagccagacaaagcaacacaagtgtacaaattaatagaagacattgaggccaccaaatgctccaaaagaaatccataaccatggtgaaggtgaacacttcaaaaccaatttcaaaaggatgggtacaaaaaatatgtcaaataaaagaagtggttcgatagaaagaatgaagtggttcgatagaaagaatgcagcttcctgtcacaatatactctattatactacagaagaatacgggattactactcaacatgtttgaatcacattgagatggaaattaaacacaaaatggaattcgaacagctaagagatatgaaaactgcaaatattgagatggaattataaagaaggttgcatgcagcaatgcatgctgacaacaaagatggttaaagaaagcagcacataaagaacaggtgataatgggcgttagcgcatcaggaactcgaatttgcatcatccaatttgatgtcctgaaggggaatccgagtaagctcatcatttgcagcccagaagaagccaaagaatgcaagtaatgcaaacggttaattaaatacaggtaatcatataataaatctggcaatctcatggtactgaaatcatagtgtgagaaaggtatacctgatctggctgggcaacatcagagaagataacatcaaccatgccaaccaacatccggtaccttgctgggtgcctagcatcctcaatgatggggatcacattagtcctctttttggccatgttaacaagatccctaccactcctgtgcgagaactcaacagcgtagaccaaaccagtctgcaaaatgacacaattagcaaaggcaaattgcatatgttgcctgaataagaaatgaggatagcaaatgacatctcaccggtccaacaatatcggacacatgagacactgttgttcctgaggcagcaccgagatataacacacgagtaccaggagcctaaatcatgaaacaacgattaacacgtgatgctcttctaaactaaagatctgacaaccatactgatgcattagcacttcggcctaagctactgcgcacagtgattcaacaacaaaaaaaaacttacaatccagatgttgtcgacaccaccaagcacagcagcagccagcttagaacggaaggggttccacaccctgtattcaaccttagttccatcctcattctgttcacgcagaaacatcagcaataagcataacttgcagggtacactacaatgcaacaaaacatacagacttctacagaacattatcttacagattcctacatatacaagatagcttatagtagctcagtagagaatggtgcacaaaagagaatttctacatgtaacactatagcttatatctcgaatgatgcacaaaagaggaacaaaaaaatgagaggaggagaaggtaacagcaatggacctggactgagatacgcttctctccgtagacggactcgccggggaccatgttcttggtgcagagcgcgtcctccttggccttggcgatgaagacgccgttgtgcttgtgcggcaccacgaccaccttgctcccgcccttcatgccacccctcccgccaccgcggccgccgccacggccccttggcgtcctgccacctcccctcccacggcctcctctccctccgctgtccccgcccctcccgaatcccctcccaccgccgccactgcggccgccgccatcgcctctccctcccctcccgaatcccctccctgaaaccaaagcatatatcacgtaagattcaaaacgagccgagagagcgcaagaccaacacggggagtaatcctagggtttcggatgcttacctcgcggtggcctcatggcgtcgactcgacgatgttgctctccgccgccgccgcagccgccgcaggtgagggggtgggtgtagggttttggagggggattagggtttggaagagggaacgaggaagggaatgatttgtagagggggaggctagggttgatgttcgatcatggccgttgatgcgagtgacgggtaatggacggtcagatcgtgaatactcccacattttaaatggattaataagctaaaaaagttagaacgacaggacggtcaggatggccgagtggtctaaggcgccagactcaagttctggtcctctaacgagggcgtgggttcaaatcccacttctgacattatattttttcttcatgtctgacattattaacaatttatttttcttttttttcttcatgtctgacattattaataaattatttttcttcattccattttattcaatttatttttcttttttttcttcatgtctgacattattaataaattatttttcttcattccattttattcattcttagggtgtgtttagttggggaaaaggaaatttttgggtgtcacatcaaacgtttgactggatgtcggaaggggtttttggacacaaatggaaggggtttcagacacaaatgaaaaaactaatttcagaactcgcctggaaactgcaagacgaatcttttgagactaattaagccatcattagcacatgtgggttactgtagcacttatggctaatcacggattaattaggcttaaaagatttgtctcacgatttcctctataactgtgcaattagtttttctttttatctatatttaatactttatgtatgtgtacaaagattcgatgtgatgttttggggaaaataatttggggaactaaacgggcccttattgtttcaacatttcagcttggttcatttatccatctccatttcatttgatttcgtggggaatccacggccgtgctgcatgagcgagcctggagtatgatgctagcaccgatggcatcaacgcccatggcatgcattcccagcaccgatggcgttcttattggtcagacgttagaaaatcaatctgcacatcatcgaactgctactttcaggtcgaaccgtccagtgcaaagaatgagcaatcggtacagaatttgtcacaagtgtatgactagtaacggactaattaacagtgtacaagaaaccatactgatcgagcctaatgattaattagttaaccatcttagttgcggcctatcactaatcctacacatatgcgcagtgtgactgcaagctagccgattcacaaaagcctaaaaaaaatctcactcctcaatccccttctcttccatggatactctcacctatgaactaacctcctagctaattaaacagcaacagcggtagcaaaaaaaaatgaaatgaaaaattggaggcatgtctatctagatgatcgtctcctccggctctgacgtcggaagcttctcgtgctccggctgccctccccataatctaaccctctccaacgcttgcactgactgcaggaagtaaaaccagcataaacatggcaattatgatgagtttattatctactacgagtaagaatataacgtgaataaaaatgctgctgtgattaacacctctgcttcccagtcagttttgcagaccatgtacatgaggatggccgtctgcattgccgtcccacacaacatgccagcccaaatgccctgcaagttccgtagaattttcgaaaacgaaaattaaatatatatgctcgactgcatgattcatttatgtagtagtagtgagacgattttgaactgaactgaattttaccttcacaccccatctgaagaggtagccaaatatgaagccgagagggaggccgaagccgtagtaacacgccagattaatgtacgccaccactccctgccatccgccgccgaccgccacacctaaaaagaagtagacaatgaattcttccaaggatcagttcatcggaatttagttagtcaattatatacttcctccgtttcaaaatgtttgacaccattgactttttagcacatgtttaatcgttcgtcttattaacaaattttaaatagttattaattcttttcctatcatttgattcattgttaaatatatttttatgtaggcatataattttacatatttaacaaaattttttgaataaaacaaacggtcaaacatgtacttaaaaagttaactgcgttaaacatttcgaaatggaggtagtatatgatgaagtgctgagatgtgaatggttgcctgagatgacgggctggatgctgttgagcaccatggtgacggcgagcatgtaggcgatgttggccaccgccttctgcaggtgcctgtctccggtgaagatgacggcgaagtggttgcgcgtggcgaggatgagcaccatcgccagcagcccgaacgccagcgactgcaccagcaccaccaccaccgcgtgcatcgtcgccctcggcctccccgacccgagctcgttcgacacccgcacgctgatcgccgcgttcagccctatgaacagcatcccctcccatccatttatattcatactgcatcaaacatatgtatatttatcattcatatcgatcgcaacataatcattgatggtagtgttttatactaccttcattccaaaatgtttgacgccgttgactttttttaaaatattgttcgtcttattcaaaaaatttaagtaattgttaattctttttctatcatttgatttattgttaaatatacttttatgtatacatattgttttacacatatcacaaaagtttttaaataaaacgaacggtcaaacattttttaaaaagttaacagtgttaaatatctagggaaggagggagtaccatatagatatggagtcgacggcgatctcggcgtcgtcgaggtgaccggtgaggacgacgagcaccatcatgtaccatatctcgaggcagagcatgacggcggaggcgagggagagcttgacgaaggcccagagctcgttgaacgccttgcgggacaggcccgtccagccgtcgcggcaccagccgacgacgtaggccacctgcgccagcgcggtgagccaggaggagacgtcgtacgcggcggcggcgccggcgatgccccagccgagcgcggagacgaagagggcgaggaggccgacgtgggcgaggagcgccgcgaagccgatccaggccagcaccgtcaccttgctctgcgcctggaggaacttctgcgtggggaagttgatggcgagcgcgaacatctgcgggatgatccgcaccgtgaactcccccgcggcggcggcgatgctctcctcctgccccagcagccgcaggatgggccccgcgaagacgtagagcggcgagagcagcgcggcggaggcggcgaggatgatccacgagcgctgcatgtagatgcccagcatggccacctgccccgccccgaacgcctgcccgcacagcgtctccagcgcgctccccatgccgagctgccattgccattgcccaaattacaatctctcaatcccatcgatggatgcgcatggaggatttggagggaggactcacgaggaagccgaaggagaagttggagacgacggagaggccgatggcaacggcggagagctcgcggttgccgatgtggccgacgaagatctgcgtggtggagttggtgccgtagaggcagatgacgttgaaggcgatgggcgcgccgatcgcccacagccgccgcgactccgccgcgaacacctcccacgccccgcgcgcggttcgaaccacgggcgcgtcgtcctcgtcctcgtcctcctccccggcgacagcgtcgtcgtcgtcgtcatcctcatcgcccttgccaacagcggcgacgagcgcgccggtctcgtcgtcctgcacggcgacaaccatacgaccgtcagcggcggcggcggcggcgtggcgggagcggaggaggtggtggcgcggggaggtttgggtggtgtggcgcgcggagaggaggaggggctcggtgtaggccatggcgatggaaggggtttggttgctggattgccgcacttcaatcccggcctcgatttgccgttcttggcgttgcctaccttgcctcccttaacaccccccccccccccccccctcttttagcgcggatggctctacttttccacgtccctctcactctcaactgatttatgtttgttactccatccgtatcagcttataaaacgttaaatttaaagtttaaagtttaactaagtttatagacaagtataataatatttatattattaaattagtttcatctaaccaataattaaatatattttcataataaatttatcttagattagagttgttattattttttctataaatttaatcaaatttaaagtagtagtcaaaatatcttataaactgaaaatggagggagtacttctcttagttttcttaggcaaaaaataaaaaaaaatggagatctttggcgagaagccgcagtggcagtgaggctgcagagccttcacaattccctatcgccggcgacgaccacggagaccgttgtggcccgtttactattcgtcgtcggttttgttgcgctaaacccgagggccgcaagggagtcgcggcccacgtgaggcccgtatgtttgggccggtttttcatgggccgttcgcactctttccacgccaccgtccctcccgccgacgctggcaatgcggttcgagcgttcgaccggcggtccgccgtgattctgaacgaaatggctacagatttttttttcgagagagaaaggtaggagtattatttatctgacgtgtacattcaattggatatatacagttatttaaattaaaacttagccttataaataacccaatctaaaattcgctcctactatgaaatgactactttttgcaccctgagaatgaacataggttcactgcgttcggagctagaaagctgaaattatagatatagtagtagatgttatatagtatgggatgtttattttattgtcaagattaaccctaccaaaattttgctgtatcaaaatggtagtaataacaatcaaaacattgctaaaaattacttgcactggtaatcctagaatttcacaaaaaaaaagaacgtggcaaaggtacggaacataacttatactacacgtttaccttcctaaatattgacagtatcaaattttggaaaggttttattgaaatttggcgctatgtgtgtgtttgttttgtccaattctggttcagcgtctgtcctgtctaaatcgccagcgagtcattcatcatcagacgtatacaaaaatgatttgcccggtctaagatgtctgaaccagtgtgttcaatcttgtccgggtcaattgtttccgccttcagaacatttctctgaactcgtcctctttctccccttttagtttcctccttaatctgcttctctttgaagtttgaatggtactccctccgtttcgttttatttgacaccgttgactt

SEQ ID NO: 62894 - DNA, 1110 bp, Oryza sativa
tggaatgtttgtacctactcggtaccccacatatttgataactggtaaccaacagcctgctaccaacataacaccagttcaaccgacggcaccagttttggcttctgcaccagccgcaccgtcgtcagcaccaaggcaaacaaccaatcctcgattgttgaccagagaacagccacagcatgttggacaaaatatcaatcggttgacccacgagcaggttgctgcgatgtttctaccaaacccactggtggccaacccagcacagtcaatgccgattcagcaaacaccaccaagacagcagacggttctgccgattcaacagcagaatttgcagcatacatcggctgggctaggaacacctgacaatcggtagaggcaacatgttgtgaatcaagttatccctgaacacttggtccataatgttcaacaggatcaatcggtgttgccccaagttattcctgagcatttagtgcataatattcagccgaatttccagaattattatggaggtaatttgagctatcagtaccagcctccattgcctcatgttcagtatcagcaaagaggatcacctcagccccaatttgctcctcaatttaatcagttcgagccgattccacagcagatgcaaggagtaccccagcagagaccttgggccgacatgattgcagatgtgatgaggaagcagtttgggctcaagccaaaggactatggaaacctgtatcagcatccataccctgagtggtttgaaagggttccattgcctggctgatacaaggtaccagacttctcaaaattttcagggcaaaacaatgtttcaacttatgaacatgtcagccgattcttggttcaatgtggcgaggcatcggctattgacgccttgagagttaggttgtttcctttatctttgtccggatcggcgtttacatggttttcttctctaccatataactctgtcaatagttgggccgatttggagaaacagtttcacagctatttttacagtgaaattcatgaaatgaagctatcggacttgacggcaattaggcaaaagcatgatgagtctgtgcagcattacattcagagggtcaaggagatgaaggataatgc

SEQ ID NO: 62895 - DNA, 2275 bp, Oryza sativa
  unsure (1)..(2275): unsure at all n locations
aggcttttcaaggtttatnagctnccatcaagaagaaattttcatctcaggagtttgagagcttatcacatcttgcacagaaggtgactttacatgagcaaagatttgccgaagccaagaagaatttcaagaaaatcaatcatgtctatcctcacatgtatgattttgatgaagaaaatgattccgaagtagcagcagccgagtgggttagaagcaagaaggttgtgccatgccaatgggtgaggagttctggaaaagaagaaagaattgactttgatatcaccaaggctgacaagattttcgatctgttgcttcgggagaaacagattcaacttcctgatggtcatataatcccatcaaccgaagagctaggcgaaaggaggtattgcaaatggcataactctggttctcattctacaaatgactgcaaagttttcagacagcaaatccaggtagctattgaagggggaaagatcaaatttgatgactcaaagaagccgatgaaggttgatggtaatcctttctctgttaacatggtacatacatctggaaggacagccgatggggggaagaattgaaactttcagataaattcggctagaattatcaccaagtaccaaagaaagtatatcaagtagcaggaaaggtattatgaagaagatgatggtggttttgatcctcattgggactgtgagtttttcagattctgctggaatgaaggtatgaggctgccatcgatcgagaattgtcctggatgcagtgacactgcagggagttcaagccgatcctgtaatagaggtaatcggctgattcaaaagaggatacctgttcatcagagattgggacatgtaaatcaagattatcaccatgatgaagatgaagataggaaaacccaatggtgtctacaggcattttcaccaagaatcaaaaaagaatggttcaaagaataaggaacatggagcgctttcaagaagtagaacaagaaatcaatcatcggctgaggaaaacaaagaccaagcaggtgtggcgtgttaagagctcggtcacaacagccgatgaagttgaagctgataaagccaaaagggttgctcaagggcaaggctactgcgtctgcatcggtgaatatggtttttatgctagcagcagagtttaaagctaggctagccgatgttgatgatgttgatgaagcctctgcttgattggttttgtcaccggagcaggcgatttttgagaagccagaggggacaaaaaatcggcatctcaagccgttgtatatcaatagatttgttaatgggaagccgatgtcaaagatgatgtttgatggaggagctgctgtgaatttgatgccatatgctacattcagaaagctgggcagaagcgcagatgatctcatcaagatgaacatggttctcaagaattttggtggcaatccatcggagactaagggagttttgaacgtggaactgacagtcggcaacaaaattgtgcccacaacattttttgtcatcgatgggaagggttcctatagcctgttgctcggaagagattggattcatgccaattgttgtattccttcaaccatgcatcaatgcttgattaaatggcaaggtgacaagattgagattgtgctagccgataggtcagttaatgttgctagtgccgatttagctctttggaagatggatggtattgattgcctatttggaaaagtttgggatgaagattttctaaaagtgtccaattgtgatatacagccaattgaagatggagagtccagattattattttgagggcgtcgtggagggttcaaacgtctacaccaaggatacagtagatgatctcgatgacaagcaaggaaagggtttcatgtcggctgatgatttggaggaaattgacataggtttaggagatagaccaaggccaacattcatcagtaagaacttatccccagaattcagaaccaagttgatagagcttctaaaagaatacagagattgctttgcttaggagtattatgagatgctaggactcagccgatcgattgttgaacatcggcttcctattaaactaggggttaggccatactagcagccaccaaggagatgtaaagccgatatgcttaatgttgtcaaggctgaggttgcatgtttatatggggatcctctagagtcgncgtgcnggctgacanggagagtgattctacccttnnnnnnnnnnggggggggtgggaggaggggcagaagggaaagcnaagaagtgttaccaacgcgatcat

SEQ ID NO: 62896 - DNA, 24172 bp, Oryza sativa
  unsure (1)..(24172): unsure at all n locations
acgtgtacatacgtccgatgatgtatagacattaattcgatcatattcgattcattataaatttaaattaataggggttgctcctgatgtatgtacatattgatcatatattgcgcatatgttctattgttcggtttaattagagctagctagctagtgccaagagagattaatcttaattagtttgtctctgttgactttgcatccgatgatgagcgacgtccacttgtacttgccttgttactcttaaattaactcattctctgaccgaagattgattgcgaaatgccgatgtgactgctgcaaattaaggggaatttaagttagtgaaatgtttaatcagaaattaatatacataactaataaattaagcacttatgtatcgatacaattgaccaatgcaatatatgcaaaaaagagcactactagctagtagctagagtactagactatactcctaataaacacaactgaatttatatatatatgtcatttagcaaaggagtatatatatatatatgtagttggtcggtatataaaattggtaggtgatgtctagctggtcctgctaattctggtcatcaggtagagatcaaaaattaactgatcatatatccatgtatatattggggtgcacatgcacgtacatgcatggaactgtacatctatatatgcatatgctagcttaatcaaggtgtgcttctatgtatatacacggtacttgaatgcaattaattagccccaaattaaactctcaataattagttggttcaattttcagctggccattatcttatctgatctgattaattagctgctagctacgggtgtaaagtttactacaaggttccatttctaggttagattaaatttccccaactaaagtgaacgcaaatttgcatcgtgtcttgaatgaaagggatcgaggcactgcagtgtacagaatatactatacagagatggaaccaacaaaaggtgacgcgattgaccaccatgacactacacaaactaaagcataaatatatgcccctaaatatatatatgcaacgacgtggctgtcttgtcttgattattagagctaatcttgtttgtatgtgctatgcatacggaagcatggtagtagctaaatgtcggagttaatttcatgacacgtcaaagctagagcttgacaaaagatgactatatgcatgcttatctcgttgatttcgctatagattgttacacgtcaatgcagcactgtgtgtcaatgatctagctagttcctggctattattatctacagtactatatatatgatctctgctcaagctgtatatatatatgtgcatgctttactaaaaaggaaaaaaaacatgcatgcatgtaaaaagaataatccatcattttgaataagtaagctagctagtactgtttttgttgaaatttatgtgttaactaattaactacaagttgcatccatatggggtgtagctagacataaacagattaaggaaaagtgcagaaatgtgtctagctagccttattaaactatctatgagaatttacaaggacattaaactatcaattgccaactcatatattattgaacaggtagatcgatcggtataaattaattaattgccgtagcccgtaggtcaaaatctctttttttttttacatgtacactgtctgtataagtcaaactgtagtatattaattgtatacggtctaatttgtctgctgctgcgtaatatgatccttgaaaccaacttatacaatctcgatctcgattctctcctagctagctgtgttgtgacacttgtgtgagaacaaattaagtccacgcatacatgcgtaggaggaaattgctttctttaaaaagatatacacacatattgaaatattcagaatgtttagcttaactaatatatgaccaaaatattttcagtttatacgtacaaataggcttcaatatattcattcatgtttttaagtgctttagcgtagttgaaaattaatgcgaacgggggagagagggagataatgtagcccaaatcaacaaggtttattgggccaacaatagtgcgggattcggcccaattgagtacagttcgtcagttgcgttgcccatggaccagttgggggtggtaatcttaattctttccaggccaagcccgtggaccatctcatttcggtcatcagtacttcactagtagccttcacctacctgatgatgtcgtcatctccatccgcagtgacgtgattctttattcctcacaatttacgtttccattagcatgctttttaaagtactgaacgttagtaaacgatgtgtttcgtgcgaatactttatatatagaagttgctttaaaataataaatatattcatctatcaagtttataataactaaaacttaattaattactatgtgctaatgattttctcgttttacgtacgtcaactttatcttgatctttatcagtttcaaacaccaccataaatctagtgaaagttttatcaaattcattattctaatttatgtttaaacctatttaagttcttatatttttttaaaaaaatacgtagtgattaggggtatatagttgcaaccgaaaaggcaaaaaggcattaagaaaaacgtgaacagtagtagtggtagtagttttcaacatttaattcgccattaggatagtaggagcggtagcattcaatttattaatgggggatttgcttgtcctttctcctttttggcgtttataaaagtataaaatccatcgcccaggtgctcctcacctggtcatcctctcatattgatgaaaagtctcctctgctggtcacacgtccgccttgtctgctagtgcccgcccagatgtcagatgccaccacatattactggtactacttcattattattattttcattttcttctgcggcaaacgtttttgctaacaacgcaaaacacttttcctctttgttttttctttcatacgtttactgagacactacggttagtaatcactccctgctaatctagtacgggatgcaacgaatcctaatccctccgttttatttcaagtgcagttataattttctgtgcctaactttaattgtccgtcttatttaaaaattttttaaaaaaattaaaaacataagtcatgcataaaccttcttatttgctacatagagctactgtacccgcctattggcaccaaccagctactgtccttaagtccttgccctcagccacatgcgtgcgttttacactttccgacataagaaagttactagtgcacgattaattaagttttaattattttaaacttaaaaataaatttgttgatatttaaaataaattttatataaaaagttttcatacgaaacgtatcgtttagccgtttgataagcatgctaataaacgagatagaatctagtagtaatatcttaatcacaaacacatgtagtgctcctctccctagaataatgggaaacaatatgctacaagttaataagattcagagcaattcatttttatacaaaatagcagaacatgttgcgcagagaaataatggaaaagtttctctaatctaggatattaaggccagttttaacgtgcagttcggtgaagctgttcgcggttcggaaaatgagaagtgtcattagtgcgtaattaattatatattaactattataagtttgaaaatatatatttatttgatttaaaaaaaacttgtataaatattttctttttcacaaaacacacatgttcgagaagcgctaacggaaaatcaagaagttgtcatctttagagctgaaaagaacaacaaacgattgagtcatccaatgacactcaacccacaaccaacaaaagtatggtcactattataatgggaagggatcacccacatataagtggcttaactacacatacagttaagttaagtcagaaaatattcttccgttacaataatatcttgcttcccaccggtaatatataggcattgttatttgacgttttattattttttcccacaactagaatatcacaataatatgtagtaaaattataatattgttaaagtactcataaagaaaaaaaaccacctttcaatctaaatagggagagttaagtttcaaaatgatggcataaagttaacggtgcattgtctaaatatagagagtgagggagtacctggataagaggatagatcatgaatcttgtatcctgcgaagcactcaatgtggcatgtactatgattgagagagatatttattggtaccaatataatactgtagagaccgcttcaaagtttcacaagttggacttggactgcttcttcagtcggttgggcgcctggctgccaagctacctctgctgtctgcaacggcgtcaccacaaatatccatccatgctcgtcatcagcagagggacatttctcgactcaatcggtgagacacggttacatttcgttatggatctccgtatctttctttccctcgatactgctacctaccatctcctcctcctcctctatagtattgtggtggtgtttggttggagggactaaagtggagctaaactttagtccctctcacaaaaatataagtctctactatagggacttataattttgtaagagggactaaatttagtccctagttcccaaacaccccctgtgttcggccaaactaaatttgggttacctcgtaaaacggttatcatagtaaccatatagttaccatgaggattactatgattttaaaaattaaaaaagattatcatgcgtgataatcgtgcggtttcttaaacctgttgttcggtagcagactgccagttgcagcgatttggagcgtctgattggccaaagcattgttcatcagttatgttaatcggtactagtaaatcaggggaagatcccccatctgatcatctgatgctccgtgatcactgctgtctcccccacttgctctcactaccgaccactgctgatgctcctcttcttgctcggtttctttctcccgcggacactgaaacccaacaacagccaatgcctatcaacaccctaaccacttgctgcctcccatggcgtaagccctcctgcatagctggcgtctttaccttcctcttcctcttcttggtgcctctctcggtctctcatctcctctcctctcctctccaggtgacaaattctcccatccatccatcgattgctatcttctcttccgtatttctttgttcattggtctcttttgcagatcaattggatggcatctttccctggaacccaatatcgatagcttcactgttgcagacaacaaactggttctgctcaactttgaggtagtaccacaaagcttcagaatttgttggatttgctccacctctgtcctgttttgggatccaaagtgctacagggattcactaattcgtcctgtattcactttgtgttgattgattgattgattcaggacggccgcccagttcgatgaatcgatccgtggatccaattctgctctgctgaagctttgatctttctggtaattcacgaaggcaaaggagaaaaaaagatgaagctgatgctggttttcttgtcctaattcctttgcctgctttgcttgcacatacagattacagatgatgccattccgggatgttgctctccacttggacgccaggatgcttccagggcaataaaatcttgttaagatctctaatcacatggtattatctcgaatttatgccaaagctgcggcctttttattttcttttttacttaaccttgccaagttgcgctacggattcgccgcctatttctgacaaaagctcctccattttcctcccattggcgcagcagcagcagctagtccactggatgatgcctccaagattcagatgccaagattacctcctgccgctgctgctcgccctttcgccggccgccgccgccgcccgcgaggtggagtaccaccattgccactgcgacggcggcggcggcggcggcggcggggggttgtggagcatggacagcatcttcaggtggcagaaggtgagcgacctgctgatcgcggcggcctacttctccatcccgctggagatcctctacttcgtcgccgggctccggcatctcctcccgttccggtgggtgctcgtccagttcggcgccttcatcgtgctgtgcggcctcacccacctcctcaccgccttcacctacgagccgcacccgttcatggtggtgctcctcctcaccacggccaagttcttgacggcgctcgtctccttcctcaccgccatcacgctgctcaccctcatcccgcagctgctccgggtcaaggtgagggagagcttgctgtggctcaaggccagggagctcgaccgcgaggtcgtcctcatgaagcggcaggaggaggcgagctggcatgtccggatgctcacccacgagatccgcaagtcgctcgaccgccacaccgtgctctacaccaccctcatcgagctctccagggtgctcggcctcaccaactgcgccgtctggatgcccgccgccggcgagatgtgcttgacgcacgagctccggcgagacggcggcggcgaggatggcgtcgtcggcgtcgacgacgcggacgtcgtcgaggtgcgggggagcgacggcgtcaagctgctcgggccggactcggtgctcgccgcggcgagcggcggcaaggaggagggcaccggcgcggtggcggcgatccggatgccgatgctgaaggtgtccgacttcaagggcggcacgccggaggtgatccagacgagctacgccgtgctggtgctggtgccccccgccggcaagagctgggggcggcacgagatggagatcgtcgaggtggtcgccggccaggtcgccgtcgcgctgtcgcacgcgacgctgctggaggagtccgggcgatgcgggaccggctggcggagcagaaccgcgagctgctgcaggcgcggcgcgacgcgctcatggcgaacgaggcgaggcaggcgttccagggcgtgatgagccaggggatgcgccgcccgatccactccatcctcggcctcgtgtccatggtgcaggaggaggccctggcgccggagcagaggctcgtcgtcgacaccatggcgcgcaccgccaccgtcgtctccacgctcgtcaacgacgtcatggagatgtcggccgacagccgcgagcgcttcccgctcgagacgcggccgttccacctgcacgccatgatcagggacgccgcctgcgtcgcccggtgcctctgcgacttcagggggttcggcttcgccgtgcacgtcgagaacgcgctgccggacctcgtcgtcggcgacgagcggaggattttccatgtcctgctccacatggtcggcaacctgattggccgcaccgagcccgggcatgtcacgctccgggtgcgcgccgccgacgacgacgtgctggacgacaggctcggccagaggtgggatccatggtggccgtcctactccactggctactcctcggtgaagtttgtcattggtgtcaagcggcagcagaacggcgatgccggctcgccgctgtcgcggaggccgagtgggaagggcattgatctcagacttagcttcagcatgtgcagaaagcttgtgcaggtagtgttattgcctggatcactgcattgcatctgaatcatctgaacatgaaattagcagtccaatctcaagagagcatattaccactgatgctgatgtcctgttgatcctactgacagatgatgcaagggaacatctgggcgattcttgatccccaagggctaccggagagcatgactctggtgctcaggtttcagctgcaatcgccactgacatcatcaagccttggaggatcattcgagcagaagcactcgtcgccgtcgtgccagattgcaggcctgaaggttctgcttatcgacgacgatgacgacatcaaccttgtggttgctcggaagctattggagaagctcggctgcgtggtctcctcgccgccttcaggatcaggatttctcagctctgttggctcctcagcagcagccttccagcttgtcatggtgaacctcgaaatgaagagagtaaaagcccttgatgtcgcgacgaggatcagccagtacaggagcggccgatggccaatcgtcatggccatggcttccgaccagaaggcctgggagaagtgcgctcaatccgggatcaatggcatcctcaagaagccggtgattctgcaggagttgaaagacgagctggcgcgaattcttcagagcacatgatgctgatgtttgctggaggtctgtttgtctaagagctctgaagtctgaatcggtaaaagctgtgaatcctgtgatcagtgtacaacctcgtcatccagcattgaagaatgaagaactcagaagaattctgtgatcagtgtacaatctcgtcatccagcattgcagaatgaagaactcaaaagatcttcgcggcgaaaacggggaacatctctaacgaaagaaagggtgccctgatggatggcaagaacacatggaatcttggcagcaatggcgtccccgagaaatcttcttcgcacaaattttgtaatatgagtttgagtgggaatacaagtcgtgtaattttctaatgatcgagatgtacactcgggtgaagtcaagggaattcgtacttgactctctctgtcaaagcaaatcatgagattggaatcaatgagatgatatctcaaaacactttcagttgcactgcagcttgcacgtgacgccgcgtacggggaggaattgatgaaattgagaatcgaaatgggtttgacttgctaaaatcgagtagagagagatgggacattgatcttgaggcgaggagaggtagaacgtgggattccattatcttaaaaaaaaaaagtagaacgtgggatgtgtgggaggtgtatcacggggaggaggatcggattgagatttgcagggaaggatcagtccgtaccggatcggcagcagatcgcgcattcgcaggagcaggcgccacgtcgtaggagggctgatcccttcccggcgagcaactccatgagcgccgcctccgcctccgccgccgccgctgccccctatagatccggttggttcgcctgaaaccgcagccatgagctcgacgagcaaagtacggatagcgtccaggaggagtagagggagggcggtttgccgaagcggtcggggtaggagacgccgaactcgagggcgagcgcggaccgccgcggcagaaggggcggcgctgcacgccggcgacggcgagcgccgaccgccacaggagcgggtggcgatctcgtgaggcccaagaacagaattggatattacgtgtacgtgcggcccaattttgttgggccgggacgaaattacgtgcttccatgctagttgggccgtcagccgagacctttcttgtggcccaataacggaattgtgagttacatgcagccgattttacctaccgactggaaatttcgacatgcgtcaggccgatttatgttgatggaaattacgacatactcctacaccgttgactttttagcatatatttgactgttcgtcttattcaaaaacttctgtgaaacatgtaaaattatatgcctacataaaaatatatttaacaatgaattaataattacttaaattttttgaataaaacgaatggtcaacaaacatttcaaaaaaatttaaataagacgaatgatcaacaaacatttcaaaacaaacatttcaaaacggagggagtgcttacgttcataggctttctatcaacttgtccaggagatcaaggagatagctagatttgctactactaacgtgcagattgtaaatccacatagtagcaacaggggcccacaatttgatgacattagctactataataagtgcaaagcaaacaatttgtaaggacaccgagcagataaactgtctagaatacaaactacacggcagatctgtgacaaggttgatccaattctaacagagatccctcatttcaagtctggacacttttagaacagaggtagctggaaacatgagcatcaagaggtgccatgacaaaaacgcgcagcttcaagcgatttacagcttggctggctgcctgttcttcttcttcacaccagacttggcaacctggaggctgcggtacactgagctaagccttgcaagagccggtttggtcagatctggcctgtagtagttgtcactaacctgcgcagaaaagaaacagctgttaagagcacaagctatcaaagatttcttcaggaaggtacatacaggaaagctgctgtagagagaacagtagcagcttgattctgctcagaagccaagcgtaacaagtatttgtcatcgaagaaccaattgataggttggccttcttatgtgttacggctcatcacagcagcatcacacattgtaacctcaaacatgggaaaaaaatttgattcgagtattgataaaaacaaaacattccttacagactagcttgtgattaattggcaatttactaattttcagatcaagttataccaattgctgtaacaggagtatttcacagaaaaacaggagcaatctctgagccttcttccatgttggggcttatcacagcagtgaatagaaaagaataatgaagccaatacgagatattaaggctcatcacaacagtgcatctaaagcatagagcatcacaaggcaaaataatgacatgaaactaagcatttatcttccaaatacctggttcttgacagccttagccatcttgcggaactccttgcgcatcacagacttgtggtagagcttagctggggcattctgcttcttggtcttggtcgtggagaggaccacagccgcgtcctttccacctgatggctggatcgtcacggtcttcttgttcgccaagccttacagaacacaacaacactatgtcaggacattgcaaaggctgaatcaaaggcataatttgcatctaaagcctgtgacgttgcgagaagcaactactgaccagagtgcttgtaggagtgaacattgtacaggttgttgggctccttggtgaactgcaccttggcattgctgtttccaaactgcttcacgaggaagcagttgttcttcttcacaatctcccagaacaaaggctccggaaccgtcgccatttcgctgtagctacatcaccaaacagatcgaccattacaccatagcaaatgaccatcagaccactaagtgaccattaacacgcaaaaacattacacaacgctggcagcaatggtgtcgatcacaaatggcatctgccctaaaatctctcatccaacatcatattgatcgaaatggctagccctatcagctatcagatctagagaacacggatgatgcgcagattggagcatagcgaggcgatctaacaagctaaacaacccgcgtgcaccgaattactcaaactaaaactaagtttacagttattgcagccaaacaactgaccgaaaagcataatagtatcactgagaatttcacgacaaaatcgaccggtcaccgagaatttaaccgcaagaggcagcgatcaaatctaccaagcaataggtcttacagtggaaacagcagattttaagatttcggcagagaatacaagcgcgaggggtgtcgaactcaccggagacgatgaagccgcggcggcgcgtcgctgtgctccggtggcgtggtggtggctgcggcctgcggaacggtgcgacggcggcgcggaggctcgcttttatacctgttcgtccttgctcacaaaccctaggttagctccgcttttaatgggctttattgggccgagcaaataatccgccatagcccatgggctactagacgggccgaaaaagcccaaaacacaagaccaactgaccagccgcctcatcaccgaattaaattcgaaaatatactgttccattcattttatttttagaaatattcaggattcaaagctttttgcaaaaatataccgttgatctcgcacaaccattacgcgaaagtgaagtggcgtgacgtcgcgggcggtatcgcgcgggggaagcgtgagaccgtgcggtcgcgcgaaatgaaagagcgagaccgtgcaatctcgctgaaccaatcagcgataccgtatttcaaaatggtgaattagtgattaattattatgattaatgactaattattattagttaaatagataattacgtcattagtcactaagcaaatggagtttgctcgtccttcccgcgacagcgcgcggtcggtgcgagagaccacacggcacacggtctcgtgcattcgctgtgcgataccatcctcgacgttacctttacgtcattttcgctcatcggttgtacgagatcgacggtatatttctataaaaaaattacatcctgaatattctttaaaaaaattaaatgaacaatatattttcaaatttaattccctcgatcgtctcctccaactccggcgccgcctcaacaagacgaagcgttccgtctgaatctgattgccgccggcgacgaacgctccgtcaaattccatagataaaaagctctttcttccactagatatattatcaaacagggacgacgctagagtcacttatcagggtcagtagaccccgacgatttttttgcaaacatcttgtaccagcactaatttatcagctacgaccccagtcaaaccccggtggtccggtgatattgttctgttcaagctcaattagcaactaaacaatactaacaagtagtaaatagaaaattagcaagcacttattatacgacagcccgatatacgtatgagatttgagcccagaaggctttgtattcctgctaaacaagtccacaaattgccttgttgtgctgctctgtattcctgctgcagtgcagtctggctcgaagcgcttcgcccaatcgtcgccgattggcaagggtaacccactaaccccatcacaatttcttaattattatcatcacaaattggttgtaggctggtttctcaagtccaaaattttaggaagttagggttctgaaatatgaagtttctcccaatttctgttacataaacataaatttattctttctagaaaagtggaaggtaagaaattagtgattttgatcatctacagcagcgtgggtattttgttttacataataatcattctattttttaataaattaataggcaagcaaagtataatggagtgtgattcttgagaagaaaaatacccacttactagttcatgtggtactaattctcctttatcagtggagataaccttctcggtaataaaagttgtgtagacaatactgcacgcaatcgtatcggtaataaatatatggattactccttgcgttttaaaatatagctacagttccaaatgatgatgacgtggttgttcgttttcacaagatgaaggatcgtaattgtacacatgagaagtttgtaacatgtaaaacataaccactttacttaaaaaaaactttattttatcatattatatggtcgatagttttattctaggattatcttaagattattataagctatagtcagttagtggtgaccccggtgactatttttcctggcttcgtccctattatcaaatgaagtaggtacaacaacttctccaaaacaattaggatggcatcacgattctcgagtaccagaacaaaattcagtacaactatctttttcatccacacaacatatggcgagaatatgttcccaaatacttgtgattttagctactaaaatcacacacttgtcagcatatacatatcagggatagtatgttctgttgaactaactagtcgtgtcaaggtctatgtatactaccacttgttgatgagctgatccatgtctgaattggttccagagactggtatattctgaaaccaactttctgtaccttaatgtattcagggaaaaacaaaagtgaagtagtagctggacatgattatttcttcgtaacaacaagtgaacaaacaggggatcaaattcagtgtgctcaaaacatctgctgctataaccgatagttgtatgcctttggatttcgtacttacctgagaaccagagtacaaattccttctagatcttatttggtgccaatgtacaatgggaacgtattactagtgtctgtctccgtagctaattaaccaatcatcagtgcatatagattgttgtcacatatatatgtcttcactgtaaaatatactccctccgtttcgaaatgtttgacgtcgttgactttttaactttttagcacatatttgaccgttcgtcttattcaaaaaatataagtaattattaatttttttctatcatttgattcattgttaaatatatttttatgtagacatataattttacatatttcacaaaaaaaaattgaataagacgaacggtcaaacatgtgataaaaagtcaatgatgtcaaacatttcaaaacggagggagtatattttatctcttacaaagtgtaaatttaaactaaatgaaaagcaaatagtacatacattttgttattggatgactgcaacatagaaaaaaatccatggcaatatatgttcaatgacagctctgaggaaatttgcattcttcaccattgaaattttaccataataaaagcaacaagaagtatattgtttcagatatattctgtgggggtaaaatgtgaagtacatagaaagctacctaagctagagatctaaattgaaccaaatactccttcaaatcaactcaattatgatgaaaaagaatacgtaattgacacacatttaagtattgattcgatcatgagcctgcagagcctgaaccaccaagtctcagctccaaatccaattcctcctcctccccatgatcatggccaccattgccatccccatccttggagcagcagccgtagcgatctcgtcgatctctaccaccaccttcttcccgacggccggcgccgcgcccaaacagccttagctcttgcggcgccggctcggcggtacgggacctcaggctcgcgccgccgccggccgccgtggacgccgccgcatcctcgcttcctccgctcgccggcggacgaaacaacctcacgagcgtatcgtagctgacgcttcgccttgccgccgccgccgtcgtcgacgacgaggaggacggcgtcgctcttccaaccctgtccttccggtggacgttcatgtgcccgccgagcgcctgcgccgtcgggaagcccctcctgcagaaggtgcagttgtacggctgcctcgtgccggcctcgtcgtcgtcgtcgtcgtcgccgctgcgggcctcgcggagctcctcctccgccttgtctccgtcgccgctcggcgaccttccaccgatcacctcgtccttgctggttttttgactcatctgcttctgctaagctaggtagagagagagagagagagagagagagagagagctagggtttactggtttactggtttgttgatgagattcagtgagcttagctgcttattgggatcgaatctaagctagccgattgtgaaaatgaaatgtacagtcaagcgagatagagaaatgcaagtgcacaataatcaatgaagtttttatgcagctcccatgaccattgtgttagagattacctctcgctgatttggatgttagccttgttttatgtttcttttttgctcattctgccggccgcaacagttgtttttgtctccgtgttatttgattttgatttgatttgattaattagctgattgattaattaactaattaatctgagttgttcagctatggccggccttcatttgcaacgacctgactggttcttggcctctagtttatcgagggtggtggcttagctacctgcagtgtgcttttgtaagcttgtgcttggaagcgtttgttgttgagtctttataggagtaatatattgtgttacgctatatgacatgttcaaccttttcttatacatagtactatcctatattattgactatatatatcattattccacatcatcattttcttttttattgataacaagtcatgtcatcatgtagtttacccaaaaagaaaaaaagcagaagaagagaagatagattcagtttttaaccactagtgttgcatgaagcggtatgaggccatgaattctcacttccttgcgtgccgctacggcccatcaaggcctatcccagaagctcgtggcacgcgaatagactggcccatacatgtggtttttggcccatccaaaataatgacaagagtaagggcatgttcactttgataccattttcaaccataccattttctagtaaagttgctaaaaaatgactacgtttaatttattgccaaatttgctaaatacaaaagaaatcctgccaaatttttggcaatgccaaaatttggtaaggtttattttggctacaatctaaacatgccttaaattttactttaagacaccttttattactgatgtttcgttttgaatcaccctttaaccaatgctttcactttagaccaggtaattttacctctgtgacactttgggccacccctcaaatcttttatcgttctacattcagtttgtcatatgtcaaagaagcaatctaatggttgatggagtttattgacaagtatgagccgccatacacttgtacttaaggtcattctatgcatgagaagagagttgaggtggttcaaagtgcaacaaatgtaagatttacccgattaaaagtgaaaacattggttaaaaggtggttcaaaacaaaacatcggtaataacaaatggcccccaaaatttttttaatctaatagtaaatccagaacgtgatgaacaaaaccagatggacaagtaacgaaggcaaaatcacattccaaccgtatcgtgtcagcgattagctcgatcacaattcacaaacaacatcaacacatgagcagaattttaacgaatactttcgcttttgcatatttacagcaaaacgttgattaattcctccagagctcgccgctccggtcgccgccggtgccggcggacgacgagctggcccggtcggagatggacgagagcggcgtctcgtcgccggcggcggccaccaccatgtccctgtacgtcttcctgaccgcccacagcgccctgcagcactcgcccatgctcggcctctcctgcctcacgggggcgaggcaccggaacgccagctccatcaccatctccgcggcgcgcgccgtcgccggcgtccgcggcaggtgcgggtccagcacgtccgccgccgcgccctcggcgagcttgcgcatcgcccaccgcgccgtcagccgctcccgcatctcccgcctcgcctcgatgggtcgccgcccggaggcgatctccagcagcagcacgccgaaggagtagacgtcgctccggtcggtgagctggcacgtcttgaggtactccgggtcgaggtaccccgccgtgcccttcacctgcgtcgtcacgtgcgtcacgccgtcggcggcgccggcctcgccgacgcccagccgcgcgaacccgaagtcgcccaccttggcgcgcagcgacggggtgagcagcacgttcgacgacttgatgtcgcggtggatgatggggtgatcggcgtacatgtgcaggtacgtcaccgcgtgcgcgacgtcgatggcgatctccagccgcgcgcccatgtccaagaacctcccgttgcaccctgcgcccaagaacctccattagtaaccaatccgatcgagctcgagctcgagctgcaatggcggatcacacgcactgtcgaggtgctcgcggagcgtgccgttggggacgaactcgacgacgatgaccctctcctggccgcactcgaggtagccgtagaagcggacgaggctctggtgctcgatgcgcgccatggccttcacctcgctccggaactccacgtccacgtgcgggttctggtcccggagcttggcgcgcttgacggcgacgagcgtgccgtcggggaggacgcccctgtagacggcgccgaagccgccctggccgaccttgagcgccggcgagaagttgttggtggcgcgcaggatctcctccatggagaacaccgagctctggaactgcgtcgcgatgcctcttcccctgctgctgttgtacagcccgcgcatcgacgccttcccctgatcactgccaggccccggcactggaatcatcaaacagattcatctatcaagaattaattcccaactgcttaattgctgctctgaattttgaaaaaaatgtttgaagtcttctgtgattcagattttataaatatgattctgtaagctttgcactagcaattctgctccagaaagtaaagaattcagagtagttgcggcaattggactgtgataattgactgtttccaattcagagtagttgcagccggcaactggactgtgataattgactgatttcttgaacagttcaggaacagttgcatcaattgggcaaataattcggattatatcctgtttgcttgagcaattcaaatcgaggtaattaaggacaaggatgaaatagatggagaagaaatgatcgagagaaacaatttacatggcggcttcttgatcaagtcattgggctctcttctgctcctcctcttagcgttgctgccggaggcggaggtggccgccgccgacgacgaggaggaggaggaggtggagagcgagctgaaccacaacccgatcgtcctgaagagcgacttgagcgacgccgccctactgccgccgcccccgacggagagcggccgcgaccacgtgggggcggggctccacggcgcccatcgctccctctccagctccggcgtgcgcctcccggacgacgaggacgacatgctgcggcggcgctcgcgtccctccatggccgcgcagccgcccgcctccgctcagagctcccaacgcgccggccaccagggggcgcgtacgcgcggcgtggacatatagctaagctcggccaagtcaaggggcgcgaccatgtccaacgccggcgagcgcgagccggtgggacccgaccagttaaacatcagtgtcactgtctgtggggccggtgatgtcctggggcccacttgccagtgagacgcggcgtttgaggtggacctggcaagcgatgactagttcttcttcttcagacttggcttgttgctgcagacaagagtgtgatagcaaatgttaaggtactgatcttgatcggccaactacactaattgaatcattaacatctccctcttcagcgtatataagctttagtcgcgtcatcacgtatgttcgcagcaactttcaaatcgcattttttttttataatccataacctatgttcaaagttcaaatccatgggcacacacgcacgcaacaagtccgtaaagtttttatagcccttttgcagctaatttagtcacgcgtatcctgagagctcactctatttgtcaacgaaagcaacatgcgtcacagcgtcagctaaaccatgtctccagctggcacttaagcatgcagcaggtaactgtgtcaccggcttcaacaactagattattactccctccgtttcgttttatttgacgccgttgactttttatcacatgtttgaccgttcgtcttattcaaaaatttttgtgaaatatgtaaaactatacgtatgcataaaagtatatttaacaacgaatcaaatgataggaaaagaattaataattatttaatttttttgaataagacgagcggtcaaacatgtgctaaaaagtcaacggtgtcaaataaaacgaaacggagggagtaccattcaaacttcaaagagaagcagattaaggaggaaactaaaaggggagaaagaggacgagttcagagaaatgttctgaaggcggaaacaattgacccggacaagattgaacacactggttcagacatcttagaccgggcaaatcatttttgtatacgtctgatgatgaatgactcgctggcgatttagacaggacagacgctgaaccagaattggacaaaacaaacacacacatagcgccaaatttcaataaaacctttccaaaatttgatactgtcaatatttaggaaggtaaacgtgtagtataagttatgttccgtacctttgccacgttctttttttttgtgaaattctaggattaccagtgcaagtaatttttagcaatgttttgattgttattactaccattttgatacagcaaaattttggtagggttaatcttgacaataaaataaacatcccatactatataacatctactactatatctataatttcagctttctagctccgaacgcagtgaacctatgttcattctcagggtgcaaaaagtagtcatttcatagtaggagcgaattttagattgggttatttataaggctaagttttaatttaaataactgtatatatccaattgaatgtacacgtcagataaataatactcctacctttctctctcgaaaaaaaaatctgtagccatttcgttcagaatcacggcggaccgccggtcgaacgctcgaaccgcattgccagcgtcggcgggagggacggtggcgtggaaagagtgcgaacggcccatgaaaaaccggcccaaacatacgggcctcacgtgggccgcgactcccttgcggccctcgggtttagcgcaacaaaaccgacgacgaatagtaaacgggccacaacggtctccgtggtcgtcgccggcgatagggaattgtgaaggctctgcagcctcactgccactgcggcttctcgccaaagatctccatttttttttattttttgcctaagaaaactaagagaagtactccctccattttcagtttataagatattttgactactactttaaatttgattaaatttatagaaaaaataataacaactctaatctaagataaatttattatgaaaatatatttaattattggttagatgaaactaatttaataatataaatattattatacttgtctataaacttagttaaactttaaactttaaatttaacgttttataagctgatacggatggagtaacaaacataaatcagttgagagtgagagggacgtggaaaagtagagccatccgcgctaaaagagggggggggggggggggtttantctcatcattagttttaagggagaaattcccatcttcctcagtcgactcatctgcagtatctgtgactgcagccatttcagcgaaagcgccactggcaggcatgttctcaattgcatcatcctcctcttcccaatcttcctccaagtatggcgcaccgtactgtgcaccattttgtggcccagatccatttttctggaagattctacacaccacatgcagatcctgcgcactcaacaggaaactaacatcagctatcagaaaaggatgctacatcaatattctatacaggttaaaaaccattggtcctccgcaattcagactcctcaattcagagtgaggataagatttccaatgcttaaatagcccagttaaaagcccccttgcttcatacatttccagacgtgctctatcacttctaccagtgcatctcgcacttttttcttcttttattgacaaaagataagctcatgctcatattggtttttctcaaagcaagtcattgatgttgtaaggaaaggtttttacctaccatatataggtatcaagtgaacaaacatgagaatgttgtaaccattctaggcccgggacagggtcgcactagataacatatctaagcagcagcaagtaacgagtgttgaaagtagaataggaccagttcccacctaccgctcacacaagcctagcaggagacaagctaaaagaacagaatttttttggtgctaccgctaatctcgtgatctcgtggtacggtagatcctgcgaaatttgagatggatcaaatgatttcacaggtacctgggtgccgtcggcgtcgaggaggcggtactcgtgcatgacccagttggtcctctggcccttgggcgccctaccggagtggaagacgagcgtcttcttcatcccgacgagcttgccgcggtggtggacatcgcggtccttcccggtggtcttccagtagccgcgcggcgtggcgcggttggtcctgttcccggggccgccgcggccgccggccccggcgccggtgaccttgcggtcgaggcgggcgaagaagtaccactgcgcgtcgcggctccggatgcgggagagggaggggaggtcccacggctcgaggcggtagaggtcgacctcggcgatggcgtcgatccggaggcggcggccgaggatgcggcggcggaggtagtaggagacgagctcctcgtcggtggggtggaagcgaaaccccggcgccaggggcaccgccgccgcggaggaggagtccggcggcgattggctcatcggcggcgaggggaatttcaatttctggatggatatgatattggagatcccgtgggaggggatcaatcccgcataattctaattctgcacggaggattgggaattttgcagggagaattgagaattgagaatcgagagagagggtagattggatcgagcggtggatggaattagggttttgaggaggaagtcgacacgagatggcgaacgccgagttagttggggaggagaggataaaagtcgcgatacggacgcagccgcgtgatgagaaagaaaataataatagaggaaatatcatactcctcggtagccgtcttgtagaagactcctgccctctcgtctgtccgaaaactttttacgaatatacctttttatttaataatttacgtttatatatggaaggatatactactacggataaattttattcagagatttttgagatgtactccctccgtttcaaaatgtttggcaccgttgatttttttagtacgtatttgaccatttgtcttattaaaaaatttaagtgattatttattcttttcatatcatttgattcattattaaatatacttttatgtacacatatagttttacatatttcataattttttttaataagacaaacgattaaacatgtgtttaaaaaatcaacggtgtcaaacattttgaaacggagggagtattatgcaatttctaagatttgattctactccgtaaattctccaaacgtagtgagctgaagatagacaatacagtggatgccacagaatgtatttatgttgtatactagtcaaacttttgagggaaaacgtcgtttggtaaaacagatttaatcctccatgatactccagtattattatttcattcacgacatatatcttgagaaaatttcgactttttttctgctcgtactagtttgctcgcccaccaaatttgaaagaatttcaaatgctttcaaataggatatattcataggaattccaaatgggagctaaaactcgctgtaacatttaaaaagaaaaagaaaagcccagcctttgcttttttttacttggcattggttgcatccacgcaggcaaaggtagatgcttgtgactttccacgccccacaagagtaggcagcctcgcttttttttcctggctttggacttgcaagattttggaggcaacatcatggaaatgcaacaaattggacagaagatgcagcctctcactaggaagcaactttgtctttcagcaaaacgagtcatttcgacttttgaggagacaaacaaacaggcaaagacaaggggtcaagggtaacctaaggatcacaattatcaaaactagggtagcacaccagcgttgttgagttatgacaacagccaaacatgttgtgaaatataatcctattcccaacaaaaataagaaataaatagaacagctgattgactgactactccagttactaacacaatcagactcaataaggaacaatagattatcttaaattttctctcaagctttttttgcggatagtgctaaaactagaaaagacaatctccaacccctcctcctaacttggcatcaggcttcttttccatcagatgatgcccctcgtcttcatgagattttatcacctctcggaactggctgtcaccctctgcattatcatagactctgctgcctgaatagcttctgatgttccagttatcgtcactttcctgcaccagtcagtaaaatttggggattcaggcctgctgtacaagcatatcatatgaaggtcggtggtgctcaatatgctttaagagcttgttctgatggtgaaaagtaa

SEQ ID NO: 62897 - DNA, 3672 bp, Oryza sativa
ccgatgattgtacattgcagattcgagctcggtacctacttcatgagtcgaggagacccattatatcttcggtgatgcctgccttgaacgtcagcagcgcgtcccgctcccgcggtgagcagccggccgccgtcgccacgttgccgtgggcgggcgccggacggcgtgtggcgccgcgtggcagcgcggccaccgccgcctccacttcatggttggtcgtggccaaggcggcgacggcgaggacgctgaggatcaagagagcggcggtggtagtgggacgcatggtggattggtggactagtaagaaccgggggggtctgtatctgagtgtgcgagtgtatcgtatacgtatcgttgttgtttttactgtagtcgacgggtgcgtgtgtgccgtgccgtgccgtggccgccgggacgcgcgtgggcgtggccatgtatacgctgcaaacaacagtagcgacgggccgtacagggacagctttcgttggcccattgtagtgagggcagaacgttactgcctggatcgtgcggcccattagtatggcctaccagaatctggatctccaccaattaaaaccagccacggaagtcgcgcattcgcggaaatttttttatttttaaattttttttattaaaagttttacaaaaataatttttcatttttgaaaattgacagaagtggtcgcctaccgccctctgggagggtgatttttaaaaatcgccatcccaaagggcggcgaaagtgacgtggcagatggccgttcgctctcaggcgacgcccgtcaacgaaatttgcaggcgacccccttgccgccctccgctagggcgattttgtactgtgcggggggccgcctgcaaatgggcggcggggggcctggaattttgcaggcggcccccttgccgccctgggggagggcgattttatactgtgctttatatttttttataaatatcaatagttatcaaatctttttatattgaaaactatacaagattaaaatctccaagactggtaaaatataattttattattttttagggcctatttggaatgttaccgtacaaatttttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctgtccatgatatgatggagtgacattgtcgatccatcgagtaaatccacacatccttggattgccctgtaaaaatagtaatgttattaagtttgggtagtaattttgtgcaaatcatagcggattttgtaaatggttagacatacaacgaaatcgttgtctacattggggcagacaaaatatctccttccaaatgtttgttcagcaaaggatgtagccacctgccagcgatctctgcacccacactttggacgctcggaccatttaggtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacatccattttgggatagttaagttaatgatagtactaaggagtgatgaaaagaatagttggtattaccacgaaatcatcgtcgacaatgtttggacacacgaaacacctttgtcctcgaggtcggtgccttacggaccttatgaactgacaccggcaacacaacgacccttccgacgctcacgccacgtggggagtcctaggggatttacgtgccattctaaagcctcagcagcaattcgacgttcatgctcatccttccgccttaggtagtccgatcttgtttcactacgtgggtaagcacgtgttccgtcgttttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatccccttccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgacaactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccttaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacaggtatttaatagtattaataaaaagtaaagtaccgtgtgggcgagggatcgacgctccgtgagaggaagagctggcgaacgcgcccgaagaggtggcgaacgccactgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatctctgggctgaactgtaccgtgcgaaaccggtgctgtaggtcgcactgctccgaagctaggggcgctcgaaggcaaacgaggt

SEQ ID NO: 62898 - DNA, 754 bp, Oryza sativa
  unsure (1)..(754): unsure at all n locations
ggggtaattgattatccnattgatactcaacttgcatgcctgcaggtctacttgttagatcccccgaacaaaaaggatcaagacaagacataatttctctaccttggtgncagnttctctttatatttcatgaagcctgtcggctttcgtggggctttcttctggttcatgcaactcggaattgcttacaaaaatagaacttttaaagcaatcacccctatcgacagaatgagcacaatctgcatgacaatgtccatgcatgttctctgcgcaatcatgaccatccatatctacatgctgactcatgtcgaaaggaggctcaaatgcctgcagtaatataccttttaaggatagcatcatgtacattaaagttttcacctaacgtacaatcttcccaccccgacaacccaaaccacatatacacaataacacaaacatacctcaagcatgtccatgatgaatgatgcattcatggatatacacctgtgaagtaataaacaatcacaaaacaataataaattccttcacagtaagcaaaaagagcggccataactagtttaaacaacatgcattgatttttcagaaaaattcggccgtgaatttaagaattatacattttttcctgaacttaaaaattgtcacctaaattaataacctccagtcgccttcgttataaccaaaacccttctataagaatcccaatccttaccaattacattctactgtgtaaacctggtctttctaaatatctaaa

SEQ ID NO: 62899 - DNA, 1316 bp, Oryza sativa
  unsure (1)..(1316): unsure at all n locations
tttcgatcaaaggagagntattgagttcgacttgtattatatataataactcttcgtaattgatgcgtcgtnatgtaacgtaggtggtagtatatttttaaacttactatannccccncccnccccccagtgcggccctttgangtggcgtgccgtactcactataggcgaattcgagctcggtaccgtcagatctataattcacctggcggattcaaatccccaaataggagtagggtattacctctcattgagagggccacctgtctaaatcctttgtctctgcatccatccacttttaggtctcgtgcgctaccccttttattattgcggaattcatgtttcgacaggcaccttcccttttaatggcattccggagaagttaagatataccaggttcctgagatagctgacgaaccctgggaatcggccggctggacccacgagattgttgttgctgaggtcaaggtgctctagctgttcgagagcgagcagagaagtacttatgtgccccaccaaagctgttgcttcgttgtaccacgagaagttattttgaaggtgaaggccgaagacatgaccgatgaggttgtcgctgcacctaacgcctctccaccggcagcagtcatggttacctcgcttccacgaggcgaggcgacctgcgggatcgccggtgatgcctcgcttgaaggccagcagggcctccctctcccgcggcacgcagctgccggcggctggagccggcgcatggtttgccgtggacgtcgtggcggttgccccgaccaggaggaggaagagcagcggtaacttggctgccggatgcatgatgcgatcgaatgcgtgaatggctggaagcaattgagtgcagtatttaatgtgagaccgggcccttccattttctgagtaagattcatatttttatctttattttcgttagaatactttacaaactattaaacgatgtctcccgtaaagaaatttatatataagtttctttaaaatattaaatacaattatcaagtttataataattaaaacttaattaattaatgtgctaatgatttttctcgttatcggtttaattatcaaatagtcccaacgcatagtatatgtaccgtgactgatacgacgacaactcagggattgcaatttcggaaatttcggacccccactactacagcaaatattttcatggacgctggaccgtttagttttcaagcgggtcgtaagtgaaatcgcaaggaaaaatagggggaccggagccgggccatcgcccgtataggaaaacagggtacgagtcgaatgcaatcaatnacagg

SEQ ID NO: 62900 - DNA, 2039 bp, Oryza sativa
ggagtagcgtttagcagtccctaagtaagctactacacatgttgagaaccatgataatctcaggtctaaggattcaacaccaacactaaatgagatcactgatgacacaacacatagggctcttgtagtgtctcatgttgggtctatccaacaacatgttcaccaacatgtgtccacattattaatttggtatctctataccatgatccatgaggcatgatcatcaattaatacatgtgctgatcatataaacatatttgttccacatatgatatttgatcaaggatcctttagaaatagtaacaaacaacataaagagtctcatgaaagaatcacatattcattaaccaataaggagttatctatttcaaggaacaatgtcaaataaatatgtaaacatagtatgtgatacaatcatctctatgattgcctctagggcatatcactaacagtgcatgcctcgctgacgggtctggagtcgttcctcgctccaacccatattggagaccatcttctctattaaatcaacggttcctcgaaccgttttagagaagaatgctcctccagctgcctcgaccatgtgatggcgggacattggggtgagtctattataaaagttctgcaggattaatcagtcttccatcccatgatgaggacatgcggccacatactcctgcagacgttcccatgcttcccgaatggactcgtcccttgtctgctggaaactggaatccgtccatgaagggcattggttttgcccgttgggaagaatttcgagaggaatgccgtagaacatttgtcctaggtgttgacagcagcatgattggcgtagaaccactgcttcactctcccgaggagggagaacggaaacagccttagcctgacggcgtcgggaccgacgcccttcatggtgcacgtgctacagatctccaggaactgctgtagatgagcgttggcatcctcgttaggcttgccacagaacgggctagcctgtgccaacgtaacgaggctggacttcaagtcgaaatccacgtctcccatgttgatctgtggccaaatggccacattctcagcagagggagcagcgaactcgcgaagggtcttgtcagccatagtcttgaaggatgatggcgttggtacaactggtttctctgtcggtagagttttctgcggagcaatgactcgcgacctgatgctccggatgaaagcttctagattttccttgaagtttcccggcaagttgaaaccagtcatgcacgaccctgttttcacaacaaaagtgaaaacaaccaaggttatacagaggtaaatataaagtattagttcagttaatctctgttatgaatcttccccttcaacggcgctagaaatgctggttggtatttcttaacaacattattagaaatataattcccagcaatggcgcaaaaatacttatggtatattatggttatagagtttatccgcaagcgcacggatataccattgtagcaattcacccgagagtattccaagggtatcatatttattttatcccgtgggaagatcatgtagagagaacttgactaataatttatatattacttgtgataatcatattctaagcaggggttagaataatccaagggtagagtgacacacaagcattagctacttattctcataatatattatctaagctaagtggaaagaaaagagaaagataatctattcctatacttctaatatatatagtatacatacattcttgttatctgatatactagctagtaccctctatccgatgctctcctggtactctgagaagccacccctgactgtcgagttccttacgacagcccattatgaccatacaaccggggctaaataaggaggaatacccctcccagtgaattaacataggattatatacacacgcggaagaatacccgtactgagctattgccatcagcggcccacctctcatccacagcatataaccccaaataatgatatcctgtaatctagacaccacgtctaaactaccaaatactactcta

SEQ ID NO: 62901 - DNA, 10183 bp, Oryza sativa
ttcgaatagttttactctggccagagatgtatcaatgtatcactgtacccacaagacagccccacaacacgttgccaatgtatcactgtacccacaagacagccccacaacacgttgccatgcgcctcaataccaccacgatacctcggaaaggagctgtgacagtacccctcgcataacacaatccaccacaacgcaccgttcctggatcataatcaccccctcaattaccagaggcatggactccccagcgacccccacggacttctcgccacttcacagtctggcgccccataatgaattatactatacaaaaggaaatgccgttacccatgctagcttgtggttggcatggttaatgtttcacaacagtagctcgcgaaccgatccttaattgtcatgagcacgaccatcaaaactatacgctcacaacccaccattatcaagttttaattatcaattgattatcataacacgatttatcatcgtgagctacctttaaatatccagctttaggtaatagtgaagctttaggctgtgttcgcatgttcagcttgggaacatagtgcctccgcacggaaaatggagcgatccattagcgtatgattaattaagtattagctattttttttcaaaaatggattaatttgatttttttaagcaactttcgtatagaaactttttgcaaaaaacacattgtttagtagtttgaaaaacgtgcgctcggaaaacggaaaacgatggagaggggctgggaacatggggttgcaaacacagccacactaatgtttctaagcatatctaagtaactatactaatatatctaattgaaccattatatgaggccaactagtcaaattgtatcccaaggtatcaaggaataaggtaatcaatgcaaattggccgtagcaaaggtataagttcacaccaccggtgacattcgaaaataaatacacagttgaaataaatagagaatttaaatataggatcaacatgctcaaaggagttgtgtttgggatctatgtgacttgccttgcaataatcggtcttcaattaatcttcttgaacacttccgacgcactcacgaatcttcgcaacaacggaaacgatgagctaatacacaaaacgaggaaaaagactaagaaactccaaataaacagtacatataaactaaataaacatgtagatcatgattttagatgaatttagagacttaaacagccttattctgacttcatatgatttagttatgaattttacaagattaatctgattttagccttatatacagaaaaggatttacgatttatcttagaaaaggaaaacgggcgctgacgtcagcgatgatgtcatcacggacaggggcttccaacgatcgccggcgatctagggctcggcggcgcaaatcgaggataccggaagaaagagcacgacgacgggagctcaccgaggggcggcacgacgacgaacgacaacggaagacggccggcggcgaggtagaggcggcgatgagatcgggacggcggcgacggcggctttccgacaacgagcggcggcaacggaggggtggccggggtgcagctcctcctttcgaacccaacggaggtggcgacgaagctgggcgacgacgggaggagcagcggggcttcgccgaagatcaaaacgcgacggcgaactcggccttaacggcgacgaagggcttcccggggtcttcggcttcgggcagatggtggccggtcttccactcttcgctttggtcccattggaggcgacggcgctgaccggagatgtcggagtcgacggctacgaccgactggagcggcggccggcggcggagcgaggagacgagcgcgggcaggcggctaaggttagggaaaagctctggaaaaagatagaaacggaagaggaggtattgatactgctatttataggcaaaggtggaggaaataggctcggacccgtgaggatttggcggcggattggttaaggttcgccgggaaaataggagatgaactccgcttcgaatccaagcgatatacgatgggatttgctccgattcttgaggggaaagaaagaggaggataagggaagaaatcccttcaaccaatttgggaaacgagtcacgggatgcaacggattctacagaggaagcgggggcgtcgagttgcatgggcagtgggcacaggagctcgggttctgtccagagatagaaggagtactgtagcgataggaaggtgaaacagacttttgtctgggctaaaagaaaagaggcgagggacaagaaatagacttcttcgggaaagaaggagacagtaagcaggcaaagaggaagaatgggctgaagactggcccgaaaaggaaaagggaattttatttacttttccatttaaattaatcatggaaatgatctttgaattgttaaaaataattacaatgctcaaataatttcaagaaaaatcctgaaaataatttgtcgtgacacaaggtcacggacaagattggggatagacaggaaaaccccttttcctgcctatcctgagaaatgagcccgaataccaaatgatcacaccctgagtgacaagatttttagtattccaagatgtcctgtctgctacaggctttttgtctgctctatatagtacacagctttacatgtgagattacaattgtgctctttgccaaatgctttgttgggcccacatgaaattacaatcgtgcccctgcatatcaacagaccctaagggcattttggtacattatgggggtcattatagtcttttggtgccagctagatggagtggttgagtggtccctgggaatattctcttggcatctttattgtccaagtcgccttcttcatggccaagagtcttttccaccaacatggatcttctcctcgactaagggtcttttccaccactacgggtcttttccatggcaaatagtcttttccatctcgaccaccatttcggacttatccggtagctgatgtcacagcctgatttccgtttcaggatttataaattatttaataaattattattagaatttatattaaatgttcattaatttacaagtgaagttaaatgtgggaaataaaatttcctaaatataaagcatggctggatttaatttttattaaattctccatgattaattataccctctgaaattttctcggatttttcagagctcaattcctaaatgatacaaagaacagttcagtaattagttaatcaattaatgatctaattataattatgttaagtgcttttcttgtttaaaaatccttaaattataaattgttgtttaaaaggaattattagaaatgatcttaaaagcctaaaagagaagatctaattttaatttgttaaatctcaatataaaagtgggctagataaaattttgttaaatacttctcttgcttctatagttcctagatttttctggaatttatttgagccaaggaagtatttttaatcaatggaatatcatttcatgaataatttaaatagaaaaaggttttaaaatctcccttttggctttgggccgaaagtcggcccaagtctctctctcccttcccccggcctgcgcgtgctcggcccgttcggcccagtccgccgcgccctccctcctctctctcagccgctgacaggtgggacccacctgtcaggtcgtcttcctcctccagccaccaaccgccgactgtagccgcaagccgccgccgatctccttccaaatccggccgcctccttccttctccggccaaatcaattgaggggaaataatctcctcgatctcctcttccttttctctttaggaaaccgagctaattcgtttggaaatcgtcggattcaatgccgatttggttagcatctctttccaaaccctaaaaccttccatctcgctgccggtcgccgtgggcctccgtcgccgcctcctagcccctataaaaggatccctgagacctcctcaatccaccgtcaccttcgccttagcccgccaacgcttgtagcgccgccttcgcgttagctcgtgtgtcgccgtcgtcggcgtgagtccggccgtgccgcgccgctgctctagtcgccgccgtcactcggggaggccctcgccaggttcgcaaggtcgccgccgtccttgtcccgtcctccgtttccgccgcagatcatcggagcgccgccgactccgtcgccccgaagctctccaccgctgccgttggtccagccacgccgcgccgttggtccagccaccaccttcggtcgtcgtcgccaccgtcgggatcgcgaggaggagcagcacctcgtccacccctccgtttccgccgaagatcgctggaacaccaccgtcgtcgttgacccaatcatcgccgccgcttcgacctcgccgccgtcgtcatccgtcgtcgtttgccgtcatccaagagctcggtgagttcgccgcgtcgccctctacccgttggtgccctccgtttgcgtcgccgcgccatcgattgccggcgagcacgaggtgccgagccgccaccggcgatgacgtcatcgtcgacgtcagccgtagacccgtggtggattagatcgatcttggccgtccattttgtttagattagatctcggccgttggtttcgtagaccgcctctatgcacccggtctaccgtggaccatctttgatgacgcaataaatcccttttgcttttcaaaaataattcattattgcgtcataattcaattaaaatctatataaatgctttaatccggtttaatctttaaaaattcataactaattcattgtaactcagtttaatgtggttcaagttgcaaaagttgtataaaataaagatctacatattaaaattatccataaattgaattaaatttatttaatttttttaaatgggctttaattagattaaatcttgtaaaattcataattaattcatatgaagtcagagtgaggccgttcaagtctcctaattcatctaaaattattatctacatgtttgtttacttcttatgtattgtttatttggtttttattagtctttttcctcgttttgcgtgttagcttgtcgtttccgtcgtttcgaaggttctcgagtgcgccggaagtgttcaagaagactaattgaagacccgttattgcaaggcaagtcacacagatcccaaacacaattcctttgaccatgttgatcgtatatttaaattctttatttatttcaactgtgcatttattttcgaatgtcaccgggtggtgtgaacttattcctttgtatggccaatttgcattgattacactgttccttgatacattgggttattataatttgactagttgagctttatatattggttcagctagatgttagatataattgcttagccatgcttagaaacattagcacataattgggataactaatgtttcactattacttaatggtagagatttaatgatagctcacgatggttaatcgtgattggtgaattaattaatgtgccaactaaaacttgataatggtgggttgtgagcacatggttttgatggtagtgctcatgacaattaaggaccggttcacgagtttcggttgtgaaacattaaccgtgtcaaccacaagccagaatgggcaacggctggacactttgcatagcaaggctcatcgtggagtgccagactgagaagtggcagagataagcccacgggggtcgctggggagtccatgcctctggtttttgagggggtgactacgatctaggaacggtgcactgctttgagttgacatatgcgaggggtcttgtcacaactacacaaatggtgacatgtttagcatgggcacatgatgatatggtgacatattgtggagttgtgtcttgtgggtacagtggtacacctctggccagagtaaaactattcgaatagccgtgcccgcggttatgggcgggtcgaacaatgtctttcgtgattagtcctacactactcattaataataatgtggtaattgatggtaattaatttagctcctggtttggaatggtacattcctggtttggagatagatctgtgcagccgggtatggttgttcaggatggttgggcctgtgcagcatgggtgtgctgttcagtgttgattaatattgatgattaattactctactgttttacaattcttaaatattttctaaatgctggttttgcaaatgaaccctatattatgccatcctttggtattcttgtgcacttgcatatttgctgtgtggcttgctgagtatgtcatatgctcaccttgcaataatcaatcaaacctcagttgaagacaagttgcgaaggagaagacgtttggcttatacctcagttgagctgcctgtgggagtggagccggagcttcgctagactgtaattccgctgctatttttcttttcttttgtaagtatttacgttattattatgatgaatctgtatattaattgtcagtttgtgtacctcggctgattcctggacgaggatttaatgcacaaataaattcggaaattgctagttaatttctgggcgtgacagctgacctgttattaactcaagaaatacgcaaaacggataatgagacttagtgacaaggactcactcgaacggtattttccgactcgaatagtgttttccaactcgaacaacattttaccatttccttgttcgaatgaccatttgccactcggatacttagaataaaaactcaatcttacccaatctcttcctctacagtgttttgggccgaatagagaggaacggtggtgacccctagctacaacaagcccctcacgggtaagggcgaagtgtgttttcggccgaaaccgtgttcgaatcaaaagctaggggagaaccgccgtcctcctattcagtcgaaaaacactaggatagaaaattttgaagttcgaaagcggttattcttgtcagtcattatgcatttatttgtttattatatatatatatatatatatatatatatatatatatatatatatatatatattgttatatgtatacatattctttatgtattgaatatgcacatttatgtcaaagtttgctcaacaccatgcggcagtttgatctgtagtcaaagcttttcaagtttggtactggaaaaagaaaagctatgaagatacccttgcttctctctaagcatcgttggcttcgagctcacacaccgcacaatcctcttggagtcaaccagacaacggtggtgacgctcacaaatctgattcacaggtgtgaagttattttagggaaaactaacttggaaaactttttggatatggtcgaaaacgcttgttcttttgctccgtcgaacctattgtggttgggaacttaattatgtatattttctgtggttgggtaccatttgctattttctctgtatgcctgtgcttcatcatcatttcgtttttgtcggggaagcaggtttatttgaaccgaaaagttgtggttcgacgcaacaagtatcattcaactcgaaacatgaagctcgttgcatttcgaacacacgagaagttgctcttttctaaagcaactaaatgtgatgatgaagagaaggaaatacattacgatgacacttgtattttttctttaaaatttttccaatggcaaagagaacatcgagatggtagtttgcgtgacttcgttgtcgagtttagaaaacggcgttcgaataatgcttcgagcagcattaacttttggcaaacttttagaccatctgagcgtcaacttagaatatggaaaaggcgctactcaattgtcccttacacgggaatgccttctcctctcaatgtcatttttcctttttcttttccttttattccgcaaagactcgaatcagaaaagaattcgagcgtttagctttggtttttgaaaaccgccgtccccctttcctttcgaaggagtgacgaggtcaaaatcgcactttatcttgtcgcatggaatttccactttctgctcgaatcggttatgagtgtttgagtgtttcatcgtttttttggtttttggacgatggtaaaacttgttcgaaaaccgccgtcctccttacctttcgaaggagtgacgaggtcgaaatcgcactttacctcgtcgcatggaattttccactttccactcgaatcggatatgagtgttcgggcgctttatcattaggtttttggacgaaggtaaaacttgttcgaaaaccgccgtcctccttacctttcgaaggagcgacgaggtcgaaatcacgttttacctcgttgcgtggaattttccactttccgctcgaatcggatatgagtgtttaagcacttcatcgttaggtttttggacgaaggtaaaacttgttcgaaaaccgccgtcctccttacctttcgaaggagcgacgaggtcgaaatcacgctttacctcgtcgcgtggaattttccactttccgctcgaatcggatatgagtgttcgagcgctttatcgctaggtttttggacgaaggtaaaacttgttcgaaaaccgccgtcctccttacctttcgaaggagcgacgaggttaaaatcacgctttacctcgttgcgtggaattttccactttttgctcgaatcagataagggtgttcgaacgctttatcgttaggtttttggacgaaggtaaaacttgttcgaaaaccgccgtccttcttacctttcgaaggagtgacgaggtcgaaatcacgctttacctcatcgcgtggaattttccactgtttgctcgaatcggataagggtgttcgagcgttttatcgttaggtttttgggcgaaggtaaaacttgtcgaactgcgtggagtgctttttaacctgttgtcaagttggcttttcttctccgaagcgtgcggaggattttctcgatttgttatcgtgttggattttcctctccgaagcgtgcggaggattttctcgatttgttatctagttggattttcctctccaaagcgtgcggaggattttctcgatttgttatcgagttggcttttcttctccgaagcgtgcggatgattttctcgatttgttatcaagttggattttcctctccgtagcgtgcggagtattttctcgatttgttatcgagttggcttttcttctccgaagcgtgcggaggattttcttgattcgcaaacacatatacaatccattattgataacaccctacgtcctgtttatatgtattaacaccgagaagaaaagagaatcttacaaggtggtcggtattgtacacttcgagcaacatgtttcccccttttttttttctcttttttttcttcttccttttcttttttttacacatagaacttcttcaaggaaacagcattccaagtatgcttaattcttctccatcgaggtgtgccagcttgtatgctcctgttttaactttctttttactatgaatggtccttccaacagccacttcatttagtgttttcttgagggccaaatcaccttcttctatttgcctgattttcacttttttgttgtaatagcttttggtttcttctgtgttttttgccattttgtctaatgcttccactcttatctcgtgcaacatttccaaggtgatttcccttccttcttcgtctttttgatcaaacacaattcgaggtgaattcgctcccacctcgcttggtgtcattgcctcatctccatatattagcctgaatggagtcatgccagttgatcgaacaactgttgttcttaaagcccaaaggattgacaacagatcttctggccattttcctttggcagaaccttccagccttttctttatggcttctactattttctcatttgctctttcaacggcaccatttgttcgaggatgacccacagaagcaaagttgatttgcaggttaagacatttacacatatctttgaactttcctgactcggatcgttttccattatccttgggtattccaaatcggcatatgatattcttccaaacgaatctttgtaccgaagcagatgtgattcgtgctactgcctctgcttcaatccaccttgtgaaatactcaattgccacaatgacaaaacgtaaatctccttttgctcttggtggaattggccaaactggtggaattggttgcaactctcttggtggtgcttttgacgttgcaccaaatttttggcatgccttacatgtcttaatgtacttct

SEQ ID NO: 62902 - DNA, 8277 bp, Oryza sativa
ggacggagggagtagtgcccattttcttttgtattttccaagatgttagttattaaaaactgaaattgtactgtcaatactcaacacctataatgaaaactagaggatgccaggaatccatggaattacctttaactgaaaacattctatgtgactatatcaatgaatacaggataatgatagctgaaacaactaagtagactatgcatttgccatcatggttgaagagttcttttctttaattaaggttttgcatgtttctattccctgttactgttctgacaaaattttaaaatagaataattcttgctggattttatctcttcatatttttttcctcgataatatatttattgctcctcctatcaagtgctctgtgatgtgtaacacaccttcatgtacttcaattaccactacagacccaagaataccagccagagataactcctgtgaaagctcaaggttcaaatgaggagaccaatggcggtggttacagttgtgatgttttttctctggatgagattttgcaggaacctgaaaatgtctgcaaaaatgaagagcagaatgccattgatgacaagttcactatcgcagagttatctggatacccaaggcaagatgatggctatgtaggcgagaatggtcctgtgaattggattgacccttcaaatggtgataatacaaactggcctttgagagcatatagtactcagaaccatgtcaatggaacacttagcgctgatggtttctttgacacggtgaatggtaccaactcatattcaggtccttcagataaccagaacctgtatttgcaagatgatggcttgacttcttctcatcaagtgggcgataacatgccattttatgacgcatcatctaatcacaaatgggtagatggaaaggatgattatttgaatttgaatgacctcctctacccgccagcagaaaatcaacccctgtttgatgctggggatgacctgatggcttacttcgatgccacggaggatgatttcaaatttgatattatgggcacagaagattctaattctcaacttccagacatgtcgaactttgtccaaaaggtatgcttcggtgcacgcatgtcacataactatgctacagttctcttacatctagttagaaggacacttcctgatcactatccttctttgacttctttctggttatcaactgttgtattattttctctgcaggatgataacaacaataagtttacattagatgggatctctaataccgctttgtatggtgcttcttcatctggatcccatggcaatatgtatccagacactgcagtaccaggtatggctttatcactatatgcttattagtaactattttcatctactaaagtttgcccattgctttgggggtacatacaagcatcttttatgaaatgtgaccatacttgcatctaagtctctcttctttaaaaatctcatggaactactttggtccagatatgccgatggatgacactgttgacaaaagtttcggaaagcgccttgccagcatgctgggttcaattccagctccacccgcaatggcttcagagttcccgccgagcacaggaaaatctgttgtcccacttagtgctgtcaacccgagtagctctatccgtgtcactgcaggcattatccaactcggtggtatcacttttactggtagcaccgagcacctgcagaagaatggagatttcaatttgctcctctctttcactgtcgagggcgacgtctcaaccaaatccattggttttgaaccggatacgcagatgagcaccacgccaatggtgttgcgcagcggcatgtatcttttcttcgtatcggcgatgattctcatgttgagctacaaagttgggctgtgtatctacagcaggtaagttatagtagtttttgttgccccaggctgtttattaaattgaaggagtcatacagagtccactcgacgtagagggaactgcctgcgatttggacagtttggttctttacattgttatagttggtataccgttctgacagttgaaagatacatagcaataaactctggaattggagaaactagagttacacgaatttggtgctgaaacttttgttggtggcatgtactgtataatttactctatttatttatttcacccaattctgggaggctgtaagcgttccccgatcgatgtaagctgatctgaaacctgaatacgcgctcttcatttttcatacccaaagggccgagaggcacagtttgcagttactgttgatcaattttcggatggaaggaattttgcgttggtgtgattatgtgcttgtttgtggtgttgtcagaaataaaccatgaccttgtgcgtgcttcatagttcaacgtgttgcgctttggagattggcaattgcatatgggaacagacgcactgcatgacgtacatatatgtaagaaacgcatagcatgatgtacacattggctatattacgtgccaatgttcgtttatcttcatcgaaaaaaaaatattatcacaaaaacgtgaaaaatctttcatacaacattaagaccaaggtggcaattcactgtaatcctatacaactaacagtatactctggaatggaaaatatatttctggcacatatgagtgcactgcgcttttgcttctgatttgttgtgttgtgcccaaacaagagaggctcacaagcacatggcaccgacggtagtacattgccctagacatgtgcggttgtgccttccttccatcaagagaaagacgtcaaattctctcccatctccagttctccatgaccgcctttcgcacatttcagtttcagcaccttcagaactaaagaataaattcgcgtgctttccctgccatcccgcagtgccatatcgtttcaaggaggatgctgctcggcaaaaaattagtacctgctgctgaggcactatgaatgaagttcatgtcataacacaaggcaggagaatcaatccgcggacgaaataatcgcaatggctgctggctggggcactatgaattttctggaaagacggtctggatgaacttgaggaaacgctccgagtagaactgggggtccacggcggagatggagatggagtcgtactgcatggacttgacggcatgctctatcttctttgacatgttgtactcctgcaatatgtctatgatacccaggtaaaggaccacgtcgtacacctcccgaaacgatttgctttcctcttctttagggttctgctctgcccttgcaggcatgttaacccctagctggatctgcagcctgtcaagtgtcaacacaaaaaaagagtaagacacctgattggtaaccctcctactttgggatgaagtgcaacatgaggaaacttttccttgtaatggaatgcttggggtgcaagcaactcagagccatggctgtaaagagggttttcccttttctacaggggaaggaaaaggaaagaagatattcacctggctgtaccagaaagtagtagatctacttccgcaaatccagcggctgttgatcgtaaacggctacctcttatgtgagggccaacaaccacactgttttcatcaccacctctttgaaccaacactagaccttccgggtagttgaaagcatcgtcctctgagcgtctgcaattgtcgattataaacatcagctcctcaactgtattaacaaaatatattatgtaccagctggaaaaagtgtccacttaccttcttctgaaagaacagttaatctatctgctgccatgcttcgatgataagatgcacgcgtccgaaggtgctggggagctctatagtgcacaccaagcaataagctgtaatccattatccgttgggtccttagaaattcactgtcagtttcaatctgcctgaagagaataataataattgtcaaccactgttgaaaggttgcgtgattgctctttgtgaaggaaaacatatgcaagaaaatggaaccacagcagcaacactgtacatgtgcgaaaattggtactttttttggtggacaccagatcagtgccaaaaccagataattttatggcaacacattgcagaacttggcatgtacttgacattgttttaaatggaaatgggtcattacatccatgaatcctctatcatacatgggctatctatttagtgacatccttcaactagttaaattttgtatttagaggatatacaagttgaacaacaatttagaacaaaaagatatgttgatttggcagcaagtataatgcagttacacaacaaaccatatcttagaatgataattgcatgagaaaatatgctcacttaagtaaagcctcacgccaggaaggttcaagataaaatgaatagttaagatccaaatccttcagagttgtgttctcatcaatttcgattttgtcagtagaacggcctaaggatgaacctttcaaatcaaatctccgatgaatcctcaattccgtgcaaaacatgttacccattacaacaaagcgaaactgcaatttgcaagtgttaaggattgtcactgcgcaagaaatgggattggagctaaagaagtgtagataaatccgttaccttttgaccactagaaggcttcaccctgtggaggccaaaaaacttagttatgagggtgttctcataagtacggacatgatggtaatattttggaagcattcgtaaaagaacctgcaaggatcatatagagtcatgaaatgtttttaacttccgcttgctaagtaggtggtgttacttataatgtataatttatcgaagaatctaccattaaagaattttctagcacgcttatatgatctctgaaaatttaagcataaaacagaacctggacttcagatttccgaagagtcttgatcatgaatcgatcatcttgtgataggaaaaagacacttccactctttcctggagaagataactccctaagtgcagaatttccacatatagagatcatataatctgcagcatcaatcttgaacatctccctcaaatttctacaaaaaataaaataagaacaatggccattttaggtgtgtgacagaaagaagagaactataagctagaaataagaataaaaagaaaagaaaaaaggtacatagctacgttcagattaagtgatgataactacgttaggtgagtatgccaattctaaagatcatgtaaatctgcagaataagtgtatgggcatatcttagagatgtacattgggatgaaagctaaataagtgcaatgaacctgaaaaccatgggacaatagtccttccatttgaagtcttctgcaggatgtgaaggagtaagtcgtgatccttctttggggaaggtcatccagaaacttgctcgtggaccaaaatctgaagcacggacttcacgtttctgaatgggcgtaatctttcctaccgtgtacctaaacacaataatgcattgatcattataggatataattattactgatgtatcaccatcatattgtcctactaactaggaaaactctcattttaacttaatagatgatgcaatattttgcacgaaagttcttaagagcaataaaaagtgctgctagaaatactccctgcttaggccaggtgctgtatcttagaatccaaaaaaactactaccagctagcaaataaaaaaccttgcattctaacttttcaaaaggtaaatgttaccgtggacactattacgcagcacaagcattagacaactagagggacctgaaatagttctgttatagttttaggatatgttgtcaagagaactagagaagactatctataaatgaaaacgatcaacagaagagagtaggtcaggacagtattagtgggaccaaagaaattaacgaacagatgtcattcaaatcttgcaactacgatgccgaactcagagggattacctgattccaagctgtagactgagcataagatcatagcttctgtgacccttaattattgtctctcctggcttttttgtctccctaacaattttcttctggcgccgttttgccttcttggacgaatccgaaaaactcctgtcaagtactacctcgctgattagaacaccttgcatatattcccgttccagcataggcagatcagaatcattaatgctttcagatctttctaggccagagcttccagttgcgtcatggccaatgaatttttcaatggccacctcaaggctccaccgtctttccaaggatacatttttcgaatgaggttgctcacttgagttccttctagatgaaggacctgaagattcccgagttaagccaaccttcatgttccccatgtcaaccgaagaagagtgaaggatgcgtgagccgtgattctgccttctaatgtcaggcagcacacctcggtttcttagattattgatgtagagctcatcattaacaggaactctgcaaccttttggatagaatgtgcctttcccatccttcagtcccttggtccaagtaccaacataatacccacactcattccatgtatagattccatacccgtgcatcatgccatctaaccagtttccttcatatgaatccccatttttccaagtaagagttcccttcccagacatcttgccattcttcatattgccaacgtaagtgtttccatttgcccacgtatacttgccatggccttctatttctccctgaatccaagaaccgtcaaacatgtctccattagggtacgtctggcatccaagtccatgcttacgattcaatttccaccttcccttgtagacgatgttgtcagacccggtatatgtgccttcaccataaatgtagccaccagagtactcaccctcgtaggtggctccagatggccacattgtctttccttgcccatgcctcatccctctcctccactcaccatcgtaagtgcaaccatctgaccagacatacctccctgaaccctctggtgtgttccccaataatgtgccgaaataaatatccctgttggagagcctgatctctccaactctgaagccagggtttgttccagaagcatgagaatcttggccatttgctaaactggacagtacctccttttcgatattgcaactagcgtctcggaacagctctactctttgagaacgggagatcccttctaactcatttggaaggactgcaggggctgtcatgcataaacccactaggaggactaacccacagtcgcgaggaagatactcctaagcacggcctgtaaagaaaagttcacgagacacatcagtaatgtaacctgtggaaacgtatccaagtgaggataaactgcgttacaacttatcctattgcaatattcatagaaagaaacccttcacaaagaaattgattgtgcagctttaactagaaaatgagagacagtcaagatcaggtgtacaaaaaaattagatgaaatttatattccttgaaactacaaacctaactaatcggagatgaaaatcgttgtagtacacgtcctgtaatcgtatcatgactattattgtccagatcattctgttgatcgtcacatcgttttgtgaaggcaaaacagtaaggacaatggtaatcaacagcagcactaactagtagtagcagatggtaagaccccacccacggtcgtttcctcaattgtttgctgtaggaatgtaatcaatcgggcatgaaaactttagcaacaaatttgggggccccaaatgacgtgagcggcagttgggctcatacgcacagcaaatggaggagtcatccaatatccatcacagtggcattcggagcttgcagtgagttgataaccaggaaaaaagtagtaggcagcaggacaggaggtgtgtgatccaatcgtgcgtagtcagtaaaaactgaaggttagtcccctcgagacaaatccttgggagtggagagatattgtatctagtaaatcaaaacagaagagggtattgttcgaaattcagaagggaattacggctcggaatgaatctaatcctaacccagcctaaatctaaacatatacacgcagcaaacgatcgtccacacaaaaaatatatagtagaggaacaaaaacgaggaaaaaaaaacgcgtcaacgtgcaactgatttaggagtaggggaaaaacgatggaaacgtgtagagtagagtgagggggatccataagaagcgggggttggattcactcgctttgggtgatgggtatcatcatccgatcaaatcaaccaatggatgaatcatgagaaggcaaattcgatagagcacaacacagacagaagtcagtgagggattcaattcaa

SEQ ID NO: 62903 - DNA, 32139 bp, Oryza sativa
cgtatatggatcccactcatccaaaattatgtagtggtcacaaattacactggacgatacattgttcgggtgcccacagttactacatagttcatgaaatgaagccattttttttagttgatacatttatgttttggtccctgcagtctttaaaaagatcactgaacacccttttttgtgattttcagcagatggaatccatgctcgggaagatattgatactctaatttagctttagctaacatgcattgaaagtctaatggtagggtggttattggttaacagaggcagaagatgtcactttttcaaaggtaatcatcggttgcttgcttgcttgcatgagcaggctagcagacaagattgtcaatagtctctgttcactctagccatttctttattcgacatgagtttcatgaatccttctatagattccttggagaaaagataacttgtctatacaaaaatcaggcaagtttcaactgaccaaaagaactatggctgtctttagatccaaaatttggatccaaacttcagtcattttccatcacatcaacctgtcatatacacacaacttttcagtcacatcatctccaattttaaccaaaatccaaacttttgatccaactaaacacagcctatatcgcattgagtccatatgaaaaaaaaaaggtgggctccacatgccaaattatcagtgatccaaacacatcatcatctaatatgcagagttaactggaccataggatggaggatcatgagctctacttgttgtcactcctgtctcctccctacaggaacatgacattgacactggcctgcctaaaatccatattaaaaccctctcatccttgcccctctctgactccctctctctctctctcacacacacacacacacacaaactagagacttatgccatgaggaggttctccaagcagcacctggtccctttcattctgctcctgctacttgtcatgtctcacttgccaatctcaagccttggttcaaggagagcattcagagaagaagctgtcagtggtttcagaagccatgagcttgctccaaccatggctccttctcaagagaaagaagcaggcgtcgtcgccggcgccggtagcatctgtggccagaagtatgctgtctcaagaagaatggttcctcagggaccaaaccctctccacaactgatgaactcatgcactgcaatctgccgtgatcatcagcttctccaatacaggtgaatggtgcagccatcattggttacctttaagtccgtctgcttaattaactagatatttcatagtattttatcacacaacgaatagagatgttcagtagtacaagtgatgtacctctcttttgcaatgttagcctttgtgtatagaaatatgaagatgcataagatggattgtgctgtagcataaattgaaatttgaaggctgactgatgtgaagatgactgtttgtttgggttgcttgtgctgtcaagctagtctcaagcaggtgtaatgtatctcggttggatgtgtgcattatcttgtggtggttgaaggtcttccatcaccagctaaaagcaaacttgtgacagagatcagtttcagtctgaacactcgttaattaagctcgtgcatgtttgtatggctaacatgagaaaatctggaaatttttcaagcacacattttccatctatatctctcttctccctctggatggttaagttttggccatgtttgaattggataagggattttagaggaggaaatggtggcatgtatagtagctggtgcagttggtcagcaattcccggaggactcgctgaagagacaggagattaggtacgtagctgcatttgtttagtgatttcgttcacgtggatgtcagtgcttggtcatcgataatcggcgatggcgaagcatagccatcactactccaagtgtttgtactcctgctgcagttgtagacatgtagattgtagtagtcatatttagtcaaaggtgtgtttagttttttgtgtaaagtttttaaagtatacggacacatatttgaagtattagcctgtgttcgacatccagttttattcaacatctagtttttccgacccttcttcctcgttttctgcgcacatgattttcaaactgttaaacggtgtgttttttgcaaattgtttctatacgaaaattacttaaaagaattaaattaatctattttttttaaaaaaaacttagctaatacttaattaatcacacgttaatggacagctccgttttccgtacggagggaatgagtttccaacctacatatgcaaacacagccttaaacgtagactaataataaaacaaattacagattccaactgtaaactgcgagacgaatttattaagcctaattatttcgtcattagcaaatgtttactgtagcatcatattgtcaaatcatggtgtaattaggcttaaaagattcgtctcgcaatttacatacaaactgtgcaattggttttttttccacatttaatgccctatacatgcgtccaaatatttgatgtgacgtttttggccaaaattttttgggatctaaacaaggccaaagcaagttcgagatccgaaatggatactacttctacctgtaaaagagtacacttttgcacacaaatttaaataagtgcatgtatagatttgtgtagaaaatgaactccttttttacggaaggtagaatctggtaggattcgccattacaaaacagtcttcctacgctttgagattttgcaggcatcagtagaccaacgaatatagcatgttcatcgcacagaacgagctactgcctctgcataaccaaacgcacattctgattctccagatacttcagataaatcgaacaagatctaagtattgcattcctttcttatgaacgaaacgaagaaagaattccattcagcaacatgtaaacagatcgtcaagaacgattacgacagcaagaggcaaacatctcaaggcaatatattgcaatttacctacaaatgcaagtctgaaacgcggactaatgatcaccccaacgcgtaggcaaccaggacaattaaaaaccttaataacaatcaattctatcacagtactagcagtacgaaatgtacgacgattagcagcaggcatatatcagagccaggtgaggtgtgagggcaggcgtacagctcatccaataaaagagagcagaagaacatgacgacagtgacataacttcacattgaagggcattgcacggttcagacttcaggcacaggccgacaggcgcctctcatctcaacgcaacaacgcgttgtctgctcccaaacacaagagggaaccagtgattaacatttaacagcatggcaccacctatgtcaccagcaattcagacatcatagtttccagtcacaaatgattctgacagtattcatgttttttttttgaaaaaaaaaagaaacagctgattctgatctactggtttcatcagcgtctcagctcagtttcagcaacaaaagattctggtttcccatgagtcatggtcagcttgttcccttcatcactgtccaaaactctggaaaaatccagtagtgatgtactcatttctttcagtcatgcacagttgttatgagatttcatggcaaaaataattgcttgggaatcaacattcagtgataagcactcattgtcagaaacgtccacactcatctacaggcatcagccaacaaaaagagactgacaagcttatccaaataagcattttggggaagacatggaaaagacatgaaatggacctaaattccttcagcacttcaataagttattcatcatgtctatcgaagattgaacccaggaaaaaaaaatcaagcaaccataatacacatggttatcgaaaggacttggagtacatgtctacagacaggtccagaaatgtgcaaaatagatgaattttgtgacaaatgtgcaaaatagatgaattttgtgactaagtaaagtcttgaggaaattagtgcaaaaacaaaatttactgaaacggagaacaatccatatgccttcctgcaatagcatgatcaggcaatagacagaattaaatttgcaagtgagcaaaatgtacttggtcatatgcaattgtgaactgcaacacatcacaacaatttctttgttatatttcttatatagcacaaggaaggcacaatatataatcaccagatgaccatattttatatttatatgaacaaattaacccgaaagatttggttaaacaggggatccatcgtgcgaatggaattacacaagtaatattgctcctcggcttgttcatttcacaatcataaaaccgcaagtgatgaatatatatattgcatactaaacaaatagacagaagaagctgatggatacgggtgatttcatgttcataatcacaagatagcagcaagtaataatagatacgatgatttgattgattagatataacgcaatccagtacaaaaggcacacggatattcacagccggaggcagaaatcacgataggaaagacagatggtttattgtttggtttgtcacaatggctaaagatagcattcactagcagatggaattggaagacatggagaagaccaagacacatactagcaggcggcgtctcaagtaacagtagcgtagtcatacgggcgggagcttgtcgtccttgtgcttgtcggcgtcggcggcggcggcggggggatcgggatgggcgtcggtgtgggcgtgggcgttggcgtcggagagcacgagggggcggtccttggattcgtgggcgtcggcgaggtcgtcgtcgtcgtcggtggagaggttgatgcaggagcagcgctcgagggaggcgaagaaggcggaggtgacgctggcgcccacccagcttgcccagctctccatggccgccgccgccgatcgatccgcaaggctagggtttcgtcgtcgtcgtcggtgggtgagtctagtttagtcaaaggggaatttgaagcgaaggggagaacgagcaaagcacgactcagccaaacacgccaacggagaaagcggacacaaggcgagcaggcccatcggcccaccaagcccatagatgtacttcatgggttgccttggggattttgacctcctccatccgaccagtagtagtacatgtataatattttttttccattttctctgaaacaaaaaggataatcttccaagctgttttcacatccacacaaaatggcttcgtcggagaaattaaccatacgattgcaatcctacggttaatcaatttctatgttcgcttttggctgcatctctggatacctgtggcctttcctttgtcacggtcacccccaccatgggtagacacccattcccaacttcccaaggcaacaagcacaaccacaacttctcagtaaatccacatgaaataaacataaatgatgatttggcctcaggccggtaaatgttacatcggtgctgcacgatacagatatatatgttggtgtctttctttgtagactcgctgtctctgtatatatatcatcactggctctagattaagacttgagcatcttcttgtagtccttgaacgtgcctgcgaaaggcgacaccctgccttccgacaccacccaaagctcatccacgctccccgttatcaggtgctcgtcgtgactcacctgtaaaagataacaagtcacccatatagcttgtaattagaatgatgccaagtcatcagcttttacaccaaaatgaacgatcttagttttaccattagcactcctccctggaaaacgagtaaaccctggatcagcgcctccacagcatccagatcctgcaacacacacaaacaaacatgttaagttgtttccctatcctcgcgtgtaaatcatcgctactgaaactcccttacaaagaggggaaaaaagatatccacctaaaagaacatataaaaaaaaacagggtgatttacttacaagatggttagaaggctcatcgagaagaataatgtgtggcttcttgaaggtgatctttgcaaaggcaaccctacttttctgaccacctgggattggaaaggctctaatcaggactgacaaatttaagattctacgagcagatgaatcattgggcaagaggatagttctcaatttctcatgaaactgggaaaggccatatgcagcctttaatatgcttaagacatctatcaaaacgctctcattacctgataaagtgtacattggttggagggcaagatttcctgtaacaccgaaagaacccaagtgtgccctcagtttctgttcaggtacaccctgcaaagagcatataatacattttttatacttagatcaacgttaaatgacaaacagactgtatgtttggtgatccatacactgtgaacttcatggtgcaacctagcaattgttgctggatgtaaaggaaagataaaaatgatgcttgaacttacagggtagcatctcatcatgtacaaaagggggttcactgttaaatcaagcccatcaacatggtgttgattgaatacagccatgcgaacctgcaaataacagccgcagcaataaataaatcaacaaaccgcagataagatgtagcagatgaaactctggcaataaaaggttatattataacaaaattatcactagcaaagtggtcaaactatacaggtaagaggcaaaatacattcaaatataaaggtccaggttcagagttctctgtttaattcagtaatgacattgatacagacaggagaatgtacactccagaatctcattataaaactattgtgaacctccatggctccatgtagaaactatgcaatcatgccaatcagaattaatgtaatatcggtaatgctaagtagtgaaatgtcatgactgtagcttcagaaggataaaagaaccttgggagagcggaacactgtccctgaagttggctgaagatctccagatattagtttaagtatagtggatttgccaataccatttggaccaaccactgaaataacagatcaaacatgagaccaaaaaaaagatgtatcgtgcagaaatactaggtatcattctttgttagtaagatgagtgaagcaaagcaacatacttgctatgcggctgtccaggtcaataccaaaattcaagtttttaaataaggtggggcctccaggataaccaaaagatgcgtcactgcacaaacagatcgtaacataaatacctcagaatgtactaactgctagatcttaataagaaagctagaaagaattacaaatatagtagcaagccagagaacaagaaaccatggttgcacatgggaagagaacaaatttcgttaaacattgaaagaaaacatatcagaaatgaaacctgaagctgatgattggtggtccagggcggtcatctggtgttggaaattcgaatttatagctgcaaagaattattcaggcaactatctaagctgattgcatataaaagaataaacacaacagatttaagatgcggtgatatactctggatcactgacgaccgcatcaacatgctccattcgctccaatgccttagtgaatacagataaataaatattaaggcacagactaaagttatcactggacgactcttaagtgaaacaatagcaaaggtaatatttggatttgcagaaattcaatggagtgatgggggatgtgagcaagcaaagtcaccttgattcttgattgaacaagtgatgctctctttgcattgtaacggaacttgtcaatgaatgcctacacagaagaaagaccaataaacttcacttcgatttttcaataaggatttaattgcacatagtagttgaatgttttcagatagcccaattaagcttttgaattttagcttagactagacaaacagttcttctgagcttagttaggtctctcaacgaatttttgaggctatggtacttgctagaaagtagaaacagatccaacctgcatgtgggatctggccttctcatttgtttcaaaagctttctgctggttcttaaggtgctcctcccttgtcctctcgaatgtgtcataatcacctttgtaagcatgtagcttttgtccatgcagatgaagaatgtcggtgacgacctaagaatttattgctatcagcattaagtgatttacatgacaaggaaaaaaatgcacatgcaaatatactacatatgaattaaggacgctctgtcaaaattagctccttcatgataatatgacatgatcataatcatcatactgcataccgtattaagaaactccctagcatgtgatacaacaatgaatgtctttggccatttcaggagatatgtttctaaccataacacagcatggagatcaagatgattctgcaaaataatatcttgttagcataggccagaaagagatgaaacaaattcatgtttttaaacttactgttggctcatcaagtagcaacaaatcaggctcaatgaagagagcacgtgctagagcaattctcatgcgccatccaccagaaaactgttttgtgcgtttacgttgcatttcaggagtgaaactaagaccctggaaagagttccaccaatcagaacatataataaagtgcgtactctggcaagggcatattctactggaataatcaggatatgagttatgaaatgttcaatttcatgcaataaccagcaagaaaacgtgatagcctgggataaagattatttgttgttgaaagtatattgataactaaatgaatgataggtatgcaaccaatgtaactgcaacgagaaaattggaagtgaaacaaaagatacaatcctacatagtacaaattgtacaagcaagaaaaaataacaggtattggatgcccagaaacagaccgccagaattgatgctgcacgagcctctgcagcatcagcatcaataaactcaaggcgtttgtatatctcctcaagcctcttgctgatagcatctttgtcaagaccatccttgcttttggacgcgctctgctcaaactcagcctcatactctagatctttctgcacggaatcgccaaactattagcaaagcaactgaatggctaaatataacaggacatacatatcttaaaatgttaattctgcatttgtcaacctgccgttgaaccagatgagcttcttcttgcaaaagttgaacccgttcaatatcagcattcagaacacactgcaaagctgttgtgtcatcgcccacaacctcttgctcaacatgcaatatctggcagttcttgggaatcccatcaatcgcatgcatcgccatagctctgagaaaagaggttttccctgtaccatttcttccaacaagacctgaagtgtgcatggaaattatcgaaatcattggggtaaaaaaaaaacctggaacttatacagaaaactttcaaggcaagaggtgatgaaaagtgcaaagataaaaagcacatcgagggtctgaaccactgactagtacagacagaattaacaagtttggcatttgtgcaatttagttttggcttttggtaaagcatagacagttaggcacgctattaaggaaaagtgttgcagagatatgtgtgacttgacatatacgattacaaatgtttcattcttcattcctaagttattcatgccagctacgaagtgaacaacagctcaagaagaaacctatgctgtaactcaccatagtgcctcccaaaagcaagtgttacagtgcaatcttgaatgagatcacgaccaccaacagtaacactgaagttctccatatggatatccctaacagctggcccaccagagttattgtgatttacaaatactggaggcattccagccctaagtgcctccatttcagcaacatgcgtttggtattgagcctgcaccaataaaaggacagtgtgcaacaagataacatcaggaaggaaagcatctccagcagcagatatacttttgtcacaaaaaaaaacacttccaccactaatctttttttcttcaccaaagacaagcacatcatcctctggtagtgtaaaatgatcaattgccaacatagagaacagcttacctctctttgtctctcatcctttctcttcttccgttcaatcttggctttgtcacgtgatgaaagcaagggtccatcaaatacatcagcttgctttttgggggcaaccttatcgtccattccctcgttcatacgtaaaggagtgacaaggcttcgcatagcttgtttaggttttaccaggccatgctttccaaatttttcacaaatcttactgcagacctatattgaaaacaaaagaaaatgcatcatggtcctgctaaatcagaatcagaatacaggagttccttgttttccctctcaatgtttcgtctttcaagatagttgttgcagctctcttctggccaataaaaaaattatggaaacaaatagaggttgagtaacatagatctaacagaccactacagaacataagcagtgattgatctacattgttgttgcccttggaagccaactgaatattattcataaaatgtgagtgctaaagaaggttctctaggcatgtggaatccacagaagatgagtcaagtgcttattaaatggatgacacaggcacaaaaatcgaaacaagctatagcgaattttagtagatgagaagtagccatacaaactgtgggatacatgacaagcaaatctaaagctctgctcaaacgggcgatgaaccacataagcatccataccacctcaatcacagcactgatcaagcgaagctctacccaattagacaaacatttaggctactgttgggcggacgacgatctgatcggtggatgggggattgcagcacagtaataaaaaataaaaatcaacaagcgggcggcgatggcgtagggtggcgggcgcgtggtacctcgaggcagtgctcctcgtcggcgacgcaccgagcgtcgatgaggaggtcgccgagcgcgtcgaagatgccgtggccgtcgggggcgccgaagtcgaagtcctcgtcggcgaggacgttggcgatgtagtcgatgatgggctggtcgacctcgtcgacgacgtcgctccccagcacctccgtcaccacccccatgctcgccgccgccaacgtcgccgccgccatctcgcctctcgcgacgcccacgcccaacgaaggagaagagaagaagaggagggtttgctacctactcctctctcccgtctccagtctccacacagatgagatgggtgccgtccgatgtggaaatggacggtccatattgacggggcctttgggccttgatttgacttcgggaaggacggcccaatcttatcagaattgtaggcccagtattgaaattacagcagcttcgtgatgatatgtgatatactaggatgacaataaaaatgccttcttagaaaatggatggatgtttatacagtgaaagaatttttgcaacaaaattttttttggaacaatggatggatggatgtgaaattttattgcgacaaaagaaaggactaagttggagctaatttttgacgggatatcaaactaaacactcttgtcaaagtcgactacaaatcgttcacaactattagtgacttgttccaacccctcgatataaacaaattagataccaaattctaatttgtagtaattaactactaagacctgaagtgaattacatgagacaaatccatccccaataataaccccttggtcatcttccttcctgagcaacacctgctccttcatggtcctcggatatctcgacggaacaaccttgctcttagtcttaggatccaaataagaacagcacctacccaccaccctgtcatacagtgatatctcctccagattaaccgcggattccatcacgcgcctgatgaatcccacgaagtgttcatcgggttggaagccgacgatggtgagcttggccagattacggtgctcgaggttagccaccgatggctgccattcgacgttcgatttgtcgcagtagccgttctcctgccgtgtcgtctcgtccctctccatcttgcagcagtgatcccacactctgatggagagactctccagcctcggtgcggcttccacgatgaacattgtccaagcgatgtcgcagccttcagggaggtcgacgagagtgacatgtcgtagctcgcccagcactggggctagcctcttccagccttctggctcaacccaaatctgcaaatcaacaggttgttcacaacgagtacgtgcaaattaacttgcaaagattcagatttcagaatgagattaagttgatgactaagtgtgtggcatgcagtcaaatgatcatgtaccttttcgctctggaaattgagattaagttaatgcagtgagggggcattagcaaggaagtgacttaatcggatactgttcttccagctcatgccggtgtcgacgaggctcaagctttggagcaatggagtgtaaccaaaaaacagtggatcccgataagagatccagccctgacatttcatcgtctggagcttgggtacatggacgagctcgatcgtctcgaaattgccgtgtgatatctcaagctcaacgagatgattgtgctctacctgcagcacgctgcgtctcaccgatttgcagttgaacagccgaagaaaccgcaggtttttgcaggtgaggaggatgccggcgatgtctgaatcgccgaaccagaggcgggtgaggccggcgaagacggccgggtaggcggtgaacaaggtgtggaactggccggcgaagtagacgaggtcgtccgcagcgcttctccgtcaggatcgagaactcgacggcggcgccggcggcgagcttccgggcggccatggcgcgggccaccgtgccggcgatggagatgcagtcgtagtacctgaggtagaagcggagggcgaggtggtggacggggatctccggccgccggaattcgaggacggcggccgtcaggtcggccacggcgccgttcgtccggaccacctcgcgcagggtgaggcggcggtggtttggccgcgagaaggcggcgacgtcgacggcgatccgggacagcatgtcggggagggtggccctcatgttcttggagaggatgcaggttttcatggcgtcagaggtgtccagcctctccaagatgttgagcacgacatcatccggcaaatcgttcagcctgtcctttccagggactaaacttggtgtctgcatcgcattgcattacatgcagatcaaattaagctagattaatcaaatcaaattagtaaatagtagtagcagaagaagaagaaggcttgcattgcatgcatgcgtacattgcgcgtgcggcgacgctttctgttcttcagggatgatctgagctcgaatgatggaggccggccggcaactcgatcgggcacgcacgggggaattcgatttgttgatgatcgccgacttaaaccctaaactgaaaagagacccaaaagcttccgacatatctcaaacgtgattggaatttgaaagagactccaagaaatcttacaagtccattggcgttaagataccaacacttaacgtcgattaccctaaatattatagtattgttttggaaacgattattcggcaaagatagtaaatttcacttggtgccgtgcggctgaaattttgcacacatactgagctttccctgttctgatcaaatagatatgaaataactctgcagtctgcactacggtcaagcccagatcttgcatacacacggttacaaacatgcttgagcttatagagttatcatgcattctctggggtttcttaatccattatattatctaaaaagaatagcgacaaaaataacagtggaagtttacattctaatttttcccaaattcagacaatggaaactgaatacagattcaatctggtacagaaggggaaatttggtaggggtagcaaactgaacacactatcaaagtcgagtacagattcagacaatagtgaaatgttccagtccctcaaaaaaaaaagaaccattccaaattaattgaatggcaaagcagctaagaccggaagtgaattatatcagaggaagaagccatctccaataataatccctccgtcatcggtgcatgtgtgacttgcaagttactgacgggcaggacaggagaagagaggagctgcttacgttgcggatacggcgactacccttgttcttcatggttattactcgtttcgatcaatgcgggcaccgatggattggatgctttgcaaggaatccgattgctgatcacctgctgacctaatcctgattatgtatccatggacttataagccgtaatcttaataactgaagggagaagagctccatgtcgattacagaaccaaaagccttacgatatctcaaacgtgacgggaagagactcaaaagaattctcaaacgaaaaaggaatccagtggcgttaacattaacataccagcactccacatccaataatatttttttttattctttaggaacggcttctttggcaagaaacaaagtttcacttgtggcggcagattttttttcacacgtgcgggacttccagtgtcaaaatactacaacataaccgaattctgatctgctgtatactgcatacaaggttggttatacacaagctgagaagctttcagtgtgacagcaatccgcggataaaatgaggagaatgataacgatcaccaagaagatagccaagcaaaaattacatcaatcaaggaaaaaacaatttggggataaatggactccaggaaaaggtaactgcagttcgagagggccgaactgatcaataaacatcatgcagcatacattaattcccaccagaatttattcagcaggtagcttttctttgagatacttcagaattgctttcgttcctcgctccagcagagtccgccgtatgctgcagacgaaatcaacaggaagttcagtgatttttctgccggtgcatgtctgaactgcaactttcttttttttttccctttcatattctaaatatgccctgagaaaattatggcattacgatggtttccattttaatgttctttcacatgtagttccgaattatatggtgagcactgcagaatcctatggttatgcacgatataaaatcggtagcagcacaggtctacatggttccatgtgagttgggtttctatttcaatgtatgcatgcatgcaatgggctcaacaatttgttcctacttcttacctcctgaggggatttccatcaagtttcaagacttgcaggttaggctcaagcaaaccctgctcaaaatagtgtccacaagaagattagagatttcagtgagtttgagaatcgtacaacttcaaaacagtactttcagttgatgtcggtgcatccgatacatcatcattaaagccaataacttaccagctcaggtgggagtgttgttatattgttgtccgacagatcaagctcaatcaaagaagttaaatctttgataccctgtgtaagtgcaacggattttgcataagcaaataaaaagggcgcacgtgccattcaaaactttctaaatgcacctgggaatgtgaaaagcatttatagaaagagggggaaaatcatattccttaaatagagaaccaagtgtttacctctggcacagatgtaagataattctgactcagatcaagaattcgcagcagttttaagcccaataaactatcaggaaatccatggagtttcattcgtctgctcatatatagagaaaaataaataagcttccatagaacactccatagcttagatgttttgcatatgttacaaccttaggtagagttcctttaggtgaggtaatttcgaaaccgcagagggttcaggtagagaagaagcactgccacttaaatctagtacttcaagtttagacagggcctcaagatcagtagccaatatctgcaggaaaaacaagtgtgttacaatatcacagattagcatgcagattcgaagtatgtcagctatatataaataatcactcttttggtaatgtgtcattccaactcttgaaagtaggaacaagaaatacatgcagcacattacccccacacacccaccccccccccccccaaaaaaaaaaaatcttgtctaagatgtcttggcacatgagaaaacattaactgtaaacatggtattaaagctaagaaagaaacaatgtgacaatccctaaaaaaatgtaaaatgacttgtgtctaaacataataggctagatggcttataattatgtcaagtctttatccatgttgcctctgcaccctgtagttcaattcttctaagtgttgtaacagctaaaccatcaacttcttcaatttcaataatcaacgttgattaacttccagagattaacccatcagggaatcatgatccaataccaagaaatttgcaaaagaaaagatatgaagaccatgacattacctctgccaaaggattgttgtctagctttaacaaagaaaggctggcaagggaggagaatacggtgccaggccaccttttaattttgttgttagacaaaatcaaagactgaaaaaaatggtagattaaaaagagtaaggagttatatcgaaacacttttatctcacacatacaatggaattgatcaattgaagtataacaacatcaatattatatctgtaattcagaaactcacttgaagtgacgagcataatgacaactcgtttggcagatcttctattgaattcttagaaagatctagtttcatcacatcatttgtctcccaagctgcaggtggtacactggtcacaccaagaccactcaagtccagttcctgatattgcaccaagttaggggctattgtggaaaaaatgaaacgatcattggttattccatgaggctccataagatccaatgaccaagatattttattcttgcattggtagtcatgagaatacattgaaaaagtcgacaagtttttgtaaaaatacaggaaacatggcagatagaaacacacaaatcagttactcttttggcatgaatgagacaatccatgaatggcaaataccacatgtgggtgaattagctccttttaaaaaagacataaaaagagatctatcttatgatatacaaatatgctgtcgaaataattaaagtaccttagaagataaagacaatcttcttgctgcagcaatttgatcatcttttgttggagtgcttccagatcctgatgctgcacaggaaatatgttgagctttcgagtgatcatggataatggttctcaaatcagaaaaaaaacaggagacgtggcaaagcttgaagcagataatgtgcactacaaatacatcattatgaacaataaaatgcatggatattgattttgtgtttttggttacctccttcatcagatgaaagccgactgcgcagatactttaataatgctgttgttggtccagaaaccaaggaactggtaaccaaaatggaacactgtattattatgttggcagttctgtttagaatcctgacaacctctttgtgaaaaactaggacaatggcatgggcatcatacctccgaagtgtcctcataggattaccagtaagcagaagctttcttagggttgtcatagtaccttgaatatagcatgccgaagcatatgtgagtgtccatagtttcgaaagttcattaagatagtagcacacttgcatagagcatgctaagttttcaaagcagataccccatggaaaaaaagaatcagccctatgatctatccaacacatagagatgcatgcaatcatttcatatcataaaatttcagctaaccaaataggaaaataacaaaagtggcatcatcgagaggagcattgcacagcagaaaaaccaacctagttcagcaggcagaccagataatgagttgtttgatagatcaaggaaagagagcttgagtctacaagccccgacaggatactcctttagctggaaaagtgacatattatcagaaaataataaaaaaaacagaaatgaacttatttcttctgtaatgttctgttaattctagcaggattggttgcagaagttaagctcaatgttacaacatgagaagtttgttgttgtctaataaagtggttttggggatcaatatttacatcaaatattctgaacaacactgttccaccattccttccgaacatgtaagtaactgagttaataagaactcaaaatatatcatagcgccatccctctaacaaaacagacaggattagacaagcctatagatggtgggagtgactatggtaaatcacatgcagtttacatacactattaatgaagctcttgggatttgggaagtgggaaaatgttaagggagcgaaacattcatgaaattttctggactggagtgtatcctagccatcccgagatgatccttttttctcaaaaaccatcccaagatagtcataagcaaaaaagcctcatgttagaataaacaaatgatgtactaaaattttgagccacacagctacagatttgatgtcccagcaacaaagaaatcaaatcaagagcctttctcccagtatcttcagattttaaaatggtgcagaataacaagagtcaggggaataatagactattaaattggcagtatctgtgaaaataaatggagtaagacctggttagagtgtagatcaagtattcccaagttcgatagcatgccaatatcctctggtatggatgtcaacaagttatttctggaacataaaagtacaaatagagtgaacttgtgctgtttaaaaataagagcatggtaaagaagtttgtccaaaatagataaccaaccccatataaaactctgctagagaagagcaatcttttatggaaggaggaatcagggttatttctacataacaaaagtagaaagccatcaatacagataaaaatgaataataaagagctagcatatgcgatagtatggtagactaactgttctgatgcaggtccagacgaattagctttgacagtgcaccaataccatccgggatggctgtcagtagattctttgctgtacaggtttgaatgttaatctcaggtagaaactcaaggatatcacataggttcgacattatttttggtactgtggctgtgtggcataccagcattcatctctgtaagcattgtccatgacataaacatcttgtctgatagcgtcacgagcttgttaccctgacattttgcagtaattggagttttcaagaacaaaagaaatgcagcacgaaaatatgataaatccagctttgacattctctataaggagtatatacctctagattcaatctgaataacttggaacagccagcaagttcatctggcagtacggatatagtgttgtttgacgcctacaggtagggcattacattatatttaggacagaggatgaagagggaagctataaagatgagctgtatatatcttcatcaaacaaagaaaccttatggagaaaataaggaatacatcgatggtggcttacattgagttctgacaactccaggcatctggcaagactaactgggagatctgtaaggcaattatttgagcagtcaaccctggcaacaacaatgcatcaacttacatgaatataatcatacatagtctcaaacattgcttcttgtatttaggcgtcatactaattgtcaacatcataacatctaaaatatgtgacagatggttttagaaatatgaatagccaaattttgagcttgttttaacagtacattaatgaaatcaattagaaaagggacatagaagacatacttgactaaagcggtcgcaaaaccaatctcttcgggaaaagcgtttatttgattagaagatacatccaacgattttagcaaaggaaggctgcatggaaaagagccataaaaaagttcagatgatattagtggtccacggttaacaatggaaattactccctcctgtcacaaaaaccatgcctgcaaacttgaccagtaatctctatcgaaaaacagttgaaaatcttgatagaatgataatattatgaaactggttttgaaggcagtgacttcaaacatgtccacaaacgatatgtttccatgaccggagggagtagtaaataaggatagtccagtacatactctccaatagctgcggggagggaagaaatattgttgtgactaatgtttaatacaacgagcgaagacaaatttctgaggtcttcacgcaacacctcaaggttgttatgagccaatatgagcttctgaaggtcaactccctgaattacaaaaggaaaaaaacagaaacagaaacaaatttgattggcgttgcttgatatcccttgtttatgcagcatgtagggaaatagtcatacaggaagggggcgaatcgatttacctcccaccatttctcatcctgagcccccgtgtccaagttgttgtacacctccttgggtacctccctggcagaacaggcagaggtgtggcgtcagcgagacatcaagaacaagaagagcgaagctgtgtgcgcgcgcgctggaatcgattaacccatggtcccctagtacaccggccataatcagacaatgcaatgcagtaaactgatgtgagaagcaggtgaaggcgtcatggcgggaagggattggattgcgtcgcgtccgagcagtgggcggcggctacagactaggagagatcatcgtccatgtcgccgatggcgatccaaccgagcgagcagagagagacaatgcacctgagggatcgattggagaggttgagggagcccgactccctggcggatttgagcacccgctccatgcaagcagaagcaagcagcctccggcctcagatcgccatcgccggagacctgatctgatctgctgcaccagcaggcagaggcagcacgagcctacccacgaagaagactagaagagagatcatcaacttagcaaggacggagagctcaaacaaatcgagatgagatcttgttttcttttttttttctttttctcctctcttctttggccacacacacaatggagcgagaaattaattaaattaaaaggaaaaaaaaacagtattagtcaggcccactaatcctgttgggccaaaatcaacattgaggcccaacgtctatgtgatttggaccttggggtgaacaaatcaaggaataagttcactttaggttccttaatatgtcggcaagtctaaaattcatcctgtattctgaaaaaaaaagttactttaaaacaatcatattaatacatttttactttttactaatattcaattaatcacgtgctaatggataacactgttttttgtgttgaagtactttcccaacttctacagagttttctatagaaaagttatttttgaaaaatatattaatctatttttcaaggtttttaatacttaattaatcatattctaatagatttcgtgacgcactttctcaactgttactccctcgacttcctcacgtacccttcctaaacgattaaacggtgcggtttttacacaaattttctattaaaaaggttcttttaaaaatcatattaattttttttaaaaaaatttaaactagtactacatccgtttcaggttataagactttatagcattgcacatatttatatagatgttaatgaatctaggcacacatatatatgaatgtaaacaatgctataaagtcttataatatgaaacggaggaattacttaattaatcccaagctaatggataacaccgttattggtgtggaacgcagacaaccgcagaggcagctcgtccaatgaagtgtactacatacaagtatacaacatcataatttctccccaaaacagttatttctccgatgcaacatttgcaggtataccatctctttttttgcatacgtgcacaatgctggtgcacattatacataacacaagctggttccacgatgctacttgacaaaagcaaagaacaaaacaagagtttaaacacaccgaaacaggtaaaatggtctttaattattgattttcaaatcgaactaagaccggaaatgaatgacatccgggcagccgattcccaatccctctgcaataatctgattcttgagcaactccctcttctccatcgtacacggatatcttgacggggaaaccttcatcttgatcttaggatccagatcaccgcaattctcacagaccttcctgtcatatagggatacctcctctagattaactgccacttccatcacacgcctaacgaatcccaccaagttgtcgtcgggttggaagccatagatggtgaccttagataggttctcgtgcctgaaaccatcaggtgcagatgattcccaatctacaactgttttgtcaccataaccctcctccctcctgtcctcttcagttttcatgttgcaccaacgatcccatattgtaatgcatatctcctttagggagggtgcagcttcaagaatgaacattgtccaatcaatgttgcatccttcaggaacatcaacgagactcacacgctgcagcttgtggaacacaggccctagtagctttgggcattctggacgaacccaaatctgcaacatgagggtaacctaaattaattcagaatgcttacacgcttcagaattaatatgctttttggttttatttctctattttgggctttattctaaagccagatcagtaaggttgatcttccatgtaaacaaatactccctccgtattttaatgcatgacaccgttgactttttaatcaacatttgacaattcgtcttattcaaaatttttgtgtaaatataaaaatatttatataatgcttaaagaacatttgataataaatcaagtcacgataaaataaatgataataacataatttttttaaataaaacgaatggtcaaatgttaattaaaaagtcaacatcgttatacattaaaatacggagggagtatgaaacaaagcgtaagcataaaaatgaccggaacagcaagcagctagctagtaccttttcgctttcaaaattcaggagcaggtcgcttatggaggtgacggtagaaaggagctgactcaactagtgaggcttagacttgaaagcagtgggacatccccaaaagacaaggggtccccgtgacagtcccaatgaacataggccatatgtctaagctttggtaggcacttgagctcaacaaactcaaaatccccatagttgatgtcaagctcaacaagttgcgggtgctctatccgcagcacggccgggtcatcttggttgagacaagagaacaaacgcagatgcttcaactgtttacatgtggtgagcaggttggggatgtcaggttcagcgaaatgcaagtgttgtagctgcaggcgtgtgaggccagcaaacgcatctggaaaagcagctagaaaagttctgaactgcttgccaaagcagagcatgtgagtttcttcgcaacagcctccttgcttctcggttaggattgtgaactcaagagtctcgaggttgtaggtggacatggcgtgttgcacagctttgccgatggtgaggcaatcatagtatctcaagtagaatcgcaagctaagttggcgaagggcgatctgttgactcctgaagttgagtaatttctctgttgcaccagctaaagcctcattcatctgaaccacatcactcagtgtcaaaagatcgggtgcaatcttattgggcgtgaaggaattggcatcaacaacaatgcgggagagctcggcagggagcttagtcatccttttgcaaagggtgcaagctctgatgtcatcagccgtgtccagccgctcaagaatgttgagaagaacgtcattaggcagagtggtgagcctatccttatcctttacagagtggcaagctggtttctacattgaattatcattgcattgcatttagtattgccgaaaaactaaactaacaaagtgtaggagaatcaatcaaatcaatgcgaaggaagagaagaaagaggctacttacattgcggcgacctttcttgttcttcgccatttgatacgaggcttatcaatattgacttgacttgttgtacaagtgtcggtgggtgttgtttggataccgggaacacctcgcctctctatctattttatttagtttagagaaagagaaataaataggaatcctattccaacaaactgattgcttctggacctcctgccggcacccaaacacaaacgaaattgttgttggaagtcgattctatttcgaagagaccttttacggtgcttgaaaggtacccaaggtacctctcctcaacttaaacatccaccgttgattctcaaagagtatattaggaattggattaacataaatatgggcagtttagtaatttttctttagccatcgtgattaactgttctttatctttggttatatcttcctgcaagcttgcacacataccccgaccttcttttcactgagttttgaacgctatatgatggatgactccaatttcaaaactagaatttatacgtccatccatctctattgtctttagaaagtaatccatacaaagagatggagggacatcgatcaatttttcatttagaagtctttacaatcacttgcaaatctcatgtatatatatggaaagacgcgcgaatcaattacctagttctaatcatcaattatgtggtcttcaattagcatgtagttatacgatctgcaaacactaatcaagtactcctaggcatgtgcattggcaccaacggactgaagacgttattgtctctccgcgctccggccggaccaaattacatatctaacatttatgaaatatataaaccaaattacatatctaaccttttcctagtaatacctggcccacacttttaagtatcttttcataggtaccttctactgtgaatcgttagattggaagtcatcaacggatttggtgcactccaagcacggtagaaaatctacatagcaagtggcggcgctcacccctcgaactccaagggacgtggatggggatgggttgggctcagtctccttgcctttggcccaacacaattagtcggcctgctgcccaatagaatcatccgatccgacgacaggcggccgggccgacgtcctcctgctccgcctcttcaattcacgcgccaccatgtcgcgtcgccgcctgccggcttccgcgctcgcctagccgtaccctgttgtatttacttgtgattcttgtgattttggatgtccggactgtaagaagtataatttctaataaaatccatcgcattcgtcccggacaccctgtcgtaccagccattggttctcctctccctcccgttcatggaacgtgagcgaaaccctcttcttccacgggcagtgagccccgtttgcctaccacgcgcacggctggattcgaggaaaaggtgccaacccaagtcgaaatatcagcaagtcgagttgagttcgtgttctaactacaaccgtatctagtcagagcttctttttcttcatgcataacactcgagccgtcaggcaggcaggaggtcgatcaagcaacaacagagcaggcatgcaggatcacccgcatcgcccgatgaagaataagaaattaaggtcaccgccgccacaacaacgtaagctagctgccctcttccttccttcgagttgatttgtttgattttcggcgacctatactatatctgaatgcaatattgcaacggtaaattggtgatgcaacgtagaaaccagcttgcaaccccgtatagaaggatgataggctcaccaccatgcctaataatgttcactcaacatcctcgagaggctagacatgggtgatgccataagaacttgcatcctgtgccaaggatgctaagctccctgccgagctcccccgcattgctgttcatgtcaattccttatgacactaggtgaaacatcgcgcgtgctgatgtgagagtttactatgataacaataagtaaaagttgttggaattaatgaatgggccttagcccactcgaagattaattctttggaaaaatcacaaaagcccacctcatgggatggcatgcatgtggagtttagtaccaccttgcttattctaggagagggggacctccttaaaaggaaggatgccctcctagccacttgaagcatgtgtggtggagagaagaggggaaacacacgcgcgcgctcgctcgcctcgccgggccgggtcggcggcgcgcgtgcacgacgtacgcgtcgaatggtccgacgaaaaattggctcctcacccttgcgcagatgcagcctccttttgcagttttgttttgctgcaaattcggattagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacttgccgtcttcacgcaacacttgcgaaaacaatctagggtttgtctcctactctgtactgcgccgtcgctcgtagactactccatcccgctcgccggcgtgcaccggcgatcgggagagcaggtctccggaacctctgtcttcgacgttctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcaaccggtctttccgtcacctcggtacgtgttcaatatgttgcgcatatttgatctgttcatgttatactgtgtagtttacatgtatagatctaatgatgcgttcatgctagttttcatctgtaatgtcatgatttatttatggaatagattaaatcattatatgtctataatctcaacaaaagtaatgtgtaagatagcttaaacaacatttgtttacataagttgatgtgatttaaatttaaatagtacgtagaataatgattcaaatataaaactaagatgatgtggctttacagagaacaaattaaaatacgaaagataatttagaccatatgtctaagagctaaaaaaaattgagatgatgttgcttgatgagagaagaaaagaagaaagataatttgaaccatagattaatcatctaaggactaaaagcaatttatgtaatatgacttaataagagaaaagaaaaataatatgaactaagtgagtatgaactatatagatatatagcatattataaaaaaaatgatggagagatatattaaaatattatgtgggtttgatttaacatgcttacattttaaatctctaaaatttaataaattattaaattatagataatataacatgtttgcatgatgcttacatgtaccagttgacagcgagacgtctgtggtgacttcgtcaatctcaagaatatgtcggcccagtcttcgaagatgctcataggggtagggtttgcgtgcgtgcgttcatatgggtgagtgtgcgtgcgttgcactgagtaattctcaaaaaaaattgttagtggatgatgatgtgacatctttgcatgttaagttttaggaattagtaggttataactatatagtaagagatgattaagtggtgtggttcggatgaatgacgtcgtggctaatgcaatagacaaacttctcaactccaggagtcaacatatcatccttcgtcaacttagcttgcgattctacctggggtactacggttgtcttaccatcggaaaagcactgcaacaagccatgtccacatgcaatctcaaaactgcgagttcacaatcctaccagagaaggaatgagacccctgtgaagaaacgaacatgctctacattttttttgtggaggctaacttgttttccttgtttctgttcctgttgtcggcataaatataaattagctgattcctgtaggaacataacctcggcatggtgtttcagcatcacaggccaaacgacggagccctgcaatattgaacgatgtccaatatgatgcttaagatgaaagcgttgcttgtgcatttaattgaaataagcatacaagttagttttgtgtgtttgtacttcaaagccagaagtttgtatgttggtaacaaacaatataatccgtcgatgggattgatgcaatggcgttaccaacaatagaattcgtcaatgaccgcgatgtgatggtctcaaataatacccaaggtaaacactaaagctaggaggcagaaaggttccatgggccggtgcaagccaaaatccctacaaagcattcaagcgagatactaggtgtccaccgagttcacagtcctaactatgaagtgaaactgctgagctcacaatcctaactgaaaagcaaaactactcagctcacaatcctaactgagaagcaaacagaccgttatgagaaactgacatgctctaaactcaagaaaatgataatacatttaccatatgagtctttaacgacacatatcaccttctccaaccacgacattgacaattgcattcatgttgatcatctgaggactatagctttgatcaaacaccattagtcctctctaatcgcaagcaatctcatgcatggaagtcatgtggagaacttgatgaaggaagcctggagcaagattgaaggtgaactagtaggatggttgccatgaccaaggtcgagcatatgacgtggatgaaggaaatgataagtttagatgatgaaggaacaattaaggtcattgtgggtatttgacatcatgtttttggtaaacaaatataaaaaaaggaaacatgacaattttggatggaatgatatttcaatactatgaaccaattctaatctaacaaggaggaaacctacataacaataagatcaatgctatagaactaaaattgtgatatctgaatgctacaaaatcaaatttgttaaacttttaatgattttagacattgtacaagtttgtgaaattgttccttagtttgtagcctttcacaaacaacaactttgtggctctaaaactattctattacatgtgtccatgaaaattgtgttttgtatagattggagatattcattaggtgaaagatatatttatatacaatatttagaagcagataaaaatgttgttgttccaagataattgataatggatatatatttggttttggtatactatgtgacacatgacaaaaatccaactgctgagtgtcactataaattattccatttaccatatgaagtcacttgacattaaaatcgtcatatgatctattaaggacccaagtagatacattatcaaaacaattgaatgactatatattttttttctaaattggtcgggttcaacttatctttatttatctcatactaatattataggttttatataaagtaaattgcatcagtagtacaagaacttggcaggtgggtgcgatttagtgcaacaacttgaaaaatgtgcaggccggtacatgaacttggcaatcaagtgcattttggtcaaaacgctgttacatataaatgattcaacatattttgtttcttctattatatttgtttcttctattataagcatactactagattattggtcatgagtacaattgaatatgtttgactaataaaatcacttggaaattatgttacaaccatttttatgcacttagttttaacgattattatatttttcggtttcaaatgacatactattttttagttttaacgatcattatatttttcggtttcaaatcaacatgctactttttattataagcaagcaaacttggaccatgatagacgtcattttgatgggtagacaaacctggaccttatgttatgttgccattttgattactgtatctcactgagtaggcaactatgatggagtataatctaatttctgtcgtgctttttctttggttactgtccaataatactttttttatttatgttgcagtaaatttttctttggttagtaattcaataataaatgtcaaataatacttttttgtatttatgttgtagtaaatttttctttggttaataattcaataataaactttaacggtaaacaactcaagtaaaagctcagcctgttcatacgctggttgggttggtttagttggttccgcagccgaaccagcaactggatggttttagccggtttgggctggttctagcaaatttgagggatgctgagttggtgggttggtttgggtggttgaccggtttagacggtttgagcccgtttaaattgtttattagaactgcacaactacactagctactacgatagctcttatatccacacttttataatctatcctgaaaattgagaaggaagaagcaattggcactaaactcgcaatgcaatgaccaatatatatacctcatttgcatgaaagttcttgtctaatgctctctgttttgtaccaatcaattctgatacaacagaaggttcaacctctaacactggccatccagaatattaagatttctttcacatacacagatgagctgagttggagattggttcatggtttacctgaaagtgtgagaggatggagcacccgctgcaatgctgcactaggttcgccgcctagagatccgtcgcaaggttgcctaccagggaggcaggaacagcttccctgagcccaatttctaccgcgccgccgccgccgcacgctcgcacgagggtttcgatgggagtatcaaattgggatgggttatatagtttcgctggttctatctctccctgaacacaacccatgtgatgctttaatagttttgacctaaaaaccgatgaagctggtaaaatcgctaagaacgggttggtccagtttgggttcgcgatttgtgctgagttcgcttgacctgtgaacaggctgagtaaaagccatatcacaatttcctggtaaaatgctagaatcttggccactgcttcacaattctgtacactcctattcatgtccaaacattcatgttgtgttttaattgttgttgttgttgctgatttaattttgtccttgaatttggtgtgttttaattgttgttgctgttactgatttaattttgtccttgaatctatttgtagaggagatgctcaacctggggggcctttcttcaaaggcaaaggcctgggagaagcgaggttagtcacttattcagttcctgcttattttccttttaatggtcacatgttttctgccctcaccgccctttatccgctatccgcagtgaagaagctgaacatcagtaacaatggtgtgtacccggcggcatccgcgaagaagcacaggagtagcgagatgttgagaactctgtcgttaggagtagcgagatgttgagaactctcattaggagtagcgagagatactctgttcctgactattgatgttgagaactctgtcattaggagtagcgagatgttgagaactctgtcattaggagtagtgagatgttgagaactctcgagatgttgagaactctcattaggagtagcgagaatactctgtccctgattgttgatgttgagaactctgtcattaggagtagcgagatgttgagaactctatcattaggagtagcgagagatactctgtccctggccataaatagtcgttgagaactctatcggtctaataagaccttatatcttctgctgcagtatcagctatttatgtgacgtctcattgttggtttgcttgagaaatgagaactagttatttaaatgtcagttttgcttggcttgagttcatttcagctttgcccggtgctgctgctgtaggcatgtaggagcatgcaggaggagctagaggtgttattctgttatgcggtgttattctgttaagcttttatatatatatatatatatatatatatatatatatatataaaagaaaatcgagaaggtgttttagagtaaggtcaataaaaaagcccgctattggttgtgataagtgaacatgtcgcctatagtaagcgttatagctaagacatacaatagagatatcatatacttgtaacataaatattttattgttttacgggcccaccatcttctcctcttctccttcttctcatccttacatggacgcctcttctcatccttacacggacgccggcaacggagaaggtggcggtgaacat

SEQ ID NO: 62904 - DNA, 36058 bp, Oryza sativa
ccgcgcctcccctggctgcccgcgagccgccccttccccaccgccgcgtcgccggccgccggccgcctgtcgcagacgccctcctcctctcacgccgcccgcgcgctgcttgtccgccggccgcgcaccgcccctcccccgccgctcgcaatcgcagagaatggagagatagaaagatgagatgggagagaagagaggaaaagagagagaaggctgacgtggcaatgctgacaggtggggcccacgctgactcacccaccacgtcagacaaaaccggggtcaaaaccaccagaggacctcaagcgaacggttttgttagttgagggctccgatatctgattttgcggttgagagacaattttgtaactcgatgacaagttgagggactttcggtgtacttttccctcagctatgacaccccacaactgttagtatgttacaactactagtaatatattaattgatcttcctcagtggtttttaaaggtgatttttgtactatgtgacattattcctataaataattagaccttgtgtagttggcaaaaaaaaatttactcctacgtgtcacatcggatatacggacacacatttgaagtattaaacgttgtctaataacaaaacaaattacatattccgtcaggaaactgcgagacgaatttattaaacctaattaatccgtcattagcaaaagtttattgtaacatcacattgtcaaatcttagcgcaattaggcttaaaagatttgtctcgcaatttacacgcaatctgtataattggtttttttatctacatttaatactccatacatacgtaaaaacgaaaccaggatattcaaaacattcaaaatatattgcttacattatagtatatccaagttactggcctgaaaccaagttgcaggaaacaagagaattctaatgcatgccttgaaacgtttgaaactagagtgtttcgtcacaaaaggaaagaagaagaaaccaaaaatattcagaacattcagcatacattattgctactcagctaatcgcattttcgcgctgatgaattaagaccggaagttaattacatgaggcgatgccatcaccaatccctctgtaatttgcttcctcagcaactcctgctcctcgacggtctgcggatactttgacggagcaaccttgattttgggatccaactcttcacagcaatcttccaccttccggtcgtacagggatatctcctctatgttaaccgcggtttccatgatgtgcctgatgtatcccaaaaagttgtcatcaggttggaaaccgtagatggtgagcttaaccagattgcaatgcctgaaaccatcaggtgaagatgactcccactgcacgtttgttttgtcacagtaaccctcttcttcccgttccaccttgtccgtcacaatattacaccaatggtcccaaattgtgatgcatagctccttcaggaagggtgcagcttcaagaaagaagcgtgttatcacatccttcacggagatcatccagagtcaaaacttgcagattctggagaacaggcgccagcagtttcgggcactctggctgaacccaaatctgtaatacaaacaagtcataaaggaaggatgcaggggttaagttgagaatgagatgttcataacatgatagagagagagacttgcttaaattaattaccctttcacttttgaggttgagatgcaggtctcttatggaggttacattagaaagaaactgacttaatctgataaggttgtgcaatctcagacctacattagtgaggcttaggcttgacagctgcggaacattgccaaaatacaagggttcttggggatgtctccaactattaaagaccagccgttcgagtttcggtagagaattgagcttgactagttttaaacatccgtggcagatatcaagctcaacaagccgctggtgttccacctgcagctgcaacacagtaccctctgtttgacacatgaacatacgcagagactctaatcgtttgcatgtggcaataatattgggaatgtcagtttcagcaagcctcaagttctgtaagtagagtcttgtaagcccagcaaaggcatcagtacaagcaccaaaaaaggtcatgagccgtttcccattgttgcggagaccataaaaagtgtaataatgtagcttataatctgtcagaattctgaactcagcgctgtcaagcttgtgggttgccatggctcgggcaacagctttgccgatggtgagacaatcgtagtattttaagtagaaacatatgctgagttggcgaagagggatctctttggctctgaaattgagaacattgtccgttgcatcggccacggcggcgttcatcacgatagtctccttaaaagtgatataatcaggatctggcgcgaacgaaactactccctccatccaaaaaaaaagtcaaatctgagtttccgtgtccaactttgattgtccgttttatataaaatttttttataattcgtattttcattattgttagataataaaacatgattaatattttatgcgtgacttgtctttttaatttttttttaatttttttaaataagacggatggtaaaacgttggacacggaaaccagggtttgtctttttttttgggacggagcgagtaggccaatttgaaagcgcgaaagcatgtgtcggaggtggagcgtcctcttagagaggaggcaggttctgacggcatcgggggtgtcgaggcggtccatgatgttgagcaggatgtcatcaggtagcgtggtgaacctatccaccaccattacgggagctgatttctgcatcgatatagtgtttatttgtgaaactaataataaattaattagtgcaacagtagtcatggatcgacagggaaagagaagactgacatgacagatgcaatgcaaatcagtaagtactcccttcgtatttatgaagccattgatttttcgaccaacgtttgaccattcgttttattcgaaattcttatacaaatatgaaaatatttatgtcatgtttaaagaacatttaatgacgaatcaaatcataataaaataaatgataattatataaattttttagataaaacgaatgatcaaacatttaataaaaagtcaacggcgtcatacattaaaatatggaggtagtaggaagggaatagacggcttacattgcggttgcggcgactacccttcttgttcttcatggttaatgaattccaatgttcaacggcggggcctgaccataacagacaagcgctgcgcttattgcgatggacgtcggctcctcctgacttgtttatatactgagaggagaagaagaggaaaagaaggcgcctccgactgaatccgattagaataggaaaatattggacacactcgatgatttttatggcttttcatcgcattcgagactgattcgattgcatgagctgtttatatatacttttttttttggaataaattggttaaaggaatcaatcaacaatagaaactcaatactagtactagtcaccagctgatggatggaggcgtggcgtgtccggatagacttttccaggcgaaggctacggaacgaaaccgattgctaatatggttatgtttagttcaacgtaaagtttgaattttaattgaaattagagataatgtgactaaaaagttatgtgtatgatagattgatgtgatagaaaaggactgaaatttgaatccaaacttcgaatctaaacatagcctatatatacacacacttcagacaaacagttaccagtctttttaccttcatcttcagtaggtcagtaaatattacaaacctggcattgattagattataaacgcctttgatctcgcttgaatctagtaccactgataagagattgaacaccaatctcttggtggtacttgaacaaaacacatttgcttcagctgtgagctggatggcaagttctcttactggacaaagggtggaaaatatttcattgcaccaaatagaaaagggaaaccagaatattcaggatatatattattatgcagcaagcttaaatatgtgctggctaccggcctgaaaccaaggttgcaggaaagaagacaagttcaatcaatgcctttaaacgtttgaaaccagaatatttcataacaaagaaggaaaaggaaccaaaatattcagaacattcagcatatattatttccagtaccacacagcgaatcacagttttgcaccgagcaaaattaagaccggaagtgaattacatgaggcgacgccatcaccaatccctccgtaatttgcttcctcagcagctcctgctccacgatgttctgcggataccttgacggagcaaccttgatcttgggatccaagtcttcacagcactcaagagccttcctgtcgtacagggatatgtcctctaggttaacagcagcttccatgatgtgcctgatgtatccaaggaagttctcatttggttggaaaccatagatggtaaacttagtcaggttgtaatgcctgaaaccatcacgtgcagatgacctccactccaagtttgttttgtcgcagtaaccctgttcttcccgttccaccttgtctgtctcaatctcacaccaatggtcccaaactgtgatgcacatctccttcagggagggtgcggcctcaagaaagaaacttgtccaagcgatatcacattcttcagggagttcatccagattcaaaacttgcagattctggagaacaggcgtcaacagttccgggcactccggatgaacccaaatctgcagtacatatcaataataaaggattcagatttatgtcaagaacaaggaacaaataaccagagaggattgcttaaagtaaattaccttctcacttaagaaattgaggtgcaggtcttttatgaaggtgatattagcaaggaactgacttaacctgataaccttatgccatctcatggctacattagtgaggcttaggcttgaaagcaatggaacgttgccaaaagacaagggttcttggggacaaacccacacactaaaaaccaatcgtttgaggtttggtagggagttgagctcaactaggtctaagttcgcagtggagatatcaagctcaacaaggtgtgggtgttccaactgtagctgcaatacactatcctctatttgacacgcggacaatttcaaatactctagccgtttgcatgtggcgatgatgtttggaatgtcagcttcagcaagccttaagttgcgtaggtggagacgcgtaaggccggcaaatgcatcagtacaggcaccgaaaaatgtcatgagcagcttgccattgtggcggagatcgtcgatagagcaatatagtgcccgcttccctgtcagaataatgaattcaacgctgtcgaggttgtggctgtgggtggccattgctcgggcaacagctttgccaatggcgagacaatcatagtacttgaggtagaaggttatgctgagttggcgaaggggaatctcttggtttctgaaattgaggatgttgtctgttgcatctgacacagcagcattcatctgaatctgaattgcatccttggaggtggcataataaccataataatggggcaaaaaggaatgcagcgaaatgtttaagtttgagagcaaatgtcgaaggtggatcgtcctcttagaaaggaggcatgtcctgacagcgtcgggggtgttgaggcgttcgaggatgttgagcaggacatcatcaggaagcttggtgaacctatccactactagtaggtggttattgtgagctgctgatttctgcatcaatataattttgcgaaacaggattaagcaaatataacaagtaaataggtaaatgcaaaatgaaggaagcgaaagatgaagaaaaaggcttacattgcggttgcggcgactacccttcttattcttcatgatgctgatgatggtgggtggttaattccaacgaggtacggtgtgagtatctagcttggctgatggattggacttccttgttggtttattattgctatatgaaggccaacggcggctcttcctgtcctgtatatacaaggatgaggaggcgtgggcgaggtctggccgacgggcaactactactccatctccgtatcctaaagagaaaatccataaaatgccatcgacaagcaccctaatcctagaaatgccatcgacaaagacaacttcccaaaaatgccattgcacaagcctctttctcccaaaaatgccatcaccgtcaactccacaccgttacaaccgttatttttttaataatgactattttgccctcagtgcaaaatatacctagtttttactgtcaaagaaaaaaaatgaaatttctaaccctaaccctaccactaccgatcctgatctagcgctctccccggcggcgtctcggcgacagcggctcggcggcgatcccctactgcggcggcgcggcgaggaggacgatggcggcgacgcgacaggacgcagcgaggaggaccagcgcggcggcggtgcggcaagggcacggcgaggaggactgcagcaaggacgcgacaggacgcagcgaggaccaggacggcggcggcgcggcaggacgcggcgaggaggtctacggcggcggcggtccccgacggtggctcgatggctgtcctcgacggtggctatggctcggcggcggtcccttgctgcggcggcgcagcgaggaagaccatggcggcgacgcgataggacgcggcgaggaggactagggcggcgatggcgtggcaggatgcagcgaggaggaccacggcggtgacgaggcaggacgcggcgaggaggtccacggcggtggtggcgcggcagggcgaggtgaggaggtccacggcggcggtggcacggcagggtgcggcgaggatgtccacggcggcgcggctattgcaggatgtggcgcgggggccgtagacgccggcgaggagaggtccgtaggcgccggcgaggagggggaggagaggcctgcagccgcagttgctgaggtccgtggaggaggaagctatagtcctagctggtgttgcaactctgatgttgaaattttccctttgtttgatttgatttgaagactttgtttgatttgatttcagtgaatttaattatgaaataacttgattgatagcaaaataatgatgtttgtgaatttataaactaacagaaatataatttattgtgagcaagcaatgcaaaatgatgatgtgtgagtaaatggttgtctaggggtaagattgtcttttcatgcaacttaacggaaagatgctaacggcagtttgacggtgatggcatttttgggagaaagtggcttgtgcaatggcatttttgggaagttgactttgtcgatggcatttctgggattagagtgtttgtcaatggcatttcatggattttctctatcctaaacggaggaggagggaaaggaggactctgaattggagtccgtctcgtcctagtctggaattggattggaggaggcacaagggcaagtgacgcatggagagagattagggttaaccttgcagagattttgctccggctccggccctaaggtggctgggcggcggatcaggggagacgctggcggccaactccggggtccccagcccggagtaacttagtgggcctatccactggtagggaaccagtggatgctgctgatttctgcatcgattgcaaattgcgggaaactaaatatattagtggcaggcagcgaaccaatgtagtactagtaatatgctcgtgctaacgctacgataatatttagtaatacaaataaaataatcaaaataccacatatgatatatcttttgtatctcaaatattaaatgagatacatttatgatttaaaaggtagaggtccccaccaacgtcgcaccaagctgacacgcacaaaactaacaagattatacccaaacggcacgacgtcacaaagattacacccaaacggcacgatgttacaagttgggtctccacccacattagttgcaccaaaccaaatactacacatacaaacctggaacggtcatacgtgtcgtatgtccgaacaagaaaaaaacatatctgaacaagtgggtcatgaaccgtgcacgaacattagattaccatgtggcgcttttggcagcacaccatttttaagcaatcctatatgattattcaaaacaattacagtgattcagcccataacttatacagtttgatgatagtatgtggatacgggtcatttcataggaatgtcacaaataacaatgttgtgttacatataatgcgaaatctgtcaaatttcaccaaagattttcacaaggctatttgagtcaagcatctttctaatgttcttttcttgtcttccggccacttttgtttacaacacctctactcggtgcaggactccattcttttttactacatctgtcaaagttaaggaagttaaggggaaaaaaaagatggttaccttgtaacagccactgttacctcgatagtgccatgctgctctggcaaatcgccatggcctccatacagctgctcacaaagattagagaccataatttggccaagctgaaaataataaaaatatgaagtattaaaataataaaaaaaatcaagcactcggtgcagcaactactgaacattattgaaagaaccagcgagaaattctttttggctcaattaaccgaaaaaaatatttgatttcccctgttccacgtgtagtgatattaatttgtagttcagcagcttcagcattagaaagctaaattcaattcttctggcaaccatatgtttaatagaaaacagtgtacttgtttgatatccaatgccaaaaccattgataaataaaaggaaaacagtgtacttgtttgatatccaatgccagaaccattgataaataaaagaaacctgaagcgagctaaattaaaatactgtctggcaaaggatgaaaacagacagattacctagaaatttattgaacaattttaaatactatgtaacataagcaaaatagtaataatcactcatcaacaggtttagccaaaaaaaaaagattagctgtgctcttctgttccaattttttttttctagatttcctgcaaattttagaaaggaatacagccaatgatctgttagtgcaataaaatttgttcagtgtaattcctgatgacctggtaaacaaacagatggtcggcgacgaagtccaccggcggcggaggcagcggcccatcgccatggggacggcagcagctttacttccttcttcattcacctcaatcaccgccttgtggatgacttggctcacaaacaacggcaagccggagccgtcgtcttccaccatcacggataggttggtgagctacggtgagaacggcagccggagccccagctgcccgaggacgccgacgacgctgtcggcgaaggacaccttgaacttgggcaccatgaactcgccaacccgcaccgattcggacgaggtgctcgtgcaggaacccggccgctatgccatcttttccacgatgccacgcagcccgtcgcgtgcgtcggggaggaagatgaccatggcgtactgcgtgaggtcgtcggccgccgcggccgcgcttgcgcttgttacggagattcggcgcgctgtagtggagcttgagcaccttgaacccgtcatgcacggcgacgtactgtttggactttggagttgctcgacgacatgtacgccggcgtcgaggcggtagaacggcttcttcttggtgttcttcaccaatcaccatgaagggatgctcccagctgccctttaggtagatggcgttgctgagcacgatggccatcgtcgggccgacggatcccggcggcaggacggagtcgatgaggcccctcctcacctgtcgcgtccactcgttgatctgcttcctcgcttaatttcccggccttcaagaaaccccaaccaaatcaagaacagtgtacaaaaatttaaaattatgatttgcatcgccctgaattggcatctggatatgattcattgattcatcgtgcagattagtaatggtagatactaaccttgttcttgaaatcgacggtggtggcctcggccttgtacctgccgacgacggcgtcgcaccacacgccggacgtgaacgcgacgcgcggcccacccgacgccgacctgtcggccagcgcggtggtcgccatgtagaacggcgaggagctcatccagagtgcagcaatgggcgaggggaggcggagcgatctaggcaccgcggtttgccggaaggagagcgcgtggcggcgtggggggcgtgattttcggctcaggagcgatggtttctgcgagtgggggatgcgagaggaggttgaggcgtacgtgggacgatttgaggcgttggattggatgattctggaccgttggatttgatgaatgagtaatgtaggtgtaagagtgtgttggtgaattatagggtagataacgaacgaacaaaacacaaaactaaattgatgtttttacagctagcaatgacaataaataatgatactatatatatatcacagtataagattggcggcggcggcttacattgcgattacggcggctacccttcttgttcttcatggatgatacacccttgttcttgttgcgtattcaatccgatggatcggtgtgagtattaagactctcctcctcttcctctcgatcagtcggcccggatcctatgcgaactcgtacatggatcgatcgagacagaagtcacctcccttaccttccctttttcgagatcaaatctgatgccaatgaaacagcacacagctatacctctgtttttttttcttttattcccctcgagtactacgggttctgttttgaacgtttggaaattggaactgatgaagtagggtacggtagggtgtatggataaagtaaggaaagacaggccggccctaaactttgggaggcccattggaagcggcggcccagatgagagcagatcccctgtcacgccgacgccgccgccgccaccgctgttgccctaacgccgatctaatgctggagctccattcgcttgttcttatactatacaagtacctatgccggtgatgtatagctgctgctgctggtgcttggattcggttgaatttcataggtatggtcggtcagctggaatagcagtcggtgtgggtatatatgtagcctagttcgcatcgggcggaagctgggaagggaagatctagttcgcatcggagccggaatcgaatcctcccttcttttcctcttctcctctccatcatcagtatataaacaatacgcgcagcgcttgtccggtcaggcccgccgccgttcagaagcttaacattggaattggattttattaaccaccatgaagaacaagaagggtagtcgccgcaaccgcaatgtaagtctcttttctttcccttccttaattaattaattaatttgcattattattattgcataataataatatctgcctttcctgtcgatccatgaattaatttcgatgcagaaatcagctcccgtaaccgtaatggtggtggataggttcaccacgctacctgacgatgttctgctcaacatcctggaccgcctcaacacgcccgacgccgtcaggacctgcctcctctctaagaggacgctccacctcccacgcatgctttcgcactttcgaattgccctactttcattcgcgccagatcctgattatatcacttttaaggacactattgggatgaacgccgccgtggccgctgcaacagataatgttctcaatttcagagccaaagacatccctcttcgccaactcagcatatgtttctacttgaaatactacgactgtcttaccatcggcaaagctgttgcccgagccatgacaacccacaagcttgacagcgctgagttcagaattctgaccgattataagctacattattacactcttgatggtctccgcaacaatgggaaacagctcatgaccttttttggtgcttgtactgatgcatttgctggacttacaagactctacctacagaacttaaggcttcctgaaactgacattctcaatatcattgccacatgcaaacggttagagtctctgcgtatgttcatgtgtcaaacagagggtactgtgttgcagctgcagctagaacaccagcggcttgttgagcttgatatctgccacggatgtttaaaactagttaagctcaattctctaccaaaacttgaacggctggtcttttatagttggaaacatccccaagaacccttgtattttggcaatgttccgcagctgtcaagcctaagcctcactaatgtaggtctgagacggcacaaccttatcagattaagtcagtttctttctaatgtaacctccataagagacctgcacctcaactttgaaagcgaaagggtaattaaattcaagcaagcctctctctctctctctctcaggttattaacacctcatactcatcttaacctgcatccttcctttatgacttgtttgtattacagatttgggttcagccagagcgcccgaaactgctggtgcctgttctccagaatcttcaagttttgaatctggaggatctccctgaaggatgtgatatcacatggacacgcttctttcttgaagctgcacccttcctgaaggagctatgcatcacagtttgggaccattggtgtaatattgtgacagaccaggtggaacgggaagaagagggttactgtgacaaaacaaacgtgcagtgggagtcatcttcatctaatggtttcaggcattacaatctggttaagctcaccatctatggtttccaaccagatgacaactttttgggatacatcaggcacatcatggaaaccgcggttaacctagaggagatatccctgtacaacaggaaggtggaagattgctgtgaagagttggatcccaagatcaaaattgctccgtcaaggtatccacagaccattgaggagcaggagttgctgaggaagcaaattacagagggattggtgatggcgttgcctcatgtaattcacttccggtcttaattcctcggcgcaaaaatgcaattagctgagtagcaataatgtatgctgaatgttctgaatattttggtttcttcttctttccttttgtgatgaaacactctagtttcaaacgtttcaaggcatgcattagaattctcttgtttcctgcaacttggtttcaggccagcagcctggatatataatgtaagcagtatattttgaatgttttgaatatcctggtttcttttttttgttgttgcaataattccccttatccttttccctacaactacaagagagcttgccatccagctcacaggtgaggcattgttttgttgaagtaccatcaaggaattggtgttcaatctcttattagtggcactagatacgtttggagaatccatgccctggtacaggcaatggagtttatcttccggcattcctttgcgaacaaaggaggcatatttctgtttcttcagtctcaagatgctactcattgatgcctctgttccaggcgcatcattcctagagatcttgccagtggtcagatttctccctccctgtttaattaagagaagttctactcagtggctgcagggagatttggcaggaaatggagaccagactcctcagttgaggactacaatggtacatcgaaaacaaaggatttgagaacaggcagaggagatacagaacagggaggttttgggtgctgtgaggatcagaggaggcgtcacaagtcgaggggcgaatctttgtttaccaataaaaggttatgctttcatttatcttccattgttatctatttccttgtaggtagagatgcgaatgcgagttccaaggagtgctgtcccaaatacctgtgacttcaattatacagttttagaagttatgtttttatctaacttcaattgtgcttgcagttttagaagataatgcttcacaataagaagatagttgacacactagagggtaacattttatagccccccccccctaacattgaagtgggtgtttcacttaatatcttgccctgtatgtttgaaaagggaggtggatgatagccatgtttgataattgattgagcgcattctaacgaaaatatacatgaatagataaaaatacccactgccgtagattgatgcttagacactttgttaatttgaaattgccatagagagcttatattgatcgagttaaacagcatgcagctacaatttttgtcccaactttttctgctttatgaactcctaagttgaagaaagttggtttccatggtaaacttagtggataaccgagacttgaacttattcattaccttacattgtgattgacacttgagctgttcaatatattttgcttattccattttatactatgtatctctgggagaactattcggctaatttagttttattttcctttttagctgttatggcaaatgcaattctcatcaatatctttatattttattgatggttgacgacagactttgttcaaacacattgttgaaaccctatttaactattcgctctctcttggtagggaatcattgtgatatcatccaaacagttcaaatttgacctttgcattgcagccacatgcaattaggagctagcgatcaacatgcaaatacttagctggcatcactgtaatgattataagttcaaataaatatgaatcactgctttgagcttcaatttgttgttcactgacagtttctttacactatcttctctaaatatatctattctgtacttctattacagcttgtgatgtctgcgataacctgaaagtgctttgtcagagttgagccaggctaagccatcaataatggctcaggtattaaattaaaaatttattactcaaactctcatggatctgttgacataatccaaaactgttttgagaaataagaacccattcttcgtagttttcttgtcttcatgcaacactgaagctgtgaaggaggtgccaattgttctgaagctcctatatgatcgggatgccctggatgaagggtcaaggagtccctggttatgaagaatgccaagccaattcatggagtggctccggagtgtggagtatttccagttcgtgtcatcgtgtgtgattgtcccaaagtcataagtactagagcctggggcgcgcccgttggcgcgccgcctgagtggaacattggtgaagaggcagtggatgattaagcctgagtggaatgatggtgaagaggcagtggatgattagggatatagatgggaggaaagaataagcaagttttggttaaaaaaaataagaaagcaggcactcatagagaagcaaactgcagctaataagatatagacatcttaatacttagtggtctctagtagtaataggcacatatacagatggtctttaacatctgcaaggtagtgcagtatggatggtaagcacttatggtcccaatgacgcatatccaatttcatcacttgtcgcacggcacaatgggctcatcttaaattaaatttgaatatatcaatacacttctaatataaaatttaaacaattgaccagaatggtgttaggatctcaagtttttattgtcgagaccgctcatgttcagaattcaggtatgcactactaatttcgtactaacaaatgaatcaactctatgtaattgtttttcagtactgtataaatcaacatttatgctcacattcttctgaaaaatgtatacccacttcttcaatattatgtccaaacaaagggaaaagaaaaggaccggcttattctcagtctatcctgctgtcaatccttcatcagatgcatgttatgttctcacttccttccaatcttgcccttgcccattgtgatctactgatctgtaaggctgtgagaacctttcaagagagctattgcctgcacaacatacatatgaaccaatttttcattagttcctgggcccgtgaaaactgagtccatctggtcagaaagaggtgctccaaattgcatcatccccttccttcatcttgagtgcgcataagcttgctagctggattacaaaccactccacactgcacctctaattgttttccaccgaccgcatggttgcttgtttcataaagaaaatgttagcagttggtttggtattatagtgatcttcagaaatggtatagggtatacaaagcaacggaagaaaactgatgtggtggtgttccattgcgcatatctgtcattgatgcttcaatatttacactgcccaagttatagaccacctcaatttcttaaatggagaacaaccccaaagcatgttgcttgactgctattattactgaaggcatgtattttttaagggatatattttttacacggtgttcaataacatactttgaacctattattacttaaggcatgtattttttaagggatatattttttacacggtgttcaataacatactttgaacctattattactgaaggcatgtattttttaagggatatattttttacacggtgttcaataacatactttgaccattaatttattccatgttatgctcccaatgaatatgaaattagcatcatatgaaaggacttcaaagtatgaatatcacgagcttgcaaataagcagagtggtagctaaagcgacaacccacaaaaaagatcaatgttgcagtgctgatcaatttattttcactccttgctgcgaatcatctaaaaacctggactactgtcatattacctgaagatgaattattgcgagctgaacatggaaaattctggtatgcaatccaaaggtgtcaaacctgacatgaaaaaggaaaatgatcagatcaccaaagaggctcatcataccataccatcctcaatcttaagtcaaccaaactcatattatttgcaattgactgaaacctccgcatgaattcattattttcgtctctcttttccttatgtctatcaagaaaccatcagtgacccattgcagtcccatttaaagtatttaacatttaagaaaacattcagtacagtaaaatggaagattgagatttgcatcttctgaatattagtgccaaatataaacccatcctgctaccagttgtactaaaaaaaattgactgccaataaccaaaatgctaactactaaaaaaatcatccagtatgtgaagctcctaaatttttccttatgctactttgtaaaactatagtacagagtttctggcaagaaaattggttcccaggtcatccactcatgatggatcagcaagcaatatcactgcagtctcattttccagacaaaaaatatagtgttaggaactcatggagttgattttgtaagatgcagatgagcaacattcagccatcatacagtaataaatcgaaagaaactaagatttacgttgttaaagaagataaccttggatgaatcctaattcaatcataacaaagccaagaatcataatccagtcttaatgaagccaagaatcctaattcccagtgtaccttggatatgagattgatgtcaatggaggtgcgagcaacagtcgacatagtagttgaccctagttccgaggcacgcactatattgccaaaaatagaacatagacaaattacttcttcaaattgcagtgaaaattcatgcattattcattagagggtaaattaccattgattcagagatggcgatcgttgccatttgttcattttagtctatgaatcattgtgttcattttaaactacaagaaccgcatgtggagggagtgaaggggcttgtgcttcagaataattttgatgtgtttcgtgttgaattgaatcttatttaaccctagcagtggtggattgagcttggacttttgggggctacgaacaaacaaaacaagagaagagcttcatccagatgtagaagagaaggtaggcttaatgcaagcaaatttgagacaaaagtaggtgtgagagagagagatgaatcacagaatcagaaagaggatgtggatgctcaccgggatgcagcaggaccacggcgcccctcccctcccctgctgtgctctgcttaccgctgacattgccaccagcttcggcttctttttcggccttggctccagctgcggccactctcacgtcgtcctcctgtggatggactccaacctcgccccgttgatcgttgcgagatgtttccttaacaatagattatatgtgctttctgccttatggagcagaaattataagccagcagacagcaagcaaatataccatgtcaagtaaataaatggatcagttaattgatatcattgacacattcaagaggacaaacttacagggttgtgcatctcttcacttaaaccaaaattttccagaatagaagcaaccaatgtggagaaatagtgtacagcataggagccaacccctacctgaacatcggaataccaatgatatgtgatgtaaccagaactaattgcaatttcctgaagagtgtgccaacacaatttataccagaaagttgtgggcatatggaacttaccgcagatccataaattgtgaggtaaaataaacttttccttcccattggtaacaatttcatcccctataatgaataataggtcacaccaacaatcaatttgatagaacacatttttccataagcaaaaaaaaatcctagttaaaattgagtcactgaacgttccttatcaaaagaaaatggtcttacttcttggtcttcccacacagtttagagttgcctcatggtgtattttacaacaaactaacagaattacaacgaaaactatcttcgctaattagatcaagagatttctatgtttagaatggaaattctataaataaactcagagtgaggtgtttaataacaaaatacagtaagttaacttaacaatttcatatacttaataataagcttgatggaagttcccaataacaaaatgcagtcagttaacttaacaatgttgtctgctgataagtaatcaattagaccatcatgttatgtagaagactgtcaaaaaaacacagaaaaaaaataataataggacattggaaccataaaattttaagatacaaacttacaaggggattatgaaacaaaacaaatatgcgaaccatacgaaaatccaagtgttgcgctaaaaggaatatgtaaataaaaggactatacacgaaaagaagttcataccaagcacagagatgaatcgaaacaaagtgggtacggtctagctattaagagatgttattcaggtaaaaatcatccatctgtatacttcgtaaaacgggaatacttatccttcaaccaaaaaggccgaaaccaccatatacaaaacaaattttgagacattaccgaaatgcattggttttgaagtgaaaggaaaggcatgtcactgcagatttattcacggcaaaagagttgcaactttccaatcacccctccacaaacccactccaaaacccaattctatgactaaaccccaagaatacctaaaataccaagatgctatcagacgcatcttacagcaaaaaccccaaaccaccccaaaggccctaaaccctagatagaacggcgctacgatccccgtgcaaacgcagcagcagtcccaaatccgcccatggtgcaccaaactgcgggcacgattatacctttgatggaccgccccacgatggtggaatcgaaggccgcagtgtcatcgccggtggagatgatgatgggcgcggcgagcgaggctaggagcaggagcggatttgggaaatcccatgatacataagcgttacaagtaaataatgatttacacagtacagcaagcagtgcaatggtttctacaaatataaccgaattttaatttcataggcaaatgaaagacaagcataaattctacaatgtcagataattcaaattgtattgtcatgctccactaactaatgattttaatggaagaatgttgaaaaaaaagtaataagatttctgccagaaaatataagtttcagttcagtacaaaccacccataccaagagaatagcaccagttttgaatgatccaagtgatagcatctcaattccctgtaagataaagagaatcagtaggtttatctccaagaagtttgggaggaaaacagaacatatttgtgaagctcttgaaccatagtcatttcaataatgcatattaaccttatatctcaagataagacaagagcatacctgaatgcagaaagcaatccccaaaacattgtttgctagccaatgcttcttcgcagaataccatatgcaaaagaaaaatcctgggattgatgtaacaacttgagacttggtaaactccactgagagcgctgaaataagaaattaatgaacttaaaagggccaccaagacataagcttgtaacatgattcatgattgcaccaatctgacagatacacatgcaacaatctgacatatgatacacaattgcaccgatgattgagcatttaaaaaaaaagaggtttgggtcctacagacatacagtggaaaaatgcatcatgctgaacgatgaaattatcattccattcttttggaagaaatcatttcatggaaggcagcaatgttgcactgcatcagaaaaaaaaaagcacataaacaatcttaattgcacaaatacaatattacgtagttacatgaatggaaaagctactatatcatccaacctgccagcttttgtgtacatcattgattcattttcctaatgatctgcaacaacaacggtgaaaaaaatgattatagagatttggtgggggcaattagatgagatgaaggaaggggatattagatataaggatgtaccgtgaataaggcactactggaactcgccttcgatttagcacaacactaatgaggtaaattagaacatggacaaccagacaactaccctacccctgcatcagaaatatgaagctgcacagatgagcttttatctcagctgtcataagcagtgaagaaaatcaagcaaaacttgtaattgtaccaatgagtgagatggacagatggttgcacctcattaaaaataaaaaggcccaaacctcctgtccccacctgatgctggcctcctcccttgttccccatcacatcgctccagccgctgctgccatctctcccgcgcaacatgatcagaaatccggccaccctcactgcatgcaaaattgaagctcatcagaaacgactctgtgcaacaaagaacaaccaagcaactcctctgagcacagccttgccacctcttaattatcagtgcatagtgatgtacacattcatgaaacaaaaaaaatatccacagctagagaaacacgcaacctttgatcgtgcgaacacgataaaggatcagtcattttgtgcacctccattatcctcatatactgtgaataatagaacccgtacaaattgggatcgtgctgcatcagtaaagaatcggggatgagaggagatttcttcctgtaacttaccgagatggccactgggaagagccttggggatggggcttggacgccgccagccacctgcctcatgaccgctatgagcagcggaagcagcagggcgaggaaccgccaccaaggttgagcggccattgctgtcgccgattgaaccggtaatttttttctctgttgtgaaagggatgaacaccgcggcaaagacaaggggaaggaggatctgagacccttagcctccctgttgcagccgattcatccccttgtcatcgttgacaatggcggcaagctgctcaaggagagctcgattctgtgtccgctagatcaaccacaagcaaaagtcagtattgcttgagatcacaacacaaaatcatcatagctgcacaaaagacaaagattggcatcgattaccttggcccttggggcgaggcagcccatgagagtggcagcggcattgccggcgttgttctcctcaataaaactgattgtggagttcattacgagcagtgtgatgatgcccacgaagtcctgccagcccggcagcttccctgaaaacaccaaacaaatcaaccctcgtcaattcaatcaaacctctcacaatccctcacatgccatgctctggaacatcatgattcattaaattcattactacttactcctccattggcaagagcgatggccatgatcgccgcggcctccatgacccaggacagcgggttccacatgaacctcaagaacttgctttcctgcacacacacacacacacaaacaaacatgaaaaaaaactctgcaccatcgaatcgattcctaaacagaacaagaaactttagtgatggatgcctgggttagcctccaaacataaaggccattactatgaaagagctgcaagagagaaagcagttgcgggtggtcccagaaggcttggattgcacagattctaccagaggatgttgagatgctcccattgcaactcactgatggagaagaactggagagctcagctagagctggaggaggtggtagtaccagttccctactggtaccagtggtggcttgatcacttcaaattggagggactattgggccaaattcctctactgaatcttgggagagaaactacggattgggtgggtcaccttcttctccttgagcttgttggggccgaagaggttgaggcactgctcggcattggtggaggtgagccagccggagacggcgatcgacagcgacgacggcagtggcaccgcgaggcggaggaggccggcgagagcaggaggtggcaccgcgatgggcaggcggcggcgccgtcggcgtcggcgtcggcgggggtggagaagagtgttcgcctcctccctttctccatgttcacctcgaagcccacgctcggcggaaaggcgtcggagcgaggggaaggcagaggtgaaggcagtcggagactgcgacacgacggcggcgtcggtggaggtggaagcggcggcgcgagggcgaggcagatgtggacgcggtggcgcgaggcgacggcggaagtggcggcgctcgacggcgacggcgacgacggtggcggaggaggggaggcgggcgacagcggctagggttaggggtgagtggaccggcggcggaggaggaggatggttgagggagagggagagagaggaggagcggcggcggcgttcggcggcggcgcgagggggaggcggtggcggcgcgagactgcggcggcggcggtggcgcgaggcaaggcaggagagggagagggcgagacgggagcggggaggggaggggatgcaggcggcggcggctagggtttgggttagtgcgggtagtttagcgaaaagcccctcaagttttaagttttacagcgcggtcctaactcgcgtactttccttacttctcatgtaatatccatattttttaagggtctttacgaaaaataacacctcacaagtactattctcgggggactgcggacgaattacgcgtgaaccagagggctttcgcaaaaaaatacagtagaaatcctacgtggatacgcccagaactcaccccatccgccacacttaatagtctctaatttccagtctgtttgtgtgcgtttcttatcttatgagtaatgttggtcaatacagccagacagtcctgggaccggattatgtggtgccatatctcctggcggttgactttttatctatcgaattgttttactcctgaatctggtggagtatgtgtgaatggttaatacccgaatctcgtgtactttaggttcacaagaaaatattgatgacaagagcacaagattgacgtgtttctgcagtactaaaacttgtttttgggtaaccaggaggagcagcgaagcaaatctttttcggttccctggctatactcgtggagtgcaattgtaaaacacaaccgcaaaccaaacctttgaaacaaccaaaacacacagattccagggcacatcccaccagccaaggacaagtagctgtgcccttcgaaccacatcagaaaactagcaatcccaaacggagcaggacatcaacatatttccagagttgcaaaaaaagcagtatcacatacagcagcgaaatagcgtatggttcaaatgattgttactgctgctgaattgtcttcgtgggtaaccgagtggcgtggttcagctaagtcgctaccttatagttacaacttaggtatgttcaaaactcaaccacatagaacaaaaaacgtccctactacaagcggttcaaaattacttggccccacggccacgggcccttccaccagctttgacgcctttcttctggctcatgtatgcctttcccatcttccctttaccttcagctgaaaatattggtcgtacagtgaagagtaaatgagacacctagtagttaattagggggataaaaaccaagataaaataaattatagttgcatttaacaagcgaggtcaaattcagagtcctcaatcagtaatggcattcacaacatgaaaacatttcattggtccaattgtacagtgtgaagagtaaatgagacgcctagtagttaattagggggaaaaaccaagatacaataaattatagttgcatttaactgtgaggtcaaattcagagtcctcaatcagtaatggcattgacaacatgaaaacatttcaacacaaaacaggagaatgatgtccaaacattaaactaaaatttctataaaatggctgcatgtgcttagaatataaaaaaaccagcacatgaagatatatctataattctatataactagaagacactccagatagaaacaacagagaacatgaagatatatctataattctatttaactagaagacactccagatagaaacaacagagattaaaaaataaaatgttgttgaacccaatgaccaagttaactgttcacaacatgacaagttgaaaatttgaccagtttactattcccttcatccaaaagcttaaaacctattccttttgtcacgaataactcatccgtcatgtgacaaaaccaatgaaccattgacatacatgcagccaataagactattccttttgtcacgaacactaaggtaacccattcgacaaaacaaatgaactatatacataaatacagaccaatagatagcttcacaaacacagtgacttaacacagttaggcttattgaggaaaggcagcagcgtaccacccagagcggaggcctggtccctcctggccaccagaggatcgtcgaaatacccaactgcatgcaaataaacagtatgaggcacaccacaacgaagcaaaggtcatgtaagcaacgaggcacaggtcaggtaagcagtgcaaagaacttaccggagggcatggggtagacgatgaatgcgaaaccggacttagtcccgacgagcgctcctttgcggtagcgcgtgaacttgttctcgaacatgacctcctctgtgtcctcctccttggtggccatggcttccctgcaagtatcaaaaaagaaaaatcaaatcaaatcagtactaaaatgcatgagatccaaatccacgcccaccaaaacgcaatagcatacgagaaatcggcaagcaagagatccaaatccgcaccaaccaaagcaacaaatccgcacgagaaacaaacaaatcggcaagcaagagatccaaatccgcacccaccaaaagcaacaaatccgcacgagaaacagcaaatcggcgagcaaaagactagggagatccaagtcgcgaataccacttaaactcacagggaaacggatctgcaataacgaagaagcggaggccgaggacgagagacacacacagtgaaggcggcggcggcggcggaaggtggagaaatgatgctggtcgttccttttatacctataaaacctgggccggcccaaacctagtgcctcgtcttttgccttatgtttttatgtttgtaagccaaaatttaaattttctatcttaaatttaggccatgtttggttctataaaagttttactgttttcgagcactttttgctataatagatctaaacactagagttgattttagggttctttcatcgtagcttatttttcagcatttgcttttatatcgttaaaaacacgtatgtaaaaaatttatttataaattattttccgtttgcaaatatgccgtcaataagcagaacgatagagtcctaatatagttttgcgttgaataaaaaagaacatgttgcaccaaatattgaaaaaacaaaaaagaaaggaacatggatcaatggatggatagaacaccaaccaatctcgatagtacccgtaatatatcatttgatctctaatctaacaaagtctcgtgatcaaataacatatcatttgatcagagacgactttgtaagattggagtggaggcgcgaacgaggtccggcgccgccgcgcagatcgatgacgccggcggacggtggacgactgcggcggacgaatgaatcgagacaacttctcttctccatgatggatcgtggatgaatggatggacggactgaccgagtatatatagagccttcaatttggtgccttgtatatcgggtccccgtaacggaaattgaccatttaattcattctatttatttcaattcggtgccttatatattgggtcccagtaacggaaattgaccatttaattcattctatttattcgtatgccaaatcaaatcttcactaactaatttctttccttgtttcccagtaacggagtagtattgttattaaaacaccgcaatcagcgccacccaatcacaattaacaacacctacttataaggagtaccatagttgggctaacggcttggcccatggcccgtgtacgtacgcttagtacagatctgacaaattcgatatttctggcttagtaagttaaggctgcatttgatcatgcatattagaggttagtttttaggacgtgaaaccaaaaaactcattagcacttaattagttaagtattaataaatttttaaaaagatttattagatttttaaaacaacttctatgtagactttttattttgcaaattacgcaccatttaatattttgaaatatgtgctaacggagaaggagagagctgacgtttgaagttggagaaaagaagcatgcaatggtcattaatacatgtctcttagtcttactattaattaggaaaatatttcttcggtagaaaagacacaagaataggaaaggcaaacatcggttcaacattaactcttattttatataaaatgaaaatatggttgcacgaggatgaaaaaaaaataaaaaatagtaacaaaatatatatttttccatttaatgattacaatctctatatatgatctctaaatagggtgtgtttagttcacgctaaaattggaagtttggttgaaattggaacgatgtgatggaaaagttggaagtttatgtgtgtaggaaagtttatatatgtagaaaaattttgatgtgatggaaaagttgaaagtttaaagaaaaagtttggaactaaacaaggccataatcttgttcttatctctactttccaactcacctacctcgttttctgcgcgcaggctttgcaaactgctaaaggtgtgtgtgtgtatatataaaagttactataaaaatcatattaaccctttttcaaatttattttagctaatacttaattaatcatgcattaaacgctgcttcgctttgcgtgctagggacgatcacacccttaaacatgccctaatagcattcaacgaaataaaaaacttccttaaattttatcagtaatgcagtatatttttggccatgtatgtacaacaataacaataacaataatatgcctatatacggccggcacagctacgtacatactcccctcattttaaattaaaccaacctagaaaatgatttagtctgtgtattttaggttgatttattttaatattgaggaaatatgataagtagtactcccatattagggccgtgtttagttctttttcaattttttttaaagtatacggatatacatttgaattattaaacataggctaataacaaaacaacttacagattccgcatgtaaacggcgagacgaatctattaagcctaattaatccatcattagcaaatatttactgtagcaccacattgtcaaatcataacgtaattaggctcaaaagattcgtctcgtaatttacatgcaaactgtgcaattggttttttcgtctacatttaatgctccatgcatatgtccaaacatttgatgtgatagaatttttagaagtttgaagtgaactagtttagtttcacaccaaaattagaagtttgaagaaattgaaacgatgtgattgaaaagttaaaagtttgaagaaaaaagttggaatctaaacaataccctatgtgagtgtgacacatctaatatgcaatcaagatagatcgaaaagacagctacagtcaaaaacaggcaacagggcagtttcttcagtcagatatgatcgacgatggcagatgaccagatgtattgcgagcagaatttagagtgtgtttagttcacattaaaattgaaattttggttaaaattggaacgatgtgacggaaaatttagaaatttatatgtgtagaaaagttttaatatgatggaaaagttgaaagtttgaagaaaaagtttggatctaaactcgaccttagaatgacatcagtatatgaagtgtactacatacctttaccactagtaggctgtgtttagttcagcacaaagtttagattttgtttgaaattggagatgatgtgactgaaaagttacgtgtgtatgacaggttgatgtgatggatgtcacaccctgaagttctcctcccaagcttaaaattaaatttataaatgaccctaagaaaataccggtgcaaatcaagataaaaccctaagaaagtaatacaaataatacccgcgccggtcaccactcccgaaaccgctgccgccgcgccccacctcccccgctttccccgcgcccacgccgcgtcgcctgcgcccactccacatcgccgccccctctccccgcgtctcccggccgcgcctgcgcacgagaggggcgggattcaattttgaatcccctcccatcttctctctctccttccccacgtcgccggcgaaatcggagtatgacttgctgagtacagtggatagtactcagtcttgctctatttttcccccaaccccagagtacgagtatgtgtccgatggtgggttcttcgaggagtaggcttcatccgtgcagtcgaggatgcctatggagtgatgttcccgctgcagtttaagtcaaggcttagctcctgttacctttctttttcccgctgcatttatgtaagacttttataatgtttgtaagacgtggatctgtatgtcaacattgtcgtttgtgtaccccggccggtcctggacgggggttttaatgcatattctgcttggaattctattcgggaatttctgggcgtgacaagttggtatcagagccgaccttgaccgtaggacaagccaaatggaaaacctaagagccctctgaattcttttcattgcataagttctttgcaattggatttgttccaggaaaatttgggatctgttctcgtggttcaagggaaaaaaatcttgtcgctcgtttaagggaggtttgccaaaacaagtcggtctagggttttagtaaaattatttgagatgttttgaccgtcagtcgggattggatgggatttgatgggcgaaatgcattagttcttagctcaggaatatgagttgtaaggtatttatgcttttattgttattataagtatgtatctaatttccccattatcttatcgctatgtaagtccgtcttatttattcgctctcatgcaaaataatctatgcataaaatttcgctcttattcgattctcttatttgagtcctttattgctttatttaatttggatttgagcatgcattgatcctacccctttgtcttctctagatggccgagcacccacccaaccaccgcggagaaggcatggatgacttcgtggcagagttggcacgcatgacactggtggtgggctaccccaacgcgccggagtacacgactgttccaccgctcagtggcgagcttcctcaccgtgtccgcttggaggtccatggttacgtggggacttgcctcgctaacatggtggtcgaggcgtctggagccacagcagatcacgcatgtcaggaggcagcatatctgatgatggccagactgcgggagcgccacaactacatcttccacaacacggtgtaccgtttccaccctcgtcgagccaacgacagtgatgtcagttccttccgtccgacagccggcgagaacgacaccaccttcagtcacgtgcgctgtgatgagggggatggacaggatgcactcggacctgcacaaggcgtccaaggccttgaatgatgggaagctcatgaggatcgtcgctctgaaggacgagatagcgcgcctgaagagggagaatgctcagttgaagggtcttcccgcgccaggaggagtccagatccgcaccacgcctcgcaagtcgacaacggcacccgtgcgcatccagcttgcgcccaggaacccacctccgtcagcagctcccgcagcacctccagttccgcccgcagctccagcagttcctacagctccagcgccagccccagctcctgttcccgtgtcagctccagcatccgctctctccttcgcacctgcatcagccgtcaggggccccgccagtggcaatgggggttggttgcctgctactcccagtggcagtcgcgaccgcagcagcagcagctccagtggcatagagccgggcagcggcgagacttatctgccaggctccaggagtcgctcagaggacctggtgacgagcaggaggacgccttcaacttcaccgaccgcaggagccgttccgagcattaggctcgttttccattagcttatcgactgtctagcttctgcttgttagtttgtgtgtttaggttgcttgcttggggtcagttgacagtcgatatcatgtgcctatgatatggctgtcttaataaggatttttgcttgctgtttaaagtattttaattcagattagaacaattgcagtttaaatttctatataataaagcttagttcctgagtatctgtttttctccgtttccccgtctgctcttcctccagatggtctacaccaggactggcacccgcacgacaggcgagggcagcaacggcgaagaacgcgctgatggtgtgcaccccaacagtgattccggcaatggtccgccaccacttcccgagaatccgacgctagcccaagttatggcacatcagactcagatgatggcagccatgatgcagcagatgcagcagcagcaccagcagatgcaccagaggatgctgcagcacgctgaacagcagcaccggcagtttggtccccctccccctcagtccaagttgccagagtttctacgtgtcaggccacccaccttctccagcaccaccaaccccatggaggcgaatgactggctccatgccatagagaagaagctgaatctcctgcagtgcaatgatcaggagaaggtcgctttcgccacacaccagcttcaaggtcctgcgtcagcttggtgggacaatcacatggccacccgcccgccaggcactgaagtcacttgggcggagttctgtcgtagcttcaggaaggcacaggtgccagacggggtcgtggcacaaaagaagagggaattccgggcgctccatcagggcaataggacagtgacagagtacctccatgagttcaatcgcctcgcgcgatatgcaccggaggatgtccgcactgacgccgagaagcaggaaaagttcatggcaggtctggatgacgagctgaccaaccaactgatatctggggactacgctgattttgaaagactggttgacaaggcaatccgtcaggaggatcagcgcaacaaaatggacaggaagagaaaggcggcacagttccggtccaaccaaggaaaccatcagcgaccgcgtttcactcccggacagcagggtggacctaccaccatgatcgtccgccagcaccgcccgttcaactccagcaacttccaccagggcgctagtggcagtcagaaccaccatggaggtcagcctaaccgcggtgcagctccacgcccaccagtggcaccagcacaatcaggcccgtccgcacaagctaaggagaccgaagccaaacctgggtcctgtttcaactgtggtgagcttggccacttcgccgacaaatgcccgaagcccaggcgtgccgggccaaggtttgtctaggctcgtgtcaaccacgcgtctacagaggaggcgcaagcagcaccagaggtcgtactgggtacgttccctgttaactcaatccctgcaacagtactttttgattctggtgcaacgcattctttcatttcaaagaaatttgtggggatgcatgggttaaggaaagaagagcttagtacaccaatgagggttcataccccaggaaatagttcaacctcagtcaattttagcccttcagtgctaatagaaatccaaagatcaccatttctagccaacctcattcttctcgaatccaaagacctagatgtcattcttgggatggattggctgaccaagtttaagggagtcatcgattgtgcgaatcgcacagtcaccttgaccaacgagaagggagaaaccgtggtgtacaaatcactagtctcaccaaagcaaggggtctccttgaatcagatcgagatggaaatcccagtggtcaccgaggagaagaattcgaggaagttggaagagattcctatagtctgcgagtacccagaagtgtttcccgaagatctcactaccatgccacccaagcgaaagattgaattccggattgatttggcaccgggaaccgcgccaatttacaagagaccgtacaggatggcggccaacgaattagcagaggtcaagaagcaggttgatgagcaactgcagaaagggtacattcgaccgagtacttcaccttggggtgctccggtcatttttgtggagaaaaaggataagacgaaaaggatgtgcgttgattatcgcgcactcaacgaggtcacaatcaagaataaatatcatttaccgcggatcgatgatttgtttgatcaactgaagggagctaaggtgttctctaagatagacctgcgatcaggctaccactagttaaggatccgggaagaggatattccaaagacggctttcaccactcgatacgggctgtatgagtgcacggttatgtctttcggacttaccaacgcacccgcattcttcatgaatctgatgaacaaagtgttcatggaatttctcgacaagtttgttgtggttttcatcgacgacattcttatctattcaaagtctgaagaggaacatgagcagcatcttcgtctggtactcgagaagttgaaggagcaccaattatacgccaagttcagcaagtgtgacttctggttgacagaagtcaaatttctgggtcatgttattacagctcagggtgtggcagttgatccatcgaacgtggagtcagttaccaaatggaccccaccgaagaccgtgtcgcagattcgaagttttcttggacttgctggttattaccgccgattcatcgaaaacttctccaggatcgcccgacccatgactcagttgcttaagaaagatgagaagtttaaatggacagctgagtgcgataagagctttgaggagctcaagaagaaattagtatccgcaccagttttgattctgcccgactagatgaaagacttccaagtctattgcgatgcatcccgccacgggcttgggtgtgttctaatgcaggaaggcagagtggttgcgtatgcctcgcgacagttgcgtccacacgaagggaattatccaacccatgatttggaattggcagcagtggttcatgctttgaagatctgggggcactatctgattggcaaccgctgtgaagtatatacggatcacaagagtctgaaatacatcttcacccaaccggatctaaatctccgacaacgaagatggttggaattaatcaaagactatgatatgagcattcactaccacccggggaaagccaatgtggtggcagacgcattaagcaggaaaagttactgcactgctctatgcatcgagggcatgtgtgaggaattgcggcaggagtttgagcatctcaacgtgggaattgttgaacatgggttcgtagccgctctagaagcacggcctacgctcgtcgatcaagttagagccgctcaaataaatgatccggaaatagcagagctgaaaaagaacatgagagtcggaaaggctcgggatttccttgaggatgagcatggcacaatctggatgggagaaagattgtgtgtacctgacgacaaggaactgaaggatctgatactcaccgaggctcatcagacacagtattccattcacccaggcagcactaaaatgtaccaagacctcaaagaaaagttttggtgggtcagtatgagaagagaaatagctgaattcgtcgcactctgcgatgtttgccagcgagtgaaggcagagcatcaaaggccagcaggtttactccaacctcttcaaattccagaatggaaatgtgaggaaattggaatgaactttataacaggactgccccggacatcattgggtcacgattcaatctgggtagtcgtggattgactcactaaggttgctcactttataccagtgcataccacctatacgggaaagagattggcagagttgtacctggcaaggatcatgtgtttgcatggggtacctaagaagatagtatctgaccgagggagtcagttcacctcaaaattttggcagaaactgcagaaagaattggggacccgtttaaatttcagtaccgcctaccatccgcagacagatggtcagaccgagcgagtcaatcaaatcttggaagatatgttgagagcttgcgctcttgacttcggtggagcttgggacaacagcttgccatatgcggaattctcatacaacaacagttaccaagccagtctacagatggcaccgtttgaagctttatacggccggaagtgccgcacacctctcttctgggatcagacaggcgagcgtcaattgttcgggacagaggtattaacggaagcagaagagaaagtcagaaccatcagggaaaggttgagaattgcccagtctcgacagaagagctacgcggataaccgccgaaggaagctcacttttgaagcaggggattatgtgtatcttcgggttaccccgctccggggagtgcaccgttttcaaaccaaaggcaagttagcaccacgtttcgtgggaccctacaaaatcttggaacgaagggggaagttgcttattagctagaacttccatccaacatgatcggcatccatgacgtgttccacgtgtcccaattaaagaagtgcttaagagtacccgaagaacatgcagattcggagcatattgatatccaggaggacctgacatatgtggagaagccggttcgtatacttgataccagcgaaagaagaaccagaaacaaggtcaccaggttttgccgagttcagtggagtcaccattcagaggaggaagcaacctgggaaagggaagacgagttaaaagccgcccatccgcacctcttcgccagctcctccgaatctcggggccaagattccgtttaaggggggtaggtttgtcacaccctgaagttctcctcccaagcttaaaattgaatttataaatgaccctaagaaaataccggtgcaaatcaagagaaaaccctaagaaagtaatacaaataataatcgaatctggcatgtggaatttttcttgagttctacatgtcgaaattcactaacaagatttttagtggaatttttagagccctagaaataattttaaccaattaaaatggagcatgcaatattttaattccagggaaaatccttttctcctttttctttttctttttcccttccctttccgaatgggccgccggcccattctctcctttttctccccctcctccccgctgggccggcc

SEQ ID NO: 62905 - DNA, 5657 bp, Oryza sativa
  unsure (1)..(5657): unsure at all n locations
gtcttacaatatgaaacagagggagtattgaataacaataatagttttatttttattccagagatatcatactgaattattttttatttattttgtatttttcatgtatcaacaatcttatagagatgtttttatgcttttgatagcatttggcaattccaaaaatcccatgtcagactttttttgcaagttcaaaaaatgattcatgatcattcttcacattcagtcggtgaactgataatcaattgttctttcatggattattaaaacacttaactaatggtagactgattcccttttgtacaatttgctgtgcaaataattgttgaattaccgagttgctcctatgactttttcactgtgccaaaaatgattttgtgagcacctgcgggtgctggtcctcttgaagatggcaacgctatttgtcgatctggccaaattcaaggtgggtctaactgaatgcagaccatactatctctaaaagtgcctttgagcctatagtaagccaacttataataacttatattaaatttggaatgacagtgttttctttttgtgggtttattggcccgagtgaaatctagccagatcaaggccatgtgtgattttggtttctaaataaaagtaatggttatgaacggtatggttttccctttcttctcaggattgaatctttgaaatatgcatgaatggttagctttgaatgaacatttgtactgctgtattatactattaacaagtgcaacttttcaataatgtgacttgggatttagaaattaaggattaaaagtttgcacagaaaaggcatagagaagatattggtagcatttagctaactccaatagagggatggttgtgcaacctataagagagtagttaaaggaaaattggaaattatgtgtataactctgctgcttttcgatgtcatcgatacatcagaaagtaagaaagatgaccaatggttgagatgatgaacagtcattctgtgcatggtttcaaataatcaattattttcaagttatacaaattttaatttgcaatgcttttaaatcctcttttagaggaaccttgaagcagcaatgaggtgacatgcaaaatgcattttgcaccagaacaccttgaactaaaacgggataaatttctgatggtaacactaataggatgttaatttatatatttctcaagatactgtatagtaagagcaagtctccacatttcagaaaattgtgctttccttgcaacaaacggcacttggctagtgtacatctaaaatatcatttctagatcaccatctgtatcgctcgtttagtatgattacaacaatatgcaatttcccccagcaacaaacacaaaaatttggcactgatactactatatcatcctggtttcttctactgttctactcctaggattcaagaaagccaaaagaccgttctttagcagtaacacagaaactaatcaattccacatgaacaaaacaatagtaacttgctaagatttgaccatattatcacggtttcttctactgttctactccagggctcaaagaaagccaaaagaccgttctttagcagtaacacagattagaaactaatcaattccacatgaacaaaaaaataactaacttgctaagagttggaccgcatcatcctggtttcttctactattctactcaggcttcaacaaagccaaaagaccgttcttgaacattaataaaggttagaaactgtagtactaatcaattccacatgaacaaaactacaattaatttgctaagagttgaaacatcagttaatcaagaaaggtagattgaaccgaacgcctcacctagcaggtttcttctcggtagcaagacgcgtcccgctccatgggaacttccccacttcctctccggctctgtctttcaccttggtacctccattcctcttcttccccagcctcccggggttgccgtacaccaccttgccgcggccggccctggagaagcccaccttctcatcctccatccagtgcttccccttgccctccccttccacctcggcgccctccaccgccttcctcctggcggcggcggcgctggccttgcgctccctctcgccgaggacaagcccaatggggaagaggtcgggggagacggggagcggggcgcggagggtgacgtaggccttcttgtagtccggcttggcggcgaggaaggggcccccgcgcaacttcttgcccttcatgttgagggtgcggacctcgccgacggagaagccgtacatggactcgaggcagcgccggatgtcgaccttggaggcggaggggacggtcttgacgccgaactcctgcacgaagaagacggcgcggaaggaagcatgagcttgaggggaaggttggcaaagtggatcacgcggcgacccagccggctccccatggctgtctggctggcnacggcggcggaaggttgggtgtgncgnctgtgaccgtgggtggccagcggcgggaggcgtagggttttaggatccggcgggtccgctgtctagttgcggtgtgactttagcccatatccaccgtccggctcatccgacggaggacgtttggctgtgtgttgtttcgaacgatgtttcatgcgtcgtgcaaaaaaatgtttcatcgataaaaataaggtacataaacttgctcggcgagtgtaaataggtataacaacttgtaaattgctcgttttaatacaatagcttgtctagtttatacgaacctagtacaaaacaacacacatgcaaaattgatctaatgtgtagtactaaataatcatagtgagacatatccacgctagcagttgtttgtacttgtgcagacctgagcacactagcttaattttaaacatatcagtcacaacgatacttatattacaatctcttgtaggctgcatgcactactgtaggatcaagatgtcgactagaggggggtgaataggggatttaaaactaaatgacacctaatcaaaactaacttaagttgctaggcttagtgagggtcaactctaactaagcaactaagttatgttttgcaaacctagggtgatagtggctcaattatatctctaggaaagtaaatcacactcctatgtcaatgtttagcaatcctagggtgaaatgatctctagtatgtctctagaaatgtaaattgcacaaatataaatacaacaagtaaatgagacaaggagacaagagatttttcaccgaggttcggaaactcgccagtttcctactccccgttgaggcgagcccaactccaccgctcaaccacgaagccaccgcacgcccccttcgtcaaggggtgggcaagacgggagcaggcccacggagaggactacccaagcctcggccactagggtagttcttccttcactccgaaggtagtgaactcaaaaccactcacaaaccggcgccgggcctcctccacaatcttcttagagaggtcaccgggcaactcctccacaagccgtctaggaggcggcaacctccaagagtaacaagcaatgacccggcatggagatgataaatcaagtgccacactagctctacaaatagaagcaaatgtacttgactcttgtctagaacaatctcaaccactacaatggatgaacactaagctcaaaggtgtgtgagagaggtgcaaggggtgtatgcaattgaattgggtgccaagagagccctcttgctgctggaaggggagtatttatactcccaccaaccaaaactagccgttgggggcgaaatcccccagctctgtgctctgccggtctgaccggaggtatgtggccggtcagaccgtgctactctgcaacggctagaaaactagccgttgtagccctgtcagagggccccatcggcctggccggtcagaccgacgttgagtggccggtcagttcggcctcggctcggtcagaccgccatcagctcggtctgaccgaatacggctccgtcggctctgtatcggccaccccgagcagcaccatcccggcctccagggggccggtctgaccgcgcatgtgccgccggtcagaccgccgtttcgtggccggtcagactagccagggcacgccggtcagaccgccactatgtggccgatctgaccgcccctggtcaggccgaacccagtgaaaaaaaaagattgtgtgtgtgagatgaaatatgagcacaagtctaaatgcataatgacctaatgtgtcaattaaaatcatctcattgctaggtcattacccccttgatagtacggcgaaacaaaaaaataaactaacaaatttgatcgcccttcacctcgactaattttaaaactaaagcactagttttaccgttttcttttcttcgcttcgcgccatcaaattttaatccatcgatagtcatccatgcgcacacatgacgtggacctaacttaaaatatatctcaatagcaacggttagtccacaattagcgcttgtcattaattaccaaaattaacaacgagggcctagatgcttcaatctgcccctttttggtaattgataacaaacaccacgaatatatataatcaaacatagaacacatggacatatactgtaaaggaaatcaaaagctccccctaaacatgtgcataacaatcacaaatggcaaatatggagccaatgcacatttcaatttcacaattcaacatatcacaaacacaagagcaatatctcaatgtgaacttcaagaaatattcatccatgagcataagatggtcatatatatatcagtatcacatacaccatccatcattgcacaagttcacatcacttaaccattcaactcacataagtcacaaatcatcctaaaagggctcacaaataaacataggctattacaagaccacgaagggtccaaatgacatagagttcaacaaaacgataaagaacacacaatatagagtaacagcccatacccatacataatatagctcaaaccaccttaacctattagatatgaggacactaacctcactaccattagtcccaacccacaatacataaagcacacctaaggacatttttctctcccttttggcatcaagtaccaaaaaggtcttaattcttgtggaggagaaggaggaagcgccaaagaggaaggattaggagtatcacgacgacgatgatatacaaaagcttgggtgctctccaacatttggactcgagaatccaatgcacccactctagtgtgcaatctccccatggaagcattcaagtctccaacatcggtgcgcaagccacgaacatcctcatgcaatgcttcatgcctggtagacaagcgttgaatgctttcacttaaggtattaatagccccaagtaccgggttgaagtattcattgggttgcattccaaagtaagcatagtgaggatgaaagaagcatttggatcatacccatgaggaggaggaggtgctgggcttgagctagctccagggtgagaagagggcaccgtcctaggagcacggggagctctaggctgaaggcggggcttgtactgcttgtgcttcttcaaattttgcccagcagccccaagcttgttcttgaatcaacctcatgatgtaaggggcataatagattccctgagtgaatgtcctcttgaagatagcaatctctggcatcatgagagacacaa

SEQ ID NO: 62906 - DNA, 1075 bp, Oryza sativa
agtgcagtgcactcgtttatccggtctgtgaccagtcacagactggtcagatcgcgggtttggtggcgacaggcgatctgacgcacgcctcgccccatccggtcaggacgagggcttctaggcgctcgtccccagctggagctagcgtgttacctcccagagatggcacgttagtcctagtcagatatatgccaggcttcatcctaaccattacaggcaagatgttgtgtgaagaagggcgaacatgtagattgctaagctgacacgtggtggacaagaatgaccgacgtgactggtctgacaccggtcatgtcgtcagcagacagccacgattccacgtcgcatctgctcccggcgaaagtggaggtagttgtgggccgtctcatcagatggtgactcggacggcaactatacaaatctccgtccatttatgaaaaggtgaggtaagtccccacaaaaaagagagaaatggtgcatgtggtatccccttaagatataaaaggaggaccttgcccactgggaggggggactggacttttccagatggggaacccagaacaagggagaggctggctcatactttgtagctccttcatacacagatctcccaaaacacaggagtagggtattacgcttctcagtggcccgaacctgtatacatcgcccgtgtcttgtgtgtttcctgtctcgcgagccttccacatacagagagcttagaatctcaccctgagtccccggccgaactggcaaaggggggcctgtgcggtctcccggtgaggagccccacgctccgtcaccgtctatcgttgggaaaagatggacataaactttgttggtgcatggtgcctatgagtatgaacacacattttttacacaaataaataaatatactacataagcatgtgattagtattaacgggtttttctttataggatgcaatacatggatgcttagaagaccatggttcccatcggttatctagatccaacaaggatctgtcaatcccagcataccgtaacgctatcagaaaacactgaacagctcaagaacatgacgcctgaagaaatagcggaa

SEQ ID NO: 62907 - DNA, 2053 bp, Oryza sativa
tgacatgtgtgactgaagtgagaagagcaactccttttatagcctcccaatgacggttgtgacggtggaaatggtcgaaaaataccctccacccgtcattgggggctaatccacaccgtccaggcaaagccctggatcggatggcgctgagaaggattcggccgaacctggggccggcccaatccagcccatttttggctggcggcctcctccgttgttcttctctgcagacttgtgaattttggcccggtttgtcgtgtcaattctgagttcttggcccactcatacataagtctaattctcgacatcgcctaattgatttattgtctgtgttgatgtcgattctcctccactttattgttattctctgcaaaaggttagtgaacctaatactagtggaatattattattctaacatgtatatgcattgcaagcattattagttctcctctattttggcaatattgatggtcgaaactgatcgataacgactgtcaacaaaaccccccaagcttgaacctgtgcagctcatttacctcaggttcccagataattgtttgctatttatatttaacctttgagagagcacttacctatgaacctatatataagagatataaaacagagcaactcttcatcatttcaacaaagagaactagcttgtcttacctagcataactcaaacctatcctatctttttttttggtattttctattttgcaaatttttatgttgtcttcaagtttataagatgcaattggaaagcaaatatgtaattggaaagggaaatatgcaattggaaagggaaatatgcaatgtgatacaagttacctcagtggggggagagatatctccccccaagcttggctttccctcagggtccttgataaggattgaacccctgaaagcggaagtacgcttgaacatcatcgtgctgttgctgcatcatgttgttgatgttggcaaactgagcatcagcagattgttgccattcttacgtttgagctatgtgttccgtgaggttgtactggatctcccccgtctgcacatcaagggtatccattctcctagtgatttcacccaagtcccatcgagaagaactcgagcgccattcacttggagatggaggcataccacttgatctaagacgttggttgtccccccattggatatcatgaggcacacgccaccggtcctcactggcacttgcccagcttgagactctaatgctgtggcgtggaacttgggtccatccgggtgcatccccagttggttcccaacctgcctcatacatctgcacgagtgttgaggatgatgaactttcccgttcattccttgtcatgttgcgtgtctccctgtatgctccacttgcacgagattcttctatgctctacaggggaatggttagttcatgtcagttatacaaatgataccctgcatttggcaacgggattttatttgtacaaccggggaaaaagtaaatcaaagatccatccactccatacttcagaatatgcccttgcactagataggtctcatccatacacggacgagcggctgagataaaagcaattttgttgctaacgacacctaccccttttgctatctgagtaatcagagaagtgcactcaacaggagcagagaactttatactttctaaccattgtcttatcatacatttcacaggagcaattttgatctttctaaccatggcaaacatgataatcaattcatcccccctaatggtctaagatcacctctaggaaacaaagtcatagcaatccatttgtgcatgagcctaagtgtaggattatggatatcattcatcataggtttcttgcaaattggagcaccagaaatatcttcccaaaacctatttttctcgaacccagaaattcctttctagagatcgattttacagcaatcgtgaaaaccaagaagtgtgcttaagcttttccatgtaagtgtaaactccttacggaaaaagcgaaaggaaaatccatcttctatttctttcaaagtgcatagaaattgcaaagtaagcaaacgagaa

SEQ ID NO: 62908 - DNA, 18145 bp, Oryza sativa
ttaggatttgtgatgtatttgatctgtgtgtaggatttgtgatgtatttgatctgtgtgtataattaacttaatatttgggatgttgatttggagatatgcatcccatttgattcgggagaaaatacagggattaacactagccattagcaaatcaacaataaaataaaataaaaaagatctcgaggtctttagtcccggttggtaccaaccgggactaaagattccccctctttactcccggttgatggtgttaccaaccaggactaaagatcgatctttagtcccggttatttgaactgggactaaagatagcgatctttaatcccgaattcgtagtcccggttggaaaaccaggactacaaagggttctaaaccgggagtaaaaagcatttttccaccagtgactgttaattgcttgcggagcagtcttgagatcaaggccgtagtgcaaaatgttatgaattctggctgcggtattattagcagtcgtctacttgatgctgtaagctagcttcaagtgaaattggaggtcaatggaatgaaatactctgagatgcagttctgttcgtacaaaactgagggtaaccgaaggtttttgccttctttaaaagttctgttttggatgcttcatgtcacttggacaatatgctggcatagacggtatgtacgattcattgaatataatataacatgattcttggtttttcggatatttcatgtaataatgactcatggatccattaattcttgctatatagctggtacccattactaacaaatattgctataaagcagctctctggtgcagccacatcatcggtatgttgtagccgtggatcgttggtcttgttctgatctgagccatgtgatagcatacgccatctcctgagtcacagatcaattgagcagcctatgtttagcggctaagccaaagttaggaggatgtatggacgtacgacccatccaataatcctcacggtcgcatggcccccttcatccaagtcttgctcttaagacatctaagagcaagttctacataattgaatatcttgactgcaatgggggttacatatttgaaactgtttatgtcattttgaaagtatcaaaatatttcagtagttttcatttgatatcgatatctattgctacgtacaacctgttttttgctacttactacagttgcatatatatcgcagcttgcttgtacggtttcaatatgtaatactcctccctccgtttcacgatgtaagtcattctagcatttcccacatttatattgatgttaataaatctatatgaatgtaagaaatgctaaaatgacttacattgtaaaacggaggaagtaatatctatctcagatctaaaatatagatgtaataccctgcaacaaaatatagatatgataattaatattatgatttttggaaagcacttaatttcctatttagtcattatttgagttagaaatctatgtattaagtcatctatgaggtcctcgaaaaaaaagtcatctataaagcccgcagcaacacagcggggtatctgctagttgggtctggtgtgaatgccacgttttgaacgtgatgctaaatggattggtgttgcaaggctgacttggcagggggctgacttagcagggttgtggggggcgttggggacttgcggtgtattgacctctattttggtcagagcacaagggacgtggtctatgtgacttttttttgtaccgtatgtgcaatcgtaaggacgcaggaaaaagaaaagtctagaggtagctaagtcattttgctcgtgcagattatggtttatcacgggaacgctttgcaagctcttaaatttaaattgtctgacaattatagtatagtaaatgcaataactaaattattttgatcatttttttatacatattcagtttctaaatatacttattttgtattcagtttctagacttattttgtcaatatacttttcgtagatttgtataagcatagtgcttaatttttattattctattaaaagtcaattaattttactatgtggaaaattttgtatttgggttgagatttgagaaggtgaagaaaaaaacaaatccaaattaggggtgcaaattcaatgagcagcatatagatcaaatgcaagattataatgtaggcaaattttgctacaggatatcgcaacttcgtggtattagctgtgggacaccgcacaaagtagcttttggggaaagacagtctcaaaatgtggtcatttgccaatgcacaccgcagacattaaaatattaatttctcgttcaataggagagataaacggtgtaaaaggtcaaaaatgctcctaggcccacttgtcatattgttttcccacacctaactcccggccatatccttcgatcaccgccagcgaccaccccgacaccgacgtcggcaacggcgcgaccgcaccaccattactacttgttctccagcaagcagctcaactcgttcggcgccacggccgtgcttgccttctccaccaccgtgccgctccttgcgctctacatcctcgacagcctccgcttaggcgacacggtgggtgtcaccacggcgtccccgcacgcgttcctcctcgccgcgcagatcttcaccgagggcctccacgctgccgctgggtaggtcgtcgtgctccatctcggcgtgtattggcttgtgtattgtgcgtctatggtgggtgttctctctctccctaggaggccttgtatttataaccatagatgccccattgtctaagtagaactagggagtcaagtatagatacgatccgagtagtccttttcgtttccatatagaactttattggtccttccttatctgaaactccttctgtatacgaggtatgattccgtataagacttggtatatggtgggtcccgtcgagcttagtcgattactattgggtatgtggtatccataacgctgacactattagaatataatccacttgtcaagtcagagcaaagttttgtattatatagtaggaaaaacttataagattacaacattagaggttgtaacctggcaaaaagaaaagaaaacaaacatgccaccactaccacaacacaggatggcagctccacaaaaaacgtgagagggtactagcactaagctgattgctgctaagcttgaccgatcgccaatagacctaagggggtcataggtgccccgccaaacaccgactccacacagaagaacgtcaacgtacgagctcccggttaaactcatgtacaggggttgagaagaggaagagagcgagagagaaggagatccacttggacctacctccaaccttatggcaacaaccaagaaatgtcgatgattaaactgagagaaggcggcaacagtgaggaacgaaagacctcctgggcaatgcctgtggggaggtgacgctagaggctccaccgtcacccatgaaggatgagaaagtggtcgcttgacaatgccctaatagagggtcacgttgctagaaggcatcaccgttgctggctcagggagatgtcgagctaagctttcacctgcagaacccacacccacacctatcgtctccaccttaaagccttgttacccgatcaatctctgctagcacataactccgatgcaccaacaccccaacgccggctagctcattcccgccttcgtcgggtctccacgtgccaaagtcgcctcccgcacccatcggtgtagctcaccaccgacaactgcttatcctgcaatccatgccacgaccaccagcctccattgactcacccgcaatggtcgcctacagctgccggtcgtgctggcctccttgctgtctccaatgtagtcctcttgtcgcgccggctgtgttagcctcccggccgttgcccgtaccctcactggccgctagtggctatcaccacgcgggccttcagatacggtgcggaggtgctagatacggatgcgaggactccagatctagtcatggcgacaccgaccactagctaccgtccctagggccatctgcgggagcgctagaaggtgtcggatccaccgcctgcaccgccctttcttcgtgctgcgtgccacactgtctccgcgtgcgccagcatgccgccttcttcggtgagcacaccattgcgcggtgtttcccccaagccgtgaggtggatgagaggagagagacgagcggtggcggcacctagggttttcccccgagctaccattgggatgtaaataattatatccatatatgtagatatacgagaaatgaatttatatttagaatagagttacataatttgagttggtcaccaggattctatgtttgcactgtggggtgtcgaactagaaaaatgatacgttttgattagtgttcttctctatgcaaacgatgagttcaactcccccgtcttataatatagcaacataatactggatgaaatatatcctaatatactacgaatctagaaagagagatgcatatcatctagtactagcatgagacagagggagtatataattataagagcttgtcccagctcatatcgttgtaattgaagcctgggagagttcgcgtctatcctaattcattttttaattgtaattaattggctatgtgcaccgtgaacttagtgcaaaggtcggaaatatatgctttctataaagtttattaagtctaaaactcaacatgcaaccataccacatcacccactagcaataattacatatttaatcacatgtaagtatacaacatgatctatattttatttaattctacaaaccaaaatgcaagcatatccaatcatcacccctcatatcatcatttacacaatattttaacaaacatatctatcacttttataatatttaacatatagttatcaatatgtttcacactaaagcacaggtatcatttgactgataaaccctgatgtttctcttttatttctttttactcctagcttgattgtaatatatatatatatatatatgtatatatatatatatatgtatatatatatatatatatatatacatatatatatatatatattgaatcgcttagaaattcccgcagcaaagcgcggagaatcacctagtgtgtgtatatataaatatacacttcctattgttttaaaaaacatgcatgtgacgaatgctagcaaatctgaaaacggcgtcccatttttcttcaactcgatcgactctagtagatcccagttaacttttcgcgttcccatatgtagataagtatatatatgaccaaattcgtgtattactgataatatactttgatcattctagatcaggaacacaaatttcaacacacggtcccggcccctttgcacctaccagtcaacaagcagtaccaggtcttcaccctggctgtctcttatcgagtgatcaattaatcctagctagtcccatgtagctcagtcgaaacttcataattcagctgaggtagatgaactcatattcgtcaaaggcaaatttcttgcgttccaggtaatctaataaagaccaggtgatcttctttgtggttgaatcgtgacaagtcgactgccgccagtggtcgatcgtaacagtcaactctaggacaggtgtttcgttgcctagcatagtgatgaacttactatgtcatataaacagaagatttagtacgtagctggtgacgacaaccatatatatcttgaagaaaaatctcaaacacgacgtagaaattaacacacggcgatcgagtatatttgggcagcaataactataaatagaaagccccacctccaaatgagatgcagacacacatctcaaggcattgtgcacgtagacacgagtgagctgtttaattgagacttcgtgcagtcgtgctcctatcttctcattaggatttaacttaatctgatcagaagatagtatatgcacacgtgagtgagtttggcggttaaagtgcggtgacagtctgagagtgcgtgcgtgtagttttcaaaagaaaaaaaaagtgcgtgtttcctagttgaactcgtaatagaataggagtagtaaactaaggatacgtggcactgatggaaggcagccgcggtgacaagggcaaggtagtggtggtgatgggcgccacggccaccggcaagtccaagctggccatcgacctcgcattgcggttcggcggcgaggtgatcaactccgacaagatccaggtgcacgacggcctcgacgtcgtcaccaacaaggtcaccgacgaggagcgcgccggcgtgccgcaccacctcatcggcggggtgccccccgacgccgactacggcgtcgacgacttccgccgcgacgccgcgcgcgccgtggcgtccgtcctcgccaggggccgcgtccccgtcatcgcgggcgggtcgaacaggtacctcgaagcgctgctcgacggcgagggtgggtcgttccgcgagcggcacgagctgtgcttcctgtgggtggactcccgcgcgccggcgctgcacaggtacgtgcgccaccgcgtggaccgcatggtggagcaggggctcgtcggcgaggtgcgggggctgttccggctggacgacgccgactactcccgggggatccggaggtccatcggcgtgccggagatggacgcctacctccggcaggaagccaccggcgccctactgacgcacggagacaagtacaaggtcgcgctgttggcttccgccgtcggcgagatcaaggcgaacacgtggagtctggcacgccgccagctgcggaagatccaccggctccgcggcctgcccggctggagcctccgccggctcgacgtcaccagagtgctggagttgaaggtggaggcccgcagcgaagcggagtgcgccgccgcgtgggaggcagacgtcatcgcgcctgcggcgcgggaggtggggatgtttctgcatggaggagggaatgtggtggagagcggtagggaggagcagccggtggtggtagagaagatggaggttgcggcagtgggtggtgccggtgcggcggcggccgcggagaagtggtgtggtcggcggttgctggagacgacggcggcgtaccatggaatggaggcggccgcggcagtttgaccagttaataacgtcggaagagtagtacatatatattcatgacgtttcatggtttggtttggttaggttagctggcgattattttattaattaattgtttcattttttaataattgttgtatccatttaataaactcaacctgaaggttgattttcggaatgtaagtttgcgtcacctcttctcaatatactggagaatgtcagctcatttttttcatcaaactcaaacaattataaaaaaatcactaccgtagaaaggcaacaagtgccggttgggaaaccctaattggtgctggtttttccaatcggcaccacggaagcagtatggatgacactggtcatcggtgccaccaaaaaccggcacctatatagtcctaataggtgccggttctaagccaaaaagacacgtggctactaaattggtgccggacctagctaataggtgccgattctaatgtaaagagacacgtggctgccaaatagctgccgtctggtaatgaaaaatcggcacctatatgttgggtaaaaaaaataaatattgcaggaaattcatccatacaaccctaattccatacgaccccaatttcatccctaagtcaaaattcaccaagtctaaaaactcatgggtccaaaaattcctatctttaaatcctaaacatttcaatatatattctaactcaaaatatgctaagtttaaatttcctaaatcaaaagattgtaagtctaaaatttttgaagtctaaaagttgtgggctgcggcctgctaacttgtcaaggcctagctcgttaaggctcgcgagcagctcgagctggctcgttatctctaacgagctaaaatcctagcccggcttgttagaaaaatgaagccgagccgggcttgtcacgagccgagcgagctaacgagccacgagcttcctgtccacccctacttacatccattgtaaactagagttttggagtccttcaccatggttgtgatcttgcgatattccctattatcagtgccaaacctctccccatcgcgcagcatctgatctagaataggttcaccatgatcgacacacgtttggtcctcctcctcctcgcagccgtcatttgcatcatgcccgtgatagttgccggcacttccctcaccttgctcctcctcgccaaggaagttgcccacaaaaccccttgtaagaagatgtgcatggacctgttgagccgaaagttgtctgtcttttttgcaatcatgacatggacaccaaatttattccagtgcatcaactaagtttgtgctggtggccacggcaacgagagccacgatccgctgtagttatccattccagatccattacattcaatgggtacctgcgattattatcgtttattacaaaccgtgaaggaaaaaacaatgaagatttcataatttacaattacattagaataaaaacaatgaggaatgaccattttatcctatgataaaattgagatttttgtacacacccacgtcacaatacttagatattcatggctaacgaaaatataaaaaaatttctatttttcgtcaatgcgaaaaaatatttggctaatgtgaaacactaacgacgatggcatagatggaataaaacattaattcaaatttagcataacatccgagaacagatctacgaatgactgatggatccatacaaatgactagtgcattttacatgtattaccacatggcaattcaattcaacgagaaaatgtgaatcggggtgagaaataatgaatatttaccttgtaggcttcaatcttcaactaaaacccaagaaaaatcgagcaaaaccgcttccacctcctctagccgatcgatgggcaccctaagataaatttgagataaatcaagctgtcaatggacatttccgtggccttaaaatagtttgactagcattaatttgactaacgaccatgacatagatggaagaaaacattaacgcaaatttagaatttcatccaacaatagatttaatgagattaatcgagtggcaagggagggaatacatgtactgctgttggaataaaggtgctggttcaaaacccaaaaccggcaccttaatttctcttgtcaaccggcacctatgtgtggggcccaccaacggctaatacatgtactgacaagcattgttggaacataggtgccggttctagacccaaaattggcacctttgtcttaaaatcggcacctatgtgtggggcccagcgacgtctaatttgggagggagaagattaaaggtgacggtttgacggttttttactatgaaccgacacctttctctgacacagattttaggtgtcagttttatttaaaaaccagcacctattgtacataaaggtgccattttttgaaaatttggcacgtgggagcaggtgcataggcacgaaaggtattataggtgccagctttacctactccggcacctatagtgccgacaccgtaaataatacgattgactaatgtaagatataccggagaatgtaagtctcccgtaactttttttatacaaccttccttaccgagctctagctggtaaccttccagattgcttaataatgttgtggtcagagtaaagccatagacgcaaaacctgtatctggtctagacaagagaaagtacaagtctataatctctctaatactgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcaacagcggaaaaaggcgatcctagcggggcttcagctccactccacaggcaaaactcaactggggtctgagccttggtcttctaacttcgtcttcagctcagaagcactacacttctgaaaagggggaataatagcaaggctgagtacaaccaccgtactcagcaagccacaccaatgatgcagacgtgcaaggggatacagggatggtttgtggctatttgcataaaggcggttgtaaaacattttattgagcaaaacagtaaaactgttgagtaattaaagtaacattaaaatctccactgatcaacgctacaccacgttgaacaggcccaaccaacccacctggactacagtgcattgggtcgatttattaaggtgggactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacatcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggtaagcactgtaagtcttccagggtttcccgtgaaccggtccttaattgccatgggtgcgactcacaaaaccatgcacccacagcccaccattcagtcgcattttagttggataagcacgaccataaaacatggccaaaagtctcgagcacgcggctcaacaagatactagaatgtctaaaactgcaattatcccatcgactgatctagtggtaattaagcatggctaagcataaagttctagctaggtcacataagtaacacaagctagtcgatttattacccagggttgacaaaggatagatatcaagtaaacatggcacaagcgagcagataggtaaaccctgatcccatgtaattagcaaaacatgcatatttatttgtaaacggtaaaacatttataaattgggatcaacatgctcaaggggaatgtgtgacttgccttgcttcctcactttgatcttctaaactcttttcctcgcgaccgcgatcttccgaaacgacggattctacacgctggcacgcaaaacgaggaaaaaccctaataaaaaccaaggaaacagtacataaaaagtaaacaaacatgtagagcttaattttagatgaattttgaaatttgaatggctcaattcggagttcgaatgaattagatatgaattttagaagttttgagccattttaatgaatttctagaattaaactcgatttattgcgcaattattatttatttttacaaaggaaacggacctcgctgacgtcagcaaaggggaggggcggcgccggcaagcgggccccacacgtcagcgagtcaaagggggagggcgcacggtggaccaagtccacacgtggcctcgggggcacgtccaccacgtggacggcccagatcggcccgagccgatcgggcggccgaggggagcggcggccaggggcacagcacggcacaaggccggcctggtcgagcgatagcgcgcggcggcgtgcggccagacgaccgccggcgacagcggcgcgtcgcggcagcgggcacggggagcggcggaggagggaaaaaggagaagggacggtggggattctcaccgaggacggcgacggtgagacgaccacagggaggcggctggcggcggaaaggatggcggcgactggcacgagaggcggcgggaacggcgttccggcgacacccgaccatggcggagacgcggccgagggccggcggggccctcgagatgacgaagccggaggaggtggcggcacaagtcggcgtcgaccggagaggcggcgcgacgcggctagactcggcggtggcggcggagagagatggtgaacgcggcggcggcgttccaggggcagggaggggaaacggagtaggggccggggtgcggcgaggaacggcgatgccgatggcggtggtagcgcagcgcggcagcgacgggagcggtggtggcgcgcgactggaggtgacgagaggcagctgtggctcgggtgcacggtggatgtggtgtttcggcggagttttgtggaaacggagcggtggccggtgtgcggcaaagagcggcggagccgacggtgcaagcggcgcggcgcggcggcgactaacgcggcgggaaacggcgaccggagtttgccgaagtgtggcagcgcgtgggtgcggcgtggggagagcgagggagagtatgccgggctcgggaaaaaaggggaaacggacgaggggagcacggggatgctttttatgggctcgggaaggcgggatcgaggccggacgtggcggatttgaagcgacaacggccggcgacgtgggcgacatcgtgggcgaagtagggctcgatttggcgccaaaaattggggaaaagtgggggatttggtggaggaggtggaggggatcgtgcccacgtcgttggatgcgagctcgggtgcgggagggcgccgtattttgcggcgacgtggacggcaatggcggttggggtcggccggcgagaggtaggaggaggagctgacgggtgggaccgccggtcccacctgtcggcgaagggagagaaggagggacgcaaagcagacttttgcgagcgggccaagggagaaggccggcccgagagggagagaggggggggggaattgggccgaaaggggcccaaagagaggagggaggattttatttgttttctttttattttaattggttaaatgatcttcgtgactttaaaactatttctcgagctccgaaaattcacggaaaattccggagagtacattagggcacaaagaatattacaaaatattcccggccattgatttttaagggaaaatttcaaattctcccattattttacttgattaaattgatttatcttttatttaatttctagaaaatgtattattaattgatttttattcccgaacgaaaatcggggcgttacagcacagggtacacattttttattatgtgttctatatgcatttactcattgagaattagtgccttcaacccattctactcccctctcatgttacttgccccgtcataaccttgccctcttatgtcttgtaaaaagttaatgtcagacaagacagcacaaattgagttcttaagagtcagtgaagaagtgtccttataagtcctttgttgacaaaccgaagaactattgccatctgctcttttttagatttatctcgagcttcatcaaccattatgcaatacttgctattaccaatttcttctctaactgatttttgcactttttgagcaattatgcttaggatttctttttggacatcggatgatgtatacttttcatttcttggagaattttctagcacaacttctcgcacatctttgctatatgaagccaaaagcttaaccatttcgagaaaattatctcgatttaacgaatttagagattcattatggcctctaaatggacacccttgaaatgttaaccacctacaaggacataatcagcacacaaacacaaggctattagatattataatagtatagcctgtagagtttagatgtaaataatgtgcaaaaaaaaaaaagaacaactcatataattatctaatggattcaatggtagtcgtaagccttagtcttgctccttccaccaatatatcattctgcttaaccatcacctcgtcaatgtgagccataaagttttttatattattgtaacaaccaactcaaaagttatgagcagaagtggcattccccatgtgtttcacaaaagcacattcttttccatcattaactttcttccattttgaaactccttcactgtgaaagtaactaagccgaacttgccaactggttctttgaaaagagaaaacatggcaggcaataagcacggtctgtgtgtggtgaatactctagccaactaaattgtttaaaccaattactttggaatcgacgagcatggaatgcaccattcagtgggtactcttccaagataaattggtatggcccctcagatatataaaatctcctaccatcatctcgttggtcagcagggagtgttgggatacgcataagctacgatagcataaatcaaaattttctaccacgtaaactaggaaccatgcaagtattagatagatcgttaccactcgacgcgctgcgcagcgaaagaaagcgctaagaaggcgaaggaacctcgcgatgtagcgtacgtcgatgtagaggaaatagtcgatctcactggctcgaccttctcctcctcgtgcgttctcctcgccgtactcctacgccgatcagcaccgcaaaccagcggcccctctaccggtatccacatgtacagggatggaacgccacgcgcagatgtgctagcacccgcgcgcggctagggttttgctcggggaggggagtggcggctagggtttctcacgtgatgcaataccttcgccggtcacacccctcacgaatatataggatccatgactcaggtctccaagacccgtaggactcctattcggatccctaaccgaattaagctcattttggatctccatccaatccccttattccggcccattaagcgtgcgaccctgtaggttcatgtacactcggctgtaacccgaaaactccttttcgatccacgtgtcaacagcggcccctagcagaacgtattgacccaccaggcatacataaagatcatatcggctaaacctctagtgtatacttgtatgaacccctttgcctcacgatatcggttaagctcaaggctagatatgtgtcatcctctaataactcaataattcacttgaacctgtgatagattatataacttgtgattgactcctcaatcacctttggcatggccatacgcttccataatctatagcatcgaggagcccagagatatctctccataggaggggcaaatcccatcttgattattcatatcccactacatgtttcgtagcatacccgaaaaatacttttataactacccaattacggagtagcgtttagcaatccctaagtaagctactacacatgttgagaaccatgataatcacaggtctaataattaaacaccaacactaaatgagatcactgatgacacaacacatatagcccttgcagtgtctcatgttgggtctatccaacaacatgttccccaacatgtgtctacattattaatttggtatctctatatcatgatccatgagacatgatcatcaattaatacatgtgctgatcatttaaacatatttgttccacatacgatatttgatcagggattctttagaaatagtaacaatcaacataaagagtctcatgaaagaatcacatattcattaaccaataatgagttatctatttcaagaaataatattggataaatatgtaaacatattatgtgatacaatcttctcaatgattacctctaaggcatatcactaatagggagtgcggagatttgaacatgtttacctgggtccctttcaaatgccgtagttacaattccttgttcagctctaaaggttcagcactgttctgattaggagattgcagattaaccggatcaacagcttccacattagttgggttaggatttttcaacagagcctgcccttggagccactggcttgtaaaagcaatcaatcgttgttatcttcctcttcatcttagctaaacacctagcaattttgatgtagctgaaaatataaataaaggaaaatcacaaaattgattattgattctgctttaccggatcaaggttagtaaaactagagaatatagagtggatttacagggtatttacagtgttcgatttggggataacttaccaaaaagcagcagccaacagataggtggaacctggtccgtgagctcagaagatgtgcgcatgttctgcagaccacctctgttggattgcttgctcctagctcctgcttggtgcctcgagcagccactctatcggcggctggccgcgtcgccacgagactgcaatcggctgatcgccgattagcgccggacgggacgagggagaccggaaacgatgcgtcggtgctgcgtgcttgagaaactgaaggccggcccctagcgatcgcccgttagccatctcgcaagcgatgggacttcacgacgaagccgaggtatcgcttgactctctcccgtatatcgagactccaagtgctaatgggctgggcagctgcgcagatggccagatgggctttgtcgggggtggggaatcgttcatgggccattggggggtgccaggcccagttcggcaccccctatagcttcgacactgctaccggcaatggtcgagtgcaccgtcgccggccatgtcggacgacgagaaggtcctatcctcgcctcctgctccactaacgctgccatctgctgtcggtccgccgctgcggccgacggggcggatgaccttgtttcccacagcggcatgcggcacaacttaaaactactggccctcaccggctcaccgcttgcggctcacctccagctaaggttgtccatgatctgcgcccgctctttcctcctccccactggcgacaccaatggcgaagaagaggggggcaacaatgtcttttgttaaattctctctccagctctaatgaaagtaatagtttaatggttctattgttttgccgtaaattatcatatttttaaagtgtttttgagcaaattaacgttcttaatatgtctaccagtaaatatcatatttttttaatatcctgtagcaaattttgttaaataattattctaattctactatgttaaagaataagcttgtttgtttagggtaattttttaccaagccaaaattttatcaactttaataatgtcgcatgtatatttaatttgctactctatttttctcacagtagttcaaattctatacttaaatttgatattgatagcgccaaaatttattgacgacactaacaaaattttgataaaataaaaatgaactctattccaaacgagctcaataattcatatggatgcgagtcttacgccaccgtgaaatatcctactctacctttgtgcgccccaaccagccgctgtccactcggccgtcaacgacgacgtcgtcatgcgcgagagcgaagcgcacgagcgctgaccctgccgcgctgccgcagccaacacgccacgccaggagcttagcactgagcgcgcacaagagattggctggcatgaattagacacggcttccagttccaaatccgaaggaaaaacacagcactgcacgccccccgccccagcttgatgatcgattaattgtcggcagctcatctttccttgtcacatatcgcaagagaagtcatagatgcactagtcatatatagtacggctccccgggacccggccacggcaggcttagctgtgctgtgtgacccagcgagcttcgccggccggcgcctctccatctccggtccagtttgagctccatgtcagaattcacagtactgcagtggacctaaacgcgctcgatcaatcgccgtctaattaggccttgtttagtttagaaaaattataggtttagttgtcacgtcgaatatatcactggtggagaaatgctttctagtcccggttcataaccccctgtagtcccggtttttcaaccgggactatgaatccgggactaaagatcgctatctttagtcccggttcaaataactgagactaaaaatcaatctttagtcccggttggtgttaccaaccgagactaaagatgggagcatctttagtcccggttgataacaccaaccgagacgaaagatattttttcttttttttctgcttttaatattgaatattgatttcacacaatcccatcccatatccaaatcatcacatattacagaacatctccaaatcctcacacaaatcatctccaaatatatcacaaactcttaaaaaaattacatcacaggattctaaaaaattcatcacagattcacatctcacacaaaaatacatcacagattcacatctcaaaaaa

SEQ ID NO: 62909 - DNA, 28160 bp, Oryza sativa
  unsure (1)..(28160): unsure at all n locations
atgtctggtcatttctcggtttcaccgagtgaggttgagagtctccttaggggcactgacggcaaagagcacctaaatgagctttctggccaagatgcagtttctgccgaaggtgatgacgaaaaattccaggacacctgtgagcataaactgaaggatgaccttcactggattccatcctttgacaaagggaaaaacctttccctggttgacatggagtttgataaagcattccaagggatgggtttggttggtgaggaaccacttgggttctcatcatctcgttacaatccaattgatgctaacaatgagaagaaaactgaggagccaactgtgcaaaatgtgaaccgtgtcattgattcatccaaggttgttgcatctagtgaacaaaacaaacctgatgattctgaatttccacacgaagcttcatggaagaagcaactcttatcactgtacaagaatgtgaggaaaagcaacaaattctggcccatcgttgttgctactgctttggtgggagtcacatgtttttggaggcgctggcagaagggcaagttgcagcatcagccggtcaaattgtatcccagcagcaatgaggtaattgtgaatgaacatctttgtttttaagaaaaaaaatgccttcctttttttcttttacaaaacgtgagggattttcctatggtcaacaagtaggtcggtaggaatgtaaggacggacttgaccagtagcagacatctttagttagaatcaaaccatatgcatcctcttgcaggacaggggcaggcctagatatttgatcgggaagtatgctgtggttttccccccgaccaatatgaaggtttctattatcacaaggatgtcttatagcacatactgtaatatccctttacaccttaagggcttgtttgggtaggccgaaatcatggtcaacacatgtggatcctgtatttgaggcccatccaaacaaatgctgttctgataagtatcttaggttgtaatgctaagtgagaaacacatggtgagggacaccttttttcaagtaactagaggattcccctcgcattgcagcgtaagccagaaagtcttcatagtatattacatttgaagggagcaagtaactgaaggcatgaatgatggttgagattaaactcaaagagagatccagtggcctatgttttttaggtgatgtggctcaatgcattttgagcatttggtgctaattatataggaatacaggatataagataagattgtttattttggcctccatggtttgctgaaatccagcatgtttgatgcttgttgcggcaattctgattttactggttatgaagtggttgctatcagctgagttctaattaacgcaggcttctgttggcttttcagaaaattaaccaagctgtaggaccgttgaatcgcatcaaggacatccttgttgccaacaatcacccagctccagctatccatggacatgctcgattgagctgattatgctcaccaagtcccgccaacatgctcagtttatgagacatctcctgaatatgtacccacttgagtcatcatcatcagtgaagaatgaatgcactggggcatcatctactcaatactgaaaatcgtctgggtgtttatgcgttgaagttatgtaattgattcaaacccccccttggatttgtatttatgtgtttagtgtgattcatcttcttcctcttttgagagtactgctcctggtttgtcaattgcagtgccctttcaggttgctgcagaaaacttgtatatatatatatatatatgatcatttaggttgatgatgtttttggtctgtctgtgttgtgtgatcctgcttatattgtcaacacttacgtttgatttcccaagaacagtttagcagaagctgtaactcgatgagtcaggctttcagataccaaagctttgattacatcacatattgtagtattgtctgaagccactactgggtctctttttaaaactgtgctatattccattttgtattactagcatatcatgaataaatacataattaccccacttttacattgaagaagacaaaacaactccatttgaggaatgtgttgggtacccattggctgacagtatggaaattattccttgtctgttagtattagcatagaataatcttgccccaatcgtggtggctggctggccgaaataagaattgctgcaatggatttaagaagattgtttcaatcatgttcctatcctaaccacatggacgcgtttttgcagtgttaaactgaccaagcttgcaggcttctttagaggataataatagtacaaaatgatggcaattatatatataatacttaggaggagagtgagacaccttgattaacaccacacttaacactttagaagtagccaaaaaccagagtttggagatagccccagcacatgtgggtgttggtgtcatccccagatgattctgatggggacaaccaaccaaaccccaaaccttgcaagaaaaaaggattatgatgctaacaactgacagcaaccaaggtgtcaccctaaagcattagctggatttttctcatcttccaattatcactgcatggttgttacacctgcaacacagcatctcatcttcttctttttgtgtgtgtgtgtgtgtttctagaacaacaaattacagtggtcactcacagtgactgcaatcagcacctactttttcttggacatactattacttatcatccttttttcctatccttttttttcagtagacaagaagtatgcatcaacgatgttatgttcttttccagtgcgatgaccaagtctacgttgaaacaaatggacttctatgctgaaatacaatgcaggtggcaatcaacttattcacagtaataagggaaatacataaattaaagagaaaaaaatgttactatcaagttgattagacagatacacagttcttaaataaaccaactagtatttcattaaacagccgcttgcattggaatctggctaatcacttcatcagtacccagtcctatcgttaagcaaccaggccatcatttttaattatttttttctcctccaataacaacaaacaaaacgagccctctctctctcaaaaaaaagagacaaaaaaatacagataaacaaaaggagagcccgtcgtgtacgtcgttagaacagaaccaaaaaaatacgagaagaccactccactaaaactctctctcatctgactccccccatgaaaagcaatcgcttttgtttgtatctaccaaaatttgtttgaactcgtcaaacagttgacttaaagacttgagttacgcacgcgtgagaaaaccttcacggaactctgcaaacacaaatatacgaatttcacattcgtacgacttgaatggaatttttacggaattccagattttgaattttgaagtttggcgttgaaaagattattacagtagaatacaataataatttctccgtatgcgtcgcgtacgaatggttatacggtggagtttggtcaataaagaaagcaacggaatggaagctgtgcgtgatgatttcacgagcaaaagttgaagaaaaaaaaaagagagagaaaaatgtttttgtttgtttttccaatgggaaaaaaaggtaggtgggccccacccatctccagctgcacgagggggcgtgcagtcgccggctacctcagaagccctacccgcctcgccgtagtgcgaatgacaggtgggcccgggaaccgcccgagcgcacggatagcgcgtacgatgtggggtgcgtgcgattattattatcggctgcctccacacgcacacgtgggatagtgccaccgggccctctccctgaccaaaatgccctcgcgaactccttccattttacgatactgccacctgaggtcaacaaccaaatccattttcctcccattatattctcgtttcacagcggtgacacacggagaaaaaaaccaatattaatttcggtaaaatacgaaatgactaatatgcccatgccctaatccccttccgtgtcttgtgcttctctcttccccggcagcgcgtccatcgaagtagtagcatactactctctactcctctcctctcctctcctccgctttggtttgctccgatctgcagcgagagcgggaggtcgtcgccggcgaggaggcgcggcggaggaatcctctccttcccgatcccgtccggtgcttcctcttcttggtctgcgagtaaagctcggccgccgccggcgacgaactggtttggggagagccacgtacggcgccgcctcgaatcgaatcgaattggaggtatcattccttctcgtagaggcacctcctccaccgcgtgtggcttgatgagcgggcgtggcgtggattgggaatccatcggtgtttgtttggtcgattgattgattgatttattttttttccttccattaaaccatcgtttattcgggatttgttcatgcgtagtggtagtggagttgtaatagcagtttgtttttttttcgaagaagaaaaaagaaaagaaaagagggaatccccgtgcctcacgttacgtggcttggaattttctttttttgatgatccattcattactggatgatttttttctcgattaaaacgtttattaatcttgcaggttgatttgactcgttggttggagcgctccatcgattaagcagacggagtcatgcttcttctttgggtataaaagtttggatctcggaggctcgattcaatctctggagtgggaacaatcgtttgctcgtggtcgtgggatagctcctctgcgagatgcagagtgggagcgagatgagacccgtgcacaacagtgtcgacacggtgaacgcggctgctgttgccattgttacagccgagagccgcacgcaacctcaggcagagccggttcgtgcctcactccctgcttccatgattttttttttcatgtatgatatcttcgttgcgtgattcagctgggtcatttaggtagcttacttcgatgatattgttgtgacggcgttcttggttgcttggtggtgggagcattactcggttgttttttagttaaggttgctgtatttagtaggcaaaattgaagaactgataggcaaggtacgttttgtagtcttagatgtggttttacgctagagtgttgatgtattggacagtaaacttgcatttttagggagaaactgcgtaagtggatctatgagtgcaaattttctttgcttattcatcacttgttgacttgcaactaatttcttgtccaccgtctttaacttttacaatatatcagaaatttttagcacttcaaatcgaaaatataacataaatgctgccaggattagttcctgctgtatatttttctagctattgcaatctatgattcatttatccccggtatatattaccatgtttgaccttgaatgaaacctatgtatcaccttaaaacattgaaaatatgcatggataaattaccattataaatactgtgagaacaaaggaggggaattgttgaaactgtcagtttgaactcttcagaggaatagatgggaccaaaagattcttcctgtgctggccatatgcaagtatgcaaccagccattattttattttaacttgctgaggccttggtcattcttgttttttttattacatggcctgctgtttgggctttcatctttgtatattattaatttccctctgagattacctctcatagggaaatgcagcactatggtgctcattcatgatagccactctccaggctatttagttcgggttatctcgtggctatgatcatttatgaaaccttcttaatgcttttattttgaactggaaagtcattacctggctaatgggggatctatgacgtaattttgatgatttgtggaatttcatttctagtttttcgttacggttacatggagcctaatagctcgatgatgctatatttctattgccaacctgtttacatgttcacgttattggtcatcctaactctgcaatacaatcgctatagaatgcatgtctgacaaaagctaggtgcaggctactgtactcgactgtgcttatgctgtttatgtgccaaatatttatgctacaatagtaatcttcttaagtcacatttcaggaggattaagactttccttttgaattaaatagtgttgttcttttgcagcgaagaaaatgggctgattggttgagtgtgtacttctgctttggatcacagaaaaatggccgacgcatcagccatgctgttcttgtcccagaacctttacctccgaggacagatgcacctatgccagaaattccaatccatccgccacccccggtattcccctttgtcgcacctccatcctctcctgcttcttttctccaatcaggaggtgcatctattgtacaatcacctgttggtgctccatctttttcgcctctctcgccaaattctccatcccccactgggccaccgtccatctttgctatcggaccatatgcacatgagacacagctagtctctcctcctgtcttctcagccttcacaactgaaccttcaacagctcctttcactcccccaccagagtctgtgcatctgacaaccccttcctcaccagaggtgccatatgcaaagctacttacctcaatcaacaacagcaaaaatgctgaaacaggtgagcttcagtcataccagatttaccctgagagcccaataggacgtctgatatctccaagctcagcttgttcagggacttgctctccatttcctgaccctgaggtgcagacttcctcacgttccacattcccctcattcccagttcgtgagcctccaaagatactggatggcgagggaattgcaacacagaagttgatacctcgccatatgcgcaatggcggttctctcttggatggacatatttctgctgctgtaccagtcgtagacttctctgcccgacttcaaaataatgatcatgctatggatcatcgggtttcatttgagttaacagtagaagatgtagctcgctgtcttgagaagaaaaccaacattaatggggagtctgctgcagcttcttttcgccttgtgcccaccggtaacggagatcacattcatcccagagaatcgaatgatacaagagcagggctatgtgttgatgaaacataccatgatctgcctgagaaagcacggcgctccttgtcccttcgtaaggctaaagaattcaagttcaacaatgttgatgctcctagtgtggagccgagcgttggatcagactggtgggcaaacgagaaagttgctgggatcacatcagagccaaggaaaagctggtccttcttcccagtggcacagccaggggtcagctaacagttgcactgaccataatcttacaagatgaagaaataagcttctgtcatttttgctcctgctgtttctcagttccccagataccatcatcataactgcaggagatgcaaacttatgcaaaatattccagttttagcggtaagttggagttagttagtaactcagtgtccagctaatatcatcataagatactaaaggtgatgcagattctggaacctgttgttataaaaccataatacttccatggtgtagcgtctgttgtatcctccttaactgactggctgttctgatactgatgctgtttatgtacataataaactagcgaaaagagtagaactcttcctagcagcagtgtattgtcagagtggagcaagcaaatgactctgatcccctcttcaattagttgtgctttggctttagcagaagaaacttgaaaatattgttctgtcgtgcttaccagttcggcaagaatttcaattctgtcttggcatatgtgatgtcacatctcttatcacaaattctgtaagcaacactattttgttgtgctctgtatattaaattgggccaagtgctgactgtttatatttgaatgtttgattacccatggtcattctgaaatgagaattattctacccttaacttaatcacgtcatttttttcataattaatggtgtatgaggattgttctgttgtagttgctgagcctggataggaacaaaagagctggaaaaaaaatcaatcagagctcttacgttgtgctggctagaactctggacgaaattcattgatggcccgccagagattacatcaagatcacgagacgttgatcgtgcacatagagaaacccgacgagcaataattatcactgatatgtcaagatttaatgaccccaatgcttgtcaagagacgcatcgctaacgaaaatattttcccatgcattctcgcaagagatgagcatatgcgtatctatcaatcttgtgttgcttctcataattatccacgaaataaaactatcagtacgattggaattatatagcttggatgaaataatgtcaatccaggagagcttgaactaaacagaacagagggtgttcctgatatttgtttttgtttgggtcaaaatcaatctacgtccaattgaaaccgatgaaaacgaaacacaaaacagcaaatatcatagtactgttcctattaaaaatggaaacaagaaaaatgcagcttgagtcaaaatccgcattaagcacggagataaacttaattaagcatgggtgattaatggaacagaaagatttgaggccatagctgagggagagagagagagagagagagagagagacaatgccacaatggtgaggataacgttgatctatcaccaaacccccttgtggcccctttctctcacctcacaaatcaataatttaggcctctcttcgccgccgccgtctcaccgccggtgagcttaagctgaccacgattgcccggcctctgtccctgtcaatgggccccgctgcgtggttaatattctccctgatcaatcattgcctgcccatatcaaacatgctcactaattaaattgtgagagggcgaagcagaagtgatcaacttccaaacttgtggtaaccaatcagtaacaggaactgtcgtcacaggttatactaccatagcaccatatcttttatttctctataacctatatgagatgcaatcgtatataatcattatcgacccatctggttatagataaatgctagttttgactttgagttgttctacttcgaacaatattttttttaataatttaactatttagcattaaaattatgccattagatttgtaaccagaaatagtttactagtactatcttacatttaaatatattcgctttgatatcacttagaagcaactgttgaaattcatctactatatttgtttttttaatacataacgttattaacttttgaaataatgtttgatcattcgcattatttaaaaatttactcctttcattttatattgtaagtcgttttggctttttcctagtcaaactcgtttaagtttgactaaatttttggaaaatctaaaataccgaattggttttatttaatctagcattgaatatattttgataatatgctattataattttctatatactcggtcaaactcaaataaagttgactaaaaaaaagttaaaacgacttacaatatgaaacgaacggaataatatagatatgttaagatataagttatacttaaagtttatttaaagataaaacaagtcatatcaaaataaatcatatttatatatattataaatggacataggaagtacaatacttgtgttgagatccgtcaattatttattaacagagaaagtataatgcctttatattagagtataaataaaatgcccctaagtgtgaatttagtgatataatattcacgtagacaatttagctgagtttgttatattggtgaacaagctgatgaagaggcatgaggtaataattcatctgaatatgttactagtagtagttagtgatattttaagactcagcagagggtgagaaacgttccacccatgcatctctttgcctgtcaattagtgacaataatagtatacaaaaatcagctgatatgaaagcaacattcttacatgtggcggtgaatcatcgttaccaagtaaaaaaaactctgtggtaataacatgatcgtattgtcaagtttccaggagaaattctcaaatataaacccagaaatcaaacattttattccttgtgcagctaggatccaatagagacatgtctgtagtaatcatgttcatgtaaacaaatgaggtgagcagaccgcagcgagtgagctcacatgcgccaaccatttttctgcacatgaaaatacaagaatgtttttttcttttttctttgggtgtacacatcatcctcatcaatgagtagagagaagagtagagggtagtagagagccaaaaaaaatcgatcatggagaggccatgtggagctcgccaagtgtgagcatttaccttcttggaaagaatcccaagctagaaatccacagaattatctgctctcaaacattggctcatctgctcaacaatcctatcctcctcctcctcctcactggcagtgattcccccaaccccatttctctctgaattgggcttgtttctttgctgaattattattttgctcattccactctggttgcttgttcagagactccatgtacaattagttgaccattcttctagttagcttctcttgtgttcttggagttggagctggtctgtccatgtgagccatgttgcagattgggctagctttgggagcaagagagtggtagatcttcttcttgccagatttattgtagatacaatacaatcccatttcttgttcagatttcttggtgaaaattcctagctagatccatactttctccagtgtagtgtgtagagaagaagaggccttgtgaatcttatcttgggaaaaagaggtatatccatccacccatctgtgtgctgttcttgattggcggcaatggcgatggagccgacggtgaaggtggcgctggggacggcggcgttcgggatcttctgggtgctggcggtgttcccggcggtgccattcctgccgatcgggaggacggcggggtcgctgctgggcgcgatgctgatggtgctgttcggcgtgatgtccgccgacgaggcgtacgccgccgtggacctccccatcctcggcctcctgttcggcaccatggtggtgagcgtctacctggagcgcgccgacatgttcaagcacctcgggaggctgctgtcatggcggagccagggcggcaaggacctgctcgtccgcacctgcgtcgtggcggcgctcgcgtcggcgctcttcaccaacgacacctgctgcgtcgtgctcaccgagttcatcctcaagatcgcgcggcagaacaacctcccgcccaagccgttcctcctggcgctcgcgtccagcgccaacatcggctccgccgcgacgcccatcggcaacccgcagaacctggtcatcgccgtccagagcggcatctccttcggccagttcgtgttcggcatcctcccggccaccctcgtcggcgccgtcgtcaacgccgccatcctgctctgcctctactggcgccacctctccgacgagaagtgcgtcgaggtcgtcgccccggtccccaccgacgtcgtcgaagaggaggacgtcacctcccaccgcttctcgccggcgaccatgtcacacccccgttcctcctcccaccaccaccaccaccagcagcctggcagctcgctgtcgtcgcctgactgcgaggtgttcgagccagtgaagcccgtccctgtcaccagcaatggcgactccaacaacaagccggacgccgccgacgccgccgtcgtcgtcgggatccaccagaggcgcgcggcgtcggcggcggcgtgaggatgaaggaggaacatgcgttccggtgggtggaggagaaggaggaggccatggagcaatggaagagcacggtgtggaagacgggtgtgtacgtcatcacattgagcatgctggtggcgctgctgttgggtctcaacatgtcatggagcgccatcaccgccgcactcgccctcatcgtcctcgacttcaaggatgcccgcccctgcctcgagaaggtaattctgaattcctgatgctgaattgatgtcaaaaacgaaatttcactgaattctgatgctgaattgatgtgaaaaacgaaatttctctgaattctgatgctgaattgatgtgaaaaacgaaatttcggtacattttcagttgtttatggactgctactagtatgttcattcttgctcttattttggaaaccaatgtgttgtcgctctcactcgctctgaattctggagctgaattgacgcaggttgtatgaaaaaagaaattttggcaccttttttttccttgggtgaatttgtttacaggcaatccaatcacttcgattggtattctctgcgaaacagaagtcattactttggtatttgataatccaatcatactgaactacactaaatttgttttcagtatacaatccaatcatgtagcactatgttcttattacttctgtttttttcacatagcagtagattgccattcattttgaaacaagagtctttacttgataatccaaacatatcgaactacactgattactttgtcaagttccttgtcaccttgatgatagtactttggtcttgattttcgataacatttggttctgtcacatccctgtgttgttgctaaattgaagtaattgtgtgcaccaatggctctgctgttgtatttagtgttggttttggatacctaactgatgttaacttgagttgttaactgtagttttgctgaatgaaatttcaggtttcctatccacttctactcttcttctgtgggatgttcatcactgtggatggattcaacaagacgggcattcctagcgcattctgggaattcatggagccctatgcacggatcgatacaccgaccgggatagtaatcctcgccctggttattcttctcctctcaaatgtggcgtcaaatgttccaactggttagttctgccctctgttcatggtcaataatttcacatggcacatgtagaaattttcatccttgttgttactaatccatccagattttaaacaataactaagtcaaggaagcagcgtagacttaacgatacatgtgcttcgcactttccatgctatgcttgtcaagagtagaaaggaaagctgcttctttttttaatggaagctcacaatgccatatgtgccatggttgtctagcaatgaagcaacatatgagaggaaaagtttatctgtcatcctgcactttgcgcaattctcgcttccaaaaaaaaccagaaaatctccactaggttcactcacctactcatgatagttaatagaacaagatatcaaagaacaataggttcattttggagtctgaatttggggctggttctaaacaaagtgtgaatgtcatagctgataaccatgaagttcttatcagttaaagattgctctgtcctagtttcttccagtgaccagaaaaaaatcgtacaaaaatcagttgggcattctttcttttgatttcctgattcatgtatatacctgacaaatctcattgcagttctcctgcttggtgctcgggtggcagcgtcagcagcggccatctcccctgcagcagagaccaatgcctggctcatcctggcctgggtcagcacggtggccggcaacctctccctccttggctccgccgcgaacttgatcgtttgcgagcaagctcgcaggtcggagcagtacggatacaccctctccttcttcagccacctccagttcggcttcccggcgacgctcatcgtcaccgggattggcctactgctcatcagaagcaactgaaaaatggtacagaacatatatatgaagaagacatggatatcaggacatgtacaaaaagaatgtgaattttcaggtcaggtcgattgtatttctgcaaagattcaattgtgggataaaagaaaaatgtctatctttgcctcggaattaagcacggatatcatggtgcttggaggctttttgagctgtacatttgttagttcatattggggggagaagatgtatatgttgcagtagcaaggatcataaaagggaaatgtatatttttgttcagcattctacttgtaatccatatatattttttgaagtcgaataatttgtataggcaggagaagagaaaatcaatgaaatgcatgcccctatcgatgcagctaatgtgtcttattgcgatttactccctccatccaaaattctcatacacatttcatctttttttttttccaaataagatgctcgtatttgcatttcattcaaggatctgaaagattgatacgttcctctcctctgcgatccgacccggaccgttggaccgttagtgttccatcgaacagccagtaaagccaaaaatgcttatagtttgggatggagggagtattttctatcaatcgcagcggtctaatttcctattggggtaaacaataatatggaacaaatgcaaatattagagaaaaacctaatactcccaacgtcacagaatataacaactctcatcctaggacaatgtatctggacatgacattctatcctaagacaatgtatttggacatgagatatgtctagatacattgttctaggatgggtctcgtcctatcttaggttgctacattttgaggcagaggtagtatcaaataaatagaatgtctgagatttcgaacccatgaacccaaactgactagtacaccactgtcgagggaagatcctcaatagcggggagtcgtgagaccccccatttgtgagttcggccgggggcggaggctcgtctctcggaaatcactcgctcgtccctaagattaccggcaagcttgcacgcaatcggattatacaggttcgggccgctatggagcgtaacaccctactcctgtgtttgcgattatggatgagttttacaaaggtttcttcactctaaaaagcgcgctcactttctctcttctggagttcaggttttctgggcatcgtccccttatctcagtgggcagggtcctccttttatagctcaaggggataccacatgcaccgcctctacctaccctctatcggagggggatcccactccactttgggcttcaaaccgtgccttctcccggaagctaagcaataaccggttctcgagtggaacccggcgccgccccccgcctgacacgggggacagccctgtcatttcctcataaatgaacgatgacttgcgatagcccttcctcgagtgacgctcggatgtgacgggtcatacccacccccactccgccgggtacaagggcgacgtgaggacatggttgccctatccatcggatatgacggtcacagaccggtcatatccgttggacagaggttagctaggcgcgccgcacgtctgcccttaccgcattaaatgcggtgagggacagttggggcgtcgcacatttatggctgttcagcctgtgctcccttctcgctctctccctccgccgcgtggcagccgggtgagggcctcggggcgaagccgtgggagagcccgagggggtgacgtcatgccccgagccccccccggccgcttccacgactcgtgtgacgcgtgagtggggccagcctgcagagtcacgtggccggagggaaagtaattcccctctacttcatataccccctgtcgacgggtgatacccgtagactggatatagagggtattggggtacgttggaacaaggatctacgtagtacgacatcaagcaaacaaaagataagaattatactggttcaggccccttgataggtaatagccctaatccagttgatgtgagattatatgatagaaaacacaggttacaaagagaacaagggaacttgtcggatccggcgagattgtagtcgagttgattcgactagctctcgatgacttggctccttataagctccggcttcgtaggctgtggaggttgtgttagctctgagattcgatgcctaaaccctccccggggggccccttttatatcgcagatgtggaggtctcctcatagaactcggaggtatcagaccttatacgatacgccaacgacccagtcctgcccgagtaggattcttcccatctgtagattccgtgaaaggtttccttagaatatacaggaaatatccgcatgcgcgtgggtatgccatatcgatatgtaacgtatatcgaagggtaaagggtatgcctaacccgtaaccctgacacccccaggcccatatctccgacaaccacctcgtaaagttaggcggaagactcctagacgtttcttgtaatacgggacaaacgatggggttttaagaaaagtgttgcttgctacattgtagttgaagaagagaacgggcgagggatttcggttgcttttaggaggaggaggataaccctttggatcgagacgaaggtgtcagtggccggccaacatcctcatcgacggcttcgcccgccacctcctgaggctccccagtggcgaggacaagctcgtccttaccctagctccccgctttgttgccgggcacaattacaattgctcgcctaggctccgccacgcctcgctgcggtcgacctcaccgctcttttccccagccatagccacaagcatctcaaacccgtgtcgtgaggttgaaactatactgagattgaaaggctgacttgttgggcccacgcttccatccacgttagcaagccatggtggcatgtcacgttgacataagtggcaaatagttaataaatcatcttttctcatgtgtaataaaaaagtaaaaataaatctaaaaaaaggggtatttaaatagttcgccaaacctatcagtgacaaataattaaatacttaaattcctcctttagttggaccaatttatcggtaaataaataagtaataaaaaaagaaatcttatcttagcttccaaaatcattgcgcctcgactcgagtttctctcccccgccgccttccgctcgtcgcgcatctggcgagcagagcaggggagggggcgccgccgccgccgccgtccttgtgcatcctcatcccggtgagcatccgcatcctctctctctcattctcattcatctctctctccctcccagtctcacccacacttttgtctcgaatttgcttgctcgcgttaaccctagcttctcttctagatctggaagaagcttttttctcttaatttcatcagagctttaatctccttttaatataagtaacagtttgttttttgcccccaaaggttttgggggtggttctgtcccaggttggatccgcgccccctggctgtcaccgtaatctttcagggttttcgcgaggatgtcgtggtgcacgattgagtctgatcccggtgagttttagtttatatctctttgtctatatcattagttgcatgttgttcatgggaggtttactggatgctagccaatgtattgtgtttattcattagtaggaaggatggttgttgcctttggttttccatcgattgagcactgtggggaatatatattacctagttttttttttttactttgttactagtatctgtaagccgagggttactttctagtagtaattttgatgtgtaaagtctttactccattagttcatctgactaatatccacttggggtccttcggtatgtgtataatcatggatgaagtaccaaaatactgtgatctcaccttacacatttcattgcgaatgattgagtgaaaataaagctttgatcatgctatcctgagtacatcacagattatcgcagtgcttatttttacgtttcaagtgttcttaccattgcctttccaaaatatacctgttgtttcacctgagtatatgacctgtaggtgttttcaccgaattgatccaggagatgcaagtaaaaggtgttcaggttagcttccagggcctgtttctttcctaccatgaaaaattgttagaaacgaaatctatatcaagtgttcttgatatgtccttaggcttttaattattacttgtaaaacagtgtaaattggatggttggctctattggttgattctactgtttctagaatacatgtttaactgatcttctgaagatatatgctttgcttgtgttgtgaagctaaccttaacctgattgaactcactttaagtaactaccacactatatatctctatgatcagcagagtgtatgctaaacaacgcttatgggaaaacatattgctgcatataccatggagctgtgtgcttgaatgtaataaacaatacccttgtgaaggatatggagtaggacaatacctgtttggtagtaataatttctgaagggaatatggtggccaactagtaagggttaacgaatatacatcacagatcagtgcgatatgtctattaatattgttagctcagctacaaaaggaaaagacctttattttggcgttgtatatacttgcaaatctaatatacttccacttttggtgccctgtccttttatagttagtggtaggaaattctagaaaattgcaacagatggccatggacctggcattgtcagaaaaaaaggccgtcatttagcttcagtttatgactttattaaataactcttagctgccttttacattgctattgtatctttaaacaggtggaagaactttactctcttgatgtggactctattagtgaactgcggtgagtctcttcaattttttgttgtcatgcgtctctgttctctggatggccttaacacattgttgtccacttctcataggccagtttatgggctaatttttctcttcaagtggatggctggggaaaaggatgaacggcctgtcgtcaaagatccaaacccaaaccttttctttgctagccaggttagttccattttgctccgttagctacctctgttcagaattggatttaacatttgatctaactaaatcaatcactgccaggtcatccctaatgcatgtgctactcaagctattctgtcaatcctcatgaatcgcccagaaattgacataggtccagaactatccaacttgaaggaattcacaggagcttttgcacctgacatgaagggccttgctattaacaacagtgattctattcgcacagcccataacagttttgccaggcctgagccatttgtctcagatgagcaaagagctgcgggtaaggatgatgaagtgtaccatttcataagctatttaccttttgaaggagtcctctatgagcttgatggattgaaggaaggacccataagccttgggcagtgttctggtgggcctgatgatcttgattggctaaggatggtgcagccagttatacaaaaaagaattgaacgctattcccagagcgagattaggtttaaccttatggccatcattaagaataggaaggatgtatatactgctgagctgaaggagctggagaagagaagggaccagcttttgcaggagatgaatgagtcctcagcagcagagtccttaaacagcgaacttgcagaggtgacatcagccattgagactgtcagcgagaagattatcatggaagaagagaagttcaagaagtggaggacggagaacatcaggaggaagcacaactacattccctttctattcaactttctcaagatgctggcggaaaagaagcagctaaagccattggttgagaaggccaaacaacagaaggcttccagcacaagcacgagtgcaagatgaagccaagtgccaccaatggctgtaccgaattcgttggttctcattttgaggaaagcatacgttcatgggttactggggttagttgttgcattttccctttttgagaatgcgttatgctatcagatacggcaccttgttggcagcttagagatatcactaagttaatgaaccagagtacattctctttaatctttttctccgtgttgtattattatctgttatgactttctgcccttgtgtgatggatagaaactgtagaagaggtcaattgggtcttaagggtggtggcattgtttatttcgcgtcgtggcaatcgaatagaaaaatacatgttggaggatggaagttttgtgtctagatgctgtcttggaaatgcccacttgctaatcttacttgaattagatagatgctgtgagtgtatccatgaccatgagagagctggagcctagtgctggtagagttgactttcctgagtgaaatcgcttgcttgggttggcttgtagatataagtataagaaaacggataagaaaattcaggcaatgaatctgatgcgcatgtgattgattctggtgggatttctataggacatctgattttctgttgaacagttaacgcaaacgacaggtttgaatgatacagtattcgaacttgttttttttttctcttgtcatcaagattcataattgttggagcatgaatgatctggtgtgcaacctcttaagctctatagctaggacgttgctgtcatctctgttgttgcaccagctaaaggacgaattgtgaccaaaacccgaattgtgaccaaaacctttgggactttcagagtgatctttctgtcgcacttgcacacactcttttgtcattcagagtggttattatccacccattttgaaacaggatttcaagaaattaggggacaaaaagaaattatacacattggatttgaagaaatttagagctggtgtcgtactcctattttattttggtctattatcccatacttatgcagatcagctggatggattgcatcgtcagatattcttacaaaacaaacttgctcaaaccaagaccagattagattagattttgttgtgaatacaaagtcaagcaacaacaaaaaaaaaagagattgagaaagagtggcgagttgcgacgtgaccaatggaaactcgaaaaacagaaaagcgaaggataataaaaactcataaaaaggggaggagggagaaagaagcgagaggcgcatttgttgtcgttgttgttggttccatgccgtaggcccatcgcgatctactagtgtttttttgcctctctcccccntnnangcntnnannnnnannnnnacccccaccactcccccccccctccgcttccgccctccgccgccgccgccatggaagccccgggctcccctaacgcctcctcgccggagtccgcccccaagcgcgccccccgctcctcgcccccgcccccgcagcagcaggcctcctccgaaggtaacccgctcgcgcctcccatccccccatctcactctcgatatcgatctctctcaacgtggtgcgcgcgtacgtgcgccctcgcgcgcggtttggtctggatccgcgagatccaggcctccgtgttccgctctgagatcgagatctgcaaccacgggcggcaaatatggtggtcacatggataacactaggccgctgctgatttgggcgtgttctgcgtttgtgtgcgcttgtgcaatggagaggggagatgcaacgatcagttgtttcagtggtagttgatttcatgttcatcttgtccgctggggtgatttggcaccggttgatgttgacgatgagttcatccgatgcgtttctgtgtatgcatcacaagtttattaacatgtccaagcgcggttagtaacagctgcatgtgtgatcatatacaatgagcttacacataagagttgcaatttgatgagtaccatcatttaattgtagagttgagttgaccacatgagacgtataccgatatgcatcgctatctgtactcttactagcgatgacttgctggatgatgccgtggttgggtctgtcactctgttgatgttcagggttttctacttttcgcagtggaaccgacacgtagatataataagtattctaggaattcaaccctacatcttgattgtctatcccacagtagtctgaacacacccagccatttacttaacattgtgataactgatattggatgttgtttcactttgttggttgttggcctgtaaatatattttttcggggaaattgcaattggggaacaagaggatgcttacaggaaatgcgaagtcatgcacactctatttagcaagcacatctcacctttctggcatatgccaatcattaatcttgtccattatggtttcctcgggtctttggttgacacacttattgcctttaaagtgttatcattatatgttggttgttctaatggttcattagttacatcaaaatataagaaatataaagttctcctgatccaccttgagtggaaaggtatttaactcagtcctgtcaattgctgctttcactctgttcgtagcatattcctaccattatgcttgttgctaattcatgttttttaacttgttatatgttcaaggagaatatgatagaccatgccaaaatataattcggtcataatgtgaatgaccctcttgttattgttcccaacaagcatacatgacacaactgtatataccaaacttctaaactacactgactggaaaccaaaattcagtcagtagtggttctacagaacatgtatagttaagtgccccagttggaccattagctgtttttactatgcatcatggaccacttttgttgcttgagttaaaaaaaacaattttgtgcctaaacaaataatggcatgcacagtttttggccctctcctttattgctagtaattctgaatttccaagtgatcattctccacagatgacaaggagaagccaacccatctgaggtttctggtatcaaacacggcagcaggatgcattattggcaagggtggatcaaccattaatgaatttcagtcccagtctggggctcgtattcagctatcgcgtagccatgagttcttccctggtacaaatgacagaattatcatggtttctggtctgtttgatgaagtaataaaggccatggagctgattctcgagaagcttttagctgaggtaaactattttattccgcaaatagttgtatcatagggccatgttactttatttgatgattggtattctatggttactttcccagggggaagaaagcaatgaagctgaagctagacctaaagttagacttgtagttcctaacagttcttgtggtggaatcattggtaaaggagggtcaacaatcaagtatgtaccattgataaatttgtttctggtttctgaaatcttatttttattcttattcccattgcgcttcttcattttcttagttggttataatgtatgtataccatgaagcgtgtctgaaccgaatgaggaaatgcatggttattttcctaatgcactcatctttgacttaactgcacccaagttattgcatgctctcttgtcaattgtacgcaagcagtatttgttgtttcatttgtattgttttgtgttggtttatgtttctttgaatgtgagttgacatgcttgttttctcatcaggtcattcattgaagactcacatgctggaatcaagatttcaccacaggataacaattttgttggtttgcatgatagactcgttactgtcacaggacccttggaccatcagatgcgtgcaatatatttgatattaagcaagttatcggaggacgttcactacccacctaatctgagttccccatttccatatgcaggtaaacaaatttcaatatttgatttggtgtcaaacggctacttttcttattatggggtgccttaattctcggactgcatttcttttctggaattcatatactgcattgtataggtcacaaatgaacatgcttggtcactcgtaccatttggcagccatgagctttctgcatgaatttttattcagctactgcacgattgttctctttccgtttcagtgatcatgttgaatgcgttcacatgctatgtccattcagttactgcatgatcattttatctgaattcctcttcttttgttttcaggccttggtttccctagttaccctggtgttcctgttgggtatatgatcccacaggtgccgtataataatgctgtgaactatggacctaatgggtatggaggaaggtaccaaaacaacaaggttagtgattgctgctgctttactcttgtcttgtatatcactaaagcaaaccttttgaattcaatatcagcatttttatgcacatgttggtatgagctaacatgtgttcaattttgttatgcactagattaaggttatgttcaaggtgatttgcattagatgttctataatagaaatactattttctggttgtggttttgtacttttgtcatacatcactataggcatctagaatttctgcttcaaaccaaccttaacaatagtaagactcattggatgagatgtctgaattactaattgtggtttatttgagtgacatattccatccatttgttcatccatagtatgctttagtacatgttagtgcaaagcataagacagcttttaacgaattgaagtattattacctatgtcatgcatgatgtttttcaccgtaagtaacatcagtgctgtaaattctaattcagaactgtaagtaacgtcattgtactgctttctactgaattccacaaacattaccattcactatttttcctttttttccctttgagtgaaatttgatatatgcgttcagagcttcaaattaatccaacaattgtctgctgttgaaaattttgcagcccagtacacctatgagatcacctgctaacaatgatgcccaagattctctcactattggtattgctgatgaacatattggtgctgtcgtaggacgtgccggaaggaacattacagagatcattcaggtggtttcttgcgctatgaattccacagttattacttttttcggtgcatttttcaattgcttaataccttgtacctatgactgtaccttctctttttttgggtacaaaaggcataatgtttttttttgtagtatcttaggcgaccatattagccatcttcttgagttgtatcaccctatgtcccacatgtcagttgtttttctgcctcagaaatgtcataacctttcttcatgcttcaaagattttgtaattgtcccaactgatggttgtcttccagtgtgatcatgttggcgtgtttttactgaaatagcttgcaatttgtcgagtgcaggctagtggtgccaggatcaagatatctgataggggtgacttcattgctggcacatctgagaggtatttccttggttacttttcaccatcagaacaagctcttaaagcatattgagcaccaccgaccttcatatgatatgcttgtacagcaggcctgaatccccaaattttactgactggtgcaggaaagtgacgataactggaacatcagaagctattcaggcagcagagtctatgataatgcagagggtgacagccagttccgagaggtgataaaatctcatgaagacgaggggcatcatctgatggaaaagaagcctgatgccaagttaggaggaggggttggagattgtcttttctagttttagcactatccgcaaaaaaagcttgagagaaaatttaagataatctattgttccttattgagtctgattgtgttagtaactggagtagtcagtcaatcagctgttctatttatttcttatttttgttgggaataggattatatttcacaacatgtttggctgttgtcataactcaacaacgctggtgtgctaccctagttttgataattgtgatccttaggttacccttgaccccttgtctttgcctgtttgtttgtctcctcaaaagtcgaaatgactcgttttgctgaaagacaaagttgcttcctagtgagaggctgcatcttctgtccaatttgttgcatttccatgatgttgcctccaaaatcttgcaagtccaaagccaggaaaaaaaagcgaggctgcctactcttgtggggcgtggaaagtcacaagcatctacctttgcctgcgtggatgcaaccaatgccaagtaaaaaaaagcaaaggctgggcttttctttttctttttaaatgttacagcgagttttagctcccatttggaattcctatgaatatatcctatttgaaagcatttgaaattctttcaaatttggtgggcgagcaaactagtacgagcagaaaaaaagtcgaaattttctcaagatatatgtcgtgaatgaaataataatactggagtatcatggaggattaaatctgtttgtaaacccccaaaaaaaccggaaccggttttnttttccccctctcccaaaaaaaaggtttgtggancctaagtaattaccaaccattaaaattaacatttctgtggcatccactgtattgtactatcttcagctcactacgtttggagaatttccggagtagaatcaaatcttagaaattgcataatactccctccgtttcaaaatgtttgacaccgttgattttttaaacacatgtttactagtttctcttattaaaaaaaattatgaaatatgtaaaactatatgtgtacataaaagtatatttaataatgaatcaaatgatatgaaaagaataaataatcacttaaattttttaataagacaaatggtcaaatacgtactaaaaaaatcaacggtgccaaacattttgaaacggagggagtacatctcaaaaatctctgaataaaatttatccctagtagtatatccttccatatataaaccgaaattattaaataaaaaggtatattcctaaaaagttttccgacagaccagagggcaggagtcttctacaagacggctacccaggagtatgatatttcctctattattattttctttctcatcacgcggctgcgtccgtatcgcgacttttatcctctcctccccaactaactcggcgttcgccatctcgtgtcgactttctcctcaaaaccctaattccatccaccgctcgatccaatctacccttctctcgattctcaattctcaattctccctgcaaaattcccaatcctccgtgcagaattagaattatgcgggattgatcccctcccacgggatctccaatatcatatccatccagaaattgaaattcccctcgccgccgatgagccaatcgccgccggactcctcctccgcggcggcggtgcccctggcgccggggtttcgcttccaccccaccgacgaggagctcgtctcttactacctccgccgccgcatcctcggccgccgcctccggatcgacgccatcgccgaggtcgacctctaccgcctcgagccgtgggacctcccctccctctcccgcatccggagccgcgacgcgcagtggtacttcttcgcccgcctcgaccgcaaggtcaccggcgccggggccggcggccgcggcggccccgggaacaggaccaaccgcgccacgccgcgcggctactggaagaccaccgggaaggaccgcgatgtccaccaccgcggcaagctcgtcgggatgaagaagacgctcgtcttccactccggtagggcgcccaagggccagaggaccaactgggtcatgcacgagtaccgcctcctcgacgccgacggcacccaggtacctgtgaaatcatttgatccatctcaaatttcgcaggatctaccgtaccacgagatcacgagattagcggtagcaccaaaaaaattctgttcttttagcttgtctcctgctaggcttgtgtgagcggtaggtgggaactggtcctattctactttcaacactcgttacttgctgctgcttagatatgttatctagtgcgaccctgtcccgggcctagaatggttacaacattctcatgtttgttcacttgatacctatatatggtaggtaaaaacctttccttacaacatcaatgacttgctttgagaaaaaccaatatgagcatgagcttatcttttgtcaataaaagaagaaaaaagtgcgagatgcactggtagaagtgatagagcacgtctggaaatgtatgaagcaagggggcttttaactgggctatttaagcattggaaatcttatcctcactctgaattgaggagtctgaattgcggaggaccaatggtttttaacctgtatagaatattgatgtagcatccttttctgatagctgatgttagtttcctgttgagtgcgcaggatctgcatgtggtgtgtagaatcttccagaaaaatggatctgggccacaaaatggtgcacagtacggtgcgccatacttggaggaagattgggaagagg

SEQ ID NO: 62910 - DNA, 8389 bp, Oryza sativa
aggcaggaggatcatcatatcctgctgattaaattaagtttgggacagagaattgctagttagctcggtgtcccttcaaacatcatacattcaaatggaagatgatatatataggagtaatataatatatctatgcatatccagttgcgtcgtacagtgttatgaattgtcctcatatatatcgatcagtcatattcatataactttgtcccttgtttgttttcaatcttctttctcatgtggttgcagtatgaaccaaaattgaaaacgatattattccaaaaaaaaaaatggaaacgatatacataatggcttgtggctgtatacatatatccacgatatagtagctagtactgtggatatgatttagtagaaccgtatagtacacgtgaatcaattaagtacatatatgttgagaaaaaaatgatgatgtggtggtaaagtcaggggtgcatactatgtatgacgtactccaacggaccatcactaacctttaaacaatgatatccatagatattacatatgtatggtttgtgctatcaatagaaatttagtaagctcagatttattattggttgttatttccttagagtatatgttagaatacgtatttgtgaatgtgtgagtgtgccgtgcgtataaatcatctaaccggaaaaaaaaagaaaaaaatcaagtacaggtgttatagcagctgatgacagcaatcaactcatcgtgacattgacatgaatgtgtttatttgctcatctctgattaaccggtcggtcggtcggttatctgccacgtgtttcgcacactgtgcatacgtatgcatgcatattaacatcaatcacagagacaaactacatatcaaattaaacgttcggatgcaaattaagatatttccactaactggctagcttgtgttagctatagctagctagcttatttatcaataaaaacatacagtaccatgtatatattatggtttcattaaacaaaagtaaaccatatttcatatttagggatcaaacttcagtggttgagatatattcgacgaacgtaaacaaatacacaaaaactttcaatcgaatgtatctcgccaaacaagatcaaagaagaatatgtgatgcaagcaaaacatgaacattatgcgcaattcgtatatggacatggcataattaaaaagttacgggtaatggagatgacctgttaaatgtgtatcttttgttgctttgcatcgaccggtcggttcattgatttcaaggtagatcagatgctgatgctctgtgttaataattgtttatgagctataagctagctagtggaagcccatggattgatgaaatacaagctgggaagcaagatgcaaagcagagcacacatttctatttttttttaagtgccaaatttgcaacatgctaaagcagcggttttcgtgatcaagctaatttaaaacgagctagcaaaaatattctgcaatctttggaagttgaaatgtaggatggatggattgattgattctacagaaagtgagaacaactttggccacatatatatgttttcttccactgaaaattcttgcaagctaaggaaagaattaacaatcaaaataacttcatctttttttagcttttgacatgaattaagatcaccaaaaagattccttgttttgttgtagagagtataacataaagaaaatgaatctttgtacagaaagagcgaaagattgatatccacattatattggtcgtatactttgggaaaagaaagaaattaaaggacggtaatgaccgactttttcctcctgaagaaaacagttgagatcatctgactataatatcgttttggatgcatggtatacgtgcatgcaaaacacaaaagtttgtacttacgtagagagctaatttcaaccatggaccattttttttataattaaagaaagtacgctatcagttggaaatgtactttatgagaaagttggatggaagattggaagagagatagacgcgtggttggtggtccgtgccttttgatcgtatgaacgtatgatcatagcatcattttggtcttgatttttgcagcacatgtacacacatgtaacagtattagtacgtgtgtgtagcccacttaattattagtaatcgagactttgtttaatgtgtggatcgagtcgagtgagcacatatattccggcacgcactacagtgtactatagtatagtgtttctggtgtgcattttgtttgatctccttttcaattcgccagctagcttaactggatcacctttgtttttgtctttccttttttttttaacggggtacatggcacgcgtctacgtcttgtatgctgcaaaatgatactctctccgtttcaaaatatttaacactgttaactttttagtacgtatttgaccattcgttttattcaaaaatttaagtaattatttatacttttcatatcatttgattcattgttaaatatactttcatgtacacatatagttttacatattttataattttttttaataagacaaacggtcaaacatatgttaaaaagtcaacggtgtcaaatatttaacggagggagtacaatcatacagctgatagctagatgcaatgcgtgctaagcatataggcatctgatccctgatcagaacctgaaaagtgcacgagacgagagccaaactgtacgcatgaatgcacgatcgtgctgtcaccatgcatggatgccaagctatagctagccaagcatatatcatgtgttagagtgagagtgagactactcttttttctgttcatgagtatatgctgttcatgagcactactcttttcttttcaccccaaaaggtgctttatgtttctcctaatttaaattaactttaaccaaatttttagaaagatatcaatacctataacactaaaattagcataaaaaatctaccattgaacatgttttgtaggtacttcatccattcaaaaatataaatatttccatattcattttgaaaaacgtactgaaatgtttatatttttttaatagctaaagtatttgttctatgtaaaagtgctgatttatttctctgtgaacttgattaacctataacaccatcaaaccttacaatatgaaacagagtaactatatttttctttctcaaggaactaccttgtgtactctctgcagtcaactttactgtgccattgtcactgacatgtggactcgacgacatatcaggtccatatgtcattgacaaaggcatagtacattaaccgcagagcagaggatcctgatccgtgtactactactgttctgttcttccctatccctagaggcagctggctgagaggactcaatcaattaactggtgatcgatttgatttgatctgatttaatgtgcatcgtcgttgcccctgttctgttttcttaatcaagcagcagtaattttccaactcattcgattccaatagattagatatagataggtagcctgttgctgtatgaactatcggcgtcacccaccatggagatcgaattaaggtcatggatgcatgaatgcggccctacgtccgtctaaaacatgacacaaaccaaaagacaaaaaaatattgtgtgggtttggtttatcggacggcgccgctcttactctggagtacttaccttagcttgcgcctgcagattctataattatctattgaccgtttcgtctaacactgatctcatcctcctaatccttgcactcacctacttatacttgatttaattatttaagtctaatcaaaatatctctctgatattgagctctttttttttctccctttgagctgtctatatatgtgatctaatcgaatcagccggactgatcctcaactacacgcttcatcatccaacgctccagtgctccaccatctgcattccaatttccaaaccacttccctaactttttccaccctcacccacaaacaaatctaacccaaatagtttatgtactaacaggatgactaattagctcagctttgcccgcggcacacacttttggcatataaagtccgtgtcaaagtttcagatgaaaagtttctggatggaagtttccaaacgaaggttttttcagatgaaagttttcattaaaaaatgtgttgaaatccctatgtttgggcctaataatacagcgaccaagcggcccaacctacgaccaccagactgcctacgtgccattttggcccacccaacccaaatattgtagtagctctatcaaactatatgactataaagaacgtgcacctttaaacaagattacaagacaagtatcagttgctctagactctgaaccctttgttgtttacatcatgcccatttaaccccataacattaacacaaataaatttgtcaaaaaaaaaaaggtgcaagaaactgactttacaggtaggatggacagtggcaatgtgtaaagaccaagccccgtgatgtgacactgcaccttggagtttcagcaaaaatctctgcaagtaaatcattgcatgaattcagctgctaacacaattgacgaaatgtatatgacagcttaagaacggagcaaaaggtaaggaacaatggaatgccttgcagatgagcttacctggtgaaatcagaattcatccaaagcccaccatccactaaagattcaatcaagcagcttcagggcttatttcgcatatacggtcagccttacttgagctgtgacttcagggtgaagcttaatctctgcaatgtattccccaatttcacgaatttctggcactgtcacgagacgcttgtcgacatccctacatgaaatagtttccggtaagcaaagcaacagcagcaaatagagcatcgcaatccttccttaaaaggtagtgattgtcagtgcacttagaagggcatacctattaagttgtgactttatgatgtcaacaagatcttgtgctgtgacgctgtagaatagaagaaaaacttgttattaagtgcaagtaaaataagacgatacataaagaactatctactcgataaaaacttgcctcccaaatatctgttttcctttcccacctttacgtggcactttgaatgccccaatagtttcaaaaacacgggcaagttgctgtgcctcttcttttacctactcaagcacaaatgctcaacagggtaagattatgctaacactggatgaaagttcttatactcttatggaaaatgatattggtaggaacaaatcatgctttagactttttacaaaataagctaaaccacaactacgtaccctggagaacaaggattagtagggtataactaccacagtagtttttagacagacaggaacaaataggaataagtttcaactatatcaattcttactgagtccacaaatagaataataggtttacttacccgcttcttttcagcatctatcctctcctgttctacttgcatttccctgtagacagcagcagaggaaattaagtagcttactagccatccttttacaagaactaattgaacatgttgaacaccccagaagaactgaactagaaatgcagaataggcatctataaaagtttgcagatttatatgtcaatcctgggctccacaaggaggcaagagatacaatggctaacacaacagaataaatagctgcaaatttacacctgcagcatactgtgaaaaccaactacgatgaaacataagcatacgtcaattaatttactaggagcacctatctgttggttgaaacatagcctatacaattcgtgagatgtggtaaatgactgtaagacagaagattacttgagtacttctggggtgagcagcgttgccttgccctttggcagaaggaagttgcggtagaacccggccctcactttaagcgtgtcccctttcttccccacctctgctatgtcatctgtcagtatgacctgggagaaaaagaaactcaagtgaagtaaatcaaatacggaatcgtgcattacatgctaaagtatagaaatgcataatagacaaggaagatgatgacataggcttggaacattttacagtttacaggtgcaaattttgaactgggtgtatctagatgccttttagttgcaactttccctacaaacaaacagcatggccaaaccaacaattccggcgttccggggcatatacagaatcatattagagatgacttttgcatctgagttgcaatgctaagaggcacctaattaaaaacatgacgatagtttcttccatttccatgtactgcatcagagcatgcgtccatggcaatgtatcttttcctatactcagatgtgtgaatgcacacagtaatcttaagcttacagctgctgcatttcgaatttttcgatcgatggaatgcagtcgcatgcgctttgtaatctactgtactgattagtggacagggtggtgacagacagtacattgggtatggctagttctaaaagaggcaaaacaaaagcatcaccagcaacagcttgttcaatcagtcagtactagtactgcttagctcgaacgaatcgcaattaaatacatacatacatacatgctgcaactgtggagagaaaatacaagtggaagccaaacctggcgatacttcttgaccttgccctgggcgacgacgaccagcgacggggagcggcgcggcgggaggcgggaggagggggcggaggaggaggcggcggagctccaggcgagcgtggaggccatggcgttggggatggattgcgggggaagggaaggaactgcggctgctgctctcttatccacttccccaacggatttggtgccctctctcttgggctttgcgctgctttgggcctttcaaatcggcccagtatcaaaggttttcttcggggttgtcatgggcttgaagattaagggtcattttggtttggcgctccttcttgccttactaattctttgataacttaaaggtcaaaaataaattatttggtaactttgaatagttaacacgtaactatttgaattagagtcaaattttgctaaatcaataaggtgaagccaaatagacaataacaaaaatttagtaataccaaaatttactcaagatttggcattgccaatattttggcatggtttcataccaaacaagtcgtaataataatccaccaaattgtaacccccttccactcaacgtatagagaaaggtaggagatatatatgtacgtgatacctcgacgatattactaagatagatagatagtacatgtgatgccaagatgttataacatacattaagagaaacactcaggggtcttccggctagctccacaaggtgatagcctaaatgacctggattcgtaacctcaccccttctaattatttgatattaggtccttcactaatattcatgttataacataaatcgagaaatatattattataacactattttggtgctatcttgaaactcaacgatacatcactagctaccattacgtataaacgtgtattaatagtataagcaaatatcaacgagtatcatcaagtatcaatgtgcaagaacgagtattagcaaatactccgtatcttcatgaataatatcaaagagtataatcaagtatcattgtttaattatcaacgagtatcatcaaaatatcatcctcgtatatcatactccagtatcatcttgttgtactttttctgacaaagatctccagctggtgacctgtttctcgaaaggaacaaaaattaaaaaaaaacctagcaaatcgttcttaaaaagaatggcgattatatatcttattgaattagtatgtctactgctcaacgagatgagaaaaccgaagagaagaggggtatataatcgagtatatgtcatcgtcgtcgtcatgtcatgcagccgtccatgacttcgtccttcccgccatcggagaaaccaaacaagcggactccacgaagctagctaagctagctagcgcgccaaaactttaaaaatcctcacaccctcttccaccttcgcttcatctccaatccaattctccatcgatcgttacacccaaagatcgagataccaataccatggaggaaatcttggaatccgagtactcggccgccgccgccgccggcgacgcggcgtccttcgtgctctcccgcttgccccaccccgacaccacggcctccgccgctgccgccttcgtcgtcgacgtcgccggcgccggcggcggacgaacgacgacgctctcgttcgtcgccctccgccgtgccgcgctctccctcgcctcggggctccggttcgggctcggcctccgccgtggcgacgccgttctggtgctctcgcccaactcgctcctgctcccgcccatagttcttggcgttctggccgccggtggcgtggtggtcgccgccgacccgggctccacggctgaggaggtgg

SEQ ID NO: 62911 - DNA, 1687 bp, Oryza sativa
tcgggggagcccgacccctagtcacgggaggggcgggctgccgcccgacctcgggcccgatccccctccgagggagggccacgaggcattggggccagtctcctccgactagtctttgggaaagagtagccgccacctcacgtcgggcctgactccccttgggggagggccacgtggcattggggggcagcctcctccctctaaatatgataccctcagacccatatcaccgacaagtcttatttaaaaggaaatgttcaaatataggtgagacttgaagtacctttaacgataaaacaagtcacggcaaaacaaataatacttatataacttttaaaataagatgaatggttaaacgtaggttaaaaaactaacagtattatacatttcaaaacgaagggagtatcgtattagaaaagatccttctatcattcacctcatttattcgtgacaatataaaatacgcatggctttacaatacaagtatgcaattggctgagcttcttccaggcactggaattgtcatctgccatggaaaatgtgtctttgaaggtcatggttcattttaaacggtacgttttacatagagaaaaaataggaccaaaccttacaacacacaattaattagaaaagaactagaaaaaaaatgctactacagcaacacaccaccaattaaactaaactacgaaggcagtgataacaaaaaagcgtagcacaacactcatcaaacgttgtgcactgtacgaacaagcaataaactataagaaaacaagactcctgcacactggcaaagacgcgacgttatcatcatcacaccatcaccctcgcgatctggtgactccgacttcaccaggaaacactaacacaaaggcaacaacctagtccgcgccaaagcataacttaaaagggttcatgtcatcgttgccaaatatcatgccctgtcgatgccgcagctccgacttcactaccaccaatcttgttgatgcacagtcgagctagattgacgagccttgcagacaaaaagcttaaagccccacactagagcgagacacggctaatgaagtctgacttggatcatcattgtcaatccaactgttggtttaagagaaattgagttttcacataagcgtttgtcgtactgtttttttaggctgacggtcagaccaccaagtgacctatggtcagaccgacgctagtaggtcggatagaccgctagacgtgtgttccattggttttttttaggttggtatgtgttttgatctatcaagattcgattatttgacttccattgatgtaatctatcatcacccaccccaaatttgttaggcttggttatttatgttcgatcctataaaagggctataaaggttaataggtactgttatcgcttttctccgcaaacacgaaatcacttaaagatttacggaggggtgaccgtcctatgttgcatttgcactgaattgcagtcgtgggcgccttagcattaggccggagtacgtgctgcagccgcgccgtgcgtacaggccgggaacgcaatatgtgttactcgcaagcaaaattccccgagagaccgcgaaatcaatctccaggccgttagcgccacatgatatgatatgcagctccacatattaaactagtatttgactgactcgctcgatctctgatcgatccgtccctctgccacatg

SEQ ID NO: 62912 - DNA, 3299 bp, Oryza sativa
tatattctgacaaaaaataatagagaaaatgaaccacccttcaatcctaatctaaacattttttatcacacatgcaacatcaagttgtaattgttgaaacattacataatacctatagaaacatcccaatgacgccaggtgcaacatttatgaatgaactagtgaaacataataaaatactcattaaaacattcaaaataacatcatgtgcagcataaaaaaaaagatccattacaacaaaaaaaaattgtagtgcgcaacatacccctcaccctcctccttttcttcctcctccctctattacaccttgccactgtactccttgcctctagctctccacggtggtcctccctagggacgctcccggcaggcagtagagttctctatagatagccaaatgggccatccgacacggcatggcccaggcccggccctgcctcggctgaggttagtcgggtcggcacggcccgacctacatgtcgtgccagcccacgggctgcacacacggcccaggcacgacagcccatcgtgcttcttggccttgctttatatggttatttaagtctattttgcatccctatactatttttcttcgatcgtgtcgtgccgggccagcccatcgtgccaaggttgcagcccaggcatggcccggcatgggaacgaccccagtcgggccgtgccgtgcttgggctgggccaaaatggcgttccttgtgccgagccgcgggccatatggccatctatagagttctccatcaccacaagtgtcttccttcacctactggccacaatgttgatgcttttcaccgcattgtcccacttgccaaccccgtcatttgtcagagctccatgtctagtcaagcttctttcaccttgtagctcctcccctcctatacctagtcagtccatatcaggtcacggggagctctatatgataagtgggaagctggtgatcagatggttggccttgcctggtgctatttagggcgatctacgcctggatacagaggtggtcagcatagtggaacagacatcgacgaaggatcatcttccttagggttgggtccccactttctccttggagctcctaccgtcgtatgtccaatccgtttctcgatctagtcgaggagctccatggtgaggatgaatgtggtggtctgagggccaatgagggttgccgacggagggtaacagcaggagtggagactccttgaagcccatcgtcgagcaggggttggccagcagaggggtgttggtttgtgggccatgtggcgaccatgtgtaggtgatggtgtttggtggtagctgagttgatggatgatgaggccaccacagataagatggcaggcagtcgggctccaggcgaaggtttaggcccagagacaataggccgtgcttagccgtggccgacctggtgctaggctccttcctcagtggcttgtgttgttggcttatggcacgacgtctttccttcttgactatagatagcctcttaggtctgcagtcttggtgtttttttcctactatattttttttcgaggaaccgatgataggagtttctcctgtcagaatttatagaagaagagaaatggcccagttaataagggaaaccgggtccaaaaaccgaacaatcacggttaattgaacaggaaaccggcaaaaacctatacagaaaaggaaaagaaagcaactattgagacctcatacaagtcgtcgttgccgagcttgccaaaggcaagcagcttcaacaaggtctccataaccacccaacatcctctagtggagcagaaaccttctgagcgaagccttcaacaaggaaaacaacattaagaatgttgtcaacgctcgtccccaaatggaacccggttttcacctgaagggagagagagccatcatgacgatacctccaaggaggaaacggcacccacaggcatcgatatcatcagcctaggaaagcactaggcaaggttttcacccgagactctctcaaaaatgctccacctccaaaccctcgtcgcgttgcctggacgtctgttgagggtcatcgttgccgagcttgcaagacaagcagctccgactctgcctcaacagtcaatcacaatgcagctcgaccagagaccacctcacacacaggaacccaactgcagcaaacctacggcgcggccgacgaacaacgagatagaacgccggaatccaactccgcacgccacccctaccacaccaaggagctccccggcaatgactggaagcagcctagcctaagaagggaggagtacctaagatgaggggagcgggcgccgcaccgccggagagcactggaagaagaacaactgaagaagaggagagccggatctggaggaaaaggaaggagggagatggaggcgtcgtccccatcgtcggcaaaccgcagcaggtcggcagcccccggccgggtccgtggcagccggcgccagagcagccgtcgtcgccgacgagcccgcgccggagaagcccatcgtcgccgccgcccggcctcgacgttgctgcgggatcgagggccgccgcccaccgccgtctcgccagtccctcgtcggctcgccgctgccggtggaagtaccagatccggccaagggagggccggatccgagctcaccacgcgctggcctgggctcgtcgccgtcgccaccgcccggcctggtgtcgtgtagcacgcgccgtcgccgccgcccggccacgtcgtcgcgtagctcacgccaacgccgccaccatcccgccagcccctcgtaggttcgctgccgccaagcgagggccggatccgagctcaccggctctagatccgaacatcgtagccggtgccgtgctcccgcctccggtctcgtcgtcgccccaaccgcgttgaccaagtgagggagatggggagccccgccgctgccgtctttgcagctgcccggctttgccggcggctgctcgggcagcggctaggcggggggaggaggggaagggtggggcggcggcgggtttcgccgcccgcgtcgcccctggggcggagcgaccgagcggttttgactacagctcttgatatttttcctactatattagaatttaacttgcattattttgcattgtctgatgcagtttgtaaaaaaaaaaaaactcaaatgggtacattccagcacggggaatttaaccaattgagctatactaacttcgctatcatggtacatataagggttctttagttgaataccacaatttgccaaactcgtggttaggcactttgaccaagttagcctagtgcttagttcattgtcacacttagta

SEQ ID NO: 62913 - DNA, 978 bp, Oryza sativa
ctcagcaactcctcgtgcagcaagtccctgtgaaccctgccatacgcacggccaatcattattggcttgttaccgtctaggtacacgatagtatccttccagacatgttcaatgcagctctccaggcccaggtctggatagcaaaagatcaagagccataagtccatcatgtaccaaattatgatggcaacaatgttattcagtgctgaaaatagtatgctacctttgaattcatcctcccacacaccgtagttgttcgtgaatggaagatcagggccaatgagaccaacattgagccctttcttagctgactctgctgctagggataagccagctggaccgcagccaatgatgaccaaatcaagaactgaattttcatcgggtatgggcagcagctgcacacaaagattcagagcacgtgctttattttcttgagacaccatttatttattcgttccaatgcagagtttcaggaaataaactaaaaaaaatcctgattgggctgacaaaaatgtttcaaaagttcagtacaagttattcgcattcctagcagtctagaaactttgaacaatttccaggatgtccatgtgtcaagaataaatggcatgatttcggggaactgtgcttgtgtttagcctagcacttcacttgttgcttgaatcacatcaagtcaaaggtgtgatgttggactgcaaatgcgacgcacgtacacttcatcaaattcaacatctctgagaaatttgcaagcagacaataattaatgcaacagtacgttccaagttgcatccgaaggtgtaattagtcagcagttgagttgagaacagtatgagatactcttaacttatcccctaattaacaccttttgtacaggcgacgacgtgagctcccattacaggagacatggagaatagtccaagctccacagagatatggcaggcagcagcaagcatgggcaaccagaggctgctcttttttttt

SEQ ID NO: 62914 - DNA, 35640 bp, Oryza sativa
ctagctggtcctttggaagatcaaacaatgtaatgcctcaaaaagcacttatttccaaatcatgagcactgtgatgaaaaaacaaggctaatcttgcatctttttttttttgcggggaaggctaatcttgcatctattgtctcggggagaaaaaagtaataataattaacaaaggagctgagttcttagaccctaatccttccttgtcccccaaccttttcaataaagtgaaatgatgcaatagactttttgtttagttgtctatgggaagcactgctagctacactgtacttggcaattggtaggatcatgacaaaaaaacaagggttttactagtttttatctgtccatctaatcggttacagatataattaccagttcggtataaactaaattattactacagctcgaaataaatgaagtaatccttctctcctcgcgtatgttgaagtacaacaacagtaagtttgccagctaagaaatatcggtagctagtagtagcaaattatgccagacccgtcgagcgatagccagatgccaaataataacaacaacaataataaataaataaatagataataaagagaagaaaagagaagagaagaggaatgaaaaggaagtgctagctagctagctaggtcaatggatgagcaaagtcgcagttttgtttaatagcgaagtgataacgccagtaaacccattatgcagaggagtagttgttaaaagtgatgttgcatccaatcaaagaaaaccccggaaaagaaaaattatagctcacagtgacactgcacgagtatggtcctttcatttttctctccgatgtatagctattaatattattgagtattcgcatttatttatgtttatacctaaaaaactttaaagcttgtgaacacatttgcggtcatatggccctaatttttcgtttctcaaatatagcttgccatttccttttcttttgtgatacttggaatgaatttgcagttaacatgtttatgcaattttcaagtaaactgaccgctatgatcatatatctgtaaaactagaaaaacgtacaagaagcctacagggcccaaaatacattaagcccataacagagaaagcccacagacctagacaatagggccttgtactccttaacgggcctataaaatgcaccgggctagcacctaacatagccgatctaactcggcccatttgagcccgcgtcggtgtgaggtcctcatctcattctctcctcctcctcaagatttttctcttctcatcattcgttggcttgttgcccttgcagagctcgcgcgatccatcggaggccgcttcctttcaattctcactaattaatcgagttccatatcctctcaagatgaagaataacaaggttcgtcgtaaccgtaatcacaatgtaagtaccagctttttttttacccccctcaccatctccctcatactagttatttatatatatatactgctaattacctgatcaagcaagtgtttttctctacttgttacttatcacatcatttgaggcaagcatcttatataataaactttcggtcctgattttagtactattactatactaaaatctgtgagtcctctctccagctgtaataaactttcggtcctgattttctcaatgcaaaatatgtgaatggcatgattcacatgatttgttgttgactattccctcataattatctcccaagaacccattgtaaagaacaaaaagaagtagtactccactatttattttcaacaatttgtatgaaattacctaaggacgaccagtatacttttgtttgaccctcaagaaatgcattcatgaacaacagcttatttgaactgcagaatttcacataaattaatttgcccgctgaattcttccaaaggttgttttaatttgctaccaattgaaaaaaaaaagggaaaaaaactcgatctcaaaatgattttaacaagtgggtacaaagaggacaaggcagggaagaatggaagggttggggggttgcaccggggcagtagtagccacatcatcgtcttttttctaatccattccatccgtcccctacgctgcacattgcccgaggcaatgccaccacacatgctcccggtctatcatgagccaccctagcaaacccgtgccttatcctatccaatgaaaatggggcggatatttcccgaccgtccgtccgatccgagacttgcggaagaaatataggagaaaaaataggatactcgatactatctgacttcaaatccgaattcgttggaaaaatatgggttaggatacgagaagatacgtatccgtccgtatgtcccgtattaaaaaatacatatgaaaatttattataaatccacataaaaacatgataaaatattggttaatcacttatttacatgctcacgtataatattgtatatttttttcttgatgtatatcttttacttcctccgtttcatattataagactttctagcattatccacatttatataattctatatgaatgtggataatgctataaagtcttataatatgaaacggagggagtagtactttaattatcttattatatttaatatctatgaattagagatacaaataaatatccgttcttgaatccgattcgaagtaaataatatgggacatgatacgggatgagtgatatgttacccggcactatcaaaatccaactccgaatttaaaaggaaatatgggttagaatatggaaaggatgggatccgatccaacccgacccgatttcacccctagtcacgtggtcccgtgcgtccggtcccaccatctatcctgcagtattcccctgccagtgagaaccatagaccacgggtgggtcatacgcctgcatcctcgtgcctccttttcatgcaaaagaaaaaaaaaaggaaagaaaagaacaaaggatgcattgctcttaccaccaccaaccagagatcttagagacgggatgagttgaggattagggggaaaacatgcattggatgagttgacatccaaattcatcatagcttcacactgtattactaccttcgtactaaaatatagttatttttgagttatgaatccaaacacatagttgtccagattcataactaaaaatatctatattttgggacggagagagtagtactattactccctttgtcccataatataatagattttgatattttacctgtactgtttgattactcgtcttattaaaaaaattgtgcaaatataaaaaacgaaaagttgtgcttaaaatactttggataataaagtaagtcaataataataataattctaatttttttaataagatgaatgatcaaacaatgcaagtaaaatatcgaaatccttatattacaggacggagggagtagtatttagatgatggtgataggtcagtagttgctgacactgtgactggggttacataaactctttacaggtaaaagtaaaaaagaattacttactgatcgaatgcacctcttatactatctcctttctgttcagctctctcaaggctaagattaatttaaccacatacatagagacatctaatctaatttgttgagatctacacaccgagatgttacaggctaggagtggtacagggtcttgagcctctttgctgcctggatgaagcccagaatcacctgcaactcatccaattgctgctgctttttatttagcatttggaggagattagagccagaggttaagactacaaactgatcacaggttatactacaatacaaactgcctatctaaaaggtataggtggtgtgtaataggttttcagctgctacctgagactgaaaatgctgctggaccccatggaagagctgttcctttgatggatcggggttcatgcttacctgtgcatagtttttcagcattagaccatggaaatgaaatgtaaggtttgttggatccaggctgcttacaagattgaagtgcttccagtatctccacagggtaggagttccgagtcttgtcaggtttactctctgcaaacaaaaggtaagaaacatactttgctcagaaaaaggaaatggtatgagatgtgcaaaagacagatcaaaatcctagcagctttcccagcaaactgaacgaatgatcaatgaaagttatttcgccctgttcataataagcaagatgcattggctaaaacagcagaagggcctatgacaacaatagatcctacataaccatggaccaagccatgtgatccaagggtcacactggctttaattttggattgtacacggcctgatatctcgattagtaattaccgtttgcaatattgaactggggtgaaaattgcctcggttgctggattttgtacaggatgaccagggccttgtatgccgaactcttggctttgttggtttatggtattctatgatcgctacttgcaaaagcagaagaaaattgttagttgattacactgttaattgttagtttaaagcaattggctatattgcaattatcacaggatggtcttacaatagtccatgtctttgtctcccatgtcggaactgctacagaatgaattgttgccgtcaatatcatcgtcgtcttcgttaccagttggaggttccaagacactcaaagcattcctctgcagcttcacctctacaccattctttagaacctgcattttcatgaatatctcaggtcttggtattgttttccattatatttgcatttaatagttcaactcctaagctcataaacacttaaagaaaacatataatctcaaacaatggtggttatagattatgacggtattattaacacagatgatattttataaacatgtagagaattacttgcctagctactttctaaaacaaaaaaatcagtactatatcgttcacttgtgaaacaaacatttcaagataaaaaaaaacacaataaagtaaagtttaagtgggatactaaaaaattcagtgggagactcaccagccagtgccaacctcctagaccaacagccttcttgacaacaccttgtagaccgaccaagacagattttgttcggttgttcccagtgacgatgacctttgtgtgccgaggaagcactgagagctcctcatctccactatcgtaccgaggcagagacagaacccgggaagagcatagttcagtctccatcatcatgctgattctctgccctgatctctccctggttcaaggttttgcatcaaattcaatcagtacacaaacaaactcaatactgtgaagtgttctatgattgactctcaacagcaaacaataaatagctctatcaacccagtgccagaataatttccaaaattagcatgatgttcaagatttattgcatggtgcaagaaccaagaaagctgcatgtgagatctgcaggattggtgaactttgctaaaacagtgctagtcctaaataaaagaaaaataccaactattattaggcatagcagaatttctgaaactagctcaacattaaaaattaaaatttgaccacgcataaagggaatttgaaattcaaaatcgagtcttgagtcctaagttacacaggaaattcatattttgcatagattaatttccattgggggggggggggggggcgatgaagcctgaaagcgatcaagatgatgtgacacctccatgcaactcgatccggatcggactaaatctctcatctgatgcgattgcaaacagattgaagagcattagtgactcccaaccactaaccattatggtgatgaatcggcagagacacttaccaggacccactaccagctagctggctacaagaattgctcgttacttgctggagtaacactcgtcaaagtggtgcgtctaaggaatatgtacaaaagcagtgcaggtggccaggtagtaaatcagaaaatgaaattgtgtagatcaattttggttatgaaatttagcaggtggctaggtgatttgcattaattctgtgtactagatgtaaaattatgtggagtaaaccaagaatttatagttggggcaggtaactctcctgtgttcatactttcagtaaattcgcatttaaagtgggagttacggagattgcagactacagtaatgaacaggtcggttagaataattttgctacagtacagtcttgtgatgcattttctcccaactgataccctgatgtgcccaattctaatgcaataattttaagtatagattcgaatttactgtaaaacacagtataaatttcacggtacaacgcagaaacccgatctaatcagtcagtttacagatcgtctagcttcaagatcttaattaaatggaggatgaattgggaatgctatatgagaagaaaaattgcatgcaaagccagaattccaaaatgcaatcaaagtctggatatgaacttctgttgactgaggatcgcagctgtaacagtgtattttgctatagacacaggatcctagtacatgcaattaaggatatgtgcactcttgctgcaaattgtactgtaattttgaatttgagaaagaagaagcgaattcaaaatgcacaagactgtttttgtaagcgcaatccgagctcgaattatttaaaaatcagcacaagaagggatatttaatcacgggtttaacactagcagatttatagaaagatgtaacttcgaattgaaattgcaggaccaatgatggaaacagacaacccgatcaaaatcgaatccatcccaatcgagcaccaggaatccgaatcaagctagcacaaaaccctgcaaccgagagcaggcgaaaacccgaagaattcaggggcggatccaacttgggaaatgggggttcaattgaaccccaaacctttacttgtattaagagaggctaaggctctgaaattaagagaaaaggctcgttccagatctagaagagaagcaagcaaaatcgagacaaaattaagtgggaggaagacacagatggatgagaaagagaaatgtggaggttcgttaaaaaaaaaaagaagaagaaaagggaagagaatgtggatgctcaccaggatgcagtaggacgaaggcgcccctcccctgctccgctccggctccgctatgctcgcgagatggatggagatcagcgctggccgcaggtgcaaggagcggagacgagactggagtttttcttggcgctggtgggaaggggcaaagatactcgacgcaatgattccgtaagtttatgagagaagggaaagagaagatgggtcaataagtaaaacgagctgaatcatcaatacatgattaattgagtattaactattttaaatttaaaagttaaattaatataatttttaaaagcaactttcctataaaaagattttgtaaaagaacacattgtttaatagttcgaaaagtatacgcgcgacaaacgagagaaatcttctctcagctaccgaacgcaattaaagtaaattaatccagctttaatcaaccaattgtcactttaaataaccttgttgtctcaaacttttcaattaaaaccagccatccattatttgcaatgactagtatcccatatgtaaatagtgcttgaagaaaaaaggcaaataactcaattgggatgggtggcgaaaacaaacttgttccactgacagcacccattgtctacctttcctctcctccacgcaccaccggcaccgctccttctccacgagccatcgccgttcctcctctctatctccgcatgcgcagccgcacctactagccactgacttgtctcctcttctaccccgtcgccgcgcacattgtagttatagtcgtcattgaggccagcaacgtggggactcgaaaggtaggggttgacctggtagagacttgcagacgctggatccaggttgtcggaccttatagatccgcagctgttggagggaagaaagaaaaaaagggagagatctagtgtgtggagcgatgataaagttaccggacttggaagttaagtgatgatatccatttcaacggaagtggcataacactccactctccacagtccacacttgtctcattaagactcaagagcagggtgaaggtatatatgtggtgaggcggaattggcaagggagtgcagctcagggttagaaatttcggtcatttcggatcccccgatataatattattttggttgaaattttatttttttaattttttgtgaatttagtaatattttgtttaaattttactaacatttgtttaaacttttggaaatttcggtatatcgatgacctctaatacaatcggctaaaccgaaaaattaaacactggtgcagctgcggggacgagctcgacttaattttgtcggatttttatcgtgggctgtgaaggacttttttttttgtttaatggacttacagggctgaattttaatccggaaaacagcccatcgatctaaacatattttatggagctattaaaattacttacatgcctatattattatacgctggttttaggtctaaaactggacttccaagtaaagcgtatttactcgttcaggtaaactgtgataattcatagctgtatattggtatgttactgtcaggaaagatacttttttctaaggcttggtttagttcccaacttttttttttaaaacttccaacttttccatcacatcaaaatttttctacacacaattttccaacttttccgtcacatcgtttcaatttcaatcaaacttccaatttttgcgtgaactaaacacacctttaagtcatgtgaatgttgtaaattctaatagcagaaagctgcttgtaacctagctgaggatgtatgttaacttgtctgtcagtgtacagttcattactgcttgtttagatttgcttctgttcatacttgctcaggtaaaatgtggtgcatggtccgctataattaatagctctaaccacaagtaattttcatacattgaactgaggaatttaaagaattgtttacttttttcttatgcttttagtttttacttgttcaagtaaaatatgatgcatggtccgctataattcataggctcatagctagtatgtatgtatgattatggctgtcagcaagatttttttttttttttgcacaattcgtaagtcttctcatacaccgtggcatttgaagacccggcaataatggcgccgatagggccgatagcatatcagtatagcactaacaagtttacaaatacgcatgcttaacatttacttaacgagaggggatcaaatacttgatcacacataacataagaggggatgagaggaggtaaaaatagtaactagtaaaattcacatttggagatggaattgatgcaaagctatatatagctgaaggcgtgcaaccaagaacatgcatgcctccgcacacacaagtaccatttctcacaccaaacatactacgtacacatagatataattacagcaacatcagatatatataaacgcgcttataattatgcagcggctagcttcatcgatcaccagacggtaataacacacgtagtactgtagagacttgatcctccatcatcttgcagcatcaactcggttgattatttcagagtaattatcgcttaattaagatgatggtgcatggtaattaattagtcccggctcttgaaggggattgctctgatcaccaccacgtggtagatggccgccagtgccgctccgatgaacggaccaacccagaaaatccactgcacaaatccatccatcaattagcactaatcaatgaactaaattaacgtgtgattattagcaactactccctcaaatcccataaaaaacgaattttgtacgatgaatttagatagtatatatatattcagatacataataatagaatgtgtcacgttccgattggttttttatcggatggatggagtagctaagtagttgagaaagcattaaataatggttggttgcatacgtggtcgtgccatgcgtgggcgcggttatagacgatggcggcgccgaggctgcgggcggggttgatgccggtgccggtgatggggatggtggcgaggtggacgaggaagacggcgaagccgatggggagcggcgccaggatggggacgtgggagtccctggcgttgcgcttggcgtcggtggcggagaagacggtgtagacgaggacgaaggtgcccacgatctccgccccgagcccgtcccccttggtgtaccccgggttcacggcgttggcgccgccgccggagcccatgtacaacccccgctggaaccccttcaccacgccggcgccgcagatggcgcccaggcactgcatcgccatgtagaacaccgcccgcgtcagcgacagcttccgcgccaggaacagcccgaacgtcaccgccgggttgatgtgcccgccggagatgccggcggtgcagtagacgagcgcgaagatcatgccgccgaacgaccacgcgatgccctggatccccacggtggcgcacttggacgccgacttgttcacccccatcaccgtcaggatgctgatgtacaggaacaggaacgtcgccacgaactccgcgatccccgcccggtagaacgaccacgacgtcagctcctccacctcgaacaccggcgccgccggcggctcccggtagtccttctcctccgccccctgcgccgccgtcccgatcggctgcctctccgtgtacctgttcgcccccagcctcacatcctcctccttcccctccattactattaatttgcctcttcttctttctactactcactactagctctcttgccggagccggagacgacgacgacgacgacgacgatggcgagctgtggctgtgaggagagcgagtggcttcctgcttctttttatagctcctgctccactactacgtctgcaccaatggccttctctttctcttcctctttactaattaattaattaattaattattcattttgttttagcagtcggcaatttagtaattagtggacgacaacgatgatggtaggggtttttgttttaccttgattaatctgtggatgacaggaagcgctactgttactaagcttgaatttgatggttcatcggttattgtcagcgagagataaataattcacaagatgatatgatagattagtagtatgggttcgtttgctacggggcaggttctggaaattaaagccatttttgtttaggtgacacgggccctgtttggatccggagggctattaaatagccctccggaatttcgttatttaagagtattaaacgtaaattactgacaaaactcattccataaccactaggctattttgcgagacgaatctaacgaggtatattaatccatgattgggtacattaatactacagtaatcagctgctaatatggattaatttacatcattagattcgcttcgcaaaatagcctaggggctatggaatcggttttgtcggtaatctacgtttaataatcctaaatagcaaaatttcagaggactatttaatagctcggaggatccaaacaagaccacggacagagtggtcagtttggaagattatcctttgtgtgagctcatcgagctgtctcgacttgcatagcattatctttagcttgatgatcgatcaatcatagccacaaactagccattcttcctaattgctagcagttggcaaacattgataattcagcattgctaacaactcgacccaagaagaatgaatatataccttcatattatgtgctaggtactgtctcacttgcaacagtaatcccctctcgatttaacaatctagcatataataatgtgcgtccattcctctcagtgataagactatcaagtagtagcaaagtcggctagtatgggggaaaatggccactaggggaagaagggcagctagcagagtgggtcaaaaggaaaaggagagctcactcgtttattcacttccaaattttttcttcaaactttcaacttttctattacatcaaaactttcctacatacacaaacttccaacttttccgtcgtatcattccaattttaaccaaacttctaattttagcgttaactaaacacaccctcagctatagctgcagctgttcattcattcagtcagtcagtcaccacatcaatctgcatggacatcatgatcatgatcatggaatccagatgcactagcgaacaaaggcgaccaaacacaacagaagccgcaaccactcacgaacaaggtctactgctactacttctaccgttctacgagagcagcaaacggaaggaaaaacacacgagaaacaagaaggcgaaactgtactgcacaagagaaaaggggagcttgggcggtcggaccaggacagagacgggcacggcagccgttgcttcatcgctggccacacaccactagccgcaccaccacctcccctccactccggtctccggcctcacatcacctgtgcagctgcatacaaaaaatcaattcataaaggtgcacgcccttggttagaaaaatgatgctacttccatttgcatatatacatcaaagtgacgtagtgatatggagtggttttgtcttggtagaaaaataaatggtcaggacatcacagtatttctgtatttgccgtttgctgaacaacaactgttcatctatgatgattccctcccctgtgtgtcgtgtagtgcatatctcctgcaccgacaaagctactaggctcttgccacgcgtccacatgatcagacatactctttccgtaaaaaaaaaaaaagacaaaccctggtttttcatgtccaacgtttcactgtccgtcttatatgaattttttttataattagtattttcattgttgttagatgataaaacatgattaatattttatgagtgacttatctttttaattttttatatatttttttcaaataagacggacagtcaaacattggatatgaaaacctaaggtttgactttttttttttttagggaccgatggagtagaatcgatccagggaaaagaaaaaaaactggagaagctggtttataccttcatggtcctttccatagctgtgacactcctatctgggattcgacacagttatattgtcaggaagaaacatgacagtttgagaattacagaatctgtatataaaaaaaagagtccattcgccatggatcagatggacatgttcatggattgttaggaccatggaactaaaatcacttaaaaattccttcatttcttatgtggccacaaaactatataaccggttactatacaaaagattgatgcctgctagtgatgacaacatggatccgtagttccatactaggacaacagcattgaagcctagtgccctagttacaaatacttctacgtagtactacgttactacaagtcagtggagtcgcgattctgcctccagagaacatattatgttacaataccgtgagcaaatataatttacatcagacgtatcagtgagcctctccaactccaaggccatgctgataagctttcttacgagcttacagcatcacaattggtgtccttcggtgaaggttgcatgtgcatgtgcgtgcagactctctcaggctgtcctcttgtccagaggttcctgagttcaccccgtttcctgccgagcgctatgaaggtgcctgcagtagcatggtgccgtgttaaaatgagagcactaaacccctgaagctatgaaccttctcaccaggcacaaggaaggctttacttaccaagcgtaaaaggcacaatgtaaagaagagctggttgaccatgaccatccataaggttcaaggcaacatacgtgatcataagacctaaagaaggggcaaaagaatacagtatgtcagactacaggtaaaaaacaccaacatgttgccgcacgggttttgttagatgtttcaattgttcacgtatacgtatgagaatcccttttctttcacattcacgtatgataatccttttattttgtcatttccatcaaccagcagaaaataaaaggtactacgtccatccctaaatatatgacgctggttagttaaaaaatgaactaaccaacatcatataaaaaataacaggggagtataaaccaaaggtcccattgtaattttgtttctactatcaaaagtatcccattataggacaatttagtttaagctgtatctggcaaactgtacctagagagttggaaaacacagggaagtgcatgtaagaagtggcgtcttaccagaaccataagcaaccattgaccacaaaaagtaaccagattgcaaggtctttttggcagcccaatcatacctacaaagagagattgaaaaaaaaatcagtgtagtgctcaataacgtactgtgctcagacacctgcaaatccaaaacaatttatgctgattgttctcaagcctcctgagcaatttatgatagcccaccaggattaggctatttttttttcacaaatatgcaaaagccttgcacgttaatatagcaggattaggcaaagacttgtagataaagcggatgggcagaatttaacactgaccttaatgcaaaagcaatcaacagcccaggaagaagtatatcaccaaagccaatgatactgaatccaccccatggatcaaacattcgtgggatttttaacagcatgggcacaccgtcttcatcagtcttatcaccacgggcaacctacgagcagacgctagggcaattagcatttcgcaagttgcagaagcagaacatcacagtatgaaagtagtcatctgtacctaccacaatcatcacactctcatgaaaccacatcttggagataaaaacccaaaagatgtcatataagaaggaacaactgagaagaacagatccgacctgatcatgatggaaaaagagcaagaattgttataaaagtccccactccccactatatggtaagcataagcagcagggcacaataattaccttgaggttaggtatcctaacaatttggattacagtaacaatcagagcaataccctgaagacaggcaccatgttaattaacattcaacctcctaatcatcccaattgagggtgagggtataaaaacgaaacttcacttacaagaatatcttgcccaatccaagcataggtcatccggcgataaacagcccatataacagcaaacacaatgcaaaatggacagactgcgattgtaaggtatgaaaccgctccaaagaagggcactttcacgaaagattcggcagcaggtttaaaccatctgaaagatcacatgattactggtaaggaaactttcttatgttctcttggccacagcccacagccatgatatataaatattcatctgagacgtgtctactatataaatcctagcccataaaacaatttcaaagggccacaaatgtaccttgacaataaagccaccaagcaagtttgcagaccctgcataaacaaataataaagaacacacaatgagctcaagaaatgtaagaacaacaatcatacaaacataaatattagttttgaatatcgactaacagaactaaggtcaatttaggccctgtttgtttagcttaagattattgtaatctagattatcaaatcaaattactataaactagattataataaactgacatagaataagctgtgagctgtttgtttctctggattattagaggcatctaagggtagtgggtctttagccactcaataatcttggaaaaagctcatccatagaagattattagattataataatctatcataataatctacttgtttgtttcagcttactcctaataatccaaattataataatcctaagctgaatcaaacagggccttattcttctattcgataaaagttatcatgcttggcattaaagagaaaccacaaagctccttgctcagtttggcatgattctttcatagtagttcatatagtactgcctcacaatttgtgaaatttagcatttggaaagcatacagattatatgtttcaatggataaacagtataaagatcttagggccagatatccagctaattaattacagggaaaatggaatggcattgaacacacctctacaccaccaatgcaaaagatgaccaccagaagctccacaaaccagtgagacataagcttgtagagcattatcaagaagcaagatgcaataacaacaaacagtattgccgatgtcatgttgatatctaccatgccactagaaccaccagcctctaagtttagtgaactttcatggccatcctacataaaccaaatgactgttagttctcttttcaagcaaacaaaatccagaacaatagtcaaataagcttctgttcagaacctttagaagcttctcttgttcaataactgcttctcgagcactccatgctgaccagtatgatgcacaaagaatggtaccaacagccataagccacaaaaacacctctgcagtatcaaccagaggacggtctggagagtatagctgcaccgaaactgagaaattgaaaacaaattcgatacatatgttagatactatggccaaaaaacaacttccaagacaaaacaaaatttgaaacaaaaaaaaaacctacataggacatggcacaagatttcaggtggtggaaggctttgaagatttacctttaccacgtgtaagaagcttctgtaaatcattgcctgcatcttttggcagaagaactgcaggtatatttatgtccaaatctgtttcatttcggtcgcagaccatcttgtatagctctgcaagtggaagcaggagtgcaggacacatgttaaccacatttatgagtgctcacctatattgacaaacatgtggggactggtgcaatacatgtgtccaactttgaaaaaaatctgataacacagtcaaaagtaagtatctaacttatcaaacaatatgaagtgatgaaccactgcaactaaatttgggtgtgatgcatagacattgacctttcaatgataaaacaacctaggaagtatcttgagcacgcacgcacattaactatttgcacccatggcaagaatatatgttgatctgcctatgtagggtaaagagactaatggttgtaatcttacaatagatagtaaatgatcttttaacaaaggtaagacacagaagagatttcaggtaggatggcaatggtaaatagaaggtttatagtggtccaccatgcatatgcatagtaaaatggtaagggagaatattatgctattcgactatttcaacatcttgatctactaactaatcagctgctgaacgcaggtataaagcaaaggacattatatgtatgaatttacaaataatttcacaaataaggcataccatggacatgattgatgattataatagcagaagccccagcagcttcagcattcttagcttttttagtgaacttacagtttcccctttgcactaacaaaacatctccagcaacctagataaaggaataatcagtcactgggtaggaatgtaggacaccatcgagaaatcacaaactattaatttgtcatttccagtaagctaaccttctgtgtggggggatcacaacagtcaataggatctgctaacaatagtcctgtccgattggcatgcttttcctttgactctatagtggggccaaaacgagcaccaacaccaacaaactcaccatcctctctgttattgacccaggtttgcacttttacctgataacacggtgatggaaaacaacatagttaaaagaatggtcacatgatgggtaggaatacttgttatcaataaagtagcactgtaaggtgttaggtataaaataacaaatttgaagctatgaagctaatgcccctgtgttgtgaccctgcctcctactttgcaaccaaacaggcacctggagagggcccgaggcaggttgcaacaacaggggttagccagtgagtcaggtaatgcaaggaccatatctccctgcatcgaaacttgataattctaaaactcgccattttgaaacctacactgacaatcaccatatagaagagactacaaaataccatatgctatactgaccatctaaaaacttagtttaacaactataaacactaattgaatagcactaataactagttgttcaacagttcaagtaaactagtaactaacgacaggtcctcagcttacaaccgaagcctccaaagcagatcgttaattgtaggctatagcccgctccaacgattgactgatgagcttcagaattcaaaccaaatcgggcaggctaatttagtcgagactctaagcaaagccgcgagtccgtgtccccaagttatcaatcacctgttctgagcagcaaacaacatcggtgaagtctacaattgacaaaatcggacaggctctataccgtccccctgatctgatactgtaaagtcacaaatcaatagctcgaaaccctagcttcacctacgactgaaattgaaccgaacactcccgtcccgtgcagctcggaaccgaaaattcgggtcgcatcgtactaagggcaagcgaagaaaccgcgcaagcgagatggtagaaagtctgggaaggggcgtacgaggacgaagtcgttggagcagccggggatcttgggcgcctcgtcgtcctggtggacgatgtcgccgccggccgcgaccccggccagagccgccatgaccagcaagagcgcggccgccatctccggcgagctggtgcccatggccaccggacctctcctcctccacgctgctctccgccgcgagggatggatggggatggggatggggatggagatggacttcttcctcctcttcttctccgcttctgttgtgagttgtgacgcggaggaagttggaatggactcgggggggaggtgggcgggtccacctgccagtgagccagccagagtagtacacgagaagatgggcaacgtggactggtcgcgatcagcgggaggagtatcgtgctcgtacccgatggacttatccccattctctctctctcttcgggaggtaggggctttacctgggcctaggcctgctatgaaaatgttcatgggccaggttgacggcgaagtaatcttttttttcactctttttgagtaaattgccatttggtccaccttttattacccaaattttaatttggaccacccttaaacctattttttcaatttggaccgggtaaatttaccattgttgcggtttggactaccatgacaacttttctcgtcatgtttaatttccctttcggcaaacatatgaaccatatatagaggagatcggccgtatactagagctgatgtgtttaaggtcgttgattgcatgagaaaaaaaatcattcgtggtggtccaaatcgcaacaatggcaaatttatccggtccaaagtgaaaagatatgtttaagggtggtccaaagtgaaatataggtaataaaatgtggcccaaagcgtaattcactcttttttatcaaaatatttacaaaaattagggaccggattgcaaagttctactctatctaaaaaacaagagctgacatattctagtataacagagtcaaggagggagtaggtcgctagccatgagcaacgatctgattaaggtggatccatcatgagggcgtgcggggttttgagccgccactactagcgtaaagaacttgagagcctctacaaaggtcccgctaaatttttggagagtcatagatgggaggggggattgtagatttatctagtttgttcagattcctctgatatttttctttctgaatttttcactgaaataattaattaattagggacttggatgcaaaaatgttggaccattacgcctactgggggagaacggtccaaaatatggatcgaaatggaaaatgccgggggttacaatcggaaatacgggccgtggactgtaaaaaagtttaaaaaaacccactaaaaacgtgggccttacaagtgctaagggcctagtagtagtagctatctaatccagtagtaaagttggttcgcatggcgcggcggaggcgccagtggtggatggcgtcgcggaggggatggttggggacgagctcgcggcggggcagcttcaggttcgtcatcggcgacgtgtcgcgcccgctgcgcagccactccctgatcgcctccgcctcgtacgagaacccgtctccggcgatctgcgggtcccgcatcacctccttcaagatcgggcacacgaagtaggacggcgccccgccctcaccgccgtccgacgacgacgacaccgacgaccacgacctccccggcgccgcgctcatcgccgcctccagcacgccgcatgcctcctccagaagttcgccgggacggcgagctcccgctggctcctcctccacgtcgcagcatttcagcccgacgagcgccacctccctggcgacctccaacggccagcctccagagctcgcgtcgaacacctcgtgccacgccttgctgccgcccgcggcctcccgcgcctcctgcttcgccatcaacggcggcttcccggtgacgagccggaggaggaccacgcccagcgcgtacacgtcgcgttccggggtcatctcccccgtcgccaggtgccgcgggtccacgtagcccaccgccggccttgacagcgccacgccgccggagctccgcaccagcctgcacatgccgaggccggcaagcttgctcgagcagcactcctcgcccaggaggatgttcgccggccggacgtcgccgtgcaccgtcgcccgtggctgcgtcgagtggaggaacgccagcgcggagcatgcccggtgcgccacgccgcacagctcgtgccacggcagcgccggcgcggcgccggcgaggcggtcctccaagctcccgcccggcacgaactcgtgcaccacggcgcgggcctccgggcacgcgcccacgagcgtgacgaggttcgggtgcctcgccctgccgacggcttccacctcgcggcagaaaccgacctcgtcgacggcgacgtcacggccgatcatcttgacggcgaccgccatgctgcgcaggtcgcccctgtacacgctgccacggctgccgtcgccgcctccgatcctgacagattcgtcgaaatggttggtcgcctcctccagctccggcaagccgagccgcaagaaggtcagtctctggtcaccagcctcgcttcccgccattgcttccgccggcacatcgtcgcgccggcgctctcgccggagctggtggaggaggtcgtacgattccgacagcttggcctcgaggtctctcatcatccgctcggagctcgtgatctggagctcgagctcggcggcgcgggcgtccacctcgcgtgtctgctcgagtatgtcgtcgagctctcgcctgtcctgctccatggccgcgcgctccctcgccagcctctcctccacctccttccgatgcctcgcctccctctgctgcgagctctccgcttcgttcgcctgcatcgatcacatcatccatccatggtgaattttttcacgaacacgtaaaagaattgcacgtcaatatatcagaagaaaagaatgtttgtttatacaacgtaatccgccagaccggcttatgccaagagaagagagaaaagacaaaacaagaaaaactaaagaagaaaaaggaagagactactacgacgagtaaacgcaacttcaatcagcgggaagcatccatggtgaattcgacatgaacaatgggatcgaaccaacgatgcaatgcagcttggattcatttcctctacttacaattcttgtcgcgtcggcgaggtcgcgctcgaccttttgacgccggcgagtctcctcgtatgcctcatgcctgaggttctcggcttctatcacagcatccttgaacttgtcgtacgcatcgctcacatcaccagcatcctcctgtcaaaacggaatgcaccgtttattgtttaaatgtttactatctgaaacacatataatgtgtattacactgatgctgtatattctggtgcagatcagttggccaaaatcttcgacttatgaaacatgtgctgttcaaattatgtttctgtagtggagacaaaaacaagtcatttcgacaattttagtaccattttcagcagtccaagatcaaacaatctaggagtaggaaaataaacagatgtctagcacttgatgtaactgaacaagtaaacagatgtcatgtaatgtggaattcagatagtttttttctacatgttgggatttgttcattttttctttaaaaattctttcaactttttttcccttgaaactagtattatactgtatgatttatgaaacgtatagcacataccgaaccatgccctgaaggagttggtgagtcctcttcaatttcttgcagagactgcacaacagcagcagctgatctctgtacagcctctacattttcagacactgggactgttgatgaactagcaacagcaactgcttcatgattaaaaccctcagtgccacggtccatggcattgtcctccctgataggagtctgatcaactgatgatgtcgtcggttcggctggatcctgcataccgaattgctcgctgcttaggctgtgcactcgtggcgaggatctcgacctcgagtaatcagaagtgctcgacctcggagttgtgctagttgtcgatgatcctgttctattgagtccttcgttcacctccctataacggatcagacaaatggaattaaaggaaatatgtaaatcttataatatttttccaggaaaaatagaatatccttatgttagaacagctagaaagctaatagaagaatgccaaaagttcagaataatatgtcacaaactaggatgttcaggcaatctcagtgcttccacaggtactatttttgttcaaggtttgttattttgttagtcatttgtcataaacattatcatattatcagtatatcagattattctttgtctggcctaattcttttttgagcaggatgtctggcctaattcagtctgtgatcattgtcttaatgtgagaacagctaaaatggtcatagaagaacggtaaattcccagacaactatgtcgggaaatgttgccgacgcaaccacagtttctatcatgtttatctcgagaaaaaaaaagtttctatcatgttccttacaatgatagaagaataaccacgagttaaacggtgtgctacttcaattcagtcttcagtctttgtcatcagtgctatcatagaaatctacaaatacctgtcccattttgagcaagacagggagaagaaaaaccaaaggcttttgcaagttgcatcgttggcattaagacttttttgagtcatgcatgcatacctagtgcagataaggtttcctttgcagacaaaccagatcttgcaagaggggctcgccttcagttgcaccttccgagctttcttagatctcggcgcccgcattttcctaacatcacattgcatccagaattccagatcatttgcctttgaattcagcaatccactggcaccaagctggaccagccagttcttggaccgatcgattgataacaacagcagcgacagcgagagctggatttgtatgtattaatttccaagaacaagacagccataccttgaataggccttgtcagatgctgctcccatgacaagatcagtgatcccatgatcatcgacgagctggaggaggcctctcgcgatgtcgtcgcaggagaagatgatcttgctcgcattgacctgcgagtttttttcagcaactttgttagcaacccaggctgcatatggagaagagggagactgtcataataagaacacagccagaggctgctggtgagttgagactagcaatctgatattgacagcaagcaagatggatcaaatgtaaaacaatgaactctttatcatggtttcaaccttttgacttttgcaaatgtccaagagatcatctaagactttgctgatcctctcctcctccagctgcctgtatgcattcacctcctcctctgcaagctgacttactgggacccatgcccccactgcaaatccacaggtagtacccaaaaaaaaatgtcacaaaagatccaacattttttggaacacaaaagtgtaatgtaaaaggtattgtaaaggtaggaacataacaaaaggcacctactttcaggttgacagatttggtgggaaaagcaaagagaacataaacagccagctggtgtcattttacaagaaaatattggtagccaagtctaacattttgatttcatcaaaataatagccagataaaaggggaaatgttttacaacctgattaaggtcagagctagcattgcaattcttaattagactgaaaatacaaacagtgaatatgcttttagctgaagacggatatgcttagcagaaactatagtactgttccacttggcagagatgtatttgtataagattattctgagcaatagtttaagttgtccgagatgttgatttctacgcattttttttccttgataatgcacgtccacgacaagtcagaaaacaaattgaggcctcaaatgggaaaataaaaggaatgtaagcagtgcacgtagaacagccgcagcatcaaaaaaccccagtttccatggaggagacagcagctagcttgaaatgggttgttatttgccaaaaagaaatggaatgatctttctagaaaaattagatttgtcgcatttagggaaggtggtttgaattattttctgttatttgcaagagcggatttgaaaagatcaggtatttgccgataacgggagatgaattttatatatataaaaagtttgcaatggttggaatactgagattgcaatggtgccatttcgaaggagtgcaatcaaatgccaagaaacagaaaaaaaaagccatttctgaaccggattaattacaagcaagaacagatgcatgggggcaattgagaacccgtaaaattaaacagaaaaaaaaaacaataagaagcataaacaaccaaaacctctgcaaacaacaagaagaccgcaagaattagcgaactgcaacaagaagaacgcacgcaatgaagaacgggagttaattggaaataaactggaatagtatttggaatgaaatagctagcgatggagcatactcatattgacccgggaaggcgggcggtggacgtggatgaggacgatgcggctcctcctcctcctccaggggaaggcggcgagcacccacatgaggttcgccttccattccttcaccgcctccttccccacggcgcagtacaccgcctccgcctccgcctcctcctctagccactgctcgccgccgtcctcctcctccgccgccgcctcgcgaccactacctccaatggctcctcctgcccctgccgcagcttccatgtgttggggttggttcttggttgtgcacaggatcacgctgcccttctgctcatccaaagctaggctaactaatacggagtactaaagccaagattagctgctaactaactactctggaattaaaaaggacaagacggcgacgcacgcatgcagcagcagcagcagcgttgaggaatgaaggaagctaggaggaatcgaccatggccatggagagcctgctgatatacagacgcatgcagatttaagcggtactattactaagctgaatctctttgcctccaatccaatggcagtggaaaaggaaggagggatgatcttcaaaagggaggaggaggccgtggcaaatggcaggaggggataggagaggctgacaggtgggcccatggagtcggatattccccgtaccttttctttcatgggatcccgtgtggccatccacaacgacgtgctcgccgtggcacccagctgcacacttgcagtttcagactagctagttgtcgagttcctccatcaatcacgatcactactgtacgtgcatgtgtagccgccttgtgtgactcccggtcacaaactgtcagtgtacttcaattgtcgttcatgcatgcatgggaccaaatactacaccaaaacctctctctgatctctccttctccatggattcaatgctactccagctagtacacgtagtagatggtcaagacatcttcctgtttaattctaatttctgaattaatgtccctctttgcatgtgcacttgaattctgaaacttcgctctgatttccagccctgcaacctgcatatgcctttcgctgcctatacgaacccaaccttaaattggattggtcggtgaggatgatgcggctctcgatcgattcattgcatgccatgttcctcctaaccctgctagctagttagttaccaaacgcatcaactaggttgttcagttattaacaagctagactctgaatctctgagtagtaagtactaggacgcaaattaatttaaaaccgcggataattgattaattagttgcgagcgagaagaggtcgccaacatgaatcacgtacgggagacatgccgtatttatacacaccgttgactaaaatggatgcttctatactaggaatatcccatgaacatagatggatatgccttgaccctgcaaaataaagcccactaccgtaatgtttcttaaacagagctgtctacatacccattaatgatgtttatagtataatagcatatgaacatgtcttaatacaccaccaagctagcttacctagttgtatttttcaaattaatggcacccttaaatgctcaaagatggttaattagtagcaccagcattaagaaaacatacctgtaggttaaaacttaattggttatcagggccacgaacatcggagataaataatcatctgggggagacttgaccaacaagttcatctgatgtcagtgatgatgagtcctcttaatgacacatggtggggaaggatgagcaatctatagtatatgttatgttttggtttatctaccttaattctcagcatttatgcgatccgaatataatgctgatctttggtttttctggtcattttgtagtctgaattttcagatcagacaacagaactgaataaggttatgaatctgtgcttacattcttagctacttaattttttcatagttaaacaagtttgttataaatgaaaatgcgagctgctatcagaagattgacatattggcggtgaagcatgcatcatgtatggaagatggaacaagaggtagttgggaaaaaagcaaacttaccaacccctaactgttctaaccttttatctccaacatttctcaatttgttcctcgttggaaaataagcacgctacacgcgtggggttcaatcagcagtactatcttttctgatttcatgacaaaaacatgtcattgtttaccttattcagaaacaagaacctgaacatatacacaccaacaaatactactattccatttaacagcgggagaacttttgctgatgtatcaagaattctcagagcacacgcatcatctacatcactgcatgcgtatcaaccgtaccaaaaattaatccgttagcttaaccaaactcatctggttatgacaaaaaaaaatgctattgttctggtagctatctggacaccattcttcagttgtctgcctgtcggtgttagctaaatagttcagtcgctttctatgattcgagatatggctagctaaacacaattccaaaaggcccagaattctaagattcacactactttcagctctttcgtagtattaggttaatgattctaactggacacctaatcaggattttaaaaatattatagagaagagagagtgaggatgccttgtcaacctcagctcattcctagggaaggtgtatcgatcgcattacgtctccgagttgtcgcataaggcacacgataagtttgtttgcgcattttatatagcactccgtatcacttttgtacttctttgatctttgttagttttgatctgatcaagcagtagtaaactttaactattagtaaagtggttatgattacaaactaatgatacaattttgatactataatcagattattttataaaaatacagttggtgagagattggtaattcaaagtaaaaaccgacatttgtttctgaacggaggtaatactaactacgtacgcacgcacatttgagtaaatttgtacttcctccgtactcgtttaggacaatgtttaagtcaaaccttagaaatataaatcatgaataactctcaagttgttgagtttgaaaatgtaaaaattatatgaatagatttgtcttgaaaaatactttcatatgagtatgcatatattattttttaataaatatttttatagaaagaagaagttaaagttgtgttttggagaccgtgtcgctgtccaaaacgacttcctttacgagtacgtagggaatacgttaataaaagaaatacagtttacagtaaaaaaatccaataatatgcacaacaatagacaattcaataattaatctacactttccttccgcacctatagtacttggaccaaagtacatgttgaatgccaacgtctcatcagcgcattcaccttcaaaagatgtacaggccaccatttacgtcaatcgtaagccaacgcgtattcacgagaatacgttttctgtacgtgagaacacattccagtgtatacgccttcgcgctccatttacgatttcataacagggaggcgtatttcatagcgaacgtgacacgcagaaaccaacgaggagtccactccagtgatccgcgctcgcttggaaatccgagccgcggcctcagatccaattttccgagtcaaaattctgggaggaatccatccaatccgcggaggaagcttccaccgcgcagatccccaaaccccggcccatccccgtcctccaatccacatcgatcccctgcagattcgaggcggaaatgggggaggggatcaacggcgacgccggcgacctcgcggcggcgccgtacgaccagtggctcccattcagccccgccgggggatccccgcgcccatccgcgcgttacaaggtgcgcccaattccatttctacctccgattactcacggccttgtcgtctgatttttaatttttattgttgtagcagtagttttcgtaattttgtccgtattgatcagttggagtagtagatgttgtcgtatcaattctcagggaacgcacgttaagaacaaacgaatgcgagtagtagatgctgtcgtatcaattctcagggaacgcacgttaagaacaaacgaatgcgaaaatgtgacaaaccgcgtgcctaatcctgtggctttggagatgccatctctgcgtatagtgggacaatgccgagggattggcattaggactgaaatggccgacagaagtagtcttgagagaattttggtttcagatacgcgggtgtggccacattttggtaatttccctactgtcctgttttcatggttatctgattaaagccaaagagtttatgcaaggcggcatactgaaaccgttgttgtagtgtgctccatttgttagactgtgaaacccattaaaccttaagatagtatatgataaggataacttgaaaatctttgggttgcagcgttgcctagtcccctaggagatcttcttggtgcttagtcactactctttctccttttctcctctccttgttgttctcaggagtatggtttctaccctagttaatctagcgtgccctccctctcccctgtaaacccccatgatctgcgtcagcactcagcaggtcgcagttgtaaaatctctcttttcctgctaacatatcgatgcgcaaggcttttgcgagttcgccgaaaagaaaagataacttgaatagcgtgatgttctttggttattccatatgttgtctatcatattttattgaagtgctaatacatgacagcatgctgcggaagtggttcgtgaaaaactctatgtggttggtgggagtcgtaatggccgctatctatcagatatccaggtttttcagtctgcactaatgcactctaacaaatcatgtttctcatgccatttctccttctatatcataacaagggaaaacttcacaggtctttgattttaggacactcaagtggtcagcattaagtgctgctagagattcaagtcagttgaatatcgaaaataataccacagacccttcattccctgcactagcaggccacagtctggtaaacttactatcttttctctttcacttgtatggcaacttagcaatatttttatcatacaatccaacattggtatgtttcctatgctaacatagtgtcaccacttaggtcaactggaaaaaatatattgtggttgtagctgggaacaccagaacatcaacatcaaacaaggtttcaggtactcattcaaaagctctacaattatttgatagatatcgtcacactgaaacatagagcacagaatcttcctatcatagatcttcttagacatatatattgctaaataatccacttatgactttattgctttgccacaccaccaattaccatgatcctttatgaccttacatattgtatagatgcaatatttgaagcggctatatgtacattacatctttatatggacctatttatcgcttaagatagataatctccaataggggaactgaagcaatctgtacgttagttcagaaccctttcctggttttctttgcctctacctgtaaaatggtaccgactattccttgctccatgtcatttcatatgtcctggcaaaaaaatgagatgcaaatgaaatgctgactaagataattactcgatgtagtttcatgtgtttaaaggctgttcggattaactttgatattgttttaagtgatgatttttacatttccttatgttatgcacttgtacacagtgtactgaactttctatttaatcatatatgcttcataattagcttcactttcaaggtgccccaaacagtctatagtacttgctaacatgtaatatcatccttgcagttttttaattatgttctattaaaatttcaagaccggtatttatcttaaatgatagtgctgactatctgcatgcagtttggcttattaatgtggaaacaaatagctggtcttctgttgatacatatggaaaagttccagtaagaatcatttccttttgtatttgaaacaaaaagtaattcttttgaagtgatagaactgaatgtgctggcatatattttctgcagaattttctgaatactgaacttctctgcttttctcaaccagatatctcgtggtggtcaatctgtatccctggttggttctcgactgataatgtttggtggagaggataacaagaggcgacttctgaacgaccttcatatacttgacctggagacaatgatgtgggaagaagttaaaacagggtaagaatttatttattgattgtgcaaggttccatttacgtattgttattgcataattcattattatctttgtgtgaaataggaaaggtggtccagctcctaggtatgatcattcagctgctgtttatgctgatcagtatcttttgatctttggcggttcctctcactctacatgctttagtgatatctaccttcttgacttgcaaactgtaagtgttatatactctccatgtatcttgccatacagatggatttgtgcattgagtcacataccataagtttcaaaggcaaaaagttactcagttgtcttgatatttattcattgattgcctattgaagatctccaaaccccccgcactggtagttctaggttctagtaggcctttcaagtttcaaactgtatccagttaatggaaactaaggttgaatttctgggtggttgtatgcaatgactaagatccaacttcagtctgttatggcgaaaacttaacagcaactaccgtatatcataagctggcaataggtacataaaacaaatcatgttgtgcttctgaatgaaggagaattttatttcctccccttatatcaacccaagttatgatttgactaatactcctatgaacattgttttctattcattcttgattaagtgaagcttaatgcttacagatggagtggtctcaacctgacactcaaggcgcgcacataaatcctaggagtggtcatgctggtaccatgattgatgaaaattggtacatagttggtggcggagataacgcaagtggtaattcctgaacacatgatgctcatattttcattttatttgcaccacctgtgctgctgaagtagctagaaaatacaacgatgcaggttctactgatacaattatgatgaatgcttccaagttcgtttggtctgtagtcaccagtgtgccagcccgagatccgcttgcttgtgaggtaaacaattgtgctacctagttctgtgataaattttgctcatataaatttctatcgcacaactgtgagaacaaacacatttgaataggaagttccttcctctatacttacgtaaaacaaatcatgttaatagtaaactagccgaatttcctgcacagttctgtggcgattgctgaaaatgaaatcgtatttcttatacagctttaacaactcctatatatttctgatcaatctacatcatcataatctgtacccaccacaatttatggtatagataattttctttttcctcaaacttcagcagtaatttcaagtccctgacagcaaatgtggatgcttctctttctactgttttaagaacataatggattttgctttgctgacaacttttctttaatattatatttcttttttttaaaaaaaaaacttttcagggtctcactctttgctcaaccacagttgatggcgaaaagtttctggttgcctttggtggttacaatggacaatacaataatgaggtattgaatttaaaagagtgacttagttctatgcatagtacttcaattcagctttgaaatgatccatctgtagattttttacttttaggtgtcacatgtcttgtgccttcaatgcttgacacactcaggatgaatttgcatcttttttctcttttcatcttcccttcctttttggtgcacatttttccatttgcaatttcttcacaagtggacactgctgcagatatttgttatgaaacttaagccaaggaatttagtgcaacctcgtctgctccaatcaccagctgctgccgccgcagctgcttctgtgacagctgcctatgctgtaataactgatgagaaaaccagagacattgttgcaacggatgatttagatgtgaagagagttcagccttcaggttcttccaaacaaattactactgaacttgatgcacttaatggagagaaaggcaagctagagtccagactggcagaagttcgtgatgaaaactcaaaactaaaggatagactagatatggtaaagttatcgcatggtgaattgacaaaggtacatgtttattttccattttgtaaaatggaattctcaattcatctctaataaatcctcactatttttctttcttatgaaggagcttaaatcagttcaacatcagttagcagcagagggttctaggtgccagaaactggaggttctgtcttaatgcactacaatgaattctaagcatgagcatgccatcttcttttgtttgatccttttacatgcttctgaacgctaacctatttccttattctcgttaattcagtcccaaattgctgctgctcataaaagactggaatctactgattctttggagaatgaactagaagtgttgcggcaacaaatatctcaggtggagcaaaccatgacaactgctcaaagacagaaatctgggggtgtttggaagtgggtggcaggaagtgcagagatctctgatgatgaatagtaagtgctacttgcaacatcctggagtggaacttctggtgtacttgtgctttaagtaattgtcaaagcgcttttgttttgcaccactttactactggaactttattttaagaatgatgagatttgtgagctgccaattttaactcattttggtattgctattgtaacattgatataaaatggtaatatataacgatcggcaacacgaacatttcaagagttattgttttatagtatttcttcctatgtagtggttgtgtgagtcggccgataaaaaagttggtatttgtgaaatgaacccaataacagatcatctggggtagaaccttttcttggtcaaaatgtcatatcatatatataatcatatgcaagtcgtatttgctaaaatgtagatctcctgcgtgttcgagacaaagatatttgctaaaatgctgtgataccaaatacatgtagtcacgtacccacagaggttatttgaatttagacctgcatttcttctgtactccaaatacaaattcacacacagagttgtcacttaagtcctggaggctgaaggtacagaaatcaagtgctagcataaatactgcatttttctcctatcatgcattatgcccgtttccatacaatttgattcagactataatttcgtaatctgttgccactcattcaattcgctatatttcacagtacaacttttgcagtgcttgtaaccctttgagcatggttgtcaggtccaccaacaccaagacaagcagctaccaagcagagagacgcatgcagagctgctacagttttgagataatttctgggtgctccctcaagatcttgttcgcggttgattttgagataatatctcccaagacagtcttctgaatcttcttaagtagtggcacctggtagaaattttccataggcaagttagacattcaatagtaagagcataacatcatacaaatataccgaatcatttgtatcacattctagaaataattgattagttattaattttgtgttcgtcatggcatacttttctgtagtcggtgttacagaagtagaaagtgttcattggtttcggcgaggggatgaatacattgtttatatacctcaaacttgcaaatatactattcagatataaatttggttcagttgtcactatatgcatgtctcaattctgtgtgtatctcattcataaaccccgagaaggacatcgttccttgccaatgtttgttctagtacatatgttttcatgcatgatttttctagtgatgttgagtcgagaattttaccgaagaagttggttcacttgtcactgatattgaatgggcctttccgctgttttgcctgcaagaattttgacatgtaaagaaggtgaaatgtgccattttttcgtaagtgtcaaatattgactgatacatagaatcttcagtaagggcgcacttactgtgctatcaccgcggcgcttgcagcgtcaggcgccacctgcacttgctccgaagctgacgccatcatcttctccggcgagccggacatctccgtcagctcgacccacggcagccaccgccggaacgcctgccgcgcctccgtcgtcgcgagagcaggcaccaccgtcaccctcctcagcgaggagagcatcgtcaggggagccgcgagcgccgccgcgacgtcaggcgtcgccacgacgtcggtggcgccgtgcgcggccgccgcctccatggccgccgttggatcggaagacggcgaggcggcgagcagcaccgtggtcactccggcggctgggagcgcgagggcgagcagcggcaagccgtggacgctgcagatggggagagacgccaagcaaacacggccctcctccggcaagcttgcgccggagacggcggcgatgaggtcggcgtgcgtcatggtcgccgccgtcttgg

SEQ ID NO: 62915 - DNA, 29056 bp, Oryza sativa
  unsure (1)..(29056): unsure at all n locations
cgtgcaacaagtgcttccccaccttccaagccctcggcggccaccgcgccagccacaagaagcctcgcctccccggcgccgacgacgacaacgttaacaacgtcaccaacaccaacgccatcgtcgtcaagtccaagccgccgctgacgacgacgacgacgccgtcggcaccgtctccaccgccgcctcaggcggacgccgtcgtggtcccggacgtcaccaccgtgctgagcctgaacaacgtggccgccgccggcagcataatcaacaagctgagggtgcacgagtgctcgatatgcggcgccgagttcggctccgggcaggcgctgggcggccacatgcggcgccaccggccgctgcacgcgccgccggagcgcgcggcgaccacggccgccaccaccgccgccaccgccaccgccccggacaccaagaaagagggaagcacgagcatcaacctggagctcgacctcaacctgccggcgccgtccgacgaggagtccgtgtctcctccgccgccgccgccgccgccggtgctcctggctctcggcgggcagttcaacgacggcaagaagccaattctgcagctcaccgcctccgccgcgctggtcggctgccattattgacatgacatgagcaaagctaagctcaagaattcttttcgtgattaacactgatcaattgatcatttttttcacttcttcttcttaatttttttctgggggattaatcactatacatgcatgtttacttacaaatttgtttggcatgtacatcaagctggaaactgtaacatatactattgattctttcgattcttttctgtaagattanctatacatacatacatacatagggattgattgacatttatacatatgaaaatgaatcaagtttgagatcaatttttgtccagaaattattaaagtttggccgccacttggagtgtgatcgatcgagagtgtgcgagcacgagtgagtggtggaaagttgtctgaaaatgtgacgaaaaaaagaagatggtggcaatgcaattcgttgccattcttctcatggaaattaagaagggagtgggtgcaatgtaatggccggctacggactattcaactattcctttctctctctttttttattttaaaaaaattgatctgtatcctagcttagttagctagctagcttaatcacttaatcacttctgttcagtggcagtgtttgcaaaaattaaatatccctgtacatataaagcatgatctgtttatatacttttgatgcaatattattccctttcggacactgcactgcaaacatcacttccaattagttaatttatctcgggggagaaattaaattttgattaacgcctgctgtttgttcttaatacgtgttggtacgttaattgtatttattaatttggtaagtttcaagtagtggtgtacattagtacatacgtttccttttgggctttgctatagtagctagctgccttgctgcaataaagatagagatagtgaagtaggcaaagttgccaagggagttgagagggttgcaagcaaaagacaattggaagctagccaacaatgcaagctgctactagctagcagtatcagtatgagtgagagttgggcaaattaattaatataattggcatatatatatatatatatttgatgagcaagagtgagttgtttcagtttgttgcctagcttcactactggcctgtcttgctcaattagttgcttgcccttggatatatgtgtgtgtatgtatgctttattagttggtttctccagcatcaagtaagtaaattaatcacaggggcatatgcatatcagcatatgcaatgaaagatgcaaattaggccggatcaggtgcttttcctgcaggggagcttgttttgtttgcaagctagcctgcagccacagccagctgcagtgtgcatgcatgctgtgatcctcttcagctctgcactagcatatatacatgagcaacaagttaaggagataataacatatactatatgattaatcaattaattagtcgatctctgaagtggatctcatgcatgcatcttcaattaccactaaagttaattaatatattagtgttgatcgatgaaaatcattttttttcgtacttagacctaaagtcagaattttcatgatcccctgcatgtgtgtgtacttgtgaatatctatctattgagtgctgatattttccctcttatgcaagaagtcacttgatattccaaattgggcaatttggatcactgcatgtccaactatacacactgttcatgtcatcagcatcccagccgtccccttattaatgtagtgtacatatccacaagctgcactattaattgttgattgcaaaaattaagctgaactaacaaaatttcaattctgaattaacgtccactccatatagctaggtgtttaatttgcaaattaattaaaaattaatccgtggtttgcattaggcaccaagtgtttccaagtggccaatcgctgcacctgcaaaggtaaggtagctgaagtgaaaaggcaggcaggcaggcgatactttccgtgacatgtacttacttttattaatttgacagcaagacgaacatataggccggccagatgagctgagctgagctagctatagatcatggatcgatggatggatggaatatatacttacctgcagaatgcatgcatgcatgcatatgatccatatgcatatagattgttggtcgatcatatctctctatatatatctatactatacggcatggcatctcatcactcatgtctaatcttctcctctatgtacgtactttggcctgcctgcctgctgaataaatatgcgttgaattaataattaagctaagctagatagatatgcaagcagtatgcaagtcgaccgatagatcgatctgtcgcaaattaaattaagacgcgtatatatttgcatgcagtacaccatgaatttctccttgtatatatgtcactactgatcagtaccactactctcgagttaatgaaaatccttatctaaaaagattagactgatatttatgttatcagtgatcgatttttattctgatttctgaattatactcgtattaattaattagcaagctagagagtgtatcttgcagctagtcttgaacgtaccagagtagtacgtcttgaatattcttggtacacgtaggtacatatatgactggatcaaagagctaattaagctagctattactgacttttttatttataatttaaccaaccggccggtaccatcttgcagcaacgatcgatcgatcaatgatattctgcagtaagatgatatatatgccattggtgaagtgcacgtcttgtatatatgcagtactagctagctattttgctgtgtactcttagtttgcgtaagtagaccaaaaattcagccttaatttctgtcctcgcaaaaaagaaaaaaaaatgtgtctttctgcaacagaagaaaagtaaactgcgaagaaaactagaaattaattaaagagatttatctttttgaataaaaagatctatctggggttggagttgacattattgccacatggctttgagttcttgcggttgcccaaataaagcttcttcgttctgatggctagcttaattgatcatcagttggtatactctgaagctaatagggctagctagtacatgatttgtatggcttaatctgttgcataaagaaacaccgttagttagctggtgtcatctgattactagctatatatacagttcttcagctattagctcgtcgtgtgggttgatttcgacctgacttaatcacgggagctccatgattaatctggtgagttgtactgactaaccagtaaggtagctagctaattaagcagggtatgatcgagtcaagtggatcgagtagctagcagtgcacttttttttaattaattatgagatgtactagtagtccaatagtgctagctactagtgtaattagcttatggagtatatggtttttgttagttgcctttgcaagcttccaatgtgggccccaccccattggtaggcaagaggaacatcaatcaaacatgtgctgatatattggtacagtagagcaataagagtagcagtagcagtagagcagccggccatgccatttgctacatcaccaatacactgaaagtgcactatagattggtggcatcatatatatatattcttgtactatacagctcccaatttccaactccaactgccgtccttgcatatctagctgcaattgtctatggctttcacattctttcaatttcctcctctaaaatcacatgcaagatttctggcatcatccaagaaatatgtatacatgtatcaattaatttgtacttatatttccttcttttatatactctgttttgattctctctcacacacaaattttccaacaagtcttctgaaactcttcagagagaagaagcaaacctaattcacactatttttaaatgcatatttttggtacttgatgcaccttgagagagagagagagagagagagagatagagagattacgtatgtgttatggagatgtccctgtcttgaaagcaggtaagattagcaaagtgctttaatttattgagtattggttccactttctccttttcagcttgccaagatgaggcttatcaagttgccacagacatattagtactctgttgggttctctttctcctacgcatagacacatcgatgcctaaagtcgaaaatgtgcatgttctttttcatagctatgtgatgcttgtcattagcctgtcaggaataattgtattgttgtgtgcttgctaggcaaagataatcttctttaacattctttataacattaacagtcacatcatttggagtagagctgctcatatattacactgagtcacatcatttgggcagagctaattttctgacttggtttattttcagccgttaattaacagcagggtattcagacaaaaaacacatgagcccatcaagcataactgaacaaattgagtggttgcaaattactaatagttcctgcaaaagaaagcaagggctctctcaatcaaagctgctgtttgcatttacttcgactttggtcgattaggcaggagagtgttcatgtccaggtcagttatcgaccaagaaaatattaggcagcacatctgcttgtcaaagcagttgatccttcagtgacgactagacgatggagtgggaaaaaaaacacaaccaggactgacaaaacagtataggagttgccatagttaagataactaacgtgtcaagccaggaacagtgagtgacaataagtagcattctggaatgaatgattcttcagatcacgtggaaacggttgttttgcaggtgaagaaaaagcaggcatcgtcgcacaggcttggctcaactgtgatcttgtcactttctttctggcctttacacttgtcaaacaggactggttcatgcgtttccttccagtttcaacattctccaacctccaggctacaagaaggggctgctgccatgccaacctgaagcgttcatctctccaataaaggctgcaaaatgaccaagttgagtttccgggttttagttttcgcttcttgaagttgatcccctgaattcctcagcaagaaattctgtaggacatatgactagtcaagaaaactttaaacaagaattttctacagcatgtcattcagtgatcatttcttgctttacaaagacagtgtaaaatttattattatgcccaacagtacagcagcatttagactgactaaaagcctaaaccattacatgctaaaacggactaactcatgggactaaaattctgagacaaaggcgaattgtcgtggaacatctattaatatacaacagtgaaattttacctgacacctattaatgtacatgtccagttccctgcatcaataacaaacatcgggttcactggatataccaatcccatctcgtgtactacagtgaaagtttagaactgacattgcgtacctgcatcaccagctcactccaatgcatccattgtgcatcattcatcttgtcaagagagctcctgtttctcaatgcaaaaggaagctagagttgtatcaatagcatagcatcgtaaatccagcaggagaggcgagacctccatgtaaacatcatgagccattacacttgccggaatcctgaaattcaatgctggaacctgaaaaatgaatgaagtagataatatccatataagttgactaaagatgggtaatgaccaaagtacaatatcagtgcatcatcttaccaattgcccatcactgaatgcaaaaataggatacaccaaaacgaataaatcttaagagcccacgtttcgcacttcacagtggtgcttctttctcattagtatgccctactgatacaatctgcaaagctgtgcctccaacaagccaagctgtgagttctggttgttcctcaaggtatttcaggggagctgtatttccatctcttgtctcaacaccatagacaaatggaagtctcatggtaagaaagctctcaggtggaaggacaactcgacaaccaagactgaacgatccttgttgatcatggtcagaagcatttgaaggcaaacatgaggcctgatgccagtgagataaaacgaaacttaactcgcataatatttaagaaatgcatgtcgtaaaaaaaaattgcatcccatgatcccagtttacaagtgagaatttcatttgttcgatactaaaatatcaagaagagattcatttgcttgatactagaacattgagaagataaaacgactacatgagtagggatgattgtacttgcctcaaactgtacaactgggcagcttgccagcagaacagggaaatcaggtgtgaccttcaccaaaaagagtagccgtatcagtgaaaagacaatattaaagaacagataaatactacaaggttcaaaaggagagcagcttacaataaaaatccgttgaagttgtgacacagcagcagcaacctttgcatcttgatttcccttcctatctgagctcttgcaatgtgggcagtgcatatatatgggcagatttctgtttagaagtgaaaatgcttctccaccatcatcaagtgtaacataatgaagagaaagctctccctttctttcattctgtggatctgaaagccagtgagaaggctgcaaggtctcagcgtcaaccctgggcttaagcaattgctgctggctgtttctccctgatgaatccattggcctattgagcttccctccgctggtcacatccattgttgctgctaatctagatgcattttggggcaacttttgtgaaccatgtttgctttctgcttcattatttagattagatctttcaaactgcaaataagacgaatcaatctccttgagatgtttctctgacagtaagaaacgatgaccataggaacactcgtgctcaaatccgacatataccatgaactgctgtatagattgattaacttctttagtctcttttccgacaaccattggcactatattgctccctatctgtagaaatggctttccgccagcacttccattactcttatctctgctcactttctcagattcattgtcagctataggtccttgactaagagctggatgaccacggccattagtttggtctgctccactcacttgccgctcatctttccagttgccaggttttaatggcctcttctgttggagagcaggaaactcagaatcccttgctgtgtggccagcaacaacttcagcaaaaggcttcttcatagtaaagtttggaagacctttaccaaaattaatacttgaattgttcattgactcgacttcaggttgttttctagaattttcaagtttcatagatttaatttctgctgtgacttgggtcacggccgattttacttctccagcaacaatagggggagcctgaggatctgcattagatgccgtggagaaaggtttattggtagcatgagtgccatgtttcccttgtcctttcccaagagaaatcgtccaccttaaaagatatttttccttggagcaaaaacctgcttggagcaatccttttgttggtttgtaatatcttgctcctccaagccgcaccaaacgccaagaggatactggaaatgcaccagcattggtctctcttggaagcacaagagtaggtaacagatcttcacaattagagaagcagttaaaggtcatgttcgctgcctcaaaatcaaaagggtcatccctaagacggcgtgaccggccacaggcacatgcatggaggaaaacatatccactagaaaactgtaacgctgcatctgatggagaggatttaccgtgtctctggtgcttacatggtctgccagtaagactgacagcatcgcattgctgccttccagattcccatattgcttggcattcatcttttagcttcttggagaatacttggacagccggtcctttaaccattgagtggaaggatcgtaaagctttctgtagctgtacttcatgcatgctggttgggtaaaaggcaggcaaatctttcaaatacacctccttagcagctggaagtatcctttggcaccatgatgaagaaaatttcacattaagccccttattgccttccaagcaagataaagcagtttgaattgcgttggatcctgctgaaggaagttgatcgttctttggaaatgaacttgtatgagtaggtgatgccttcatgttttgggaactacttaacccatcttccccactaaacagtgcagacaaaatagatgaacttatagacaaccatgtatcgaaagtagggagatcaggagcactcatttgcttcccggatgctgctgatgctgcagcagcagctgctgctgctgccaccattccaacaccagaaacaggaccagcagttgtattgcttgagtgtccccctcttcctctcagcccatctgattgtcgaaatataaaatccttgatgaactgaacatcttcatgggttgctggatggcaattgttctccagcgaagaaacatccaatgatgatttggatgtcaaagagtcttcaaacagtcctgcaatgatatccaatggctcacgtttcttactaattgaccgatccaacagtgcaacgacccttgatgtatcaagtgagaacagaggtaggtggctcacattactgacacccctcgaaacaatatgccctggctctagacccacaagtgtccgacacttctttagcaagaaacgtatctgaccttctacagaggaatgcagcttcttgctgaaagtaccatcagatctgattgctggcctagcaagcataaccactgaactagaaccttttgaagtcatgttaggttttggcaagccatcagtgttagaagcttgatttgatgatgtgtcgttcgtatcatccggacttgtcggagcacctggagcatcagtgatatcatcctcaaagacaaacagaacaacagggatgcatagccctggcagcatacaaggatgtgagccagttcctgacatcaacgagattgctgagggatgacgacctccacggcgtgcaggaggagagatggatgaggccctgtgagtaggctttgttggagtattagagcgagcaacttttgatggcactgcaggagctactagtgacttcacaaacggtgcaatagcatgctttgaggattgcaacagacggaatttcttcaaaatctgtgtgtcgaaccggaagccttcttggagaaatattattacatggcaaacctggcaacgtatagaaaataaaagcaaatcaaaatcaacattaccaaacaactgaatcctaaatttccattagctaaagtttgacggtaacttctaggatcagagcaccaatcaaatgttactgacaaatttgaatcgcacgaggatttgcaagcaaggtaggaaaaccacaacaaataggttaatttaattgctacaactggataaacaaacttaaaagtgtcatcttaaatttttctccctggcaaatcaagttaggaaacaagtgcatttatcagctaaccacagattttttttttagtttattttgcattcccacggtccaggtaacagctggataaatgatgcccctatctcccacaacatcgccacttcaaaactaaccgatcgtagttgtcaaagttatccagttaggcatgagaaagattgaacccagccactaaattactgtaccaagttctgtagtttgcattggctgctacacagcgtgacaatttagaggtagatgacctaatacaaatgtagagaccgcgctatgatagcttcatatcatatcagggcaaaacaaaagctgagacctccttcacagctagaatcaccatctcatgatctacatcgaaacgattataaacactcacggagaacatgaagagcagctcccgtagatcgcccgccccctccagaggtgtcggcggcgacggagcgaggtgcaggaacaccaccctcttctccccgtcgcggtggtacctgactccgcccgcgagggtcctggcggagccaccaggggagaacacatgggcgtccaggatccggtcggcgaggcgggcagtgcccccgccgccgacgaagccgacggcgacgacgccgtcgtgggagggcggggtggcggcggggggcggcggggagggggaggaggaggcgggtggcgggggcgtgcgggagaggacgcggacggccggggaggggcccgcctgaggcggcggctccatcgccggcggcgaggtgggggtgggtggcgccgccgcagtagcagcaacctctgtctgtgtattgcgagacgccaactaattgttaaatgggcttctacctgggatttcacgagggcttagtgggctttctatctatatgggccggtaatgttaaataggcttttgttagagttgggcccgttgtatgggctgctgagctccgtttcgtcggttagttggttttctgatatctcaaatgggggaaagaaaaaaaaataaagataagaaattgtgtcggtttcggctgttccacaatgttgggttgttcaatgaaccaaacaagaagaaaaaaaatcactgtgagtaataaatgggcatgcagtgtagtgttgtccgcggttagatcagtcatgctcgctcaccgaccatcgatcctagctaattaagctagcaaatgatcatgagcgagacatatcacaaagatcacagtgtgcatatattgcacaagctttaatatatttctctgttcatcatccttaagggaaaaaagattaatgatttaggtaattaagcacacattgcataattaagccggccgagctacttagcttatttatatataggagatatgctaccacccacaaacttgcacgagctagcattatattcgccctgaacaaattaagctagcaactcctccggtttgtaagatcgatcaatggctatcattggtcggaggcagcagcagggtgtcgcggcggcggcggcgacgttggtggcgttgatggcggtggtggtggcggcggcggcggaagcgcagccgtcgccgggggtgtacccgagcaggatgttccgagcgcgggagttcgggcgcgacttccggagcctgtggggggcggagcaccagcagcaggaggcggcggcgccggagacgggggtgacggtgtggctggaccggcggtcggggagcgggttcaagtcgcggcgggcttaccggagcgggtacttcggggcgtgggtgcggctgcagcgcgggtacacggcgggggtgatcaccgccttctacctgtccaacggcgaggcgcacccggggtggcacgacgaggtggacatggagttcctcggcaccacccccgggaagccctacacgctgcagaccaacgtcttctccctcggctccggcgacccgccccggtccctcggccgcgagatcaagttccacctctggttcgaccccaccgccgacttccaccactacgccatcctctggacatccgaccacatcatgtcagttccatcatttcttaatttacagcttaatgatcaaccgttacgttaaattcaattatattatctactcactccgtttaaggtttcaagattttttaattttagtcaatattaaattgcttcaaatttaaccaaatttatagaaaaaatattaatattatcgatcaatataaatttattataacaatatatttaattattaattacataaaagtaatttagtaatgtaaatattactatatttatttataaacttgatcaaattagatacagtttgactttaactaaaattaaaacatcttatatcctaaaatagagaaagtacttaaaaacagagtaagcagtgttcatcactttcttgattgcttaattgggctaaacgaaaatgtccgatgatggatcttgatgtttccttgtcggtggctatagcctatggtagcaagaaagatttatgtcgatattatattagcgcaaattaagtaggagtaggagtatcaagcatggacaagccgtacggcaaaactgcagggtgccgtaccaacgctttaaacacttgtggcagcggcgacactgacacgtagtacgattgcagcagtacagtacagtgcttgatttggcatgtagctagcgatcatcaatatcttaggccgccgacaccgactccctgtcgtcgttcgtcccagcatctgcataaatgtagtgctagtatatgatcacatatgttcaattaatttcataaatactcactccttctctaaatatttaacgtcattgactttttaaatatatttaactgtttatcttattaaaaaaatttaagtaattattaattcttttcctatcatttaattcattgttaaatatactactactactcaagtttttgaataatattcatacaagtttttaaataagacaaacggtcaaacatgtttaaaaagccaacggcgttaaatattttgttacagagggagtataatgttaatactagcatggatgcatgaataatgtatttgtgttatgatggatcgatcagcttcttggtggacgacgtgccgatccggcggtacgggcggcggagcgcggggggcgcggcggggttcccggcgaggccgatgtgggtatacggctccatctgggacgcgtcgtcgtgggcgacggaggacggcaggtacagggcggactacagttaccagccgttcgtcgcgcgcttctcggccttcctcctccggggatgctcgccgcacgcgccccgcacctgcgccgcccccgtcgccggcgacctcaccgccgcccagctcgccgccatgcgctgggcgcagcgcttccacatggtctacaactactgctacgaccccaagcgggatcattccctcaccccggaatgccgcacccacctgcacccatcgtcctcatcctccaactcctcctcgtcgtcgtaccacggctagctaactactgcttaattatctaatacgccgccatgtatactccatctaatacgctcctccgatcctcaattaagctatctttgtcgtctaattaattatattgtgcccctgtttgtcaattaatcgtttgtttatatatatactactgcaatggatgaatgggcatgctgtttaattaatgttgaatgggcatgctgtttaattaatgttatgttttctcaacatgattaattaccgtttcgagaaacacccattagttttccggttagctccataggatggtgggctagccttaccccttctaattgatactagctctaatatttatgtttttattaattgccattttcttctacactacttcctccgttttataatgtaagactttttagcattgtctatatttatttagattcattaacatctatatatatatgtgggtaatggtagaaagtcttacattatgaaatagagggagtacctccaaatcgtgtcaagacagtgcatactctggctgatatgataaccggtcgctgctgctgttgcgttgttggttggtgtctcaccaataagtacggacgtgcatattcatgcatgcatgcatcaaaaaataaagaagagatgaagcatcgattcgatgcgatcaccgacgaggcgacgacacagtagcagcgccaacacgcgctttcctgtctgccgcacgtccattaatgggccgcgccttcatagcaatacagttcggcacgataacaaacaggcccatgacatggctgtcgcaacacccttccggcccatttatagttgggccgttggtcgctcaactcaatccccttccggcccaaagcattgcccccgtcccctcggagagatttgcacttgcttccttccttccttcctccaaatctccaattccccattcgcgattcagaagaagagttctcctagttccagcttccaagtcaagggcaaggcgagcagccagccatcccgcgaaggcgactcgatccggcgacatggtgcgtattccccgtgttctaatccagcaacttttgctctgatctgattattattatgtctgctcccccctcttgtactgattactgatgaaacatcgtgattcgatttgtgctccatgtacaggtttgcctcgcgtgcttgcttcccctcttcttgatccccgtcgtcaacgccctccccttgctcttccacctcatcctcgtaacgccccaatccctttcccctctctctctctctctctctctctctctctctctctctctctctctctctctctctctttttgttcaatcagatcttctcacgaatggttatttcatggttgtttctttactagcgagcgtataattcaaccatcttaggttagcctgatctgttagcttgattgactagcaacaaacaggaaggaactatctataactgcacattttggtttaaccacggttatcgaatactgcaagtaattggcaactatagtcctcgcttgccagtctgtgccttatccactaggattcctaaaggaatcttgataattgttgtgtgctttccccaaaaaggagacgattatttgccgttctttgtaaccatgttcccatagttatgctcattggacagctgaaatatcatacttcctccgtttcacaatgtaagactttctagtattgcctacattcatttagatgttgatgaatctagacatatgtatgtgtttagatccattaacatctatatgtatgtgagcaatgctagaaagtcttacattgtgaaacggagggactataatagttacactcctcgtagagccgaaagatatagcataaatagtaactgaaaggcaaaaggctacataaggttccccttcttgacttgacaataaataatgctgaaagatgttttgctattcatattactctggataacaaataactaaggccctgtttctctcagctttggattattataatctagattattgagtcagattactataagctagattgttataatatgtagtagaataagcggttagttgtttctttcctaaattattagagcctagattattgggtttgcaagtctaaagagagagtggggtggcatggtgggtaatttttcaccaaataatctggaaaaagctcacctaaatgagcttatcagattataataagctgggctccagattataataagctacttaaataagttgtctgtttctttccgcttactctcaataatctggattataataatcccaagctgaaagaaataaaataatgttctgtagctgctgagtgttttctatttgagggcagcaaaggcgtcaaatgttggaacaaatgaagaattttgtccatgtttcaaacatgccctgaactatgccaatctcttttcttaatgaaaacttgatgtacgcggtctagtttagcgctgcctgaagtagccttattggtgttttagcacgcaatgtgcatatgtttctaggttctcctgttatctgtattctgaaaattgattcatgttctgaatgacattccagagcaagatttatcgactatttggatgggaatacaggaggcctgaaagagccccgcctgcttgcccgtttaagcctgcggcaaagaacaatgaagtaagcttccatgctagtatttgctatacttatttctgccttaagtcgaccatttcattatgcaagatattaacacttagcatgcccccactgataatttacaaactctatagagacagctagcttttatgcatggtactgcatcatactagagccagtagggaattttgcagcaactcatctgtcacagnggccattctgatgtgattggtttactccttttgctgtacagggtgcaagtgaatcaaaacctctagttgaaccccaaagcgctagtactactactaccacagcagaagataagaaagaggattaatgttgtcgagcagcggcgaacgtttcaaacaacagtgttaatgtttgtgaccgtagctattaagaaataattgttatatgaatgaatatactccccacatatgtttgggcagtgattgttgattcccccttccatcatgtaccaaaacgttggtggtagtgggcacactgctaactgcatgctagcaatcgtaaactgctacacctttccattactctgatgctgtgaatgctcaaaagaacatggtctgattgcacaattgaaatactgcttatttgacagtgtcacgagaccaaaaagaaaaggaaggaaacgtggttgttgatttcagcagcaaattgatgcagcatgaatgaatgactactacttggtgtactcgaggacagcgtagaaagggtcgaggtagatggcccggaaggaggcgaagccggcggcgaggccgaggtggcggaactcctcctcggatcgctccctgccctgagtccggtaggtggccatgacgaagatgtcgttctccagcagcgccctcgtcctcgtgctgccgtccgtcgtgtccggcaccaccggctcgcaggcgatcaccttcccgccgcccggcagcgccttgtggcagttgctcaggatcgccgtgcactcctcgttcgtccatgtcgtcagaacccactgcatacgtatgccgtataaaaatgaactagcagggttgttttaattcatgtacatacgtaattcgatgcaaaaaaaaaaacaaaatgggaattaatgagccattcactgcatgtttgaattcttggacagaatctgatgcagaaagaaaaattggggggggggggggggggtatactattacttaccttcatgaagatggcatcaccggaggggatggacttgaacatgtccccgccaacatgcctcactcctgaattttaatggtcactaattagagcatgtacaatagcgaactataagctaactataaacacattttgagaaaataaaagataagagcggatataagagcaagtttaatagtatagcccactactagctccaattcattcttagctaatctaatagtcaattcatacaatagttgtttattatactattaatatatgatcatatatgtcatacacacattgtgtattgaagtccgcactgcagctggctacaaatctgtagcccactgcttttctctcttatgttttatcttattaaaatatgtttgcaggtggttaatagtctgctattgtacctgctctaatagcagactataagctagctatgaacatattttaaggagataaaaaagaagagcaacggactacagatttgtagccagctgtagcatggactccaagacataatgtgtgtatgacacgtggaaccaggtattaatagtgtggtaagcaactattatatgaattggctattaaattggctatagatgatttggagatatagttggctatcctattaaacttgctctaagagagaagagtagtgggctacagatttgtagtcggctgcagtacggacttcaagatatatgtgtatatgacaggtggaaccagatattaattatgtaatatatgtttataggtaaatattgtataaattagctattaaattgactatatatgatttagagttagtagttggctatactattaaacttgctcttagcatcaggaacacaacaaaatgaccctgagccccatgcatattttagcgaaaaacaaatagtcccctacattgatcgacgtgtacaactcgtgcttcacttgcatgatgtacggtagtatacttgtattattgtgtggcgtctcgtgatccgttatgtcaaacatcacacgtgaagtagctgcaaaccaacgtactactcctgtattattattaggcgtacgtatcgtttcccaggcgcttcttgtttgtagtttgtaaccactgtttcatctctaacaacacaaatactctctccgtttcaaaatatttaataccgttgactttttagcatatgtttgaccgttcgtcttattaaaaaatttatgaaatatgtaaaaccatatgtgtatatgaaagtatatttaacaatgaatcaaatgatatgaaaagaataaataattatttaaattttttgaataagatgaatggtcaaacattttaaaattttgaaaccgagggagtacttcactatcgtttgtttcctgaaactcgtggtaggtagtgatgaaggaaacgatcgagtccttgtggatgaatcgacgtcacgtgaagcaagccaaccagccatggagagacaaacgtgagccacagtggatatgctgggatgacgtcactcatactcaccgggaatgggcggcgccgccgcgacgacgtcgggcaggtcgaagttgacgccgtcccggatggtgcggacccgccgcatgatcatctccaggcacgcgccggagctgcctcccacgtccaccagcgtgctcaccccctcgaacccgccgtcgccgtagccctccagcagcgcctccatgaacggctccgacacccccgtcatcgcccggagcatcacctcgttcgcctccctgcaattgcaagtccgaatccgatggagattagattggagaggaagcagctagcagattataattaattggttgatctaattctaatctacctgtccttgccgtagtaggcgtaggcggggacgccggcgttggcgcgggcgaagggctcggggccggaggggtcgaggacggcctcgtggaggaggggccaggcgcggacgagcgcatcctggtggtgctgcagaacgtagtcggcgtaggacgcgccggagccggaggggctaccgccgccgccggggacgagggtgcggccgacggcggtgagcgagaagcggcgcggggagggggaggatgatccggtgtgctcggagaagacgccgcgggaggcgaggaggcggaggaggcgctcgaggacggaggggtccgggtggcccgcggggaggaggtcggcggcggcgagcggggcgttggcgcctcccgcccagagcttggcggggacgccgaggcggatgacggcggtgagcgccatggggacggagatcatgttggcgagctccatcatcgccagcctggcctccgccggggacagttcgccgtctcctccgccgcccattttccaaactcttactcactcagatgtgatgaatctcaagtcaacactactcaactcaactgacgagacgagacaactgctgcggttgagttgtttccttcttctatctatctatatactgtatatgtactcgctgacatgtgggcccagattctatcgttggccaagatcgaatgccacatgggctctagcgataattggtcaacaattcaaatctttgtttaaatttcttttcaatgcgatgggttctttttgggtcctgatggttagataagctcgattaccgtgtataaccagcagcaaggagaaccggcaaatctcctctctcctctggttggttccagcttgcttaaaaaatagtagcgcgagatcggatggtgcatgctaccggggactaatgcgtaattagctgaaagcgcgaggaatgctttgcaaaacgtcgctgacgccacggggtttagagaggttaatacgacgttacattcttttactactccctcactctctaaatatttatcatcgttgacttttttttaaatatatttgaccgtttattttatttacaacctagactagggataagttcatgttttcacttaacaccatatatgttgacaagctttttcactttggactggagtgaagggtttgagctgccaccgtggctctgtccatggcatgcaatgcaagcaggaggtggtggactccactcgtctccacctccgttctgcattgccatcttccctgggatcgatctagtaaatcgacagttctaattaattaaaaagtctacagtaaaaataatgtcaagcaactctgtggtcaacattagtcactagggcggcggtagacaggtcatcgaaaccctcaccggcttcatcaggcagtgtgactttgtcagtttcatcaatggagaacatctcgcatgatgctaggattgaaaagaggacggagtcacgggtactttatttatggtttcttagggagattgttaattttgggttaaacttgattgattttgtgcaaatttagctactgctccgttgcgattgctgcgttagttattggtataagtgaagtaatttatgtgcacttggagaagcaacatagcagtctaaaccattgacctggtgcaaaatgcaaaagcttgcaaatatatatggtgttaagtgaaaacatagttatatctctagtccatgttgcaattattttcctatcatttgatttattgttaaatatacttttatgtatacatatagttttatatattttataaaagtgtttaaataagacgaacgatcacatgtgctaaaaagtaaacggcatcaaatatttaaagaaaaagggagtacattttagttacttttagctaaaaaataattttttgactagttatttattagggaaaagcgtgataccacaaatatagtaaatatagctgctcccattggttttgacatgcacgcacattacacgtgtgcaggcaccgcgcaatgccaatgcaccacgcgtgtcaaaccaagcaacaccccagccgacaatctgcatcacctcctttttagataataataacccgaataacctaatctattctatactggctacacacaccactatcgtcagcatcagaacacggctgacccgcaaccgcaaggcatgggcttcttggaagaagaaagatcatgataataatgcaatagttcagtcaaaagaggtgggattagattaataatctatatgagtaactgccagtgtctcttctgttcagttcagttcaggacataaatacagggaaagaacttacaatgggcagccgctctctttttactccagtcctacccatcgcaaactctttccaacaatcaattaacacgccctttgctgctcgcgctgcggccaacagcaaggcaacaaatatgtaaacctgtagtagatcgatagatacacaagaagaagacgagagaggacagacaaaaatggaagaagaaaaagaatgaagaagaagcagcagcagagctcttgtttcccctttttcctgaacaaagcttcgtgcagcaaaacttcgctttttccatcagttttattcccttccctactgtatttccacaactttacattactgaatatgcccgaaccacctccgcgatcggcgctcggcatagtgggcatttgccaccactgcgaattagctcgtttgcacattttgagcaagtacacatgtgcccgcatctgtcaccatcaccaaatgggttttacaagtacatcagacaaaaaaggttagagattagtaacatcaaagtatcagacatgtttagctgtgaagctgacctgtataatagagaatcaatttgcgcatcgcagcatacgcagcaggttcccttcctcacttgatcccattttgatccatcgtcagatagatccgtcggataccctgaaaaataaaagggacaggttgtttcagtgatttctgtacatacagagtttcagcgaaattactgtatgacaaaaataagaaacacgcaactaactgacaacatgcacaatgtctattaatagcataattaccggaaataaaacttaaactacgtaaagtgcataacaacataataaggaaattcaggtattgtccctatcagctgtagttaggtgtgccgtgtcctctgtgttagcaaagacagttatatgatgcacagatatctcagtatgcaacaaggagcaatggagtacaaccttcaggtcctgcaaagcgattcaaggccgccgacacttcttgtctcactgagcgttggagttcaagttgcatgtccatgcacgcctccagcatcctctgtatgctgctcatcccttgttgaagtctacccatgtcagctttcaaatcattaatagcatcccattcctgcaaggatgcaaagctgaataaatcctccaagatgaaactctaaatgagcatacagggcacaacttaattcaagcaaaaggaactaattaaaagtcacttataaatttcacggttctgacatctcatgggtcatggacccatggcagctggcacatttaggaaaaaggagtatgaaggaaaaacaaattctaaagacgctacagatcatgaatcattgcatgatattaacaatgtgtgtacagaaaacagatttgcaaagcatggtattgaaatagcacagataaagaaacaactattatgcaatagctccaaaaatttaatgaagagataatgcacgggatctctgtgatgtaccctgtgtctagtgctgcagttgttatgacgcaatttttttgggccttagtggctgtcggggtggcaaaggtgggggagggataacaagcgcaggtctgttaacaggagcttggaattgccgagtttcagcattcctctcttgttcctgattttcgtttggtgaattcacagatggaatagctgcatcgagattccaattgaggggtccacgaccacgtctttgaacatatgaccttattaatcgctccaaactttcaccaaaaccattactaagaagattggatacacttcgcctgaaagtacaaacgtggtcattgatcagaataagaacagatttaatatcaataaaagaatatgtttggaagaaattctagtactgaaggtcaatatacctgctaagcaattctctcagttccatgctgtacacattgtcatcatctggcgggatgaatctattttcagttctaggaatggggcccatgtcaagtggagaatcttggaaatcatcttgccagttctcagtaccatgagactcgtcatcatgccattcatcatgctcatcttgaagatgatcatgctccctggcatcatcctccatagtttcactgtgtagttcctctgcattatcttcccaatttctttcagcatcctctgcagtttcattgggccacctatcaagtgagtcgtccagagatggctgccaaaatcttgcatcccgtcctgcctcatcttgcagcctattgtcaacttgagtttcatgcatctcaaccatgttatccaaagctacacttggtgactctatggcagcattttctgcatctgcctcctgtaaacccacatcctcaagcataatttgggtcgtattctcagtaccagtgagggccctgacctcagccccttgttgaggttcgtcactacctagtactccaacactttcagccacagaagaatcaaaccggctaacatcttcactacttacagcactctctgatctgaaataagcatgttgagccatttgtcattagctggatgcaatatcataaaccctatagatattccttacgtgcaaagaactcaaaaaagacaatggcaagaggcatgcattctttggcagtttgctgtcatcagtttatctgatgctgcattaagcctaaccggcagtgcacaagaacatacttcccatttttcatgttgcatggcattgtgaatttttcacagcatcaggtgcaactctgaccattgatggacagtgttatgttagccaaataatacataactatacttcagtagaagcaattctggttctaatatttcaaaaagtgagtggacttgcacttcacgtattagtagaaagaattaaagttgcatggtatggcaaccaagaataaatgtgtccttcattgtgcttaacttatgtaccacatgcaccatgagtgcatgacacagtttgaagtttggcatttgaaactttagattttactctcgttccatctactatggtatgaccatactaattactggtcatgagaagttctaaaaatcaccacaatatacacatcaaatgaaagtgctgatgttgctccttttacaaactactctaaatcataaaagatgtaatcattcaatgcagcagtaaaaaattccatggctagtataccgttaaagataatggttatatcatattgaaatgttgtcagtaacatgaataaaaggagcacttaagcaacaggagatcactaaaacagcaccactgatgaaacctactaagcagttggggtaccagctaatagatggtaccaccatctactaggacggctcttagaagaagatatagagaggccggattcaattcaggggccctaacttccatagtgtgctactagtcaacatcatcaatatatttcatagtaccatttaggacaaattggttggtgaacagtccctaacgtgtagagcaagactgacaagttaaggtagggaccagtataattagtagaactggaacctgaaaccttgcctgtatacttgctgtgatgaaaatactcatttgatgctctagttttaaaagtagtttcagtccttcagattacagtgcttctgtaggaattaagtataaaagaagttttagcttgacgatagtacaaaatcctgcataaatcataaaaaaaaaacaatgtcctgctaaaccatatcttgcacagagcttctcctcaatgtactgaaatggtctgatcatctacttgaacaggattcataattcagatggaagtttccttctaaacaacttctaccacaactatggtttacaacttacaagtacctgcttctaactgtttagcattgggacacccattccatactaaacgtaacggtcacatatgtgactgatactcatctgccaggcaggattggcagtagaaactaaaagaaccaacagatgcacccaactctaaagccctcaatccaagaatgcacaatcaccttaacgcttcttctgaaataataatccttccaacaaaggaaacctatatattctaggcattcacaggtaattaccaatagaaattacttgacaattgacacaactagggatcaacatgtagataatatcagaaagataatatcagaaagtttccctttttaaaatttagaaaaaaaaaatcccaaattaggtcaattatgttattaatcacaatggaagtggaaggtggaattttatgctcatatgccccaaacagacaattgtacatcaccacagctcaatagaaggaagagcaatggattaaacgagtaatgtggcagtgggctcataatgtaccacacaaaaacaccatacaatactaaggggaccacaaaaacaaatgaggctgtgcaagtggggtcgtaagctacataagagagtagcaagtagcaagcgagtctaccaattatccaagaaccagacgatttgtcagaatagtataaataatgcagcgctttctacgccaacattctttgatagatgttagtggaaaagatacaaccagaaaaatccatttgcactgaaaggatacaacgaaaatcccggaaatgctcgcattcatgtaagagatataccaatcaatatatagctacaattacaagagaaagttggaactggaatgcctgctaacctcaaagtggacacacgatggctctgcctcaactgcccgagctccctcgccgccacggatggtggtcgttcctcctcctcaactggaagaaccacgttcctcaagaacctccccctaagcaatccctgtaaagcaacacatatctcagagcaccgtcgtcggcattacagatgaccgattcctgcaatgcaatgcaaagaccaacctggatgcggttgcggctgcggtgagggaactcggacacaatgtgataccctgatatcccctggagctcgcgttggcgctctcgggccatccgagtgatgacatcgagacgcgcttgtcggccacggaggcgaggaggctcccctcgcctctccctctcgccagcggctgtgtcgtccctgcgcgaggcgacgcgggagtcgcgaggctggctggccatctgcacccactccctgacgagcctgaccctctgcctctccgtctcgccgagccactccccggtggtggcggcagcggcggcggcggtggggacgtcggtgttggcggtgaggcggcgggcgatctggcgcacgcgctcgcggtcggcggtgtcgggggagggctcgcggtcgaagggctggtcggcgtcggatcggcggtgctcgagctcgcgccacatctggaggagggaagggggcgcggtcggggagggtgcctgggggcgcggcggcggcgcggtgggcgaggagaggaggaaggaggaggggtcgagggtggagacggggtggaggcgtgcgagcgcgaggagctcggcctcccggttgcgtcgctcgacctcgcgctccatggaggagagcacctcctcggcctggcgcgcgacccaccggctgaggaggcgcgactcccgcctccgcctccgcgcggcagacgactcgggctcctcgtcgggctggtgccccgcggcgacccctccccccgccgcggagcacgacgacgaggacgacgtcggggagaagcatcccccgaggtggtcgcagacgaggtcctcgaggtcccggcggaaatcggcggcggcgcccatgcggtggtggtactcgtccatgggattgggattaggattaggattaggattaggattaatgcggggggattggattgggattggggattagggcaggattgcgattgcgaatgcgaggaagaagcatttggggaagaagagaagagaagagagaggaaggggattaattgttggatagaaagattggatggcgcgagaggaatgggagacgcaagtcacggagaaaaagaaccaaagcagcaattacaataggaggccggaggaagacgaagaggagcaacaaggaagatgaagaagaagaagcggcgatttatggatttcccccctctttttttctccctttttcttcctagcttgttttagttgagggagagagaaagaagaacggatagccaagggcaggtggtggcgtcgctctctctttttttttcttctttttttctgttacggccacacaacgcagcggccaattcaattgtactacgtagtataattatcattaacaaattatactaagatttaaaagaaactctatgaaactactacttctagtttgtaatttgttcacagcatttcaaaaatcgtatggtagttttcttatgatggcgtgtattcccaagaaatacaagccccggggcccacttccagtggctccagataattcggccaaacgtggcgctgtgctttcgttttgctttccgcggcagatatggccaacggcggggctcacaacgacacgtggatttgtcttttcctctcctcatatcatactcccgtgccaatttacaacactacttatttccttccaaacatattatttttattattacaatattttatataaggaggaccatatttctttttgtttttttgtctccccagaaaattctagagttctttccacttctacttactttgtttttcccttaggaaacagcatgatgtaatggtacttaaaaaaagagagagagtaggagcggatccaacatgggtacaaggaggacttagagttttctctcacccaccgaacctatggataccccctgagtcccccctttcattttttcgtcatggttgataagatagaatgtactaaagatctcctaatagcattttagcatagtttaacaccgagattatgtgtttatgtcggtgtactcggtatattgagtcccccaattttttttcctgatccgccccctaagagagagagagagtgagtggttattctaaataccaaaatggttaagttctaagatcgaaggttgtctacaagaggaagataaaggctgttctttcactcctactcaaaagactttatggatgagttgaaatggccattttcagctcttggtgcagcctcttgcatttatttttttctatactgatttcagacttcttaaaaagtttttcttcagctgcaaaatcttttatttcttcatttttaatcgaggaagcatgtgctacgtactctctagcatttaatccatgttcttttcaacataatggaaaggattcctaaaaaataataaaaatatattacacataatgtgtcggattttagcaggtatatactggtacaataattcagctcatatcgatgtcatttattctgttccttctgttcgtgagtatttttcatggccagaaagataatcctatttatgcacacatgagcagcagatgaacaggactaagttttctcaaattgcagattacaatttgtaaaaaaaatgtgataacagtggagccatatatgattcagaagctataattcatttaccagatcatcagagatttgcccttttgcgaaaaaataaataaaatgtgatgcactgttgttatcagaaaagcggtgtcatttatgatatctgtcacacttgaacagcagttttcgtcctaattattgagagagtatatatcaaactatattatgcaacagtgatgacgatgtgcttcctccaattgcatagtgcatact

SEQ ID NO: 62916 - DNA, 25878 bp, Oryza sativa
ctgatgagtagtgaattttttttcatttttaaatttttttcttttaatatttacgaaaataatctatcggcacaaaaaattacaaaaatagaccctgccgccctaatggaggggcaagctgacgtggcagacgatgtcgaaatttgcatttagccccttgccgagcggcaaggggctaaatgcatttttcgcagccctaaagagcatttggctcgtacttttttttcatctgagtcccttgccaccctactagagagcggcaagggacccaaatgcaaaaagtaccagccaaaaagtactaggcctgggctggcttttttgcatggaggccccttgccgccctaacaaaaaaaaccctccctctcccgtctgtcatcaccgcccgtccctcccccgtttaccacgtcagcttgccgctctagtggagggcgggagggtctatttttgtaattttttttttttgccgatggattatttctgtaaatattaaaagaaaaaaatttaaaaatgaaaaaaattcgatgagtagtagggcttctctctgggcttctttcgggcctgaacgcttaaagcccgaaaccaatagtgggcctttttaactctcgcggagttggccagtaacctgttgatgggctggaccttggcgctgacgagaatggcccatactgtcttcggcctagcccatagcactttcagaccaaaaaaaggaagactaggggcaaatccaaatgcccccttaattcactggtgtttctatattttcccttaccactcaaattcatgcacaaaactcaatccaggtcaatttctcttctagctttcccctgatatcccgttttcatatattttccctagttatttcagtttctagtgtcccatagacctccatcttttcgagttgaaaactggatatggcagaagtttgaagaaaatttgactcatatgagtaggggaagtagaaatgcaagtgatttctaaggggtatttggattaggtccacctgagaagcagagtagagctgaaattttgattgcccatttgttgatcagccacgatcaattcttcaattctgaaattaaattttagggttcatttcgattatattctatcgtgatcgatctatcacttttaatttttaaactaccaatagcacatgtataagagttttatccatatgttttttttatcaaacctatccaatctaaggctccatttgaacacttgtttagcttttgcagctcctcatttactgtgagtatgtttcctaatctgttaaacgacatgttctttgcaaaagctttttatatattttttaatttataatagttaatacctgatcgatcatatagtaattaatattatttctcgtttcgcatgcggaaaaaaaacaaaaactaaacgtggtttcaaacagagagcaagcagccaagcatgcacgtagcttggtggttgatcgatctgaaattgtgaatggggtacagtaataaacctgatgataaatgtggtgtgtgcttgtatctgaaaaaagtgaagaaggcccggtgacatgaaaaatgatgggacagacagaactaagatgcatgatcgatggaaatgtgaaactgatccattattattccagccgagatctatcgcatgcaattgtagaccactttatcaaattattaccgacagttagctcttcacagtcttcatgtgcatgcattgctgttcattatctaaaacaaaaatgtgcatgtcgcgttgagttgatcgatcacagtacaatatgcatgcattacgcatgcttaatttgcctgccttatgcatgcatgcgctgtttaacttttttatgatcttctttttctctgatccgtgtgctaatcgatacagtgtatgacatttgtcgtttgtaaaacgcacgtggtttatctttgtactgatctgttgggtttttatcgttttgaagagaaataaaacatagccgaatgtactcgctccgtccaactaagaggcaaaaaaaaattgaattctagtaaaaggtcccccccaaaaaaaaaagaaaagaaaagaaaaaacggtacgatgttatattatattactaccacaaagatgcaatatacagtaccggctggagtagtagtaagaaactatgggttgaactcttagtgactagtgagtcaaattttaaactctagaattgtaaatctttttcaaatggagaaagtatatgagaatgtttagataagattctaacatgttgagttgtgatccaaattcatttgcacttaataaaggccagcttctgccgtagtggagcggaggcccgtcgccgggaggcttgggcccatcccttttggggttccaccatatatatacctcttgtaagccgccgtgcggcgatgtaacctcacctcagatatagtaaagatattttactggctggcgcccgtggttttttctctcctgttttgggagggttttccacgttaaatctcgtgtcttctatgattgatctattgttttttatcgtttgttcgcttatcgtttcctaacataacatatgtatagctgctccaaataattcaacttatcgtttcgattcaaagaagttaattgtagagttttaaaaaataaagtaaaagttaaaagctaattttctattaaatgcttatcaaaatataattaaagttttcccgaactgaccgtatattagccacggacaacatggcagccgacaaactattattaatgtgatcattgcatatatatatatatatatatatatatatatatatatatatatatatatttcaaaataattaatctcaatgttatattaaaagaaaagtaaagggaaagggaaaggggcaatataatagaggcggtcaagctaattaaggtcggtagggaggaccaagttaagtgatgatcaccacgtgtcaacgctgaccgcgtccatgtcaaaatcatccgctcaccactagtagaaccactagtagtggatcgatcgcttcattcagatagccagccgcccaggccaagttccactttaatttcatccgtttttagtcatgcatggccatggaaaatatatagcttgcgtactccctttaatttgttacgtggaatatatatatatacctactagagaaatatgacacatcacaatttaaacatgttagtacacacatcacagtactataaatttaaacattgtagtacgagatatgatatatcctaataatataaatctaaacatacatcttgaatatgtatttctaagatgtatcacatatcatacgtattaggtttatttttatgggatagagggagtatacatattagaatacgtacgtggattatattatatgatggggaagattgattttttttttaacttttgtgttggacgttttaaaaaagaagagtagttttattgggatcatcagccacgtttgttttaaatactgactcaaaacaatatctttctgaaggcctgtttagttccccaaaattttttctcaaaaacatcacatcaaatctttggatacatgcatgaagcattaaatatagataaaaagaaaaactaactgcacagttatggggaaaatcgcgagacgaatcttttaagcctaattagtccgtgattagccataagtgctacagtaacccacatatgctaatgacggcttaattagtctcaaaagattcgtctcgcggtttccaggcgagtactaaaattagttttttcactcgtatccgaaaaccccttccaacatccggtcaaacatccgatgtgacacccaaacattttcatttcctcacctaaacacaccctgattatacctcctgaggaggaccatatatgcggccatagaataatttatatagagtacttccaagcactttgtcattttgctactagctaactaaaatatactatactcccatattttgggcacgcgacccatatgcatgcacacgagtgcatacaattctgtgttttatttaacttttggtcaactagccgcaactccataaattcggtctgaaatagtagcgcgtatatatgatcgtcttcaacatacaatatataattaccccaaaaagattgatctataccaaaagattgaaaaaaaaaacactagaagctgatatctgtgacgagcgcaagcatggccgttagggtgacacgagtgatcgatcgatcgagtcatcgagagactgagcatgcacgcatgggaaatgtttaatttaaactgtatagtaggcagctcaaaaaatccataaaaattaaaaaaaatacagaaaaaaatacatatgcaggctattcgtactaggattgttggacttgagttgccggccaagttttggaggcgccgcaaatctcagaagtatgaattgaaagctgctgcctaccaggctacacagttcttgcgctgcctctttcacatgagctatcttaattaattattcgtcgctacagtctctgcctccaatttcatctagaagtacgttgctgtcctaattaacatatactgtacgtatataattatatgtgcaatactactccgtccacgattgactagtactgattgacatcatgaaaaagatcatttgtgtcatatgttaatatgcatcatgcccccttcaattcaacaccatatcatcttaatgactttctcggatttaatgcatgacactccattcttccacacaagattggctacatgggcatcgagaaatgtaaatattaatgaatcgcttatttacgaggaatgactattagtatgtttaaatagttgataagtagaattacttatccttggtctgtgtgccaagataaaatatgactatcaaaaatagatggaaggagtatatatcataatgatgagaaatctcgatcggtacaaaacggggaacacatgcatggagatatatctagaccaacaagtacgtacagaaataaacttctgtcgaggatgtacttgaacatgaatgtttgcttgatattgttatttagctatattttagaatactttacaaatggagggatgaattgcaagtacaccctctaatttaaattagattaaattaaacacatggtgaaataggaatagttaggaagctaggcagccgtaaattaacctaaaatgtacatattgatagaagcaaggcatagtcatttatgcgtaaaggtaggcaccgacgactacagtagacgaaattttgggggtggacggagagttaattatttttccgttatatatttggtacatatataggtaattaattatgtggcggtttatataaataaataaataaataaagggagatgcatgcagtatgaaataggcaaagggaggcgaggagaaatacggcatgcatgttgaccggaaggcatacacatacatatgcagaaaaaggaaggacggaaaagaaaagatgcatggcggaaagggaaaggcccgacgaatgggaggaatcatatattccatcgattagagcaagtttaatagtaagttcaatatcaactatcgaatcaacatatataagtacagtagttgtaaggttatttttaatttttcttctcctctctttttctctcactaatgtatttatattagagcagctaataattaattgttgttgcatgagagccaacacgtacgttttcttttatatattttttcttttacataataagtttatagtgtgcttatactacctcattgtattatgtttgctcttaattaaggcattaattaaggtggacggagaatcggaatggattgatgcgatgcctccactgggggaacctccctcttctctggatgcttttgctgtgccggcgccgcgtggttcttcgtttcgtttgtctcgccatctcttaattccttacgttgaccattatttaagcctcaaaatcatctgtagcttagcttgttcaaggaggccgcgtcccgcgtgcgtgcgtctgtcgcggtcgcggtcgatgccatgctatgctagcatcacctgtcaagcacgcacgcatgcagttgatccagtcaaaccccacaatctcctcaggcctcagctctccatccatctatatatacattaacaccacaacaccccttcccgctcataccatccatccaaccatcgatcgatcacttccaacttattttctttaagagaaacaacaagcttaagctagctagttagtcatcttgttaattttggcctcaaataggtctagaattcatcaagaacacgagctagctagctgcactgtctcgctatatatatatatacactgctcatatggagctagtggtgcaggctttggcggccgcagctgccctcctcgccgtcttcttcctctccaccttatacctctcgccggcggccaccgcgcgccgcctccgcaacgccggcttccgcggcccgaccccttccttcccgcttgggaacctccgcgagatcgcctcctcgctcgcctccaacaacgacaccgacgaatccaacaccaagggcggcgacatccacgccgccgtgttcccctacttcgcgcggtggcggcgggcgttcggcaaggtgttcgtctactggctcggcacggagccgttcctgtacgtcgccgaccctgagttcctcaaggccgccaccgccggcgccctcggcaagctctggggcaagcccgacgtgttccgccgcgaccgcatgcccatgttcgggaggggcctcgtcatggcggagggcgacgagtgggctcgccaccgccacatcatcgccccggccttctccgccaccaacctcaacgacatgatcggcgtgatggaggagacgacggcgaagatgctgggcgagtggggcgacatggtggcgtcggggcggagctgcgtcgacgtcgagaagggcgtggtccggaacgccgccgagatcatcgccagggccagcttcggcatctccgccgacgacgacgacgccaccggcgccagggtgttccacaagctgcaggccatgcaggcgattctgttccgctccacccgcctcgtcggcgtgccgctcgccggcctcctccacatccgcgccacctacgaggcgtggaagctggggcgggagatcgacgcgctcctgctcgacatcatcgagtcgcggcggcgccgagaaggcggcggcggcgggaagaagaagaagaagacgacgtcgaacgacctgctgtcgctgctgctggccgggagcgaggcgagcgcgggggcggagaggaagctgacgacgcgggagctggtggacgagtgcaagacgttcttcttcggcgggcacgagacgacggcgctggcgctgtcgtggacgctgctgatgctggcggcgcacccggagtggcaggcggcggtgcgggaggaggtggtggaggtggccggccggtctggccccctcgacgcggcggcgctggggaaactcaccaagatggggtgcgtgctgagcgaggtgctccggctgtacccgccgtcgccgaacgtgcagaggcaggcgctgcaggacgtcgtggtggtcgccggcgacggcgagaagaaggtggtgatcccgaaggggacgaacatgtggatcgacgtggtggcgatgcaccgggacggcgagctgtggggggaggaggcgagcgagttcaggccggagaggttcatgagggagggggtgcagggagggtgccggcaccggatggggtacgtgccgttcggtttcggggggaggatctgcgtggggcgaaacctgacggcgatggagctccgggtggtgctggccatggtgctccgccgcttcgccgtcgaggtggcgccggagtaccgccacgcgcccaggatcatgctctccctccgtccatcccatggcatccaactccgcctcacccccctatgctagctaattaatcatattattcatagttaatcactcaattatgttttgtttgtgcatgcatgcatgcaaaggcaaagcaatgcatctgcatgcgtgcgtgcgtacgtacgtatactggtgaccagtatacatgtagtcgtatatacactaataccatgcatgaattaatactagctaaagcttgatgctttaagctttaagctgagctgtgtcatatgaatgaataattgaattgaatcgatctgccggatggttattaacttattactgctctctctgtttcatatttgacttttttttctaaattcaaattgaactaagtttatccaaaaacaaagtaattaatgttttgaatgccgaacaaatatattatcaaaatatatttattgttaaatttaatgaaattaatttaatgttataagagttgttatattttttctataaactcagttaaacacttacagaagtttgattttttttaaaaaaaatcagagtatcttacgatataaaagggatggagtactatgtccatgtttaaatatatttacgacgctgctaattttatatatgtggtttctatgtgcagctttgacaataattttctctaataaattactaaagtatcaactgtggatcggaagtaattataaaagaagaatcacctatatgatttttatgtttcaaatttgaatatatattttaagaactattgatagtcaaaatttaaagagtttgattaaataaaaattatcattgtgtgcataatacgtaataggtgcaaaaatgcatgtgtgtacgcagaacggccgatgatacatatctcaatcgatatggcacatggtcatatatatgtatacatggccacgacgacattcataaattaatatatacacgtgtggttatagtaactaattaacttggtgcttagcagctagcacgcactataactagctattagctagctgatgtacgtacatctcgatccataaactatgcgtgtttgcattttggtattacgtgttaatttggcggtgttggtgcgttagtaaccaccacaaatttgaccatgaacaggctgcccaaaaacggaaagaaaattcgatccgtactacgtacggtccaaacgaaacgggacttatatattgtgaatgctagctggctacctgggcgatcgatgacttcatcagtaatgaagtactagtactactcctacatactaatacattactaaccacttcttctgatttttaatgttttgactttagttgaatttaattcagacatatgtttgtcatatcacaacaaaataaaaatgttcaaatgcatattaaaaaaaacaacggagtcaaaccggagaaaagataaatatatagtctaatgtatattcaaaaatcaacggagttgagcatcagtacaactggatggagtatcttaagctagtggtgtttagttttcttcattgttttcttatgccgctgcttcctagtaacttcaaaaatcaactaatctgttccacgcgtgcctatgcatgccatctcaagaattagctaatgtcaaattagtctttgatcaagcagagagatgcatgactggctgagtgagcaagcatgctggttggacgtacgcatgttgttgcctagacttctggaaatgattcttggatgcatgataattaagagaaactttaagttgaaaaggtacttttattattccaaaaaaaaggtacttttaagtagaagaggttaactttcatagcaacttgcagctgcgtgtggtgtggatgccgggtcaaatgtacgttcatctaactagctacatacccggcttgcttccgtgttagaaaagaaaacggatggatgtccacccgggagattagaatctatcttcaacgaataatgtagaaatgtcatccaaacaaaaaaaattccacctcatctgttcttgttgagaatggttatatgtactgtgctggagttttaaaactgttagatcatctgaactttcattccatctctattttgtttctggaggaaaaatggtggcttgaaaaaaaatgaaacggaatttttgaaatatgttatcatcatctcaattagatgaggtaaaaaaaatgggatgaggtggagggaaaaaaatgtataaatagagtgaaacaaaattaaaaaaagagaagagaaaaacaaatgtaaaaatagattgagataagaaaattgaaaaatagatgaggtaaaaatgtaaaaaatatattgaaataaaaaaatttagattgaaacaaaattaaaaaaagggaagggcccatccgggttcgaaccggagacctattgatctgcagtcaattgctctaccactgagctatggacccttgtatggtcagttgttggatagtaactacatatttaaggaaaaatggggccagccacatcagacacaagtgtggtggttggtgtggacgcctcgccgccgttgtgcaagagagtacggccgccgcatcttttccttccatctttctggtgttctccacacagctagtgtcatattatcattttatttcgcatgcagctgctcattttagtactagagccgagtttagatcaaactttcaaacttccaacttttctatcacattaaaattttcctgcacatacaaacttctaacttttccgtcatatcgtttcaattttaactaaactttcaattttgacgttaactaaacacaccctaggaaacgactctcaccatcctatccccttctgccagctgaaaagagagaaggaagaacacaaactaagctaactacccaatccatcctaagacgtaaacatttaaaatatgtgacattgtatagcgagaggttataattgattaagaagagaaaatagatagaaaaatcaaataggggatagttgtgagttgtaactagttcagatgaaagggataggttaagaaataccttacattttagagaaaaaaaagtttcaaaaataactatattttggaatggaaagaatagtttacaccatgcaccaatcatgcatctgctaaaggaacttgcggcctcatcttttcacttatacttatgcttatcagtcaaaatttgaaatttcaatcttaaattttaagttgattttaaggttttttcatcgaagtttatttttcagcctttgcttttacatagataagagtacgtatataaaatttttgttcactttttttttttgtaaatataccgtttcgcgatgggtctgatgatatatccaaagtatgtatagcctatatccaatccaacacgaggtcggtcggtcggtcggtccggtggtcacatagtgcggcaccggcagcagcattacaatctctctcgtgtctcgtgcatccagttgacaaacgcaagaacaggccagccaaactaattgactctttatcacctctatctttcactgtttacttgtaatagaatgtacttgaacttgacattgccgtcctcccttgtgtttagttagtacagaggaggcatagatagatagcattggcttgacagactgcgattgatgtgtgtccattattcttcatttcttctaccttgacaactgcttgacagttgacaaaacattgctccttgctccttgcttccatttgtcggatgatcagatcactgcatcccatggttttcaacccaaccaccgtgttcctttctttcggagcccacaggaacaagcaacctccctgcttctcttcagatgcattccttttgtcttctaaccaacacgagctccagtacctaagatatactccgtcccaaaaaaaaaaaaaaagtcaaaccctaggtatgaatctggacatgatatccagggtttgccttttttttggaacggaggaagtagtatataactagtactctctcgattttgcttgcaatgtttgactattcgtcttatttaaattttttttacaaatatacaaaacaaaaagttgttcttaaaatactttggataataaagtaaaccacaaagaaaataaataataattctaaaattttttgaataagacgaatggtcaaacagtgcaaccaaaaactcaaaatcccaggagtacatagtacaatgttttccatgataaagatgcatcatggctaaacaagtccataaacgccactgcaataccatgggctattcacctttcttttattttcttgagttgatgagctcactcaagtctgaactgatactacttttatagcatcttaaaaagctaaacttaagcagtgtagtagtgcaaattaaatggacgatcttcaggtaccaactcaataataaatccccaggttcttttttcttcctctatataatataatagggtacgatccggatccttcattctcatacaacaccgcagatgcagatgcagcagattcacagtacaccaccataacattcatattctaatacttagtatgtagaggagttcctaacatagcactgacatatacctcagcatccagcaacatcatttctcaaacaactctcttcctcttacacctacagcaagttagcgcatcgcgttgcattgcatgctaccaagcgcactcacggggattcggggaattccgtcagtcagagatagatatataggtggtgctccttccttccagcaataatacacattactcgcgaatagagttgatgtcgatgtttggagttcttgagtccatctgcctcatcaacccagccgaccatccacccatcgtatgatgcggcatgttgtgatctggcagtgccattgtgggggtctcctcctcaccgccaattggctcttcgttattctccgtctcttgctcagctttcgctttatttttctttgtcccaccatacatgaagctccccactatcacctatttcaaccaaaaaaaatataaaacaaaatgcgtaagaaccaaaccaaacagatatacacagaaaacagtgcataacctactcataactggttggttactttgatgggcaaaaaagctgatacagggtaacagacaagataagctgccatgtaccccttttattcagttcagataacagccaaaccatatgacaccaaaagaccgagattggttggataacatagcatatacaaacatgactacctgaacagttccagctgctgtcaggactccacctacactcccaccaataaccctgtggtcagggccacacagagctatgcagaggcctccactccgggttcgcgaaccaccttcctctatcaccaaatatgatccagacaggcacaggatttcaaatcgaccctgccaaaccaatggtaaacataagggcctataaagaattaagctaggcacaacaagacctacattgtaaactatgacctacattgcaagtttgaccatggatatggcaatctttgactgctaaaagaagttctctacaaagataactatggagcaaaagttcatctaaaagcagcatcaaagccttttactcaattgaggaactatggaaaatccaaaatgaatggagacaagttgattaccatttctaatgcagctcagcacatgcaataagtatgggtcaaaaagagggataagaggtttagtttaccattctgagtcaaaagcaggataaaggatcttttgctatacccaagagtgaaacatgaggacaaaagcatgaatatggaagtcccggctacaataatactaagaatcaaacaggcctacaagcagcgtacctcatatgtaaccacaccaccagagtttgaatcctgatgaagggttgctgtggatacagctcctgtcgctgagatgatgcacactgcccttgggccctgttgtgagaaggacattatcctggcagcaacatcctgcatgggataggaaagctatactcacagaacaacaaggcatatataacaacatgaaaaactgtttttcatttccagagactaacaaaaaagatcagatccactgtagttttggatcttaattagtttttttttttagaactcatgttaattagttggcatccatcagttatcaggcaaagaattgtagttcttgcataggactactatgagttaagaccactgactccaaaagatgaatcatcaacagctaaaaagtacacctttgtaggtttgcacaacacacagatgctagtgcagcctgagactaccaaatgatacttaactgtatatcccaactaccagttgtatactgatgggggaagccactacatgccaatgatagtgaagtgatttttttaatcaatagacaagagtttggtacatgtagcaggttaatgaagcatcatttattcaacaacgtcatcagtattagttattacaactgaaattattggaaatgtgttgcactcgcaatccaaaaaatagttttgacgacaatttgaggtactacattcaagctatcacgactcacataatcagaaaatcgttgcgttgaataataacagaaagttcaacaaaggttacaacagcatgattcttagctattagtatcctttgtataacttaacttacctctcctggtgaaataataatcacatgaggagtaaaacctgttccaacagaaccaagaaaccattttcctgaagaacacattacagcattttattagatagcaggaacacaaaaaaacccatttcacgcataaaagaaaagaagaggaacaaaagctagccatgcatagtcaatagaagtttctgatgttgattcaagtagtaaatcagattttaggagtacatatactagtattatcagtacacataccccaccaagttcccaacaacaccataatgagcgggcattgtgtttgcatgataacagccgtggcctccaaagacaatagtaggtaaaaaacaaccaactaagctggacaggataccattttcacatctgatccagatacccaatagcatatctaagcttaagttcatgatataagcaaggaaatacgtaacataaaaaggtggtcagaatgtttgcagatctaacaagcaatactatcgtgcaaaatgtaaggtagcatggaatcaagaagttgacaaaattcattcaacaatcggaaatcatctaccactagtttcttagtgcatttctgttaccatattaaactacccttgcattcgatcaatcattaccatataaacatacaacatgatcatgaaatttgctaggttgcaggatctcaccaagagaagccaactgctgcatctttccagacccaggtggccgccctcggccacgcttctctgtaagggcaccagaccccgaaccccccgatcctgcccccgacccaaaccctgagcctggtgtggtcaccattgtacccatcgccgaggtcgacgagtgaggcgtcgacgaagacggcgagagccccagcgtgaccgccccatcaggcttatacttcctcggcctcccccgcttcttcttcaccggctcatcctggccagcaccactcccctgatcccctttagcatccgcgctcatttcgacacccatgccaatgtccataccaccaccaccgccaccactgccgtgctgcgcgacaggggctgaggcatcaacatggtggtaaccctgcccaatgtgggaacccccaatgtgagggggctggaaagggtaccccgcagagactgcatcaagatgctgccgatatccaccgggcggcgggccgtggagcccggccgggtgcccggagcctcccggcacgccaatgccccggtgctgcacatagaaggaggagaagttggagcctgacgccactgtggactccctcccatccattcatggaatgggaagctgcgccacagaggaggaaggaggaggaactcacgcggccacccacaaccacaagcacaaccaaggtggcaactttccttcactattcgagattagattcctccgaaagctatcggaggcgaagcaaatggacgcaagaatatcaatctcggagagagatctcttctccaccgactcccgaacacaaaaaccgcagtttgtttgttttgttttttttctctcctcgagaaacgaggcgagatcagatcgagcagcgacgggagatctcgactctgaacaaggcggtgaaatctccaggcagcaaaagattggaaccaaacgcgagaaagagacgggcagaaaaaaaaacccgatctttcgcagggaaagaaggggcgaaaaggatgggatttgcgcgaggtcgagaagggatggatacacagagagatagagtctgcggcggcggaggcggcgacggcgggcggcggcgggatccgagaggcggtggaggggggagaggagtgatccaatcgaaatggcgatggatgggggaaatgggagatagctaaaaccctagcggagggggatcacaggagagaggagcccaagagaagagaagagaagagaggagaggagggagagagagagagagcaagcatgtatggtgaatgtctctatgtgttggaggagagagagtgttgtgtgtttgtgtgtgagggattctttgtggagccaatatggcagatctcatcaatgcaagtgatatgctgccttgtcctaggagtgtcctgaaatgatttgttgagtatcgtagtttggtcgaagagggctacgttagatatatgtatgtatattggatatggtgttcattaaattaggtggaatcggacaaaagttttattggccaagaaaatagtggatatcgtatttgtcggtttatgttattacgttgttttgtcctatcgtacggttagttcgaatcaatgtcaaaataaataatcacttgttcggtctccgttttttatgcaacgttaaggtagcgacaaaaacatcattaaaaccttccaagttgagattctctaagactcggagattgatgcctattgatttggtaagacagaggcaatgatatagtgattctttctattaagagcatcggctacaacattagctttatcagagcgatactggatacccaaattttagtctttgatgagccgttactttttttggcttggttttatgtttggttggttgataaaatatttcaaactttttatggctgatatggacttcacacttgttacgatcaaaagtgttagagcatgaactatggttgtcagctccaagtcatatgttggataattggctttatgtgatcgtaattgatgtgaagtataagcaaccgctttgctatcttacatcaacccacatacaatctcatggcgagatgcataaactcaaaattcatatattaacgggtatttcaagtgttacgagactttgtttttttaaaaaatgtcttataggatcaccaatggtagaatctcgtcaagttgccatctagaaatggaaagtgaaacaatatttgagtcgcaacaatcctctagcaagcttagttttagagtaccattaataccgattttatcaattttctcagatttaatgtaatgtctatgctcatattgcattatattccattgaaagtggttaaaatgaaatatgagaaagaaaaaaggtatcagtgcaaaattgtttctcactttttttagtacagtggatccgtggatgtgacggtctatgcaagagtagtgtgacgaaatatctgccacaaaggatcatggccttgaccgggtaaggagaaagagaccgagctctgctgacgcgtcagctaagtcgataataattgggtcgataaccccggtgtataggtgagcaatgccattatcatcgagagagtatttgcttacatttgttcaacaacacctgttcaatccagattttgatttgggacagtgaaaaatgctcaaactaaggaccgaaaatacaatcaaagatctttttctttttctgaaaaaagtggctacaattaaacagacagagcggtcggatatgatgaaatcgtcaatttctaagtatttggatttttctctgttttcttgggacggatccaaaagttttatttctcccaagaactgatcacgtcaccataacgttctcttgtgtacttgagagttcacaggggcaccaataattccaatggagtacagcttgatgctgtacatgtgccagggcagtttggacatcttgtcactacttccaagatttattttgtactagacaaatagcaacaagacgaagcactatatgttagtataatgctggagtaccaaacaagtctagcaaagtttttatctgtcctaattatacaaaggactgtctattccaacctgaaaacattcaataacatctaaaaaaactggtgaaaagttcttgtgtagagcaccatttgtcaacgatgatttgctggtcagacaagttgcataattgtcgagcaacaccaacaaaaggattcacacatgtgccaagtttgctgcagatgtagttgtttcatccaaatagcatgaaatagcaaaaaatctacttccaaatgcaacgatctcactttaatattttaaaagtgttcgagatgttaattccaggctctgccactacaaaggtactctacaaaccaacgtatagaaaagagtaacaagctccaactgagtagactgccaaggctagatggaatatggtcacttgaccagagcaaatgcactcatctgagcatagaacttgttctcttccatcaaaactatatcaacactggagcacagtttagcaatggaacacagattgtaggaagtaaaactccccagttacttgtcgacctccattgcttgcgcagctttggcttttgttaaggctgaaagttttgtcttcacctttttcttgccaaccttaaatttgccacccttccttttcacatcaccatctatctgaataaaaatgaaaagaaagcattaagaaggatgctgcaaacttttcttaaccacaaaaaaaaagaagaatgtagcagtttgctatgttcatatttatattcaagtaaaaacacaagaccaatcaacaggaagtgaaatttgaggagccagattgatcaaattattttttgagaaagcagtagggaatgtaatctcaaacaaggcctatataactgactgacccaaagtaaattatgagcagattaaacaagctctcgaagacaagcatatcctcatctaagattgtcatgtagttcaagcactatttctctagagtacttaaactggtgtgagcaaccaggtcacagcatatcagatggcaaatatatatattgtataccgaagatcatcaggaggtttaacgaataaaagagtcaacacctggtgcaaaaacaaaaggaacttgacaacacatgtttggaattgctaataggtaaacttcagaatatacgagtagatcgatgggaaataaaacccaagaagtacaaacagatcatataattggatagaactcatgagcaatcagcttgctcaaatacactctcaaacacaccacctacatttcactagcactaataactgtttgtgatagtaaaaaccagcggcttggaagcaattgagggtttgaagccataaaacagtaaaagactgaagctagtccataacctaaacagctgcatttaatttcagaaactgcctaatgagtaaaccagtgaggcataacaggactcctggaactgcttgggatctgtgagctcttgagatgtcttggaaaagaaagtggcacatgggaaatgaaatcgctcccagagcctcatgagaacgaactacactaaccatttcacatgcctcctgttatgtttctaaagggaagcaagcagggttacaccggtgttgagatttttggatacctgtgcctaacatccaattttgtggattcactgtaaactgacatatccttttctgtcacccctacaaaacaggctgatgacagcactgaacaaattgaaaagtatatgtggactaaagattcctgtaggtgctgtacaaacctcagtgggacagaagacagaaaaatcagacccagtctgtaataaatctttcaactagactcttattcagaattcaaatttcaaagtcctagcttacatcttccctaactctctgataattagcgaatgctggtcctggctatgcaatacagtggttagtttccacaagagcggtcaataggtcgtgtgaattatagcagagatacaactccaacaagcttatagccaccaacaataaggtaaaactagtttttggaaactaaactgcatgacatagcatactcaaacacgcatgctaatttaacagatgaagaccatccagtgttaccaatcaggagctgatcatactaactcagcaagagaggaactacacaacaaatgattcatccatagacagaaaaggagatgtagaagaggttgatagtaccttcatcttggatttcttggcctgcagcttcttggccagtttctccttcgcctccttttcccctgcacacacacacatacaagacagccaccataatcccaaatcagatgcctggttggtgaaatctacaaggagatgagaggaaaatcgacaagggagcagccggatgtatgatctatcggtggtactttggaggtcgaactcgtgctgcttcttccgcttggcgaggttgttcttcttcgacatcttcctcgccgccaaccgccgacgaagcacagcacagcacgcagcaacgaacaaaccctagccgcggcagagcctccatggagatgggagtccttttaactgggctggaattgggcctccactaattcggtcaaggcccaaactgtcgtaaagcaaagcccatcaaaggcccagttaaacagtcattagacctaacccggtgattagtggtcaaagctgtccgtcattacgagacggagacagtgacgtgaggggacacgtggctcgggccgaccactccgatcaatcatgccggacacgtggcgcgtggccaggtgccagcgtgtcattgcgcggccgcatcatttcgtttttaaatatatgttttggaacgaaatcattcgatttttaagcaccacctcacctcattacccgcgctttccgcccggcaattacaccaagaaaaggagcaaaaggaaaaaaaaagtctctttatcggaggcgtaacatctacttctgctgctgctggtaaatacactcttctctgagcttcctcaagcttctgaaaacagcaagagattaaattatcgtaattttaagcatccaaggtgtttggtgccagtgctcgaggactggagatggagacccaggaggcgaagagagcagatgtggcggcggcgccggcgacggcgaccggcggtgaggccgtcaaaccggccgccggcgatgctggcgcagtaaccaagacgagtaagattagtttcttcagcttagctttctctctttttttgctccaagtttcagtcctgcagcaactgtgacccattttgtagtgtttcagactgaagaaaatcttgtttagagttcattggtctgagaaaattgccatcagagttagtagttggaattagagtagttacttgctgcctttggtgctaatccttatagatgcagcagatggaccttcagcaccagcaggcaaagctgcaactccaacgggttcggttgacagaggtactacgtgcataattattcttcaagtttcagtcaagaaattgcaatctatggagtaaatggcagcaacaaatgaaattaacttgcagacgccatactcgcaaacgtggagctggagaggaaactgtcaatgatcaaggcgtgggaggagagcgagaagagcaaagcggagaacaagtaagataagatagcctgaactcaatcaagcactgtaataaattgcattcttgtcaatcctgtaaattatcatcgtgtcacatactcataaaaaatggcatgtttatcagggctcagaagaagatgtcatccatactctcatgggagaacacgaggaaggcagctatagaagcaaaactgcgaacacaagaggtctgaatcttcatatatctcttcttgtcaaagagatagtagttcatagttgcagcaatggctgtggcttcctgaactgactgactgactgacaatgtattccatgaattgcaggagaagctggagaggaagaaggcggagtacgcggagaagatgaggaaccaggtagcggcgatccacaaggcggcggaggagaagagggcgacggtggaggcgacgcggcacgaggagataatcaagtatgaggagatggccgccaagcacaggtccaaggggactacacccaccaaattcctctcttgtttcggctcctagaaccacaaaaaacgctcctgcagtgcagtctcctgtcctgtgtgctgatgcttctgtgtgttgatatggtgatcagtttgcagttttgggcttgtttctcttctttaatcttctgtgttgaagttccggatttcatggctctgtcatgctgctgctgtgttttccttttcgctgaagatgtgatcatcatgtttggtgagtgtaagcatactcaaaacacttgtaaacagtcagtcacatgtaaacataccaccttttttgtgaattttgcgcttccagagattaagaaaaaaagcgtgccaatttgttttgttggtgctttgtatcatgtatgtgcatatttgtattccatgacatgcaagcaacatgacaacatgtacttgttgaactcaagtacgggtaagtaacagttaggcacttgacagcagcagcaagtgtttgctgatgtgggaagcaaacatggaaggaccaaccaattactaatagtgaatgatttggaataagcactgcaatttgcaggtacaactgtaacaacaagtgcattcttgagttttcaacaagatgagcaatggaaatgaaagaaaaacaagcaacatcagaagcgctgcacaacagcgagttgttcttcatgcagttcattactgaagcagaatctcttatatacagctgagcaaaatttcctagaaccaaccaactactgatcatcaaaattcaagtagcacattcaccactcttgcacctgattctatatatgtactatgtatctactgagaataaacactagcacggcattaagccactaactatataaaaaggcatgtaatgtaaatatgtaagagctggactagttgttgatgcatgatgttaaatcttgttggcttgcagcactaatcactttccaggtaggtagctaactacatcaaccaacagtgaagtaaatcatccctatactgatcggtgaagtgatggtagtgaaggattttggtttgcaagtgcagcgaatcggcgagcgacggctgctcaggtagggggcagcgcgtcgtagaggtcgttgccgcggcgggagacgagggcgacggcgagcacgacgtcgatggcgaacacggtggcgaccgtcgcggcgaggatccagacgcgcaccttcccccagaaggcggcgcggcgcaggcggagggtggcggcattggggcggagctcggcggcggcggcctcgacgagcgcggcaacgaggcgcttggagcgggggctgaggccgcggccgccgcgcagctcggcgagcgcgaggctgatctggtccgggaggggctcctcctcctcctcatcgaccatagccgtagcctcggcgggcgctgtgacctgcacgatataatcacagctgtcgaattgtaaaatccaaattcgtagacgcactcgaatcgagcaaattctggaacagaaacatcatttccagttggaaacgacaagtggattcagaatcgaagcaaactgaacataaagggaaacacaaatgaatctgaaatgattggggagcagagaaactgtaatcacactggaatcaaatcgaagttaaaaaaaaaacgcccgatgccataaacccaaaccaaaacccagagcgtgagcatttcaaaatccaccacctcggtgagagcggagtcggcggaagcggtgatggcgtcatccgggtccggggcggcggagatgagggcggcggtggtggtggtggaggaggaggagtcggcggggtcggggaggtcgagcagcggcgcgaggtcgtcggggaaggtgaagtcgccgtcgtggaaggccaggcacttggcgaccccctggtggttggttgatcgaaagggagaggacaaggtttagcggtgggcgatcgaggaggaggtgaagggcggggaggtttggttaccttggagttggcggcggcggggatcggcggcctgggggtggaggaggagccgacggatggccgggcggaggcggaggaggagcggatggaggcggggcgcggggtgtgcacggcggcgggagacggcttcgccatggctcctctcctctccgttgctgcgcttctctctctttgtggctccttccctcatgaagaggagagaggagagggaggaggaaggcaacttgaattgggccgcttccatcatttgggcctcgcgagcgaacccaattcccagcccagcccaccttagagagaggagacagagacggagacaaatcggtggatggggcccaaaaccgtctcttcctcctccttcgccttcttctcccttggtttttccctcgtgacatcacggacaccagcggcgatccatcggcgatccaccgcgcgcgcttcgatcggcgaccgcctcaggtgagctccgcgctcctccctagctccacccccatggtattcccctcccttggccatgcctcgagagtcgagacgatccaagcggattcatccacgcgagtctcagattcagatggcctaatcgatccaccatcgcatcgcatcgcaatttcttctctcatctaactcttcttcttcttcttctctcctttgccagttagttagttaagtttccatggcggggaggcccagcatcccgaccaacagctccgctctcatcgccatcatcgccgacgaggtacgccaccccaacattagcttcatgtttgcgccccaatcataccacaactcctgaatagccccaatcataccatacctcctgaattgccgaatgcccactcttgtcttgtcatgtctgctagcgatccatttacttgcacttgcagggatgggatgcctcaatccattcctccaactaactagctaatcactgcacttctgttgcatgtatgtatgtatgtatgttataagggaaactgtttttcaataccagatgtgtgcataatctccagtccttctctagttgctcaacttgttgccttattactacttgtccaatcacccgagtttagtaattttgtcacgcattttgctagctatggaattggaatactacggttacaggaaagaaataaagtataatgcatagtgttttgttctataataacatgccgatggtcaatatgaggaatgaaagctggctgttgcttaagcaaaattgtctcaaggacacttgatacttccattctcacttgcttcacatgtactcctgaattcctgatcggttaattcacagtagcaacccatagtttccaatcagcatcgttcaatgagaaccagaggagtaaactgaagctcttaataaagaactgacacaaaaccgcatcctacctttgttaatagaaaaatatgcaacactcttttgttggtcttgacataagctgctctaagagtagccaggttccccagtgtttaatcatgattatagtcatctgaaaggaatattctgtttcctcccctgtgtttgcaggacacggtcactgggtttttgttggctggagttggcaatgttgatctgaggaaaaagacaaattaccttattgttgataacagtaataacctcaactttctaacgtgcaaagctgtttaatttttccatcaatgtcaggctgcttttattctgactatatataaggggaacatcgcgtgacactctattgatcatctcatgtgcaaaaaacatattatcattacccaattgcatgtaccattttaatcaatgtaaatctatctttccattgttagtag

SEQ ID NO: 62917 - DNA, 14085 bp, Oryza sativa
cctgacgaaagcgctcacgtgagtgtgccccccctcttcccgctcgccaattctcccaattctggtggggatttccggtgccgcctcgccggcgccatggcccatgtgctatggagattattgattcatctgcttgattgttgggtgggtgcagggcgctgttcgggtatgctatgccggcgttggagtgcttcaaggcgatcgagcagcggcctggtcggacggaccatctccggttttggtgccaatattggtactgactactgactcagaaaccccttagcttggagtaattagttcatttggtgtgttcaatttgatctctgggtgataggctgatgcttagaattcgtcgtaattgagtgaattgggtaaaccatacggggattaatttctgctatctgggtacagttagctggattagagcattagaattggtgctaatatgttactgcattgctgtggaattcagtaccaaatcctcactttcacctttctgaagtgctttgaatattggggatctgaaacaccgtatctactgtttggagatctgaaacaccttgcaagagttgaccaatttcagcaaatcttgcaggatcatactagtaatcctcgtcatattcgatgatatcgctggtgtcctcacctccaagtaagtaataatcacacaaccacaactcatcagctgttcctgtaatctgctccctgtaacctggcaatccccttcattgaatgacaggataccaatgtactctgaactcagactcgccttcctcgtctacctgtggtacccccagacaagggtatgtaatgctatgtctgcaacgcttggtccagcaacaaagctgcagctaactgcatgtcctgatcattgtctgaactaaacaagatttgccacaaaactgcagctgcacataactgcatctcctaatcatatctgaaattctgaactaaaaacgagatttaatctaatttgcaacactgagtccagcaacaaatctgcagctgcacaaaaagtgcatctcctgaccacgtctgaattaaataagattttgctttgtcactctgaaccagggaactgacatcgtgtacgacaccttcctgcggccgctggtgatgcagtaccagcccaacatcgaggagcggctgcgctacctgcgtgccaatgccggcgacattctcatcttctacctcaagaacttcaccgataggggctacgatctcttcctccgggggatggagtacatccggtcccagacgtcacgaggctcaagaacgagggtatgttaccagttactctctgtcccatatcgtaaggtgttttagttttgttctaagttaaaattctctaactttgatcaaatctataagaaaatatattaacatctactctaccaaagaacactatcaagacatatttcatagtgtattttaatgaaactaatatgatattgtagatgttagcactttttcttttacaatcttggtaaagttagaaaagtttacctagcacaaaagtaaaacaccttacaatatgaaaacagaggaagtagtagtacacatgttgggaaccatggtcatcacaggattccggaaatgtaacagtgcagtcaaagaattcaggatatgtaacagtgcaggtgtgtaactatgttggcaatggtttgtttctgctgtgcagcggtggttctcgttcggaggcgaccgggcagagaggtcgagctacgttgatgattatgtcgccggcggtggcgatcggaggagcacggcgaggcaccggcgaccccgcgacgattactaacgggctggaccggcgccatagggattcagtagagagaggtgcacaggattggaaactagttgattaggagtgacaaaatttaaaaggcccaaagcaaaacttctcaaaaacatgatgtgtatatatatatagacaggtgatcactgatccatactctggtatatatagctcctcacaatttggcgttgcaggttggctagtttgttggttttcctgttgtgatttgtgcacccgtcttcgatagactacatgattcattttttgaaacctaaggcgaaactttgttccacttttatatttagaagaagagaattaacccagtttataaggaaaaccgggcccaaaaaccacacaattgcacggttaattataggaaaaccggctgaaacccaccgctacacaactgacaacgacggcggagcccaaaagcaggatgtcaccgccaagctaaacacaaaagcgatataacagctcccacatcgcagaagaggtgttatcgttgccgagctagccgcccaagcgacccaacagcgccgacttcacaactgcagcgacactgaagacacgaaagtcgccaaagcgaaaagcagctccgacatccaacaatagacatcagccaagccatcgagaagccacttccttcacgcggccagcaccccaccagaaggaacgaagtggacccaagaagacaaaggcctcaccgagcacaaggtatgaaagcttttgaaccgaaaaagaccatcaacggtcgtcgatgcattggaacttctccgaagcgacgcccccaaggaggacacgacgtgtaacgccgccgtcgctcgtctgaaagccggaacaaggttttcatctggagattgtgggggatatgaaagaatgccatgacaatgcctccaagaagggaaatgacgcccacgagcgccgccgtcgtcgaaccggccaaaggcacggcaaggctttcgccagcatcttcacatcacccacacaagcacccccacattgacggccacagaatagtccatgacgtctcacaagcacccatacctcaaccgtaaccaacggcaaagacggacccttggccaccaactcctacagcaagccgaagcctccgccctccccctagcgttccccacgaccagaacaaggtccggccaaagaagggagggaaacccaaatgagggagaagactcggtcggcaacgaggaagtcgccaccgcggacgtcaagcccaattcctgcttcacgccagcataagccatcgtcccgccaactccacatccgcacatcgccgcccatccgacgcggaggggacggatccagccgcggacggccagatccagctaggacagcgcaagccggctcgacgtaagcgccgccgcagcaccgttgtcgttgcgaccaccacgccgccacagcctctgcctgcgcagcgctagcgccgtggccccgcgcggacgacgccgaggccaacgccgcgacaggcgcgagcgagccgccgctgcccgcccaccgcgacgccgcccctgcctgtcgccatctcgagccccgtcgccgacttctccctgccgccagccgccacctcaccagtgttgtcctccgctgctcctcgttgcgctgcaccgctctccgccgtcgccggctgcccctcgcgcgcgagccagcctccgccgtcgccggccacacctccgggaacgcggcctcccccgctgccagccgtgcctccgcgagcgctggcctccaccgccgcggccgcgcctttgcgagcgccggcgtccacagccgccggccgcccctccgcgctccttgcgcgcgccgcatccgctcctctcccctccgactgccgtctccggccggatccggcgggggcagcgccggatccgccgcctccacgccgggatgagtcgccgccgccgcgtcctagccgaagacgacgcgccgccccatcgccaccgtcgccaccacctccctcccgcggccatcctccaccgccgcttatgcatcgccgcgtcccctcgccggatccgcttccaggggcgtcggatccgccgcgcccttgccgtcgccggccgccggagccccccaccgtcgcgcgccgctccgtcctcccgcgctgaggaagagctttgccagttctcttggccccgccgccgccttcccgactggccgcacggctttccggcggcgagctccggtggcggcgaggtggttagggtgggcgggggtggcggcgcgggcggctagggttttgcccccgagccgcacgcgcgagagcgacgcggaggaccccactaacaaactagactacatgattcatgcgatgcaacccccactaacaaaccttttgatcattgtgatgaatacataatggaaacaaaccaaagaatattatactgttgatgatggataaaaaaatcaataccatacttgacgatggataaaaaaaggggatttttttttcatgagactccacacaagtggcaagccatccaataagactctccacgagtgacaggtcatacaactagttggagcaaccagctgctatttatagatttcgcatgcaaatctattcatcaagaatacgcatgcaaatctatttgaaagaattatgggaataatagatttcgcatgcaaatctattcaagaattatgagaatcagtaactaactagtgctatttatagatttcgcatgcgaatctatgcaagaactcataggaatatttgactaactaattaataagttaacgctggatattcctcctcgacctgatcaacctgtttcacgccgatgatgccggccacgaaccctaggcaagggcagacgtacctcttgacgaagcggtataccgcgccgccgcgccgggtcccgagcggccccggcgatcgccggcggtggagcgcggggtggggcctcgcgtacagccgcgacgtcgcgcgcaggagcgggtcgctgatgccggccttcggcggccggcgggagctctcctcgaactcctgcgagccgatcacgtcctcgaagctcacgtagccgggcgtcgtgtggcaccgcttgaagtaggcgtcgtgcgcggcggcggcggcggcgtgcaccaggtcgtcgtaggagtgcagccgccgcgagatgggcggcaaccgcgcctccgcccccgccggcgcggccccggaggaggagaagttgtcgctgccattgctgtcgctggtggcggcggcgctggtggagtggtgggagaggaggggctgcgagtaggatgcgcgcatggagaaaactggggcgacgtacgagacttacgagtagccgatcgagggagagattataagaaagaaagtggttaaaagatggagggcggtattagggtttgattatgagagagcatcacacccaactcgtattcggtgaagggggcgtagaaacgtattcggtaaaggggccgtagaaatagtgtatacagttatacgcacccggtttgccgcgcgccgtccagagaagattgaaactcaaaatcgattgaactcactcaactcaacccaaaagatgattgtaaatagatgtcaaatcgaaatagctaggtttcaccaatcatccgcggacggtttgaggaagcatcgatctccatcgaggactcgtgcggagctcgccgccgtcgagccgtccaggtgctcagtttgctgctgccgcggttgacgaggtcgcgctaggattgggagtttgagaggctggctggagagcccggatggccggatctaactaatgaattgttatgggctttggggctgagagatacatgggctgcaggccgaaccaacctgtgggctgagcagctagcggaggcgcttccgcttcggttcgtttgcggcctggaaaccgcgccgaacaggctactgggcgaagtggccaacacctaaaactggatttaaaagaaaaataaagccaagcataacaatactagtatttagattcggtgtaatggatcaatttacggtgaattttggatttttactctgttcggtagaaactggtagtaatataccttaggatttaatttgtcaaatacttttacttatgttatggtgggtttacactcgtcccttgctaatatcttccatagttggcttggtggtttacaacgtagaataaatgttaactttttataggtgccgtagctttgtgttggacggtaagactttgtagtaatgatataatcttcaatggcttaagtactaactcccctctttgtaggtaattttcaggtgaacccactgcgctagtggtcattgttgcttaacgaggagaatagcgatgtggttaaacacatgcacaagttaccggaggctagagtttgggatttcttttccagatttgcgtggaacttgagtaagcggttggagacctagtatccacttttgtcatcttttgttagttggcttctattcacgagacgacttcgttgtgaggtgttgtagtctaagtacccttgttttatttggtcggtggtgttgttcttatgcaaggtgtgatgctaagtactattgacaatgtatgtttggctatgtacgtatagtttggatgtagaggataggtttttaatcatttttttaaaaataaattgacattttctccctctacatgtttatctatgttttgttagtattgttgtattgctctcactaagcctagatgctcgctagatataatgtatttttgcttacttgtactcccctccgtacgttcaaattttttttatgagatagaacacaacctatatacaataggatgtgttccatccaatcgaacaattatattttgaaacggagaaattgtaagaattacaagttgtcctagcatatctgcactcttccatccatcccaaaataaataaaagaaaacttttgcaaaaccataaacagagtaaaacggaccgagacgagaataagccagcggagcacacgcgcaacaagacaatttttttgtttggcattcctatcaaaatattcccaacatagcatagcttctagtggaaactgtgaaccactgaaccaccaccatagacgatagcgtttgtagcttgcttgcaacggacaaaccaattaaataccccctccgtaaccgcgagattctaagttttcaacgaaggctgtatttagttccatgtcaaaattaaaagtttgaaaaaattagaacgatgtgacagaaaagttggaagtttgtgtgtagaaaagttcgatgtgacgaaaaagttaaaaattcgaagaaaaaagttagaatctaaatagggccaaagcgagaaagcttccttgcaaatcctggctgtgtgcatatgtatcagtacttccttcgtctcagtaagttaatttttttttattttttttatttattccaaaataaatttattttaaaagtaataattgtatcaaaattgatgaaagtagaaaataattatattgaaaatagataaatgagaaatagttgcattgacattgataaaacaaaggtattttagttttttattgatgatatgtgaaagaagatactttctccgttaaaaaaataaatctaaaacgggatgtgacacattctgtacaataaatatgaacaaagatatatatttagatttatactagcacactgcacacgacacacacaccagcaacgggggcacacgacacacacacaccagcaacggggattagaagttgacacgactgtctatctggaatcctagctgtgctgcggtagcaactgtcctcagatgctgatactccctgatagccatagccacgacgcgatggggtccccatccatcctcccctcctgctcggttgttttcgcttcaggttcagtgcagtcacgagcgcggacgcccccaaaaaactcgccacgctgtgtgcgcgcgcgcccaccgcgatccccctgatcccattaacgtttcacccgcgcgcgcccacctgccgctgcaatatatttcgccgcgccccgcgccacgccacgccacgccaccttgcgcgcgcgcgcgcacacacaccccagcagcagagatgagggggatgggcgacgacgggatggggccgatggcgatggcgccgccgcgttccggccacgccacggcggcggcaccgccgccgccgcagcacaagatggcgatgatgatgcacatgaccttcttctggagcgaccgcgcggtggtcctgatccggggctggcccggggagcgcggcgccgggatgtacgccctctgcctcctcttcgtgctcgcgctcgccgcgctcaccgaggggctctccgtgctctcgcgccgcctcgcccgccgcggcggcggcgccgcctcctcggatggcggccgcccggcgccggcgccggcgtcgtccgcggcgctgctgaccgcggtgcacgcggccaggatggggatggcgtacctggtgatgctggccgtcatgtcgttcaacgtcggggtgctcctcgccgctgtcgccggccacgccctcgggttcctcctcgcgcggagcagggtgcggccggccgcccgtgacggcggcggcggcgtggcctgtgagcacggtggcctccctcccgcggatggatccaagacttagtccccatcgattccgttaaacgagtatgtccaagcgccttagccagtagacactatgcactgtatcggatccaatgtgaaaatttaccttggatatctcgctaaaataattgtattttgtcgacttgcttgatatctgttcccgtgcagtcttctctagtcgtttttcgtttgtactcctatgtttcaagatggaatgatactactactagctagtattgatgtgagttctctactatgctaactttagatgaaccaatgatttgttagtactctccttccaaaaatatcctttttttaaatggaatccttccaaaaatattagatttatttcatattttgaattagctacatttgtagttttcatgtatttaaaacttaaatgaatagataaattaaatgattaatcggaacccgatgagtcatcttaatattcattggctgcgtacatgcatacactaattgatctttgttacaccttatctccacttaaattattattatttaaatccttcacccttaagatttctaattgtattgggtgcatatattgtatttattagagtgataaagatgataataattgtttttgttctttcgattaaatgtagctgtgtcttatattcgtttcatatgttgatgaaaccaaccctctagtatatgtttcatgctcatggtaacatatactagggtattctttttaaattcctattttgtgatagtgttgtcatcaatcaccaaaaagggggagattgaaagatctatgcactagaattgccttgtaaggggagattggaatatctatgatcctaagagcgcggtgattgttttggtgattaatgacaacccattgttggaactaactatttccatgagttggtgagattaggttaagtttcagcatcaagttaaaagattgaagctagaagatggacattataccttgatgaggagcaagtgaaggcattgatgatgcggggtatgaaatggctatctatggcaaaccggtgaagagaaagcaaggctcggctagaagatggacattataccttgatgaggagcaagtgaagacattgatgatgcggggtatgaagtggctatttatggcaaaacggtgaagggcaagcaaggctcggctacaatggaccatgtggggggtgaagggcaagcaagaggcttggcgccgatggactgaatccggtggtgaagggcgagtgaaggctttgtcatgatggtcatgatggaccgtatgaggccatttgaagctatgagtaatccgtatcaattataagaagaccgcaagatggaatgccgaggatcaagaggatgtggttcttcgatgaacatcaagtcaaaatccaaagtgggcattgatcaaggcaaaggtataattgatttgggactaatatgcttaatgagtgtaggtgagaatagtcccaatagtgaaatggtgttgacatagacaaccctcaaggtgaagcaagaagatgttcctagtggtgtattagtcccaggttgcttaggagtgggctaggatgcttggagatcccccaaaacatcaaaatcaaagtggcgagaagactcggagccgagttagactagtttactttttcgctttgagtttaggaaaaaccgtactattaaaaggggttccaagtatggttctaagataacacaagtgttcttagtggtgtccaagtgttgaaatatttttaggagctgtttttgaaaatgactctactcgggacagagagtcccacccggaggttctgtccggaacttcctggcgccgaggtgaggttgaaaattttcttaagtgttgcccggaagttcctggcacccaggtccggaacctcctggcaaccctccagttcaaatatgtgagtaacggctagatgacgtcacctaaccgttatatatagccaactcgaccccagctcattctttggccattccactttagttcttgtgttccctagcttgttctagcctctcccaatgtgattttgcttcctccacccaaatcttgtgcacttattgagtgagagagtgaatttgagggtggtggtgaggattggaaaaggttttgaaggctaggatgacttgagcacttggtgtatctcgttgggctatcacttgaagcttgttactcttggagggtgacctcctagacggttaggtgtcgcccgcaagtttccaacaaggttgtggattgacccgggcaagtttgtgagagcgttattccacctccgaaagaaaacagaggtgaggtttaggaggtcgtcttggtagagcaagcctcacttgtggtgttcttttggtgtttaagttggggatcttagtggtcacttgaaaccaaagagaagtacctaggggtgttggcttgaagaccggagacctcttcctaggccttttcttggcgaggcaaggtgttaatcaagacccggctctttggagctcctcaacggagacataggattctcggtggagaatccgaacttcgggaaacaaatcatttgtctcctctcactctctttatctttgtgattgtgatgcttatctccttatttgcctagttgtgctatcatgtctcccattgtatgatcacttgtgatatcttgtgtattttcatgtgtattactcttgtttgagacatgttgtacctctctatagtttaggcttccttgtgatttaatttacttgttgtgaggtgtttgaaatagcaatttacaactgcccggaagttccttggaagaaccccggaagttccgggcagctttctctgcttgtgagaaaaagctgccaggaagttccggaccttttgccaagaagttctgggccctgattttaaccgctacgatttgaagtaaattttaggtgcgcctattcacctcccctctaggcgacatcaaggccctttcggtaagcaactattgtatgattggctattagagcaaggttaatagtatagccaactactagctcaaattcatctatagccaatctaatagctaatttatacaatagttgcttactatactattagtatatggtcctacttgtcatacacacattgcgtcttggagtccgtgctgcagctggctacatctctctcatcttttatctcattaaaatatgtttgtagctggctaatagtttgttattgtacctgctcttatattgactatatatgatttggagttagtagtgtgctatactattaaacttgctcaaattgtttttcgggtcagaaaagaagcttcggatcattaatctttcatgtaaaaatcatgtaaagaaataccgctaaggtctattcaaccgggcatcaaccatgtggaggtctgaaaatatgaaaacgaccttgcagggtggcaccgtggcatgtgtggaggtagcactgtggcagcggcaactacctgtgctgtgcatctctctgactctgtgtggtggcgaagatttggaaaggcagcaggaagaatcttgcaagatcattgggtcccgttcttttctctaagcaaaagttgaaaagattttcgtggcacgctttttatatgaaagttaaaccgtatacttcgtacaaaaattttatatatgaaagttgttttaaaatatcatataaatctagttttcaagtttgtaataattaaaactcaatcatacgttaataccaccttattttgcatataaaacttaatttttatttttatttttatcttcagaagaaaaaaaacaccatctaaaaatcgagcgtccagaacctcttattaaaaaaaggggacgaaacagagggttaaaaaaaaaagcttatcaggcctattagcagtggcagcagggatgaaaaagggatgcttacaagaaacagtagcatctttcatctcttctgaaacgacggattgtcaggaccatatttatcaatttagctatttagtaaaaatagcaatatgatgttaaatagaaaattaaaaatttataaataggtagaaccagaaacggtaaaaaataataccactcatatggaaatggtgctcggtcgacccggaatttccgtgactgttttcatccccagtggcaaaaagggaacaagaaaaaaaattaatttgatttttttcatatagtttgtagattagcaattgaaaaaaaaaatactacagttttagttgaactgagcagattattggctatgtattggtcgcaaacttgcttctcatttaccattcttaagagccccaccgaccgctcccttctccatctctgatgagtatgtcgctattgatgcatcttctccaattgtctccaagtacgacacaatcccccttctccttcgtctccgatggttcatgccattgccgcctgcttcctaacaacatgaccttctttgtttccgcggttgatcctatgcactactctcgttcatccctaagcctctggtgctaacgcttctgtctttccctcaccggcccaccgtctctgccactcattgctattcctccatccctctaaacctgctctcatcgaagtcctcgccatctccctcattgacgcctccacctcttggcaggccatggattttgatccaatgacatccattagtggattcagaatagcaaagcataaaattaaaaccgtttatcatgttgtctattcgtaaacttatgcgtgaagattgatgaactgaaccaaatgtgaaaaccccatatacaagactacaaattacagcactattttttttttttgaaaatccctgatatgactatgcctatagaaaatcctatgacgtaaatatgagggggctttgcagtattgagactctgaacagaacctctctcaaagaaagaactaaaatacgtacttcaagaaaactcgattgaatcatggcccaaggcccaaagcccagtcgacgcacataaaatccaatctctcccggttgacggaccgatccccagtggaaaaagtctttgactgtttccactatcgcccgagtatgatttatttcctccaaccacaaaaccggtatatcgacttctctaactattaaaaccggtgcaaacaatatccctcggtagttttggaggtgggtttggctgatgtggtggtattgactaagtctttctcctacgtggcgcttacgtggcattaaaattaaaaccaaaataaaaaatatgtgggatccatatgtcattaaaaaacaattataggacccactgatatgtgggacccacctgtcatcctccctcttcttccctcttcctgcccctctctcccttgtctctctctcctccccggcctttctctcctcgggaagacgacggtgtggagaggcggtggggagcggcggcgaacgagggcggcgcgggagaggaggtggacgaggaggtagtaggcgcggagggagtgggggatcgacgacgacggcgacgaggaggcggcccagtagaagaaggtgagcgcattcctagcaacgagctccggggaggaggaggagtggcggtgcttggcaagggagaggaggacgacgtcaacttggtcggcagtggggaaggcggtggagagcgcctcccatgtcgctctcggatggtgcgcgaggtaatgggagatgcgctgaggcgtcttggcggcggcaacaaccatagcgcacgggggaggaactcaccagccgtccacgcgcgggggagtggctcaccggccggtcgcgcgca

SEQ ID NO: 62918 - DNA, 23522 bp, Oryza sativa
gaaatcaaaggtgttgttgagataagcgcaaagtaggcccaagtgcatacccgaacgaggaggctcttcgccgcggtgcatccttcgacaaactcattcagttcggggaagggcacaaggcctcccaccggtgaaacaaggtgtcccaccccctgcacaatagggatgagttccgcacgagtctcgaaatcggaagagacgaagcggggagcagacagcgaattgtccgaacccgaagtttcgaccgccgcctgcttcccccgcgcgggtgccaggagcgaaaggtgaggcccagggagggagcattgaaggtggcgcaagccgccgccacagcaccttcggcagatgcagtggcgcccaccatgaagctttgcacctcctcaccagcagatccagcgacagcagtggggaccggggatctcgaggtccgctcagccagcaaagtgggggtgccatgcgatgggtcatcatcactgaaagcattcccaatttgcacgacccctcgcgcacgggcctcggttccaacctcggtccgaagtgggggaacccccgcgatcgcggtgagagtttccgcccttccacctctttcaagtgaaggggagatgagctagatgcaacccctgctttggcatgggaagggctcagagtgtaacggggagacatcaatttttccctagtctcatcgacggtctcctcctccccctcctcttcgtcttcgccctcctcctcgtcatcggcgtcggactcaactgaggcagccgccttacgctttcacgaggcagccttacccttcgcgcgcttacgcttctgtgaaggctcaacatcgtcagcgtcaattaagacggtctttgtagggttcgcccgggccggcagttcgccggagaagacacgattcgcccggccgcctgcctggcgggagagcaattgactgaactaatttatggtgagttcgccaatcatcttccgggcctcgctttcggcctatggcagcgtaagaactgtcgaaaacaatagtacagggcataagtgtaggatcgagatgtcgactagaggggggggggtgaataggcgatttaaaactaaatgacacctaatcaaaactaacctaagttgctaggctcagtgaggaacaactctaactaagctactaagttatgttttgcaaacctagggtgatagtggctcaattatatctctaggaaagtaaatcacactcctatgtcaatgtctctagtgatatgatcttaagtatgtctctagaaatgtaaattgcataaatgtaaatgcgacaatcaaatgagacaatgagacaagagatttttcaccgaggttcggaaactcgccggtttcctactcgccattgaggcgagcccaactccaccgctcaaccacgaagccaccgcacgcccccttcgtcaaggggtgggcaaggcgggagccggcccacggagaggactacccaagcctcgatcactagggtagttcttccttcactccgaaggtggtgaactccaaaccactcacaaaccggcgccgggcctcctccacaatcttctcggagaggtcaccgggcaactcctccacaagccgtctaggaggtggcaacctccaagagtaacaagtaatgacccggcgtggagatgatcaagtgccacactagctctacaatggaagtaaatgcacttgactcttggctaaatcaacctcagtcactacaatggatgaacactaagctcaatggtgtgtgagagaggtgcaaggggtgtatgcaattgaattgggtgccaagagagtccccttgctgctggtggaggagtatttatactcccacccaccaaaactagccgttgggggtgaaatcccccaactctgtgctctgccagtctgaccggaggaatgtggccggtcagaccgtgctactctgcaacggctagaaaactagtcgttgtagctctgtcagagggccccatcggcatggccggtcagaccgacgttgagtggccggtcagaccggcattggctcggtcaaaccgccatcagctcggtctgaccgaatacggctccgtcggctctgtatcggccaccccgagcaacaccatgccggcctccagggggccggtctgaccacacatgtgccgccggtcagaccggccatatgcgccggtcagaccgccgttttgtggccgattagactggccagggcactccggtcagaccgccactctgcggccggtcggaccgcccctggtcaggccgaacccagtgaagggtgatatgagaagtgtgtgtgtgaaatgtgagcacaagtctaaatgcataatgacctaatgtggcaattaaaatcatctctttgctaggtcattacccctcttaatagtacggcgaaactaaaaataaactagcaaatttgttcgccctatacctcgatcaattctaaattaaagcgctagttttaccgtcttctttccctttactttgcaccgtcaattttaatccatcgataatcatccatgcgcacatgtgacgtggacctaacttaaaatatatagctcaaagacaacggttagtccacaattagtgcttgttattaattaccaaaattagcaccgggggcctagatgcttcaatctcccccttttttgtaattgatgacaaacaccacaaatatatataatcaaatttaaatcacacggacatatattgcaatgacaagcaaaaagctccccctaaacatatgcataacaatcacaaatagcaaatatggagccaatgcacatttcaatttcacatttcaacatagcacaaacacaagagcaatatctcaatgtgaacttcaagaaatatttatccatgagcataagatggtcacatatatatcaatatcacatacaccatccatcatcgcacaagttcacatcacttaaccattcaaatcacataagttacaaatcatcttaaaagggctcacaaataaatataggctattacaagaccacgaagggtccaaatgacatatagatcaacaaaacgataaagaacacacaatatagagtaatagtccatacccatacataatatagcccaaaccaccttaacctattagatatgaggtgactaacctcactaccactagtcccaacccacaagacataagtatatatatttcattgttaacatatatttcgatctaagtgatttatattatctcagcatgacgtccgatctatcccaatcacttgatttaagtatgtatcgacataacgattatatattgttaatatctacagccgatcgaatagatttagtcctttcttatttatttacatctgccgatcgattcaactatgacatcgcctcagagaaaaatgatatgtcatcggcaattagccgatcggctatcatttatggttttaaccgcggtttatttgtctttatttcttgtttattgctggaccaaatcaactggcacgctcacgaacctaaaaggcaagatttttggacctgcactgaagttaagcagatcttccaggcctcgtgtttttgcatcaacacgcttttggcacgcccagcgggatccgataaacttgtcaggggacaagcaagctttgaagtcaacagatcctcaaaacaagccgccaaatccagctgggtctgaagttcacgaaggaaatattattctagtcacactagacaaattgtcggctgaacataggcaggagcttgaacagatgatgagcagcatgaaggacaagttcatgaattcattcaaagaaacccgccaagggacaattgtccagaaatacaagttgaaagtggtcgctgccgatgaagttggttcaagctcagctcaaggcgataaaggtactgctggtgaaccaggcgacaaaggtagtggtttttaggagggcatggttgaagatcttggtccagatggcagtggattacaaccacagtttgacaacttccaagatcggattgactacgctatgcaacatgctttgatcaatcaatcaggagtcttagtcaatactttaaccaacatggtgaaaacaatggttgatggcacaatagctgagcatcaagttacagaaccagtgtatttgccaggtggtgtttttccaaactataagcctttggttacaggcaatcaacagggttcttctaacacaccatcaactctgctgatggcaccggttacaacttctgctccagctgcaccatcatcggcacaaaggcaaatgaccaatcctcgattgtatacaagagaacagccacagcatggtggacaaaacatcaatcggctaactcaggagcaggtggctgctatgttctttccaaatccaccagctgccaatccagcactgccgagccagcatatgccaccaaggcagcagattactcagccgattcaatagcaaagtttgctaaatgcatcagctaggttgaggacacctgataatcagctaaggcagcatgttgcaactcaagtcgtccttgagcacttggttcataatgtgcaaccagatcaatcagttatacctcaaattatccctgaacatttggtgcgtaactgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagtggaaaataagataaacggcgcagacggctccactccacaagcagctcgaccagggctacacctaatcctccacaccattagcaccactgtagaactcttcctctgatgaatgattgcaaggtgagtatatgacatactcagcaagccacgcagcaaatatgcaagtgcacaggataacaaaggatggcatagtatagggctcatttgcaaaagcagcatttagcaaacatttgagaattataaaacagttaagtgataattaaacaatattaatccaacactatacaacataccctgttgcataggcccaaccattctgaacaaccatacccggctgtacagatctatctccaaaccaggaatgtaccattccaaaccaggagctaatcaaattattaccagttatagcatcatttattatggtgagaagtgtgagactaatcacgaaagacattgttagacccgcccataaccgcgggcacggctattcgaatagttttactctgatcagaggtgtaccactgtacccacaagacacagccccatatcatgtcaccatgtgccgcaataccaccacggtacctcggaaaggagctgtgacaatacccctcgtacaacacaatccactacagcgcacctttcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtgtaacgtcccgccttcccccaggccgggcccgcttacatatgatagctttcataggtcatagactgccctcacagaccaacacatgtcttttctgcacactttgtcctcactcgtgtgcacccgggaagaatttcccggtcggtcacccatcccaaattgctccaggccaagcacgcttaaccctggagttctttggagattggcttccagaaaagaagttgcaacttgttgatatgagtattctattaatcctattaagccctaggccgggatgttacaccctcaccccttaagagagatcgacgcccccgtcgatcaaccctaggctaggaacgtcctctcttggccacgtccatgtgtccagtgccagcgcatgtagtcggctctgataccattttgtaacgtcccgccttcccccaggccgggcccgcttacatatgatagctttcataggtcatagactgccctcacagaccaacacatgtcttttctgcacactttgtcctcactcgtgtgcacccgggaagaatttcccggtcggtcacccatcccaaattgctccaggccaagcacgcttaaccctggagttctttggagattggcttccggaaaagaagttgcaacttgttgatatgagtattctattaatcctattaagccctaggccgggatgttacataatgtttcacaaccgaaactcgtgaaccggtccttaattgtcatgagcacgaccatcaaaactatgtgctcacaacccaccattatcaagttttagttggcaagtaattaattaacaaatcacgattgaccatcgtgaactatcattaagccatcattaaataatagtgagtcatatgttatcccaatagtgtgctaatgtttctaagcatggctaagcaatcacatctaatatctagctgaaccaatatatagagctcaactagtcaagttataataacccaaggtatcaaggaataaagtaatcaagtacaaaagggccataacaaagaataggttaattccacccaatgacattcgaaaatagatgcaatagttgaatagaaacaatagctttaaataggatcaacatgctcaaagggttgtttgggatctgtgtgacttgccttgctggccttggaactcttcaaaatcttctcctgcgaaaacggactctccggaaacgtcggaatctaaacagaaaagagcaaaaacaccaaaacagcacataaacaagcatgaacagtacatgtggatatttttaatatgtagatctcaattttagaaaaatttagagacttgaaccaactaaatccgagctaagatgaattagttatgaatttttgaagatttaatcggattaaaacacttatattgattttaattgaattatgacgcaataatgaattatttttgaaaaggaaaaagagatttattgcgtcagcggctagggtttgcggtagaccgggcgcacggcggcggttcacgggaacggacggccgagatcgatcctatccaaaacggacggccgagatcaatcgggtccacggcgagtctacgggaacagcgacaatgacgtcagcgatgacgtcagcgatgacgtcagcaccggcggcggctcggcggctcgggagcacttgctcgtcggcgaacgacggcgcgaaggcgcgaacggagggcaccaacgggtagaggacgacgcggcgaactcaccggtgaccaaaacggcggcggaagatcaacggacggcgacggcgtcgaggtcgaaggggcggagaagatcgggtcgacggcggcgacggtcctccggcagtcttcagcgacggcgaaggagcggacgaggatggcgacgacttggcgaccacgatggcgaccttcccgagcgacggcgacgactggaacggcggcggcgcacggctggagcggcggcgacgacggcggcgctaggttacacggcgctggggcgctaccggcgacgagaggcgaagacgagggtggcggcgggcgggtagaggagacaccggggatccttttaaaggggctaggaggcggcggcaaaggcccacggcaaccggcggcgagatggaaagctcgggctcggagagagagagaccgatccgaatcgacctcgaatcaaacactttccaagcgattttagccgatgattccaaaagagaaaaggtagaggagatcccgaagatcattttccctcaattgatttcaccggaaacggaaaggatcggccgaatttggaaggagacggcggcgcggctcggctagggtttcgggcggcggcggctggaggttgacgacgaccccgacaggcgggccccacctgtcagcgacgggaacgcacgcgcgcgcgcaggcgctgctggactgggcggacttggcccgagggacagagagagagggttttgggccgactttcggcccaaagccaaaagaagacttttaaaacctttttcaatttaaattattcatgaaatgcaattccatttattaaaaatacttcctcagctcaaataaatcccagaaaaatctaggaattatagaattaagcaaagtatttaatgaaattttatctggccccattttatattggaatttattatttaaaattagatcttcttttctagacttttaaaatcaattctaataattccaattaaacaacaatttatatatttggaatttttagggtgtgacaaacctaccccccttaaacagaatctcgtcctcgagattcgaaagaactggcgaacagatgcggatgagctgacttcaattcatcttctcgttcccaagttgattcttcttccgagtgattactccattggactttgcaaaaacggataactcgatttctggttcttctctcatctatttccaagatacgaattggtttctcaacataggtcagatcctcttggacttctatttgttcaagattagcttcttcggtaggtactcttaaacactttttcagttgtgacacatggaacacattatggacccctgccaaagattgaggtaactctaactgataagcaacctctcctcttctactgacaatcttataaggtcccacaaaacgcgatgccaattttcctttggtgtggaaacgatgaactcctcgaagaggcgtgacacgaagatacacataatctccttcttcaaaacttagatctctacgacgattgtcggcataactcttatgacgagactaagccactcgcaatctttcttgaatgatctttaccttttcttctgcttcccttaggatatccgtcccgaaaacctgacgttctcccgtttgatcccacaaaagcggagtgcggcacttccgaccatacagtgcttcgtaaggagccatctgaagactagcttgataactattgttatacgaaaattccgcataaggtagattcttatcccaacttccaccgaagtctaaagcacaagctctcaacatgtcttccaaaatctgattcaccctttcggtttgtccgtctgtctgtggatgataagcagtactaaagttcagcttagaacccatctcttcctgaagcttcttccaaaaatttgaagtaaactgactgcctcgatcagacactattttcttagggactccatgcaaacacacaatccttgccatatacaattctgccaaccgactaccagaatatgttgtctttactgggatgaaatgagccactttggtaagtctgtcgactatcacccaaatagagacatgacctgatgacgttctgggtaaaccactgatgaaatccataccgatttcctcccatttccattctggaatcttcaaaggctgcaacaaaccggcgggtttctgatgttctgccttgactcgctgacaaacatcacatactgctacgtattctgcgatttcacgcttcatacttgcccaccaaaatctttccttgagatcctagtacattttggtactaccagggtgaatggagtataaggtatcatgagcttctttcagaattgcatcttttaaatctttgttgtcggggacgcagattctctcacccaaccatatagttccttgctcatcctccaaaaaaccgatagcttttcctcttctcatattcttcttgatttcttgaatatcatgatcattaatttgtgcttctctaacttgatcaattagtgtgggcttcgcttctaaggctgcaacgaaacctctaccgacaattcccaaattcaatctttcaaattccttacataactccaatggcaactgtcgtccttccgtagcattgcaatagcctttcctactaagagcatctgctacaacattagcctttcccgggtgataatgaattcccatgtcataatccttaattaattccaaccatctccgttgtctcatgttcagatccggctgagtaaagatgtactttatactcttgtgatcggtatacacctctgtacgagtaccgaaaagataatgacgccaaattttcaacgcatgaactactgcagctaactcaagatcatgagtagggtagttcttctcatgcggacgtaactgacgagatgcataggcaatcaccttcccatcttgcatcagaacacaacctaacccaagtttagatgcatcgcaatacacttggaaacccttctttggatcaggtaaaatcaaaataggagctgatattaagcgactcttcaattcttgaaaactctgctcacattctgtcgcgtcccaaaacgactctaaaatacatcctcgaaattgtgccgagaataattaaaattcatgtgaaagccttcaacaattaaaatgtgcaaatttaaaaagtcaaataaggcttggaggatttttgtatatttcctaaaagcctaaaatgcgtaaataaattttagtggaattttcagagcacaaataataattgagaagaaataaacaaagttgaaaaggttttataaaaagaaaaatccctaaaagtcttcttttcccccccttcccttcttgggccggctcggcccaattccctccctctctctcctctcccccgcggcccatcggccctcccccgcgcgcgcgccgttgacaggcgggcccgcccgccaccctcgctgacgggtggggcccacctgtcatcgcctacctcgcgccgcgcccgccgcccgcccgtgccctagcgccgccgccgccgccgaatccgccgcatcccgccgtccccgcgcgccataaagagggggaaatcactccccgtgattccctctcccttttcccccgtttttccctctctctctccctcggattcgtttggaatctctcccgcaatcctcgccggcgcaatcaatggcggccggatcctccgcgccggtttccatctcctccggccgccctctctcactcccgacgctatataatcgctcctcgtgcttcgctcctccgtttccgccactcgccgcacactctccccgtcggattcgtgcccgcgccgtcttcctctctctccgccgtcgccgccgagctccggttcgccgccgtcgtcgctccggacctcctcccgactcggcgtcacctccttcggcttcgccgcgttcccgtcgacctcgtccaccccttcgtttcgcccgccgactgtcggagcgccgccgtcctcgtcgatccgaaccgcgccgccgccttcctccgctccggttgtcgtttccgccgtcctcgtcgtcccggggtgagccatggaccgcctccttcgcttcccccttccctcccctctctcggccgccgctccgccgcgccgttggtcgccggcggcgaccatcggggcgcgggtgcgccgcctcccgtcggccgtgccggcgaggccgccttcgggcgcgccccgcggctgccaggtgggcccggccgtcagccgcccgcgcccgcgggtgcggctgacgcgtgggacccacggcgccggtcggcgtcagccgcgtgcacccggtccaccgtggaccgagaggctgacgcgtgggccccactcccgtggacccggtccgcgcgccctctctcccggctgacgcaataaatgagtttttaattaaaatttaaatgaagaaattcgtaaatatccatttaaagagcatataaacttcaaatggtcataacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttacgaccttattattgttattgttattatttccttgttcaccctagattaaacaaaacctcaactagtggacactctactcatgacaccactagtttaattttaggtagatgcttcgcaatttaattaggtaacattaggtggttttacaactatagactttgggaattattcacatcacctggacactttggaatggtctggatattgtggaattggattcacaccactccttctattcaaaatccccaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcacagggccggtgtcctgctgctaggggctcagtcctgcctgcctgtcccgggtgttccggccgtaggcgggattgggtcggtactcttgtctatggctaggatgggttggaaactatgtcacgtcttccgtctgtataccgtggtggtatgtggcacgtggttacacgtgaggaagaggtgtcttgtgggtaaagatgtacacctctgatcagagtataatctattcgaatagccgcgccctcggttatgggcaagccgagcaatgtatccaagttagtgttttaattcttaaaacctgcttaacaactaaaatgtggaatggttggcctgggttggcttaggacgagctgggacccagggtcgggttgccagttcggtctgaatcatcataggccttgggttaaggcaggttcgtgtgggttcacggccttgattaataacattgtgtagttctaggatcgtgtttacaaaatagctttgagcaactaaatgtccttaaatgctgtttactgcaaccctaaccctttatattataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttctgctgtttctcgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaaagcccgttgggttatttccggtcgtgacaagttggtatcagagccacccttgaccctaggacgagccgtagaacccaagccttagcaatattttcaaaaataaaaatcctttgttatttgtgaaaactgtctagtctctctctgtcttgctgcttcatttatcgccaaaatctgacctttgaaaatgttgcttttctttttgtttttgtttgtagatggccggcagcgtcacccgtcgtggtttgggcatgactggcttcgtcttggagttgcggggcatgtgcgtggccctggggtatccacacggagtggactaccaggccaggccgcttccggagcaggagggtgacgatgcggagccccgcgctgcttgggaggtcactgcagtgatcctcgctggctcttctgagcggacttcgctgacagtcaccgcgggtggcgattccttccccgccgcttgccagagcgccgctctcctcgccatcggcactctccaccagcgctacccggacgagttgcagcactcgccctaccgctaccacccccgccgcggaggagcccgcgactacgccaccttccgggatgctagctcggaggatgacgctaccatcgtgcacctggcgcgcatggtggaggcgtacgacgcggctcgtatcgacttccatcagatggtgcgccgtgggatggtcgagaacaacatgaagatcctggagctgcgtcaggagaacctgcagctcaagaaggacctggacgcggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacggagggtgcgctgttgctcaccttccgtcctggcccgtcgcagcggtagacgagcagttagtaggtttgcgcgtgtgttctttctcgtttgtctttttgagttgtgtggggcatggtttatgccggtgtgtggcataactatgtcggagcctgtcttattttatttgcctaagcaacttgaacattaatgaacccatttaatagcagtaataaattcaagaattatagtagtcgtgggtggttagttttaattgtcagctctctctgttgctggttctgtgtggggttttcagatggtgacgaccaggagaaatgctgttaccggtgatggcaaccaacccgaaggcagcaaccacaaccaccagggcaacccacctccacctccacctccgcctccaccaccaccaccagacaccaacgccattctcacccaaatcctcgcccagcaagccaacatgatgactgctttcctccaccacctccaaaatccgccacaacataatgctccaccaccacccccacaacactctaaactcgctgagttcctccgcatccgcccacctaccttctctagctccaacaaccccgtggatgcgttggattggttgcatgccgtgggaaaaaagttagacactgtgcagtgcagcgatgaggagaaagtcatcttcgccgcccaccaactgcagggacccgcatctctctggtgggaccacttccaggctacgcagccagaggggcaacctatcacttgggcccgcttcaccgccgcttttcggagaacccatgtgcccgccggagtcgtggcccttaagaaaagggaattccgagagttgaagcaaggcaaccgctccgtgatggagtatttgcatgagttcaacaatctggcccgttacgccccggaggatgtgcgggaagatgaggagaagcaagaaaagttcttggcaggaatggaccccgagttgtccgtccgtctagtctctggggactatccggattttcaacgactggtggacaagagcatccgcttggaagctaagcacaaggagctggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagggtcagcaggggactcgtgcgccccgtcctcctacgccaactgtgcagcccggtcaaggccgcagggacgctcaaggtcagcagcgtctgtgcttcaacttgttcgagcccgggcactttgcggataaatgcccaaagccaaggggtcagcaaggccaagcgccttcccggttcaacaacggcgggaaggatgtcattcggggccgtgtgaatcatgtgacggccgagaacgtgctgacaactccagacgtcatcgttggtacgttcctcgttcattccatccctgctactattttgttcgactctggagcttcccactcgtttatatctgtgtcattcgtggggagaaatcagttgggggtagaaaggcttagaaaccctttgctcatcaccacccctggcggggttatgacagcaaagtattatagccctgccgttcctatagaaattcaggggattccttttccctcggatctgattctgctagacaccaagaacttggatgtgattcttgggatgaattggttggcacaattccaaggagtagtggattgcgcgagacgcactgttactctgtaccgagggccagaacaaccggttgttttctttgcacctccaacctctgtcagaagttcagaactgcatcagataggtctgtcagaaatccccatagtcagagagttcggagacgtgtttccggaagaactacctggtatgccgcccaagcgagagattgagttccggatagatcttgctccaggaaccactcctctgcacaagcgaccctaccgtatggcagcaaatgaactggccgaagtaaagaaacagttggaagagttgaaagaaaaggggtacatccgtccgagtacttccccatggggtgctcctatgatttttgtagagaagaaagacaagacgaagaggatgtgcgtcgactacagagctctcaatgaagtcaccatcaaaaacaagtaccctcttccccggatcgatgatctgttcgatcagcttaaaggtgccactgtattctccaagatcgatctccgttccggatatcaccaattacgtattcgggaagaagatattccaaagaccgcattcaccacgcgatacgggctgtatgaattcacggtgatgtcgttcggtttgaccaatgctcctgccttcttcatgaacttaatgaacaaagtgttcatggaatacttggataagtttgttgtggttttcattgatgacattctaatatactcacaatcagaggaagaccatcagcaccatctccgtctggtgttgggaaagttgcgggaacatcaattgtatgccaaacttagcaagcgtgagttctggttgtccgaagtcaaattcttagggcacgtgatatctgctaaaggtgttgctgtggaccccgaaacagtgaccgccgtcaccgattggaagcaacccaagacagttactcaagtccgcagtttcttaggtttggcaggatactaccggagattcatcgagaacttctccaaaatcgctcgacccatgacacagttgttgaaaaaagaagagaaatttgtgtggagcccgcaatgcgagaaggcgttccaaactctcaaagaaaagctggtttcctcgccagtgttaatcttgccggatactcgcaaggatttcatggtgtactgtgatgcttcgcgccaaggattggggtgcgtgctcatgcaggacggtcatgtggtagcctatgcctcacgtcaactacgacctcatgaaggcaactaccctacacatgatttggagttagcagcggtgattcatgatctaaaaatctggcggcactatctcattgggaaccgctgtgaaatatatactgatcataagagtttgaaatacatcttcacccagtcagatctgaaccttcggcaaaggagatggttagaactcatcaaggattatgatgtgggaattcactatcatcctggtaaggccaacgtggttgccgacgctttaagtcgaaagagccattgcaacactcttaacgtccgtagcatcccacccgaacttaatcaacagatggaagccctgaacctaagcatagttagtcgtggatttttggccgcgttagaagccaagcccaccttgctcgatcaaatccgcgaggctcagaagaacgacccggacatgcatggactcctcaagaatatgaaacagggtaaagccgctggtttcacagaagaggaacacggaaccctatggaacggaaaccgggtatgcgttccagataacagagaacttaaacagctgatacttcaggaagctcacgagagcccttactccattcaccctggcagtacaaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggcggatatgattctatatgggtagttgtggatcgattaaccaaggtagctcgatttattcctgtgaagaccacctatggagggaacaagctagccgagctctacttcgctaggatcgtgagtctccatggtattcccaagaaaatcgtatctgataggggaagccaattcacctctcacttttggaagaaactccaagaagagctgggtactcgattgaatttcagcaccgcctatcacccgcagacagatggacagaccgagcgtctaaatcagatcctagaagatatgctccgcgcatgtgtcctagatttcgggaagacttgggataagagtctcccctatgccgagttctcctacaataacagctaccaagccagcatacaaatggcaccctatgaagcgttgtacgggcgcaaatgccggacaccgctattgtgggaccaagttggagaaagccaagtgttcgggactgatatcctgagagaagctgaagctaaagtcagaatcattcgggataatctaaaggtggcacagtctcggcagaaaagttatgcagataaccgtcgccgcgacctggaattcgcagtggatgactttgtgtatcttcgggtcacgccattgcgaggtgtgcacaggtttcagacaaaagggaagctcgcacctcggtatgtgggtcctttccgtatcattgctcggcgcggagaagtcgcttaccagttggagctgcccgcctccttgggcaacgtgcatgatgtgtttcatgtgtcgcaactcaagaaatgtcttcgagtgccatccgagcaggccgactcagagcaaattgaagttcgcgaagatttgacctatgtggagaggccagtgaaaatcctggacaccatggagcgcaggaccaggaaccgggtaatccgtttttgcaaggtccagtggagcaaccacgccgaagaagaagctacttgggagcgtgaagacgagctgaaggcagcccatcccgatctcttcgccagttcttccgaatctcggggtcgagattccgtttaaggggggtaggtttgtcgcgtcccaaatcgactctaaaattcatcctcgaaattgtgcaaagaataattaaaattcatgagaaagcctccaacaattaaaatgtgcaaagataaaagtcaaatgaggcttggaggatttttgtatattttctaaaagcctaaaatgcgtaaataaattttagtggaattttcagagcacaaataataatagaaaagaagtaaacaaagttaaaaaggttttataaaaagaaaaccctaaaagaagttctttttccccccccccttccctcttgggccggctcggcccacttccctctccctctctctctcctctcccgcggcccatcggctccccgcgcgcgcgcgcgccgctgacaggcgggcccgcccgccactctcgctgacgggtggggcccacctgtcatcgccttcctcccgccgcgtccgccgccgcgcccgtgccctagcgccgccgccgccgcggattccgccgcatcccgccttccccgcgcgccttaatgaggggggaattactccccgtgattccctctcccgtttcccccgatttcccctctctctctccctcggatccgtccggattcatcccgtaatcctcgccggcgacatctatggagcccgagatccccgcgcccgtttccttcctctccggccgcgttctccccctctcggtgctatataattgctccccgagctccgctcttccgtttccgccgctcgccgctcgctctcgccgtcggacccgtgctcgcgccgtgctcctctctctccgccgtcgccgccgagctccgtttcgccgccgacgtcgctccggtcctcctcccgactcggcgacacctccatccgcttcgccgtgttgccgccgaccccgtccgccgctccgcttcgcccgccgaccgccggagcaccgtcgtcatcgtcatcccgaaccgcgccgccgccttcctccgctccgttcgtcgtttccgtcgtcctcgtgtcccggggtgagccgaagaccgccgttcgctttcccccttctctccgctctctcgggcgccgctccgccgcgccgatggtcgccggcggtgaccatcggggcgcgggcgcgccgctcccgtcggccgtgccggcgaggccgccttcgggcgcgccctcgcggctgccaggtgggcccggccgtcagccgcccgcgcccgcgggtgcggctgacgcgcgggacccacggcgccgaccgccgccagccgcgtgcgcccggtccaccgtggaccgagcggctgacgcgtgggcccccacccccgtggacccggtccgcgcgtcccctccctcggctgacgcaataaatgggatttttaattaaaatttaaatgaagaaattcgcaaatatccatttaaagagcatataaacttcaaagggccatatcttggccatttgaactcggaattggaccgttcaagtctctaatttttccttaagatgtaaagaacccatttttgtgctttgtttctgctgttatgtggagttatttagtgtttaagccttttcttttccgttggtcgtgtagacgctgcagcttcggaagatccgctcttcgtggaagtcgaagccgtcgattgggaaggcgagcaaggcaagacacatcatcttgatcatattgaatcccattttataaaattatgttgatttaaattattgcattatcgctttatttaaattcccgcgttatcactgttttacttagccatgcctatttacctttgttatgaccatattattattgttattgttattattactaccttgttcaccctagacaaacaaaacctcaactagtggacactctactcatggtatccctagtataattttaggtagatgcttcgcaatctaattaggtaaccttaggtggttttacaactatagactttgggaaatattcatatcacctggatactctggaattgttgggttattgtggaattggcttcacaccgccccctctattcaaaatcccctaaattggttttaggctgggctcggggtgcatggttttgatggtagcacctcgtccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcgaatggcagagggttggtgccctgctgctaggggctcagtcctgcctgcctgtcccgggggttccggccgtaggtaggattgggtcggtactcttgtctaaggctaggatgggttggaaactatgtcacgtctttcgcccgtataccgtggtggtatgtggcacgtggtgacacgtgaggaagatgtgtcttgtgggtaaagatgtacacctctgatcagagtataatctattcgaatagccgagccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcataggccttgggttaaggcaggttcgtgtgggttcacggccttgattaataatattggatagttctaggatcgtgtttacaaaatggccttgagcaactaaatgtctttaaatgctgtttactgcaaccctaacccctttttggtataattcccttgtactcccttgcatttattctgcatttgtgggtgtgtcttgttgagtacggtggttgtactcagtcttgctcaattttccccaagcccagatgaggagttcctggaagatgaaggctttggtgtctagctcgtgcctgccgtcaagcgcctgtggtcgtcgccctagtcttccgctgtttctcgtttgtctttgtgtgttgggccttcgctgcccgtgtaataattttatatacgcttccgcttgttaaactctgaattgtatcaactttggtgtaccttgcctcctgggacaaggattaatgcacgcacgtcaggaacgcccgtcgggttatttccggtcgtgacaatttattctagcattattagtactgtacatctattactgtactaatggctcatttaccagcaaaagttttacgatattgttttatttaatcttgctgcaaaaaaaaataaatttagcatgttgattttataactttcttttatttcttttggaacctgatgttcaaaagtacaaaatttgtaaccttgtttccaactgtttcaacttatcttgcaagcttgttttactttatttacttacctttttactttgattttctaactttattcaaattaatccaaaaacttgtgctattaattggataaatgtcttaactccctcctttcacttgtctttagatgccgcgctacaagcctgagtacttgtttggtgttgaggggtttgtccaggagttgcgtacgatgtcctttgtcataggatttgggactgcccctttttatgcccagattcctcatgatcgtcacgaagaaaagtgccgagtcaaagtcaccctaaacagtaatagtgaagatatcccctcagtgatgttcgaagctggaggaagaaactacattcatgcatgtcaggaggtggcaaggatcgccataggagagctccgtgatcgctacagtgatcagttggccgacactgagtatcgctaccatccttgccaaccccagggaagtgaccgtggcagttaccttgagactgagggaattgagaatgatgctaccacaaggcatttggttgagatgctgtgggctatggatgaaacccgtgcggagattgtgttagcagctcaagatcgtgaagaccggaatcgtggtaagatttgcaagctagaggacaaagtggattgtttggagaaggaactagccgcattgaagggagaagcaccaccgcagaaggccaggattcgtcttaccgcaaggaagagagctctatttgtccctcgctaccaattggcgccaaaagtccgtgtggtggagaaagaagttaccccagccctagcggatcctccggtcatcaacataagtgatgattaagaagaagaatccaagcacactcattccaagatcgagtggggagcaactcaagatgatgaagacgagccgaacgagccttcaatcaactccgatgcccggaagaactagaagccttgtcaagccgttgtcttagat

SEQ ID NO: 62919 - DNA, 1911 bp, Oryza sativa
gttaagggattggtcatcaatccatacccttggataaatttcctataatagccaaccaaccctaagaatccccttagttgtctcaaatttttgggcactggccagtcttgcacagcctttaccttaccaaggtcagtagacacccctgccactccaattatgtgcccaaggtattcaagatgagacttagcaaatgaacacttgcttgcctttacatacaactcatgctgttgcagtaattgaaatacctccctgagatgactcacatggtcctccaatgtctgactgtaatcagaatatcatccccaaaaaccagtacacattttctgatcaaatgagcaaagattgtgttcattaacccttgaaaggttgctggggcatttgtcagaccaaaaggcatcactctgaactcatagtgcccatggtgagttctaaaagctctttttgcctcatcacattcagttaaccggatttgatggtatcctgatctcagatctaacttggtaaaccattttgctccagccaactcatctagaagctcatccacaactggcattgggtatttattcttttcagtaatgtcattcaatcccctataatcaatgcaaaatcttcaagaaccatccttctttttaaccagcaagactggagaggcaaatgggcttgaacttgactgaataattccctgattcagcatttgcacaacttgcttctcaatttcatccttctgttgaggtgaatacctgtatggtttcttatttactggtcttgcaccaggaatcaaaggtatattgtgatcaaagtccctgtgtggtggtaagctggtgggctcctgaaaccttgctacaaactcagttaaaacttctgtcacttgagggggtacactatctgattctgctgcatctttttttacaacacacaactgaaccatccgtgatacagctcctgatttaaccaacccagaaagttgttttgcattcaccaacttgtagtgttccaccctatccttaactcctgtcagggtaacccttttatcctggagattgaacctacgcttctttctcttccagtctatccacataggactgaattgctctaaccactccattcccagaattatatcatatccaccaagggccagcaccttgagatcagtaacaaaactgctcccttgacaccaccactcaacccccttcacacaactgttgcactgcattcttcccccatcagctatggtgtgagctgcaatttctgtaccaaatgttcagctatgaaattcctgaactgcctgagtccaccaatatcagtactcctatttgttgattaaaccttgcagcctgattgtttttcttcccatggtaccatgcacaacacattcaaataggaccagctcctcctcacttgtatcctcttcatcctgattagagtctgactcttcttcctgcacctggaacacctcaagtaattcttctactacatgcaattgtactgcctttggacacttatgttttggtccccactttctcaccacatttgaaacattcacctctagcctttctagctgccttgagggattcaaatctatcttcccatttagatttctcctcagtttgcttcccatcttctaaattagtacccaatatacccttgcccatatgagttgatttcattgcaggcttaaaagagtctctgaaactgccccctagagtagcttttcttaccagcttcttcaagcaattcctcctgtgtttgagccagagaaagagcagcatcaactgttctaggtttatgcaacttaatagcaagcttaatgtcagctttcaaaccacctacaaacctagtaacaaagaaggtttcatcataacccctattgtacaccaacactaaatgcatcaactcctcaaacttatt

SEQ ID NO: 62920 - DNA, 549 bp, Oryza sativa
attggtcgtgtcatttctgcgttcttgatccattcattgataagtctgattctcgacatcgtctaattgaatgatcgtttgtttttatgtcgattcttctccagtttgtgttcattctctgcaagaggttagtaatcctagtgctagtgaaatatttattattttgacataattatgcattgcaagcataactagttctcctttatttaggtagtattgacgggcgaaactgatcgctaacgaccatcagcacccgtcacactgagcaatcacagaaccacaatctagaataactagctttatacctgccaaagttggatgcgaccaagtggtgaaggtgagaacgatccgaagccttctagactccgacctgtcaaaccgtgcaatcacagaaccacaatccgggactaatccacacaagaggcccgatagccaaaagcacaaactaggggcaccagaggagccttctcataagtccaaaaggactcacaagaacaaaggggtaagacacttatgcagtcttcagcaatctctcatacataaggtttt

SEQ ID NO: 62921 - DNA, 1808 bp, Oryza sativa
aatgggttcattaatgttcaagttgcttaggcaaataaaataagacgggctccgacatagttacaccacacaccggtgtaaccatgccccacacaactcaaaaagacaaacgaggaaaaacacacgcgcaagcctactaactgctcgtctaccgctgcgacgggccaggacggaaggtgagcaacagcgcaccctccgagctaccaacgccggaggcttccccctcctggggaaccacgggcgcaggctcggcacgaggggtctcgacgaagcaggtccacgccagggactgacgaacaagctcgggcctggaggtgctcttgcgggcggtgatcttctggctgcggcagacgcggcgacgcttggggcggctgtcctctccctgggcgatcttgagctgatgcagctgcgcctccaacgcgtcgaggtccttcttgagctgcagattctcctgacgcagctccaggatcttcaggttgttctccaccatgccacggcgcaccatctgatggaagtcgatacgagccgcgtcgtacgcctccaccatgcgtgccaggtgcacgacggtggcgtcatcctccgagctggcgtctcggaaggtggcgtagtcgcgggctcctccgcgacgagggtggtagcggtagggcgagtgctgcaactcgtccgggtagcgctggtgaagggtgccgatggcgaggagagcggcgttctggcaagcggcggggaaggaatctccacccgcggtgactgccagcgaagtccgctcgggagagccggagaggatcactgcagtgacctcccaaccagcgtgaggctctgcatcctcaccctcctgctccgggagcggcctggcctggtaatccactccatgtggataccccaagaccacgcacatgccccgcagctccaagacgaagccagtcatgctcaaaccacgacgggtgacgctgccggccatctacaaacaaaaacaaaaaggaaaacaacatttaaaagatcagattttgacgataaatgaagcagcaagacagagagagactagacaattttcacaagtaacaaaggatttttatttttgaaaatattgctaaggcttgggatctacggctcgtcctagggtcaagggaggctctgataccaacttgtcacgaccggaaatcacccaacaggcgttcctgacgtgcgtgcattattccttgtcccaggaggcaaggtacaccaaaagttgatacaattcagagtttatcaagcggaagcgtatataaaattattacacgggcagcgaaggcccaacacacaaagacaaacgagaaacagcggaagactagggcgacgaccacaggcgcttgacggcaggcacgagctagacaccaaagccttcatcttccaggaactcctcatctgggcttggggaaaattgagcaagactgagtacaaccaccgtactcaacaagacacacccacaaatgcagaataaatgcaagggagtacaagggaattataccataaaggggttagggttgcagtaaacagcatttaaagacatttagttgctcaaggccattttgtaaacacgatcctagaactatccaatattattaatcaaggccgtgaacccacacgaacctgccttaacccaaggcctatgatgattcagaccgaactggcaacccgaccctgggtcccagctagtcccaagccaacccaggccaaccattccacattttagttgttaagcaggttttaagaattaaaacactaacttgggtacattggtcggcttgcccataaccgaagggttcggctat

SEQ ID NO: 62922 - DNA, 21413 bp, Oryza sativa
gcaatatatcatagcagctggtatgatttgaacaaatttgctaacaaaccctgaactgtaaaaagtcttatgttgtctgacttccttgaaatgtcttcagggaagtttttgttcagtcgattattatttggtggctaaagcagatttcaaaaacctaatggcctattggattgaatagatctccactgttttctttgatgatgtttcagattgctgtgctggcagatgatatcttgaaaaatgttgagtatgatgctctaagggttgtttttaacaagttccactcggtcatatcattcaagcccacaatgacaaccatactttccccagaggtaaatatcggtgctgaggacatgaatttgtgctcctataaagtaatatgaatgatgtgacgttaatactagtggtttgaattgttttataggttatggagaaagaatcggaatctggtaaggttggtgacctggattcatatgaaattgaaggaggtgaaactaaatcagaaattcttcagaatcttaccgagttccagttttcttgtgtaagtttgtcttcattaatcatatatacctctcaatagatgaattagctacaactattacagccacaaaatcaagtcgcatccataagggtaaacgttccctttgtagagagcgcaatcattcttttttcaaggtatcctagtggtatcttatgtttttgctttgtggcaggttatgtataatgctgctctagagaatgcatgcagtgagcttggagcacgtatgtctgccatggacagctccagcagaaacgctggtgaaatgcttgatcgactcaccctcacatacaacaggtatggtcgtcttaccttctccatctgtttatgtgtgtcgactgcataacggtcggaaatggtcggaaacggtatcattattttattattttctcgaaacgaacggaaacggtcgggaaatttccatatttatgaatttatctatttagtgtcaacttcaatgccacgccgacataaattaaaaaaactaaattttgaatacggtaaccatcggttaaaatattattattatattagttttgcggaaatggtatcggtacggtcgggaaatttccataccgttttcacccctattcacatgaaagaactgatacattcgatttcatccccgcaggacacgtcaagcatctatcactacagagctcattgagattatctctggcgcttctgcccttgagggataatgatgaaacttttgcccatctttttttgttttgctgttcgaaaaaagttcacttgtcatatggagcagcctttccctcgagtggatcctcatgctaagttgcaataattagcccagttacgtgacggtgctatgcatatatcagaaatgcttgttccagtcatccttgtttatctgaatggcgacgtattttaaacaatcttttacagctgtgttcattttgcataaatgattgatcactgttctgcgttgaatttatctagagctttctcttttcttttttttttttgtgtccgcaaccattcatcggtatatcccgctcattacacaaattcacttatctatctgtttggtcagactgaatcgatttgtttagttggtcagactgaatcgatctgcttggttggtcagactgaatcgatctttttggttgggattcgtcatgtttgagatggtgggattcatctttggcgaatccctccccattgggagggataatgttaacggcgctgcttcctctctattcttcagcaattcgcccttcggctgcttgtgttggctgagagcctggactgcagttggcaggctttgggctctcaatcctccgtaattgctagttcgtgaccagtcgtgcgccagcccgcgcccgtgatcaccacttttatcattttgcctagatgagtttttgtcaatccatctatttcattctaggtatcttaatgtgtggctgaatctataatttatgcttgaaccacaatactaggtatgacttgtcccttaactcctaaagccagtgcaagtaagatcgcaaggtggtttagacggtgggttttactgacgtggtgcctacatgacgttgatgtgccaccaacatgatgacgttcacatggcacgttaaaagtaaaaaaaaaacatgggatccacatgtgagtgagtgtttgattaaaaataaaaaaattatagtagaaccctcatcttcacccctctccccttctctctcccttcgcttctctcttatctttgctctcttttgttggcaacattttgtgacaagtcgacaagtacgatcgcagcacctaaacgccttgcggtgatcctagagtcgtcaaccacttcgatctagccaaagggccaaattaagatgggttttggagaaaaacagctaaatcggttagcggagccgatttagagatcaaaatcagcctctaggccgatttagatcgatatgaggataactacccgtctcgtgggcgaaacggaaggtttccagtacaaacctacaaagaggtatcgcactctcgcagcggtggcggacggtttacggtgcaaaccgacaaagatggactaaactagggtaaatagaaaacatagtaaaagaacgattcaagtagattgtattcgggggttttacaatgaaccggccttgtcccttaaataggggttggtcttgccctctacaggcccttctccatgttcaactcgggatagaaactaaaggaaacacgaaacatgccttcccgagcaaggaaacccgagacccgacgaaaacagactcagactcggaccctgccggtctgaccgcccacatacctacggtcagaccggttctactagccggtcagaccgcccatatacgtgcggtttgaccggccctgtgaaggaaacccggtactttccaaactttggcaattttcccctatttcgtccataggtgccaaatttgggtgtaaacatctttctcctctcttctctctgctctctttctcttctctcagagcgtctattctctctcagagcgtaagcacggtggagctcgggggcagccatggatagtgttgatggaaaaaaacacactggcctgaaagagttgcttcactctagtgcatgtccaaatcttgctttcgagttcaatgcatgcagttggtttttatcctgcaaccaacaagaacagaataaaacagttaaatctgtaaatgatagtcgataagctagaaagcttatgacctatcgtctttaacctagccgatgctatcaggtatagtcacaaaagaatatgaacaaaccctaagtatgtcgtatcggctgtaaaggcaaacaatcatataatctctaaatcaatcttatctaaattatagacaaactgtatagatcggacctaaccgagacagtatggacttagagattagatatgtttatatctgttgtcgaatagacaactgcgtcacgtcgaaaggcgtggttctctcaacagtggttggaagtaagaacaattgtattacttagtgaaaatttttttggatcccccccattacatggtcttagggggctatttataatcctattacaggctccccttttagggtttaggttttacaggggaatttccatggttacccttatgataaggacattattaggggcacacaatgtcttttacatgtatagatattgggccataaatggcttggcccatctatttgctgaagtctcccgagggctcggcggtccgctgggcctcctggcgatgaggttcggtaccttggcgaaacccgtgcctctgtgccgaggcttttgcctcttcatctttgcccatgcggccctccgacatggtctccgcttggcgaagttgacgtattcctagctacggctttcgccatgcgcccttcgcccgttgtggttgtcttcctgaccttcgccatttgtctccggtccgggcttgtcgcctaagctcttggtttcggtggttccggccgaagggccccgtggtgtacctccaacaagcccctcacgggcaagggtgagtagggagtttcggccgagatcgtgcacaccatgttggtataccgcggggcgcctcatttcggccgatgttcctaccgaaacctgtcttctattctgcataaaataatatttcgatttggttgtcttggttttcatgcttgtgaacagtgttgggcttattgggccgaccgtttgcaatcttcggccattcactgtttcggcccgcactgatgggaaattactgttccatacactcctggcttacgtggcgggttttgattgggtggtaggcgaatcgccttgcgggtgagctatatataccccctcccattgctttcacttttactttcacccttagttatttttgccgttttccctgccgcccagaccgtctctctgcgcttaagagttttcgacttttaccccagcttgccaacccttaggttactctaggctcctgcgctatcctttcatggctcttcttcaaccaacggccctgacccgggaaaggtcggtgaagaccactccggatacctaggtgcctcgctcattgatgaggcggatttgacaaagcttgcctcggccagggttgtggcgagcggtcaggtcttcgcatctgccaaggctgttgtgccgaagcccggcaagaatcagaccgtggtctttgttgcctttttcgacgcagggcttcgttttccgtgcacctccctgttgccggaaatacttcatcttttcgacgtcgagtttccccaactcagcccttccgccctggttcggatcaatatcttcgactgggcatgccgaactgccggtttcgagccgaccgccgagctgtttggggcgattttctacgccattgtcaactcgaagacggtgactaccccagctggcactcagaaaaccgtcttcggaagtgcgaacttcaacattcgcccggagcgctctgacatatggccagtgaacgcgtccatgcccaagtgggatcggcactggatgtcgaaatggttctacctgttgatgcaaaaacacgaggcctagaagatctgcttaactttagtgcaggtccaaaaatcttgccttttaagttcgtgagcatgccagttgatttgatcctgcaatcaataagaaataaagacaaataaaccgcggttaaatccataaatgatagctgatcggctaattgccgatgacatatcatttatctctgagccaatgtcatatttgaatcgattggcagaggtaaataagtaagaaaggactaaatctattcgatcggctgtagatattaacaatatataatccttatgtcgatacatacttaaatcaagtgattgggatagatcggacgtcatgccgagacagtataaatcatttagatcgaaatatatattaacaatgagattatagatgctcatagcatagccgatcagatagatcagcatgtatcggctaatactccgataccactctatattaagatattaatgcaagtaaattatatcaagaaagaagtgtaatatacctagatgcaacaagatcttaacataaagggcggatctagcatgtcaattaagcacataaaatataaggctaaatcaggtaagaccggctgaaaccccgatactactctaatcggcaatctaatcggcaaccaagaagcaggctagagattaagattctaatcacgacttataaggtcaaactcatctgatgcagctataagtataaaaagaagaacaatatctagacaatcaagccatttgatgtttcatagagtggtggatatcctatataatctaagccaacgttgctacttaacctaatcggctgccttgcaatgatagatgttagccgattgaaggttaaataacgatattgtcgaagattatacagaatatatgataactcgatgaattacataaacaagattagagtatcatgaagatggaagcactaatcccgagaacgcaagccgccataacaagttttacctctagttgaagatcgaaaccaatgcagctcaacccgaaagcaagaactcgtcgaaacaaaacgaaagtaaaagggtggcgatgcgccaagattgtattgaacgtctgttgtttattacatggggctcggggtctatttatacccgagattaccatgtcggacacgactcttatctctaacaaactctaagataccataagtgtttgcgacagacttttgcccaaacatatctctaaggaaattacatgaaatatcctaattaatagatacaattgccttctcaggactcaatccgtgcatggcaatcctcatgaagcacattaactcaacccgacaacgtgtaccgcgtcacattttcggactcgggtcaatcggctaaccctatccaactcggattctgccaatcccggtcgcagccgattcagactttagccgatccttgctctgttttcggaacgatttccatcttggattccgcctcagttttatctccatctccgatattgaaattaccaagtttggttgttaacacatgccctcaagtccggaatatttggtaatgtttcggatttgccatatccgttcctccaagaatatctctcattgccgtttttccgaccgttatcgcctcgctttaaatactaaccgttgtccccgagaaatttcacaccgttagctccgttttcactgcttaagccaactttgtcttctctctctccggcgatcccctcggcgcaccaggcgatcccaaggcgatttcctctccggccaatcttccgcccgcagagatgtcgtcatccgccagtccgtccgtcgcgccatccgccgaatatgcagaggtaagtatccatcggctagatcctctcctccgccagtccgttcttccttgcctcatcttgtttccttcttctctattcttgtttacatctgtagcacttgtccaatctggtcgcgaccccaagtttgtcacatgagcatcactattttcttggttcgatcggcaatcttgatcccactgagttcatcatcgccgaaaccaataggatcccttttagattggccaacccaaatctaggtcactggaagaataccttcaaatcttggccttctcttgacaaaacttctcctgagaaaagttgggctatgtggtataagcgcgtatcggctagcaagcaagttcactgggacgaattaggaatcggccaagcgcttgctcttactctagcaaattcggccaaggatgaacccctgatggcctccgcagcatacttttggtccaacacccttaaagctttcttgttcaaccaaggccgatgaccccaactctgctcgacatcactatgattactggattagatgtgacttcatcggctaatcctatgagcctgaacaccaaaaaccaatttgacttcaggaccaagagcataggtggctggtctggctatgtagcagcatacatgggcaaaggatctgtcaccccccgagagcacactgcctttctcttgatgtggctcgagaagtttttgttctgtggatcaagttgcggccttaccaccaactggcagttcttagctgaagcccttgaaaccaagagacaattcccattgggcaaaatccttctcgactatctatatcagatgttgagcaacgcatcggctaagatagttacaggctcagtattaagtgcaggtggaccatggaggctgctgcaaacatggctcaaacttgtcatcatgaaggttgtgaatcggccacctttgatagacgcagaattcccaaggctggagctgatcacaggtgatgatggagaggaactcactcaccgccgatgcatgtcatatggagaagctgcatcgacaccagccgattttggagcaaagctatcggcctaactgctcaaagactggttctgcagtttctatgagggcttccaaagagatgctcgagtctggtttccatatgaggactcagtaaactttgatctcccagcagacttcaaatttgaagacatcaactctgaaaaatttcaaaaatctagagaagtcttctcggctgctattagtccatgcatccttcctgttggcatccaccaaggaagaaatatacaagtgtcctatgagttctatcatccaatgagctcagctaggaaatctggaatgggacagttaccaatcggcttgttctttaccgataagattcagtgcagtggagaaatctcatcaacattgatgatggatctgctgctcaacatcccaggacctcccttggccagtatcgagaacatagaactggcaaggttcaggagcaagaactttgatagatggtggggtgaatggaagcaacacatattccatcagtcggcctctatttacatgacagatttgtttccagatgttgtcccccaggtacattttactttgtcaattctgtttgaaccattgttagccaattcatattttgactaatctccttctttactttgcagacaacaaaatcttcccctcctcgcacaagcaacaggggcaaggacatagaatatgctccaggccttctaccaaatggaggtgaattagctccccctgtcatcagctaccatgcccccaggacctcaagtctgcttcaagggcagatgagataaccggccgatgtaggcaggaagaggaaaaccaaagcatcggctattgatccatcggctctggctcccaagaagaagaccaagaagaataaacccaagccagccgatgacttgcctaccttagatccatctatcgagcaagccttggatgaagaagaaatcggggaagatttcgatcaggcagcagccgaactgagtgatgcaggagaaaaaacaccatcggcttcgcccaaacaaactcctccaaatccagctgctccagctcacttttcaagggtaaaccacttgccttgattactttttgtaatcatttcatttatagcagatcactcataaatcttgcatttgtagaaaaagaagactgctgtgaagaagaaatcggcaacaacaacacttaaaccagctccaccagtaagattttcctatacaaatcctttaactcatctaatcatagctgatatttacttaacacttgtctttttgcagcctccttctcctccttcaccacctgtgtagcaaatgtcaagtgaccgtaccccatcggctacagcaagtcacaatatcgaggaagaagaacaaccaaccgctcctgctatcccagtaagtctctctttatcataagatcttagatcggttgaatttgtttaatatttaacaatcttcaaatttctcttttgcaggttttagccgatctattctcctttgacatcaaggattactttgatgaagaagcagaagaagaaaccacaagcaaggctctagcccctctagatgaaactttcaagaaaacacttgaagatatatcccttcggttagagtcatcattagataatctggtggccgactatggttcaattcgggctcgatttgcaaaaatccaagccctaatcccagatgatctggcaaacaccatcactccagcggtgtaccttgagcaacatcaattcaagctggagaaggctaagcaacggatagccgatcggcgggagcggaaggacattaaagccactatccaagccaatcggcagcttgtgcatgaagaaaaagccaaacttgattagctctctgttgggccgattcagtctaacatagattggcttgaagcccgcaagattgatctaatagctcaacttgaagaatgcaatgccgagctggatttggagaagcaaaagttagccaatcttccaaatgctgtcgaagaacaaaaatccagacttaaatcagctatcaagaatgtggctgatatgaccaagtcctttaaggccatctttgcaaccgatgcccaagacattcaagctattgaagaagtagatcaaattagacaacgggctgtatcagctatccagcgttacctatctgcatgattggtcttgtaataggtcttagaacaatttttgtaatcggctactgaaactttgatatccctcaatataatttctctgtaccgatcaacataacttttaaatttgctcaaaaatttgcaaatttgtatatatgtgcacgctaattttgcaatgacaaggcattgataaaattataatttggactaaggtcgatataaccatatcggccattgtatatcggcaaaacacaaccgattacaacaagaaaataactaaaggcgatataaccatatcggccattgtatatcggcaaaacacaactgattacaacaagaaaataactaagggcgatataaccatatcggccatctcaaggcgatgtaaatacatcggctatcatgtatcggcaacatccaaccgatcatgtatgaacccaaacacttgggtaacatttcttcaagtatttgccgtttagcgctcgtccataaacttctctataagctcccttggacacaaccttatggatttggaacggtccttcccaattcggtgaccacttgccgaatttgttatctcgagtccctattggcaaaatcaatttccaaacaagttcaccttctgaaaaagacttgggcactacttttttgttgtaatgtcgagcaatcctctccttatctttggtaacttttgcaagagctcttaatctcgattgaaccaaatcttctttttcatcggccataaggttataatactcatcggctgtcaactggtcatgcaaatccattcttcttgagccgattctaacttcccaaggtaacactgcctcatgcccataaacaagcttataaggaggaacctgaatcggtccatgacaagccatccgataggactacaatgcttcggccaacctattgtgccattgccgaggataatcagaaatctttttcttaatcaacttaatcaaactcttgttagatgcctcggcttgcccattagcttgtgcataatatggcgaataattcaacaatttgatacccatgctatcggcaaactgaacaaactcatcggacacgaagatcgagacttgatcggttgtaatggtctgaggaataccaaatcaataaataatatgctcttgaacaaattgtatagcatcccccgaatcaactttcttcaaaggaatcgcctctatccacttggtaaagtaatcggttgccaccaatataaacttgtgtcctttgctcgatggtggattaatcataccgatcatatcaattccccaagctctgaatggccacggtttgatgatagggttcatagctgatgctggtgctctctgaattgctccaaacttctgacaatcttgacatcctttgtaatatttgaaacaatcttccaacattatcggccaaaaatatcctgcccgcctaagagaccacttcatattatgagccgattgatttgtgccacaaattccttcatgtacctctcctatcgcaaccttggcttgatcggcactcaaacatttaagcaacaccccatcaatcgtccgataatacaattcatcatccaacaaggtgtatttcaaagctttatagcgcaattttcgtgaagccgattgagatggattctgcaaatattgaaaaacatcatatctccaatcatcggcggttatcgtagcaacttctactttgacatccttcatcatcggcttgaaccccaatgctccttgagccaagtccattagcttcaacgttttgctctcgagacacatgctgcaaagtcaccagccgaaatccattcatcaattcttggcacttctcattgtaaaccattaatgtatcattcttgcactcatattccccggccaattgacagatcaccaacaaggaatcacccataatctcgatagcatcagcttcaacttccttgagcaattgcaaccctttgagaactgcttcatactcagcttgattgttagttgcatcaggcttaatagtataggcaaactcgaaacttgcccccagaggagaaattataaccaagccgataccacaaccatgagtacacactgatccatcaaaaaacaaagaccaaggtacaatttcaaccgagccgattgagtcatcacgatgatcaacaataaaatcggctatagcctgccctttaatcgccttcggtgattcataccgaagatcaaattctgtcaaagcaaatatccactttccaacccttcatttcagaatcggagccgatagcatatacttaactacatcggctttacatatcacagtgcattcattggacaatagataatgccttaaccttgtgcaggagaaatataagcacaaacacaaattttcaataggagaataccttgtctctgcatccaaaagccgacggctcaaataaaacacaactctctctttctcttcaagctcccgaatcaagactgagccgattgacttctcaccagccgatagatataatctaaaagccatccccttttgtggaggaatcgaaactggaggagagctaagatattccttaatactatcgaaagccttctgctgctctgctccccaagtatattcttgatcggccttcaatctcaacaatggtgtaaaaggttctaatcttccagacaaattagatataaaccttctaacaaaatttatcttgccgatcaactcctgcaactctgttttgtcctccggtggttgaatcttcttaattgcattaacactcatctgagttatctcaatccccctttcatgaacaagaaatcccaaaaactgaccagctgatacgccaaaagcacactttatcgggttcatcttcaggccatactttctagttttctcaaaaacttttctcaaatcggctatgtgattctcaatttcttttgacttaaccaccacgtcatctatataaacttcaaccaaccagccgatcagatcatggaatatataattcatggccctttgatatgtagccccagcactcttcaagccaaaagtcattacaacccactcaaacaagccgattgcaccaggacatctaaaagctgtcatatgaatatcttcctctgccataaagatttgattgtaaccagcattaccatccataaaactcaatatctcatgtcctgaggcagcattaaccaactgatcggcaaccggcattgggtactcatcctttcgagtagccttgtttaagtctcggaaatcaatgcacactctgactttgccatttttcttgataaccggaactatgttggaaacccactcagcatatcggtatggatgaataaacccagcatcatacaaacgtttaacctctgccttgacaggttcgagcatataggctttgcatctcctcggcggctgctgatatggtctaacccccggtttgacagggagccgacattcaacaatcgatcggctgagtcctggcatctcgtaatactcctaagcgaagcaatctccaaattcttttaacaactctaacatggttctaaattccggagataaattcttactgatgaatgtcggtcttggtctatcgcctggacctatatcaatttcttccaaatcatcaatcgacataaaaccttgtccttgtttgtcatcgagatcatctaccgtgtccttggtgtagacatttgaaccctccatgatgccctaaaaacaataatttgggctctccatcttcaattggttgtatatcacaaccggacacttttagaaaatctcaatcccaaacctttccagacaagcaatcaataccgtccatatcccaaagagctaaatcggcactggcaacgttaactgacctgtctactggcacgatctcaatcttgttgccttgccattgaatcaagcattgatgcatggttgtcacgtcctgataaatgcatcccaaaataaaaatcatcttctaaaaggaataatagaattaattaaaattcgaaaagaaattggcaaacactaaaatacgtacaagaaaaattcaaatgtggcccggagaatttttgttaaattctccttggtccaaaaggagccctcaaattttagtggaattttcaagagcacaaataataattattaagaaataaacaaagttgaaaagattttataaaaagaaaaaccctaaaagaagtcttctttcccccccttcccttcttgggccggctcggcccaactctccctccctctctctcctctcccccgcggcccatcggcctcccccgcgcgagcgccgctgacaggcgggcccgcccgccaccctcgctgacgggtgggacccacctgtcatcgcctacctcccgccgcgcccgccgcccgcccgtgccctagcgccgccgccgccgcgaatctcgccgtttcccgccgtccccgcgcgcaataaagagggggaaatcacccccgtgattccctctcccgtttccccctcttttccctctctccctccctcggattcgtccgatttgaaacccgcaatcgtcgccggcgtcttcaatggagccgagatctccgcggccgattcctctctctccggccgcgctttccccctcccggtgctatataatcgtcccccgcgcttcgctcttccgtttccgccgctcgccgctcgctctcgccgtcggattcgtgctcgcgccgtcctcctctctctccgacgtcgccgccgagctccggttcaccgccgtcgccgctccggacttcctcccgactcggcgtcacctccatcggcttcgccgcgtcgtcgtcgacctcgcccgctccttcgtttcgcccgccgaccgccggagcaccgtcgccctcgtcatcccgaaccgcgccgccgcgttcctccgctccgttcgtcgtctccgccgtcctcgtgtctcggggtgagctgtggaccgtccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgtcctcgcggctgccaagtgggcccggccgttagccgcccgcgcccgcgggtgcggctgacgcgtgggacccacggcgccgaccgccgccagctgcgtgctcccggtccaccgtggaccgagaggctgacgcgtgggccccactcccgtggacccggtccgcgcgccctctccctcggctgacgcaataaatgggtttttaattaaaatttaaatgaagaaattcgtaaatatccatttaaagagcatataaacttcaaatggccataacttggccatttgaactcggaattggaccgttcaagtctctaatttttccttaagaagtcaagaacccatttttgtgctttgttcctgcttgttgtatggagtttattagagtaaaagccttttcttttccgttggtcgtgtagacgctgcagcttcggaagatccgctctttgtggaagttgaagccggcgtttgggaaagcgagcaaggcaagtcacatcatccttgaacatattgaatcccagtttgtaaaattatgttgatttaaattattgcattatcgctttatttaaattcccgcgttatcactgttttatctagccatacctatttacctttgttatgaccttattattattgctattgttattattaccttgtccaccctagaataaacaaaaccctaactagtggacattatattcatggttccactagtataaatctaggtagatgcttcgctgattaattaggcaacattaggtggttttataactttagactttgggaattctcataacatttggacactgtggaatggttggcttgtgatggaattgaacacacacctcccccctctattcaaaactcccaaaatggttttaggctgggctcgaggtgcagggttttgctagtagcacctcggccactataaggaccggtcttcgggcctctgttgcaaagcactaccgtactaaccacatgtctaatgggtaaggcttaactcggtgctcagtctagtcctgaacaaaatgacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatgtttacaacgggttccaaggccatggaatgcggagtaaagatgtgtcttgtgggtaaagatgtacacctctgatcagagtaaatctattcgaatagccgagccctcggatatgggcaagccgagcaatgtacccaagttagtggtttaattcttaaaatttgcttaacaactaaaatgtggaaaggttggcctgggttggcttgggacgagctgggacccaggtcgggttgccagttcggtctgaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattattcccttgtacctcccttgcattaatcatgcatctgccggtgtggcttgctgagtactgtggttgtactcattcttgctcaatcttttcccccttcagtaagagaagctttggagaagatgtcttaggtggagtcctggcttataccccagttgagcgcctgtgaagatggagccgtaggccgctagtccgctgctgtttatttttgattgtcaggccttaagcgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacccaaggacatattttataaataaaaattatttgcgaaagttcctttttctccttcccctaatgctatttgcaaaaggtttactccgttcttccttcttcggattttcaactagtactagatggtcaggtcagtgaagaagaggacatcgtcagttgtttgccgaagctccagaagactgcaggatctgctagtgaagtggaggaagcagtgaagccagctgtgaagcaggagtgaagatcttggagaacccgtcgcagaacctaagccaccctctagggtagagtcgttagtcgtgtgtttccttgtttgtgtgtgtagcgcgtggtttgcatcagtggggtgtgatgtaaccatgctaggttgtttgcttaatcaacttgcagaataagcctaacatatatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaacaaattgcttatagagatactacagcagcatcggatgccaattttgaacccgagtcagatgcaacctcaagtgcagttggaggcagtccaagcactcacaccacaagtcagcgcaccgccaacatcccagaaggcccctcatgccatgccgcatgttgacccaaaagaagcaagtatcatctgttttatgtgtgatgagcaagggcactacgcaaggaactgtcctcagcagaaaagaaaagcaccaatgcgaaccgaggatgaagtccgtaagatgatcattaccagcacagaatggcctccaccaggaatgacaaaacatcagagaagaaattccttccgaggtgcacaacagttgacagagcatcttttagctaatggaggtagagtgtctggtagtgaagattcagatcaagtctcctcagatgatgaagatgagaagtctccccaaggttttaaccagaataaaatagaacttaaggcatgctctcgttgtggagaaatcggtcatgttgccagctcgtgtgcctctacatgcgttcattgtgaggaagaccatccgcccgacaggtgtccaacgaacaagatcacttatttcttttgtgaaggaactgatcatgtaccaaaagattgtcaattcagttttctgctgacgaagaagatggccaaccaacccgccagttccaacggagagaagcatcaaggcaacacaaatccccgccaagatcaccgtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgctcctcaacgaattgtcatccatgcatcccgaagcagtcctatagcccgcgttgcaacagctccaattccaatgaatgcactaccacaaggtgtcaatgctcaatttcagccccagccaccagctgacaagacaggggccagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgactcggcaataaatcatagcaaccactctctgcatcgacagcctcagcaaagaattgtcgtagatggaagaagttgtgtctctccccgacctactccaggccgagccaagggcaatcaacctccggagggcgataccaagcagaagaccgtcatccgcttcaaccagcaatcagaaggaagcttctcctgtgaatgatagcattatgcagtcctatcacatcatcacagaaccaatcaaggatgcagtcactagaacaatgccagctatatctctccagaatcaaaatgagcagccatgtttgtggttttcagttcgctacttatcatggtgtaatcgaaagtttgcagcaatcatgtaattcataaatataatcatgtctgtaaacagtgagcttgctatgtttagagatgattcatgttgaggatacaatgtaccgatgttaagcaccgtccctttttgtttaaggcagtgcctcgtattcatgtaatgagggagaaatgtgtaatacagacaagttccatgaggattcgtttgaaagatgcggatatgtgatcatgtgtataattgtttactgacaaaggagacctagggtctcgtgtcagaggaactatattctaacctcgagttaataaccaacctgtggatggaaaagaaaaacaattaaactgtgttgggttaaaaagccaacgagacagtagttgaggataggagtttggatacgccttttacagatcaagataaggattgttggaggaaacccctaagggtacccgccatgcctctacattgataagatcggatatacctgccaacagttaaggagatccaggagacatcaatgtttgagaacataatagtcgatggttggtaattagtttatctggtatcagaaaaaggtcaaaggtgatgtggcagaagaacaatttggatgctccccatctcgaggaagcactaaagatgaccatcggcaattaaaccctagtggtatagatacagatagcaggcaatgtatttccctgaaggtagtcagtgcagcttttgacgaaccacatcaaggtttcaccgaaaggcagcaagccaaaggacctcatcgtccccagaagcgtccgcaatccacattaaagaataccacctgttagagataagccgaaagatgattgataaaagagattggcaaagatgttctctagcataaaagaagtaggccgaaaggtgattgataaacagaaacatgctctgcatcgctcaaggaagacccctgattgtaattgccccgcaacagtcaccttgtcattaagtaagcaagatgacctaggtaaaagtgtttctatgaaggcaaggaatgaaatcttcaactcggtatcagatgctacacgaagtgaaaagtgcaagcaccggttaccaggtaatgccaagtcttgggagatgatccaatgggaaagaacacatcaaggttaaaggtgtaaaggaatacgttgaatgctaactgaggacaacctgaagacaataatgggaagtaaactgaatgtaaagaaagtgaatccgagctgcttgttcgtgagagccattcccagttatagaaccagtgatatgttcgaagatagtctatagaggtcagattaaaatcacctctcacaacgaagcctcagatttgacagggtaatgattagacaataacaaatccagcaataaagccatgggagaagacgtcaaagtatgtcaagtgggataaattggttctcttgggaagcataacttatagttagagtggttgacccttgcatcgaatagccgaagtacctagcaccggagaccaggaaagctaatatgagacagttgatggcaagttagaagtgaatgacaagcatgatattcttatgatgacaaacatagtatcctagtaatgacaagctagtgttgacgcatgacgtgaagtggtaacttgtctgaggttgactccgaagatatgaatcatgagaagttctggaacggaagcatcactgcactaccgcaacctagtctgagtcagccaaaaggtgcaccctggtccaagtcaggtgaagaggagattccacccgcaacaggaggtcaagccaagcagttccgagtggtgaagttttgctggaagtttgtcaagacgcaacggaagaagtcaaacaagaagagaagaccgcccaacctatcttcttggtagcctcctcgaatctcggggacgagatttttgtaaggggggtggatttgtcacgtcctgataaa

SEQ ID NO: 62923 - DNA, 12196 bp, Oryza sativa
agagaaacaaaacaatatagttcatcccactggtggaatttgggtattgcggggtaatattaattcctctaatgttcttcagtgtagctctgaataattcgtgttcctaggttgttacaattggagaagtttcgaattttctcaacatgtagaacatcggatcttgattaattacttctgaatggaatacttggccccttttggttcagttgttctgaatggaaatcagattctatcaacctaatcagttgtttaagagcaacagagccaagcgtgagcaccatcagaatgaccgaagctgctcaccttgattaggctaaacctggttcatctaatttggcaccttggtcaatataggtcgcctgaagtaaattttactcttattttatttatttgtaccatatgtacattaaattactacttgtatatatgatttacggtgtttgaaaattttttatgtgtgatgaacttgtgaagtaggactacccagtgaaaaatttctggctgcgccaccggctctagtagctttcctttcctcttttgtaagctttgtacttttattagaatactcttttttatatatttatggtattgaaatactttccgagtatataaatgccaactttactttatgttcatgttatactaattatactgctagcttatctggtagatgcataggtacgggtataatgtttgcttatgcaattactctatgtcatgacgatgatattagagtagtatatggtagtttaggtgtggtgtctagattacgggatattattatttggggttatatgctgcggatgagaggtggcccactgatggtgacagctcagtacgggtatttctccgcgcgtgtatatagtcctaagttaatttcctggggagggtactcctccgcatttagccccggttgtatggtcataacggactgtcgtaaggaacttggcagtcaagggtggcttctcgaagtaccaggagggcataggatagagggtattagctagttaatcatataactagaatgtatatatactatgtatactagaagtataagaatagattctcttttattctcttttcacttagcttagatattttagggctcctttgaaacaaaggaaaaacggaggatgtgaattcctatggattcattcactgtagcagcctttgatttgtaggaattggtcatagaaaaactgaaggaaatattccttcgttgctgattctacgggagaaacacaggaaaatttccatccagtctgagctcgtttttcacttgctttgcgtaggatcgaggcaatcaagctcctaatctctttcttcactgcaggagaacaagcaatgaatggatataatttgtgttagctgcagtatatttattagaaatagaaagtgggcccaagttcttaagtaaatattcttgtgtttttcctataccccattcaaacgcatactcctatacatttcctatggttttacattcctctgttttacacgtgaattcctatcatattcccgtgtgtttcctattcctgtattttttcaatcctatgtttcaaaggggcccttagtatgagaatgagtagttccctgcttgtgtgtcactctatcctttgatttatcttaacccccgcttagactatggtttattacaagtaacatataaattattagttcggttatctctactatgatcttcccacgagattaaataaatatgatacccttggaatactctcgagtgaaatgctacaatggtttatccgtgcgcttgcggatgaactctgtaaccataatataccaggagtatttctacaccattgctgggaattatatttctagtaatgtcgttaagaaataccaacaattatcttatatgatagaaagcgcaatttggatggggtgtctcttggatggggtgaaatttttagtaggggtgaaatttttagtaagtattgatcaccttgaaaggaaggtgttgcctagaggggaagggggggtgtgaataagtcttttatgaaaattattacaactttaaagcgggttaataagcaatcaaaactttgggttcaaatcagagtttctgatatgacattggagtttccgatatgaacctaaagttttaaatcggagtttctgatttgacatcggagtttttgatatgaagtggaatgttcaacaactatgagagaaacactatctatgaacttttagcttaaacaaatcatatgtatatgaatcaaaaggtgataaacaaaatatatacacaatatatatggtcaccaagtactaagcatacaaatagatcgggtaagaataaactaaagcacaatatgaataaggcaagaacatacaaaccaaaagaggagacacatgatttgtttactaaaaattcggatccactgatccaatgtctccattgaggagccacaaatgccatatcctcacaaaggtggtgtttgaatctcctgaagatgaagatgaagattaagtgtttcacgcaaacgatgtggtagtaacgtgtgattaattgaattttaattattacaaacttgaaaaatggattaatctgatattttagaacaattttcatatagaaagtttacgcacgaaatgtatcgtttagcagtttgaaaaatgtgccattttaatccaaaagtttatcctcaaacttcagaggaaacgaatagggccaaagtcttcacaaaccatagatgctcacaagtgactcttagctatctaggagacctcaatctccaagagcaacaaatgaccacgaaatttgttgggatatgaactctaatgatcaagaaacaagatttgttctcaccactagaaacccaactcaaatccacacccacaagattcaaatcacaaaaatcaaaggggatttaagagagagataaatcaataatcaaagcacttagcccaagcctcaaagccacaaagaatcagaatgaaaagggctaacctgacaaagggtttgattgggggtttaaatagatccccaaaatatgaccgttggggggaatatttcagcacacatcagatagtccaattttatcgccctccaaagacaaataagaacgagagatagagagtgaagttcaataatattttggactctctaagacatcgaacaatttgatttaacataggatagtctgatgtgtctaagcacatgtttctcgtccttaagcaaagacccaagtttggtgatatttcggattctctggatcatcgcatagtgtgatgtatttcgattagtctgatgctgctcaaataaaaaggcaagaacttttttactcctgagtctgatttcgatgattttgggctctatggaaagcttgttttgagagataaatcaaacccagcgtaaagatgattcaaaaacttcaagagatgtttaaaagaaaccaagtgtaagtgttgtgacatgtgaaataatccggagttggtatcttggtttaggttttttaactcacacaatgataaataattttgagcacttgagacataactaaggcttcgctataggaaagtttctttaaaaaatcatattgatccatttctcaagtttttgttagctatcactgaattaatcatgcactaataagttgattcgtttccgttctagagagaattgtttcgaacagaccggttcgaatgcaacctaaccaaacacgtttgcatctcttttgatagtatggcattcatatactcaatccggttttactataaacaccaagaccggtaaaaaggctaaaaaaacttttactataaacaccaagaccggtaaaaaggctaaaaaaacatacttagctttattatacctttgccttgtgcacatcctcgtggccttagtttgttgaaaatgaacatcactctctttagtcaatacttaattcatcatatgatgtccggtcactttcatttatttaagctacttgatgcccttcaacttatgccatctatcctttgcctttcatcaatctcttgatgtagatcaaggcatgatatccatcttttagatctttatcttgagtctttaggagtcttgatctgacttgagcctcaaacatcatttttaattcttgagatctatttcttttattcaactaaatgacattgttagtccaaatgattcgattgtcaacctccacttgttgaccaaccaatcgcatatacaccacgtgtcatatagtcaaaatgtaaagttcccaattaagtttaagggattagcttggctcaaagacatgcataactaaaatatagaatttgcttcccctaaatatatctatataaaatatttgtgtgaagcaagagtatacattgagatgaaacattgggagcttattctataccaggatagaggttcattatcaacaaaattaaatgtattgggggttcaaaattaattgtattggttttaatgtcatagagacgacgagcaaaagaaaaatagcaaaaaacctccatcaccggtggactccaccctatcctctgcagccagccatatggagcacgatgtgcaaatgtaggacctgtgcagcccatcaatttagataaggtaatattggagattatatgttaatttgatttgcaaaaataaattagggttcatgagtaaaggtaaaggagagtttttagattggtgccattttaagctattggtaaaattgacaaatatatagctacatttagttgttaccaaactttggtaatgcataggaaattttggcaacaacacattgatcacattctaccaaaatttaataatgttgttaacttgccaaaattttagcattaccaaaatttaccaagattaattttggcaataatatgaaaaacccttaaaccaaggaaaaagaaaaagtcgagggggtgatcatatggatttatccagtatgaaattttgctcctgagtcctaactagtttgctctgctgagccgatacaataaatatttgctgatacaatttacgaaaatgcccctgagaagaaaaatcctaaacctcaatcctccaacttctccccttcctgagcagcagtcgcctcaagggttttgccacccgaatcgccgccgcctccgttttctccaggtaagagacgcttccaaccctaatccccccaacaccatcaacggatccacccactggttgtccgcctgcttctccccgccccaatccaccttaggaatagcgcctggctggatcccaggccgtttgcttgtttgcgtccggagattggagcgccgattgggatgaaaccgatcggcccttaatgtttatttttccccatcacgcgattgtatttgttgcctccgagagattctgtgctgttgctgaatccaattttcgtgtgatttttggcaggggattctgagatatggccttcttgcggaaggttgggaacctcgtcaggcagtccgcaggctcgggctcgccgctgttccaggcggtccgatgcatgtcctcctcgaagctcttcatcggaggttgttgtcgttttctctgttcctcactgctcatccatttcgttcttttttttttctaaaaaatatattttctcttgtttggaggggtatttgtctgatattttgccattaaactgctttttgttcctgcaggaatctcttatggtactgatgaccagagtctgaaggaagcgtttgctaactacggtgaagtcattgaaggtatgtctcttgtttttttgttttttggtttttgtttttttttgttcatattgatgataagcatgttcctatacgtatgaacaatcagtagtggtgatatttttcagctagggtgattgtggaccgtaccactggacggtcgaggggatttggttttgtaacctacacatccacggatgaggctgcagctgccattactggcatggacgggaaggtgtgttgtgcaaactttgttatatctattggtttgcaattcaacttctacttgaggtttaatgcataggtgttttatgtctaaattaatctggcatccttatttggtaaatatttaaatcaatttgacttatgaatgcaatgcatatggtgtatcagtatgtggtatggttgcttcaaaggcactctagttggtactgaagatctttactttgatgtactgccttgcaaagttaaaattctgaattccgtcaactccatttttctcttgcattgcaaagatttgttggactgactaggtgatggatgaaagttaagtggttggaaagcgtttgcactgaggagcttggctctcgcactcgcatattaggctttctgcaaattgataaggtaaatgaatataaagtttctatagaagtggtgcagtgggaacacaatgtgaacattcagaattgcatatgcactgaaccttcatggctcgcactgatccaggagccatgtgcaatttgcattgggtgccgtgcaccttcatggttgtctgtgggtttcatcaaaccggttgtgtgtgtgtgtgtatgtcctttttgctgtgctgagcagtctgttgtcatggtccacacgcagagacatgaatggcctgttgtcgttggtgcctctttgcaagtgtgttagacaaagccttcgtagatagatatctgctctgagaccatggtactaaatattggtggtagtgtcacactattgtggccacaattgcaggtggggaatgacgtggacgatgtgaggtctaaacccgcaaacgctaaaccacgcccttgtcgttatcaaccgtggcacacccgactgacctattcacgaataatgtttcctgcaatgcaaacggagaacacaagaagaaatagattgaggcaactcaggtagctagataggtaaatgcgcacaaatatgaagaagcaaacttatatttgctagataatgaagtggtgaactgatagcaaagaggttctgaagacaaactatgatctaattgatcacgaccaatatctgggtgcatttaaagagcaaaacacaacctaaaaaaaatctatgaaaccctgaatgggtacctagctatttaaagaggtgggaggacgaccaaagggcacctagggtcgttctctaccaggttggtgcgcactcatgttgggccaatacttggaccggggtcccagacgaagttacaagcccaatggcccatgataggtggcgcaacaccttgttttttcaattgtggctggttcagatggaatttggagacgaggctagatccgttttaaaagatgacttcgagggctttccatcatactagttaggtgcccatgcgttgctatggggaaaatatagatcaaccttatcgaagctcaatatggttgtgctgtggaaaacaaaatcaaattatgcttctttaaatacaaaaattagttagtgcatcaggaagcagtcaaggacatcacagcatgaaaattatcaaggagcatgcacttgcaattagatatttatgtactgataatgtgtctagactatagagggtcctgatgtgtgacatttctctattttcgtctactgataatatccatcatcaaaacttcatgttatatgcctataataggctatatatatatataactgaatattatctcgagagattacaactgaatttacatgatcaaatccaattcattaagacataaacaaatacaagtaaatttctggataatgcactaatgctcatagccatctcttaagagattctcaatacaccgagttgtaagtttgcataaatatgctgatctttaagaaacatgaatgaatcaccgttaattaggtactgtagcaagctgacattgtctgtttgctgtgaatcagacgttaaaaaacttcaaaaatcacaacactgctcacctctgacattattgcaactaaaataagaggagccttgtcaaggtgattgtctccgtatggtagattgccattaatccgtccaattctcaattccattatactcgtatctgcatcaagccgaagagaacaatcaactttgcactcttcaattgttttgctagtagcctttctatcaacaagaggacggggaatcaaagatgcaaatgtcaacttttatgatttagtgtaaagcccaattgtattcaattatctagcgacaacaatgctgataagtcatcggaaggaaaaaaagaactccattattgactatagaacaaatgtcagcgtataatcacttgaattgcttatatagaaagtatgttgatgacaacaatatacagtaaaattagtgaccgctacatagttcatgcactacaacatatttattcttcccctacattaattttgattactcagaagtgttttagcaatggaattttctttgcagccacatgacacggtttacgttttttaatgtacatacaattgcttgatataagggagttcacagttaacacaaagccatgaagactcagatttttttttcattttttattttttaattttattaatagacctttccgaaaactgaaccttttggccacgctggctggcagcgttgttttgccacgccagccacggtggcgtgacaagaggctggcatggtaggacaacgctgccatgccagctgcgcatggtgtgacaaagtgatttggccacgccaggcagtctggcttggccaaacgtttcagatttggaaatacttttcggaaaggtctattaataaaattaaaaagtaaaaaagtctaaaaaataaaaaaatttcgaggactcacctgctgtgctaacttgcacctctatccacaaaaacatgcacctacagctgtaaaaataagatgggagacagaatgattagcttgttgcaagacatttggttggcatacatgagtgcctaatcctgagaaagggcactgcatggtagtagaggaattgtccatgcacttatgatgagtccccgcaatagttcaagaggtaaaaagggattataattgtgagtagcagaatccttcaagcaaaaccctgcataggcaaaggattagttggtgagatttacatgttatgtatcaaacagagaagattagtgccacaaaaagattataattgtgaaatgtaagttactaaaagattagcagcttatctttgagtagcacacatctttaggactacttatatactatcttttgctgcaaaacagcttggcaaattgataaaattggcacaattctgcttgactatattagaaaattaactaagcagaaatatcgatcagaaaactataacaagtacatctgttagtaaatatgttcctaaattatggaagtcactggaacattgataacatcactttgtatggcagaattcatcagaatctaaaatctacttgagatttattattcctgtggtttgttcagcacaatactgtagtgctgaaggaaatcattggcataatagtggtgaactcatgtgtgtcatgactcaatcaaaacaatattgtgttattgatctttgagcatctcaggaagaagcaattctgccatgatgtccatcttcgctttttactgaacatattaaaattaaagaccctaatgtcaatcaaactgtcattaacaatgcaaaagagaataatattttgtttttcaacccatacatagagatgaaacatttgcagtaatacatatacttagtagtaaagcctcacattttattaaattatcaatgctatgaaaaatgaagaaaatcgagcagttctttcaagttatcttttttacataaatgtatgaaaacactatgcaggcatattgtgccagttatattttgagttttactaacatccataataccgctaaaagaaaatatagatcaacgagtggatttaggagctacttattccatcaaacgttgatgtgtgcaagacagatctttcagatccaaccttttagtcaggcacaatgatctgaaaaagatacatgagataaatggtcaacaaacatcatggaagagaattagaatttttaagtccatcaaatatgataatttttattttcttaatccttcaacaaaatctacataggaaatggtaaacataacacatgaactacatccttttagtacatctagcacaaagacaggtgttaattcttttcctgtgtcgcatgccaaaaaatttagatcggttacagccgagacaatagcagtattcagattagttaactgaaaggcctggaaaacatctaatgcggagaaaatgaacttcggcctatgaatcattgacctcaccttcattgctgctggttcagcaaaaggttggctgcctgccgagctagggcaaggctgcagcccattctgctgtgggttcctctattcccctcttccacgcccattgccagactgcctgccctcatgccttgcaccatgtgggaatggggatggtgaccgaggatagactgatagaggaaggactgatgtgcagcggtggggaaaaggaaggcatgaggtttgaaattctcacgacatgtggtgggaagctgtgtgatgttggtcggatgagtgagcaagcgacagcagcctagtgccgtgcgggggttgctagggtcagggtgagcgtgcgatatggtggatttggcggtagaggtggtggctgagatagatggtcatggcggttcgacccttgctgttgataaattggcttcgcgtgaaactgagtggtgaggggagggatgaccaacgagcggaggctagagggaggggagtcagcttggtgcaccgaagaatgacaaccctgatctagcaggctgacggcaaaggagttgggtgaatgacgagggatgtagcggcatggcgagggttgtgtcagaccggcgggcgtgggcacggctacagcagcgtgttgatggtgaggaggggaggggcgaaccaagcgagagggccgtcggcgtgaatgggagggcaccggcagcacgacgatggatatgttgtatcgatggacatggagagtgggatgatggatgaggcgaagacgctgcgtgggtagaaggcgtgcgtggcataggtgaggagcgatgcggaggtgttacgagctattctatctagcgatccatgcgtctgccgtgtcaggaatcaagaccaccactacggattttaagtagtaagactcatggacccaaaacggagctagtttgcaaatttggcggctgtttgaagtcaatgctatcttgggaggccgaattggattttccacaatgtaggggacttggtctctatctcgtcttgcaccatgagtgatgtctccaactccattatatgttcccaaacatcgagatcacccctgaacaaataaatgtatatatttcaatcactagttagcatcatattcttaatacaagtaaattggccatgttaaggaacgagttcaccggttgatatatgatggaaacaatggtcggatccatactgttcttggtgacatcataccgctgccacaatgagctagcagttctaaatagcggcgtggaacacagtggctgccattgcagcccgagaagaaaataacggccactattgctgcctgacaagcgcaatagtgaccgctattttgcacaaaaatttgaaaatttaaatttgaagtttgaacttgttattttcaactgattattgttgcttccttgcctgaatatttatatgataatgaggatctaaatatttattatcttatcgattgatatcatgtttcatttatggagatgtagtgcatatatctatttgaaccttttatactgggtttagacttggtagtctttattttgttatgttaggagggtcatgaactcatgatacatacacaattaacatacaattttgagtctcttccatccgttattggaatatagtggccgccatctgcaatagcaaagccaatggatgtgcaggatggccatgctttggttgcagccagtgtggaactgaatgttgatagtcttgggatcttggcaggacagttgcacagggtgcataatggagcatgtagtgaagtagtgcacttggttgagctgcatgtcaccaccaaggggatcagcttccacgatcaaggggggaatgtggaaaattgttgaaggggtacccccaggaaaaagaaaagccgctaagattgagtgttgctgttggggttggcgagttcatgtgaagaaggggattggtgagttcatgtggtttgtcaactcatgattttggtgagaggagcata

SEQ ID NO: 62924 - DNA, 718 bp, Oryza sativa
aaaaaatatttttaatttaaataaatgctgaaatgatatttgtattatcaaattagccatttaagctatgtaaattccaagaaaatttccaatcaaataaatagttcaaatcaaaaaatatttcaattcatttttttcatataaatagttcaaatcaaagtccccatatcattatccggtgcaacgcattgacattttgctagtaattaaaaaataggtaaagcttccggttattttttcgtccgtcattaaagcatgggcccacacgatatttcgccactaatctgtgaatccggatgcgtgatggtgattttgatgctccacaaataaaagagaaacgaaaaaaaaggagaaagctagcaagcagcctagccaaacagcagcaggccggcccaacaaaaaaacaaacgcagcccatcagccagcccacaaagcaaagcagcagcccagcacagtactgcacgatactgtagtagtcaggaataagtttaccttagttccctgaatttgttgctgaatctgaaagggaaaagtataccggaggtccctgaacttgtcaccgagataaaaaacgtccttgaaccgcaataccagacacccggggtcccccaactatacaaaaccgaaaaccggtaacccaacgtccctcgggggttttgaccccagttttgatctacgtgccaactgagtcagcgtggggcccacgtggccccacatg

SEQ ID NO: 62925 - DNA, 758 bp, Oryza sativa
acgtgtacacctggcatgtggggcccacgtgggtcccatgctgattcagctgccacgtgactaaaaccggggtcaaaaccaccaagggaccttgggtgaccggttttgtatagttggaggaccccgagtgtctggtattgcggttcaaggacgttttttaatctcggtgacaagttcagggacctccggtatacttttcccaatctgaaatccatccctaatcgcaatgccgggtatacctcatcctccaactcacagtaccatgtcaacgtggattatcatggccagttttaactgacgtggcaagtgagccccacacgggtcccacgtgtcgggcccaactcttctctcttccttctctatcggcaatggccgcccggcggagaggggctgttgccaacctccttccccttctcctctctccctagatgcaatcggcggctggcagaagaggaacaagacgacgccgaccttccctcctccttcctcgagcttctcgccgacgcccatggccacccacctttctttttcttcacggcacagcttgccgaagctcaccacaacaactccatatctaggactggacttgctgacggcgttcgtaagctcacgcctaatggctcgagctcctcgcccccgtcgacgtcatgcgcgagcgtgctcagtacctctgctccctcgtcatctccaacaaagtcgagaacacctcgccgtgcggtgtgtcgacaagcatcgcatcgcatcgcatcgcatgtcca

SEQ ID NO: 62926 - DNA, 1278 bp, Oryza sativa
cttgatgatccggcgtggcgcgcgtatcgttttataactcacgcggggattcttcccgcgcaattttaaaaaggattagcacaaagatccgcaaggcaatattcattctactctccaccattcaatcttgggctctcgctttgcaaagaaaatacagtaataagaaatgcagcttgtctttacatgcgtgtatctgtgtgtgtgttccagaaattaatcaggcagtatgaaaatcgaagaacatgatcaataagttatcagaaggtgccatgagagcacttctatagtatcaatttaacagtaaattgtacatgcctgaagatcatattgagttcccaaaagaagcaaaaatgcccaacaaattcagccttgttttctcattagcaaatagcaatgtaacaagtcacatacactgccgtctgcaagacagtattgtttctaacaatagacgcagagatcacatactcatctgttattcatctagtcatacagtattccttcttcctctatgcatgttgtatccttcctgtagtaatcctaatgctatattgaaaacaaaaatgtttctcgataaatcttctattagtcttacaaggcaaaaggagtatcaacgccactggcaacctgacttgtcgttgtgccatatttctttctgcactctggttacttacagtatgcatttctgtgggtacgtgcagcagttccccgtatcaagcatttgtgttaagaacactacaagtgaattaagtaagctacaatcaccttactataggtaaccaagtacctatctaggaatcgaagatgcaaaagaagcaacctgaaccttgacaaggtttgtctggagccggcccaagtgaaatgccgttagaagccacacgaagcagagctgttatcagaagggagaaaattagttcttcagtgatatatgcaatcctatgtggtgatggggtacaaatacaatgactgaaaccatgacacataccggcaacgcgtagagggtgaccatggatgccttcttctcaaggctgctgaacaacaaactgtatattccggcagctgttgcatcaccaagcctttgaacaacaacatttatcaaacctattaaaattcattttcattagttaaatagtcaaaactgaaatgggtcatacatttgtgaacacgtatttaagatgattttaaatataagactaagaaggcaactgaaaaactgactatttttctacaatagcctacttaatctggaaattcaacttcaaatttcgctgctaatcaccc

SEQ ID NO: 62927 - DNA, 1311 bp, Oryza sativa
gggaggacggccaccactgacgccaccgccgcatcccggaggcggtgccgagtcgtcgtcgtcgtcgtcattccaaatttcaatccaaactccgtcgttactctgcttgtcctcccgtcccggcaaatctaatcaaacaagtcactcacaaacacaatcccccgattccgaggtttgacgtcttataaatatgtttttttctttctttcttttcattttgacgagagaggagctgttcgttcgtattgtcaaatcaaaaaaaaaaaaaaagcattctggtatcagtatcagtagagtgtaattgactaaactggcaacaacaaaacaacgacaatgacgatgattttgaacagtgtaaatgtataaataaatgagagaatctacttatataccattgactttagtctagttcaataatctgccactgacttagtttaattttataatataccagcgtcttttgtttaacttatataatttaccatcgccgtcagttaagtctccgttagcacggtacaatttcgtactaatgaccaaaatacctctagaataaaaaaattaacccaatatattttcatgtccgcctctgttacggccacaagtacacgtgcaatattgcaggctgtgtccgtggtccacaagcccgtggcggccgcatacatacgtatgtattgctagaattctactccctccgtttcaaatgtaagtcattctagcatttctcatatttatatagttgttaattaacaactatataaatataggaaatgctagaatgacttacattgtgaaacggaggaagtaatatattagtcaatacataatataaaataagcgtgtgattagatttatttttgtaagtgcaacatgccgtcaaacaagttgctaaaacaatcatatgtatgcttagataatcatgtattatcatagaagaatatgagccgggcaacctctgtgacatgttacagtatggtatttgtgaattttcggccaaattctgaaagttttcatcttaggggtattttcgtcattagaacacaattgtatggtactaacggagactaactagacggcgatggtaaattgtagaagttaaacaaaaggcgatggcgtactatagaactgaacaaagtcagtggcagattgtggatctagagcaagtcagtggtacacgatagattttctcgtaaagagagatcaatagtctgttatgttcgtggccggatccaagctttgcacagtttagttaatttgctcctagccagtgcagatcaacatctctgggtatgtgctatgtaaatttagtttctt

SEQ ID NO: 62928 - DNA, 518 bp, Oryza sativa
tatatagcagtatggtagctaactctgtggtttactgaagtacaggctcagctgtttctgaaaacacaacactcaagaccaacaacagctttgtaagcttaaagtgagacactgaatcatcagtaacctttgaatcgatcttatcgtgaaccatcaaggcgacattgctgcatattaagaaaacaacaacaacaaaaacattagaatgcaaaaaaatccagattgaacaatgtgtgaattaacaggaaaccaagagagcaaattcagcaagaacctgaagagagcgtcgaccaggagacaggaacacgcgagagcaccggtgggttaggctgcccggctgccataatcaatcaaagaatcaataatatatcagtttttcgtcagaaaggaattaatctgatagaatttgagaatgatgaatcaatgagtgcaagtgaaggtaagaactgactgaagcagatgaagaggacttgaggcgggaggacaaggccgcaggcgatggggaggtacatcatccg

SEQ ID NO: 62929 - DNA, 1446 bp, Oryza sativa
tggcccactcttccttcgtgaaacaaacaagttaggcccaatctcttatgtttggagcggaccttcggtctttagataaatagaggaataagtttacttgatgttcctgaactttacattgagtttgtttgagatccccagtccgcaataccaaaaatctctacccctcaactatcacaaaccatgcaaaaaagatcctaaagcagtattgacccaatttttctccgctttcgccgatgtggcatatggtgggccccacatgtcagcgtcctctgggtcagctactgcggcggtgggcgtcgcaacgtcgcggaggaggtggcgaacgcctccacaggtccccgtggcggaggcagcagcgaatgcccctacgagcccccacggcggacgagatccccaccacaatggactgcctctgccctccagcgtgatgacactctctctcgtggcccgatcttctggtgagggggataactctcgctttgatcgagtgcgacgtttgcgacgtggctaccaaccagaacaagtccaagacgccgtgcaatcgctacaccacaaacgatgtcgtaccaaccgtgacgcgcggttgatgatccctgcaatgcaaacgagagaacactgcaagaacaagataagatgcaatctaaatactgcgaatagggaattaagcacaaaggaatagttacgattgaagtggtagatctaatcgacccggcaaatcaacacaccaactattgggggctctgaatctatagtcgccgactaatcgagcgaggactagagacaaggtgaatggcacttggtaaaattcaactaaacaaaactcaaatgtttttgaggatgaacaaagctatttatagaggaaaataaagctagggttcagtgctaattcgtggaggtggagggtgacactttcgagatgagcctagtctattacaaggcccaaggcctaagttcggtttcagcaacagcactgtcttgttttggcgattcccgttgactcgagatgaatttggacatgagaccagatgcgtttgaaaggtagcgatataagctttccacgaagtccaagatcactcaaatcggagttggcatgaaggcgctaggtccgtttgaagtcagtgctgtctccggaggccgaactggacttggacttggaattatcattggagcgtgtgaagttatgagcgtatccgacgaagtgatgtcctcatcacagcggcagcctcggaatcggtgctgatggcggctaccgtagcgacatggggtgggtgaagcactatgcaagctagagttggctaccgtcgctatgcccgccgccactccgctcagcaccctctaccatcggtggccttccaggcttgctgaagaagagaagagaagagaagagaagaagaaaagaacaaaggaagaaatgcggactccacattttttttctttccactt

SEQ ID NO: 62930 - DNA, 1036 bp, Oryza sativa
ggtagtagttacttgtgaagattacatgtcatgccaaattgcttagcaacaggttttattccacgtggtggttatctgaatttatagatcaaattgtgggatatccgatgcattgtttattgtcctcaaagatcatatattgctaaataggaaataaggtaagaactaaaattccttaggagtttgaaccagaaagcttctaaaattcctcagggtctagtcagtggaccactggacccctattaggccatttttaaactcaattcccatccaggcagtgtagcaattctctgttattcttgtttaacgtgtctttctgctttagcttgttttgtctgtcataatcaataccagttgttcttctcaccagggactcagacttacactatttttagtttctacccaatatgaccttaagaacatatgtgctgggtctgtggttttcttcaaaatttatatatgttccatatttgtttatgctgtaggttttcttaacaaaacattacaggaataggcggtgtaacgacccagattttttccttgattttgaagagatatatgttattgactcaaaagcaaggtcaatcacgagagcaaaagttgtggtaagacgtttgaaatttaaattcttgaagcattcagaacagaaccattatatatttaggttgcaggagctctttcatcactaattttagtagaaaaaagtatattagtatctgcatgatgatttgaaggaactagtttaatggtttccatcctttgaaatattgcatgcaaccatttggatgactggtaaactgggtctgtgatgtcattggtttcacagttagtcctatgccttttcatctagacatttgtgacaagcatttatcttcacttttttttttgcatagtttaattaatttttgttttgttgagattattgatatcgagctgcctattacaggttagtgtccctgaaggaaagaagagggacaggagaaatgacttgctactcatacgagatggaggggaatcattcagaataatcgacaag

SEQ ID NO: 62931 - DNA, 735 bp, Oryza sativa
cacatgtaatgcaatataaactcttggtgcattggttacatcattcagtttcattgacgcatgcgtcaggtttgctgtcaacgttgtgttggttaatggtgaggagcaagtctcaatcgagagttgcatgagaatgataggtttggtggaaatctcattgtcaaaaggttcatgattgatcgatgcttaaagaccgttttcagaagctgtattttatatactagtgtgcttcaacagctgatgttatctttttattaaaaaaccaaaccggcatgacatacacaagattctccttgattgcaatagctggaatgaggaaataaaggtgcatgccttggacaagttgttatgctaatcttcagaaagaattaattctgaacagtcacagattaatgctaattggtgggggtgcatgggacatacatactacacttatcagcatcatagtgctaactgctaacatttgtgcgtgttactcaatgtagggattgagagatgcgtgggaggaggtgaagcagatgcgatgcagagaggaggagaccaagcagagggcatcgtttctccagcaaggcttcgcggcggcgtggaaagacggcatccacaccgacatcgccgtcaggcctggaactgggcccccaatccaagcccataaggccatccttgtcagtctctctctctttcagtttcagcccaataggccggcctttcttttatttgattgggcccaatgaaact

SEQ ID NO: 62932 - DNA, 717 bp, Oryza sativa
atctctccatcattgtgtataatatcaatacacatacacaattcattttcacttagttaatgctatttctctcttctctcattaagccatatctcctcaattgtttctagccctcaaatgattaatctatggttggaattacctccctcattttctcctctcataaagccacatcaaattacttttaaatttggaccatcattctatatactatttaaattatgataaaccacaataacttatgcaagtttctatcgtctaactatcttacatattatttttatttcttataaatataccaaactcccgcagcaacgcgtggggtttcatctagtttaaaatagatgtattagcacacattgtacttgtttacccatatacactttgtatcattgtatgcatgcgttgtcctagcttagaaaataaacagagagatggacaagtaagtaacaatgcgatgcacatactcttggcattggcatggaactgctagtgctgcccagctgttcaggctcctgagataccttgtccttgagctctttgatgtacttggacgcatctacgaggattgatgtctcgtttgcctgcatataatcatacattcatgcatgctatgtttagattaatataattaaactctcactgctgcagaaaattctattactatcgattcataactggaagcgcacaagtttttgaaccaatagtgtgtttggc

SEQ ID NO: 62933 - DNA, 2552 bp, Oryza sativa
tttttaactgtaaagttttccattaattaaccctgatccaaaaaaaaggaggatcacctaacaaaatgcaaaagaataacaaagccccaataatatacatatgacaaattgagcacgtgcacagaattctgcctataaatattcgtgtacatttgactggcaaccagcaacagcactcaagcctccaaaccaaatggcttcccctaaaccctttgcttgcagtgccattgccttgttatttgctgcaaacttggtgtcagctcagcttagcgcaaatttctatgacaaatcatgccctaatgcactgcccaccatccgaatagccgtgagatctgccatcgcaagggagaaccgcatgggtgcatcattgctccgcctccacttccacgactgctttgtcaatgaaagtgtcctgaacctgcagagatattcaaaattttctcacttctaagtattacgtaataaccttcagtattctgacaatgcagggttgtgatggctcggtgctgctagatgacactccaacattcactggagagaagaccgctgctccaaacaacaactctctgcgtggatttgatgttatacacaacatcaaggcacatattgaggggatctgtccgcaggtgggctcatgtgctgacatccttgctgtgggggcacgcgaatctgttgttgcggtaaggggagaaaatacaaaggatatcaaactaaaagttagttatttgtctgtcttaaaaagttaacaggaactcctgacgtcagaagatgagcaactgaaatgaacaaaacataactctttatgtatagctatgaaattctataccaaaccaagccttacaaagtattaaaagtcaagttgccaaagatagtaaaataaattaattgatatttataaaatacaatcagtagtgacatatgaaaaccgacaatttatttttcagctaggaggtcctacttgggttgtccagctgggacggcgcgactcaacaacagcaagcctggatactgcaaacaatgacattccagctccaacctttgaccttggtgatctcacgaagtctttttcaaacaaaggactaagcgcaactgacatgattgcactctcaggtactgtgtatgtaaatggaactttttggtatataataccatctataataaaaccataaaataaaacagctatccttgctgaagcttgattgtcaaaacaaactgtacaagtggtgttacatttatgtaggagtatcaatatatcatggtgcaaccccaacaggttgtttagtatcaagatgctactgatcaattgatcactaacatcaaataaaaatatatgccaggggctcacaccataggccaggcaaggtgcgtcaattttcgcaaccgcatctacagtgagaccaacatcgacacttccctggcaacatctctgaaatcaaattgtccaaacacgactggcgacaacaacatatccccccttgatgcatcgacgccctacgcctttgacaatttttactacaagaacctgctgaacaagaagggtgtcctgcattctgaccagcaactattcaatggtggttcagcagattcccagacgaccacctactcatcaaacatggcaacattcttcactgatttcagcgcagcaatggtgaagatgggcaacatcaaccccattactggatctagtggacagatcaggaagaactgcaggaaggtaaactaggtcataaatttttacagtctaagcctgtgtgtgcctgtgcggaagagtgtaatgttcagagaagggagaagtgtccctttcctgatgctgtagtcgttttgaaaggtgtctgtattgctattaaagaacacatatgtgaaagaataaaatggcataaaaaggcaactggtgtaacagttgatatggcctttcatcttttcatccacaattcttgcacttgaaagatcattgataacaaaactcggctccaagcctcttactatggttgatgaatttcatgactaaaacaaacttgtaataataatggttaagaacaactgttcagaatgacttgtcatgctggcagtgatcattacttggcttaattccaatattcagttcattgactatagtttcttaactagtacaactcataaccgtagtatatcaaagttgacaaattacatatcaattgtgtagggttcaggtatatgatcacaggatgattaaaatcaccattaagaaatgtggcaatcatgcttatttgaaaaggaaaatttgaacattagatattttcctaccgtctgcacttgatatgcagatatgcaagtgcctatatcagcaacaaggaaaagctaataatatatcatatcatgattttgttttagataatatcatatagtcatattcaataacaaagtgaaaacattgacaatttgtcatatagtagatggagatttctccttagaaccaatatttattttctgaggtagacaaatatttgcaacaaaatatattgtttcccacggaaggtttcccagtaaaatgattgggaaggttttgtttttca

SEQ ID NO: 62934 - DNA, 1215 bp, Oryza sativa
tcctccccctttctctacccaacttcttagtgaaaaaaacagacatgatttttgtgattcgttagggtagagatcaatgagaggccggtgaagaaggctatgctcgatttctccagcctttcagtctccgatccatcctctgctcctaataaaggtatctacttctacttgtcacacgcttttttccctttcataaacatatgagaccgaagcaacatttttttttctttcaaaagaacatataagtgagatactgacgagaattttttttcctttcatatgaactgaggagaaaattagtactatcaaatattaggacagaagcaacattttttttcctttcaaaagaacatataagtgagatactaactagaaatttagtactatcaaattaagaaagaagcaaatacatttccgcattaattataaggtgaaacggtgagcaccagtgtcgtttcaagcatggctcgaacacaggcctcacactgagctacacccaggttctcacttgtgacaaacttaatcagtaatcacaccagcagttgcttgtctctgaaattgatgctggaagacactcgtcctgataccacaatagtaggattctacttaccagttaattagcctccttgacaccatgataccgctaacacaagttgcatatacttgtactttgacaccgcacgtaaacatgatattcacagtttccgtgcttacagcttcagaggaaccacgggttaagaaacttttggtacagcacattgagacagtacaccttctgaggcagttcagaatgttttgcactctcttctggtaataatcgttttcttttcattacttttaaatttgtctagtcttccacaatttggtttcctcgcatggcataatcagttcagttaatgtgtcattactcatcggcatctgagtatatctcttgttattttttacttttcatggagttatatagacaatagagcaacacaattcttttattgacttatggataccaacattatgcaactaaattgtcttttaaaaaaatattgccagttgtactttaccttatgaccataagggttggacagtggatcacaattacaccattttactttgtagcattctgacttggatgcccaagagataaagagccagacaaaggaatggaacaacagactaagcaagataaagtagtgaactttttcctagtatttacttaat

SEQ ID NO: 62935 - DNA, 1791 bp, Oryza sativa
atgagcattgtctcatacggttcattggaaaaacgtttaatcttaaccatccatttattttaccttattttaatcttaacaccttcatatccgttttcattgtcaaggaccattaaatgtggaaagaaggtaaagaatggagttgccgtctaaaatgctctatcccatgctttgcaagaagagaagacaaaaaattgaaaggccaattagaccagaaaaaccaaaagagggggcaaggcaacccgaaagctaagctagggtttttgccatggctacatccgactcctgagctcccccttctccattcccgatctttactaatcctgcctgaaggataatatctctgatacgcaccaaaaagttgtctttaaatagggtccctctcataactagtttaaggttgattatatcgctagtgcatactatgtgtatctaagtaatcaaaagagtataatcttcttatgtatacctttataatcgaatatatcggtgatatatggttttagtgtgcagcacacgatttcacaacatcactacctaaaatttattttattttgggttggttttgcttattggtaggggttaatggaaaccttaacctttttttttgaaaaccccttcccccattaaaaaagagacactttcctggacctgggaaaaccttctgtgtgaaaaaacttttagtgggggaataggcaagggggcaattttaaataacaaaaggggtccttttaaaaccctaggaaaattactgggacattaaacctaatactatactctttttttttgaaacaaccccatagtatttgacaaacactttgatttaacaatggaaagtgaacattttgtgtacacttttagaaagcatgtgcttaattactcaataggtgttataatacattaatactatggatgttaatataattaaaataatatttaggaccatggtagtatgatacacttaaaaatatgatgatatccaaatattgcatttataaacaagatcttaactggcagccttatttctttcttggggtaggagatgaatcctatttttatatattcttttcaccgacttgtaatacactactatgtaaatactatactcttaaattaagagaagaaccaacatgtactcacttttagttatacacatagggagaactacaatacttcaccattcttttcttgatctcttaaaaaaggaagctctataaagaaagtaaagctaaggataagggtaaaaagaaagtactatgatgaatagcttggaataacctagtatatgctaatattagttgaattgaaaacaactactaaaacaagaataaaatgttgcattaatagtcaaagggtgagacaaagcacataagcatactctagaatatacaaaacttttaggaaatctgaaaaattttcaatacaatttctatgttaaaaaaattatatattgtgttttctttaattgtgtagtactagtagtcggagtaaggagaagcaaaacatgaggagggagcgacacaaaatttactagaggaaagaaagccaaaatggcaaagaaggaagaaaaaagaaaagggaggaagaagaagagacgctggcaacagctgcgtcgaaacgctttatcccttgcctcgcgagaacagaaaaaagaaaaaaaaagaagagaagaggggaaggccatccgaaaggaaattaggctagggttttcgccatggctaccacccaccacctcgagctccccctctccattcccaatctctccgactcctcctaattaatcccgtattc

SEQ ID NO: 62936 - DNA, 10148 bp, Oryza sativa
cagatagaaactcaaaaggtaagtagtatacggtagcaagcatatgtaagtactcccttcgtttcaggtatataacatgttttgattttggtcaaagttaaactggttcaagtttaactaagtttatagacaaatatagtaatatttacattatcaaattagttttattaaatcaataattaaataaatttttataataaatttatcttgagtcgaaaatattactatttatttctataaacgtggttaaatttgaatcagtttgactttgaccaaagtcagaacatcttataacctgtaacggagggagtagtgactaaaagaatatgacgtcatattattttagcaaaattgtttttcttcccttgaaccgcgtgacatgacgttttgagcccgtttggtagagcttcaactcttaaatttaactctaggagtttggtctgaagtaaagttgtggagctgcacaaacccaacttcacatctctagttcattttgtgatagagctccacccaactccactcctattttaggtggagctgaaactgtttggctgggctctaggagaggtggagctggagttgtgccaaacaaaccatttcttttcgttttaatttggtccattaatttgacttccttttgacatatcgaaatcccgatcgacccatccaaatttgtgggcttaaagaaagcctgctttgatggagttcttttttcctatcgataagattcagatatatatgatccgagaaaaaaataaaataaaaagattgagctagatactttccacgcgaggtaacaaaagtcgattaatcggatgtcatcgacggtgacattttaaaagatggactttttatcctaaagtgaacatgtcctgtatatcatttgaaatagttttgattttttttttataaaaatatagtttgataagatatatcaataatcatcatatccctacacacacaaattcattatacctcaacatgttgcttaaaagaataaattatactctaactacaatacgcacaccatttcatgatcgtatttttttttcaccaaatttaaacttgtatgccgtgaagtaataaatcgtatattaatctgccttgtccttgtccattttgtttaaaaaaattcataactgttttcactgacttgcaagaaatgagagatggtatatatccttaaagagagagaaaaaaaatgctttcactcttttttcttcaattataaaagaaactatttttttcttattattatattgaaagataccacgtgcgcacactagcgcaaccgaaaatagaatagtcccaattaattcccaaatcactagtagtggaaccattttaatactaatccagtacaaacagacgaaccattggaaatatttggaaaataataagatttaagtcaaagaccagtaacccctatcaggacacgacacgctaaaatgatctgatcgagggcttattttaagccagatagcggtggacgagccgacgaatcagctgacaaacacgtcctattcgagcccgatatctcttgatcgctttccctctagttgctgtcagccaaactcagactcaaccaactactgcactagacagtcaaatttaatttgaaataatgcacaaacttagcaagatttaaggagaaatttaacacaaactcacgaaggacaaagtggacgatatatatgataatggcaagtgtgtacagtaccttagaagtgacgattgacaacgctgtattttttttggacgggagagtaagccctgtttattttccaaacaaaatttttgactctatcccatcaaatatttagacacataaatagagtattaaatgtagaaaaaaaaccaattacatagttcgccagaaaattgcgagacgaatcttttaaccataattgtgcaatgatttgacaatatggtgctacaataaatatttgttaatgatggattaattaggcttaataaattcgtcttgtagtttcctggcggaatatgtaatttgttttgttattagactacgtttaataattcaaatgtgtgtccgtatatccgatgtgacatgtaggggtaaaattttttgccaactaaaccagctgttagtactactccctccgtcccataataatatagtgtatcacatccatctatccagattcaatgtgtcacgttcctctaaaatctcttacattttagagggggagggagtgctagtttgttctcatcgtattcatgactgttcatgtaagtacttcatgctagttacatgattactcgcatgaacagtaacaagttgtcctaggaatctaggacgcatgccgtcagttcctgcatactatgtatatacaacacagtgtactgacaaagcagtcacgaggttgcacgccgtcgtgagctgtaaactaatctgccgatcgaccaatcgacgaccaaactaattaaccaagggatcgatcgatcgatcgattcgaggcagcagcgcacatgttgatttatacgcaccttggtgctgctggggtcgtgctgcagcggggtggcgatgaggaagacgaactcgcagccggcgatggcgggctcgaaggtggcggcgtcgtacatgtccgcctcgaacagcaccagccgctccgccgcgccgggcatcctcctcagcagcgccgtcttcttctcatcccctgtacgtacgatttcttcagatcagcaattaatccacagattctgaatgatggatttggcgatcttagcagctgagatcgagatcgaggtcgatggaattaatcatggaaaagagagagagagagagagagagagttaccgagatctcgcagggttgcatggacgacgcagcctctgccgaggagcttcttgacgagccatgtcgcaatgtagccggcggctccggtgacgcacacccggctcatctctctctttctgaaatctgaggctcttgctggatctccagtagtcaagctagtgagaagtcaaagcttggaatgggggtcttcactatggctctctctctctcctctatctcttcccggccaatttaaatagtggcgcacctattgacttaggctgtgtttagatccaaaatttagatccaaatttcagtcattttctatcacatcaacatgtcatacacacacaacttttcagtcacatcatctctaattttaaccaaaatccaaactttgcgcagaactaaacacagccttacagcaacacatgcatgcacgttgcaatctcctagccgccgcacacgccattcgatttctcttttgcaatttttataagacaaatcacatgctcacgcagcctatctacaccctccgttccaaaatatagctacatgtatgtttatgccataaatctagatacgatatcttgggacggagagagtattcattagaattaaataggctaggtccaatttaattctagtaaatttcattggcacacaattaatattagaattaataagatatggattttcatcccttaaggggatatccactcattgtttgcatgtcatctaaaaaaagttatgaaaaaattgaaaaaaaattaacaacatagattaatatgaaatatatcacccataaacatgcaagaccaaattcaacttctacaagttgtaacaaaaagaacaaattaaactaaaaatagttatcgtacattcccatctatatttgttatttttgttacaacttatataagttgaattttaactatcatgtttatggagtgatatatttcatattaatctatcttgccaatttttttgatgactatttagataacatgcacgaaacaaggggatatcctcttgagggatgaaatcactttcccggattaataccgtcttggaaaccagtatggagggaactcgacttatatataatgctaattgagagcacttattgagcggttgatgaggtggtggtgggactgccacacgccctcgccgagccgagcccatgggcgtgagtgtggcattttttctattcatctccctggttcttcctctggaacacaccacccttctgatcctctgttcctgagcagcttacgcaatctccggttctgagcacatgcgggcataagtgttcgggacgcaggcctccggaactccgttcacatgagtacctgcacgggtaagcggacgattaagtttgtagtgagcatgaagaacgcgtgattgctcttggcacttcttcctctatatcatgttcttcttcctctatatcaataatcgggatcgtgtctaccaccaatggaggaggagacggtaacggtgatgacaacaccatcacgtcccccaatgcctctagatctgaagcgttctctgggtacgtcactttattcactttagtgttgaacatgttactagatgatgctatttatgatattaacatgttcatggttagcaatataacttgatgacactctttttcgtatgccatgtttgttatgttatatttttggattaaaatatgctaaattatgactagatttttctaacagtatcttctatgtatcatcatctgtatatttgtcatgtctgtatatatacatggattcatatttagatatagatacagatatggagatatctaaatctaaatctctatctatgtctacgtctacttcctgatggtatcctttgaagaagagtggcatgcctcatatagccagttaattataggaagaatctataaaatattcgtaagtttctttatgaaaaacttttaaatataattataatataattacgatgtaattacattataactagcatgtaactggatgtataactacattgtaagtagcataacataatcaagttatcgttacaattattagacgaattaaactaagacagcatatagttaattttgtaagaaccgtgattatataaagaagaaactgctctagcaatagagaatatcgaccgccgtgttcttaataaaataactgcgggaggtctagaatattgtaaaaatcagaacaagacatatgttctattaaaaaatatcagaagaagtaaagactatagtttaatctataatttataggtaaaaattgctgttggacattcaaactttatgggtttaggtacaggtataggacattgtagaaaaagatctctagaatatgacaaccttaaaactcgaatgggttatgcccataattatattttctcattgccggtcatcaacataagagactataagccaactataaacttatatgaagaagagagaagtataaaaatgaagagagttagctctcacgtaagagtgagctattcacacatttcaaaataaatgtatttataatacataggtgagagaaagatatagaagagaaaaaaaacttagacacaatcttatagtttgtctaccatacatattaactgtaatactataagatataaggttatagttagctttactatttaacttgctctgactgagagtttggttttacctgatcaactggtaaagcgttcagtatttttgtattgactccgtgactccatgcggcaaggttggtttggtctagtctggaggctggagctgcccggtctggtattggtggaggcagttggctgcggtctgtggccaacgttacgcttcgatggagacaccgtccactacgtcctgtccactggctaatggcgcctagacaggcagtgcacaggaaaggggaacgatggttttggacttctggctagggtcggagaagagggcaaactttgctacatgacactcaaattttatgtaatttgctagcagacatcgtaaaaacgtattacggctgaaagacactcgaaaaaactggtaatttgctggagaacactctcagctcatttggagagagaaattcttcaaaaagacaagagtacccctagggtcaaaatctttttgcgctgagactagaacaaagatggaatataatgtatgctagtgaagtacttggggagatgacaaatttagatttgcataatttctaaatttttactctaacatcatgtttgaagaatgtgatcataggggcattctcgtctttattaagaatttatcaattaaattcagccgaaagtgtcctccagcaaattaccagctttttagagtgtctttcagctagaacacgtttttacgatgtctaccagcaaattaaacaaaatttgagcgtcctgtagcaaatttgccaagaaaactccgagtctctaagttttcatgggcttttgtggcccactctatccacgggccgacttctgggccgcggagtgttctttattggtagtagtagctatttatggaataagttcacttgtggtcctttaactagtcaaccaatccgattttcgtccttcaaccagaaaaccagatataacgggtctctcaactatcaaaaccggtataaactaggtccctgaacggtttcgatggtggttttggcagacgtggctggtttgacttggtccttgccctacgtggcggtgatgtggcactggaaacaaaatttaaaatttaaaaagaaatgtggggcccacatgtcagtcagataaaaaaaagtgggacccacatgtcagtgagtccaaatcccctctctatgcacggacgacaacgcgtcagcacctccttctcctctcttcgtctcggcaatccttccttctcgagctcagctcgccggccggcgaggggagtggagagggagaagggcggcggccggtgagggtggcagcccgcctgctccctctccgcgcatcgcctccctctccccgctctcgccgtcctccctctccatgcgcgcttgccggcttcccccatatcctccctctccgctcctcgcgcctcctccacaaagcagcagcctcctcctcgccagccgccgacagcccaccgccaagtgcgggcaagagagagggagtgggcatccgccgccgaccgcatctagcgctgggctcgtcgtactccggcgggagcggctcggacgacgacgacagttgtagggatgactccaacgaatctcccggcctccctggcccctcaccggtagcgggggcggagaaggatgacgagagcatgagaggagggcggcgacgacagggtcctagatctgcgcaagatcgggactggacactgcggcatcgttgtcgtcatcctcaacttcggaaggggcaccgtgagcttctcttcgttgtccgcaatccttgccaatcaccacccttttcctgtctccttgctggccgccacccactgtgcatctctccctccatctgttaccgtcaagcccccacccacggcactcggccatcgccgacctccttacgtccttcctccccgaccgtctcgtcggttgccacacgctgctccctcatctaccgtcgggcgccgctggtgcctagagagaggagagggtgagaatgacatgtggggcccatgtgggatccaccaatttttaattaaatgtttttgtgtaactgacatgtgggctcggtggtttttattattttccaaattaaattgcttggtaagctccacgtcaatgccacgtgagatgaagaacgagtcaaattagccacgtaggcgccacgttagcgaaaaccgccatccaaaccaccttggacttgttttgcaccggtattgatagttaagggacatgtatcttgttttgcggttgaaggacgaaaattggattcgttgacaagttaagggacctcagatgaacttgttccactatttattggtttcacattacttactacctgatatgaagattaaaatattactccctccatctacttttgataggcatatttctaaatctgaaaattttattttggcaaaatttgctacaggacactcaaaaaatgtgtaactggctgagagacaccgcaaaaacatgacacggctgatgggcactacaaaaattatgtaattagctataggacaccggatacaatattttataatttatggctcaaatgaggtgagaaatttttcgaaatggcgaaattgcccctggcaccatcttccacacaagattttgaaaattttctcacctcttttgacctggaaattataaaatattgtctccggtgtgctatagctaattacaccatttttatagtgtccaccagccgtgtgacgtttttgcggtgtctctcagtcaatttcatattttttgagtgtactgtagcaaattttgccttttatttttgataggcatatttcaatccaacaacctatcctcttaataactttctcggattcaatgcgtcactctccattcttccacacaagattggctatatgggcatcgagaaatgtaataattaattaatcgtttgtttacgaggaataactagtagcatgtttagatggatgataagtataattacttatccttagtctgtgtgccaagatgaaatatgactattaaaattatataaagggagtacatattaccttagcacattatggatgccctaatgggtcttacctattttttagttgtgacatgactcatgtttatggattttttaggtggatcctatattattatccactctacacatctgacacgggctcaccttactatatacttttgcaacaaacattgtcacattgaggatgccttaagagattttgcttatttaaccatatgtaactgtatgggcaaaacatattatattttgggatggagctagtattaactataacgataagacaacgttagggtgactagatgcatgtttcctctgaaaacagctgactccctgtttctcactcttccccaatgatattactaggaaatctgtgataactactggttgctagaaatatgtggtttagaaggattcatgctgaagttgggagcttacttcgtccctgcatacttccacgaattcgaaatcgagagagacacgcatgggataggggttatcaagtcagtcgcctgaggtgtcgacgacagattgcgttgggccggccatcctcctcgagtgtacgagtgtatttgtgtatatatgacggaaaaagtacaccgaagtccctcaacttgtcatcgggatatagaaacatcctcaaaccacaaaaccagatatgcggggtcccctaactatataaaaccggtcatcggaggtccctcggtggttttgaccccggtgttggtctatgtggcggctgagtcagcgtggaacccacaggagacccacatatcaggtgtccacgtcaccctctctctttccctttcttttttctcttcttttttttacttctctttgccggcttgccacgggtgagtagcaaggaacgggcgagcgcgcgacctgttccttgctactcacctggccgcgtgctcgcccgcctgctgccacccgctccgcgcgcgcctccgcttcgccggccgccgcgcgctcgcacgccgcctccgccggttgccgcccgctcgctcgccgtgaacagcgcgaagctgatgtccatgccgcccgagttgttgtagatgatgaagtacgggtacaggttggccagcagcggcgcatgcgtccgttccaggaatgggatcacgtagcgctcatgaacgacttcgctggcggacggcgggatgtggatcccaatggtggcctgggagatcgacgtcgtcaccttgatgtgtcccaaactagccgccgcgagcgcggcgtggacgttctccatggccgggacgaggagctgcgtgtcggcgccggcgacctcattgcccacgacgacgaaccggaataacaccgtcgggtaggcctggatccaggcggccgcggcggctgtcccgccgtgcgccagggcggggaggtcgtagttgggcgcgcggccgacgacgcggatgcccgtgccgccgagcgccgagagcgcggcgctgtccggcgcgtagaggcgcacgacggtgaaaggtagaaatcaacagggctcgtttagccaacacattggctaactactccttgtgcatggcagtgtagcatggtgatgacgacgtgtcgtcctccggttggtcggccacgttgccacttgccacaacatgtatagaattagcttaattagcatgcatctgctagcttgttgccgtggtgctcaacagcatcggctcactgtcctagg

SEQ ID NO: 62937 - DNA, 600 bp, Oryza sativa
gaaatgatcggttaggtttggactatagcacgatggaacttgactgaaagactgaaaaggagtttataactaaaaaatgaattggatgagtaaaacgaaaggcaaaatacattcaaaagaaaaaaaaagaaaagaaaggcaaagtcaatatcgactcttgtacgtggaagtatagtgtgtgtttaacttgagtaggaattgatgtgacaagctaacaaaatttatggacctttctatcatcatcatatacgcggttgatctttttgttgatggtgtagttggttcagctagttaaatagtaatcacaaaactcgaaacaagagcgtcgatatgtccgagtggttaaggagacagacttgaaatctgttgggcttcgcccgcgcaggttcgaaccctgctgtcgacgaccatttttttttaggctttttaatctttggaaaaggtacaccgaaggtcccccaacagcccaacttatcatcgaattaaaaaatagtccccctaccgcaaaatcggatacaacgccaacaacccaacttattatcgaataaaaaaaatagtcccccaaccgtaaaaccggatacaaagcatcccttaatttac

SEQ ID NO: 62938 - DNA, 1146 bp, Oryza sativa
tcacatatctaaataataattccggtgtcctcaagatcactacagaggaattatgtgggactattgtcaaattgtcactgcccccatgctattatggcactattaaaataaaccgtagaaaattacatgttaacctctctagaagcaaaaataactctaaagacgtgaggaaaacggtatgggtaggagggttattaattgatgatgtggtttggttaaaatattattctgtacttggatttatcaagatgccattctcgattaggggagtttcttaacaacaaaatacgagacttttgcatgattttaaatcttacattaacttttgcatatattcatttcgatgaagaatgggtatgatcctataaaattcctgtgaaatgcctcattcaataaaaaataaagacctgaaattttatttgtggtatctatctatcatccccttctcaaattttagtgttttattagtagctatccaaacggctattcctacgttaattttcatgttttgtaatgatctgttttgccattgaagtcttatgaatttttctttttttaaaaaaaaatcatcatgttcctgcgtgaaataaacaagccttagcaaatgtaaaatacaatggctattgattaggccttttattttacttgttactagtaagaaaaaacacaacacttgtgaaacatgcgaggcaaacatgaacgaggcagatgccatggcaacagaagaaaagagaagaaaccatgtgagtagccaacagacaaggaagaccaaagagtccaaaaccgatagagccaactgttgggaggaagcaaaaccaacaaccttggggagccttgtagcaaagaaacggcggcccacaagaagaaaccaaagcagcaggtggagtgaaacagacggcccgcccactggtttctcagtagccacagttttgctgacgttctcttttatctgtttgcttcctataaattctacgcgatagcttcccatttctcatcactgtctctcactctcactcccaaatcacatcctcaaattcagattcagagtcgtcgaaatcagtagtattcatcaggaatggagcggctgagctcatcggtgcagtcgtgggtggagggaacacaagcttcgccagcatcggtaagcaa

SEQ ID NO: 62939 - DNA, 959 bp, Oryza sativa
aaaatttaatatctacattctatgaacagactgtttttggtaaacggtagttggccttgggctaaatagacaattgtacgttgcgttccattaaaaggaaatcccatgctttctctaacttaattgacaaggcattctcttagtcccgtaggattaggactcaacttgaatgttctgaatgaccgactgttcactgtacattaatatgcacttcattttgtaacaaggacgtaaggccattttagtcaatgtactgaaacaaaaaagtgctaaatgcacctactacattcatgagttgcatattttgcattatcttttttttttctctctgtggagaacaaacgtgtactgaagaaagagagagagcaggagaattttaattcccctggctgtcttagttagcaaccaccactcattacaatacattagtccctgaaaacgaaatagccaacacaccatcctcctctctatccccctgtcgtcccaagcattcgtttttatagcctcaccacagctcaaaaacacaatgctagcgttgctgttcacgtcgttgccaagccacaaggagaaggaagaaggaagagaaggcagaaggaagcagcaggagaaggagaaggccagaagaaacaatggattgctgcgtgtgcagtcccatggcgtccatgtacaggcttccaaggaacgccatctgcgctgcgtgctatgaaggtgccaaggccatcatcgccttcttcaacgacgacgacgacgagcacgccgatgctgatcaaggctcggtgaagcccagcagattgacaaagctcaatagcacaaccaaggtaagaccttcccatatctcattttgctcctttattaattagtcctttaggattggtatgactatgttcggtttacaaccatctcgattgtgccgtgtgctctacttccatgaaaaatctagccttgcgtgtttctagatt

SEQ ID NO: 62940 - DNA, 30596 bp, Oryza sativa
agttcctccgtcttgaagaaaagatgaagtgaagcgaagattagggtttcgtcctggatcccagccgtcgcctgtggtgttgggtgttagaccgttggttccgctgcagctgctgttgttggtgttcgcctcgtccgtgtcgtcggttgcattctcgggctgtctgagctgcaacctaagttaaggtaaataagtcctctatttattctaaggatttgcaatgattcatatttgtcaccgtgggtaccagcactatgtcctgggactggtaccgagttcgcggtttcgtaggaagcggttcgcgccgtttttcctacgacacgctcctatcaggtgccgttgtgcggcggtgccggattggggtgtgacagagatggtatcagagcattagttggccctaggatcgaaaccccttattaggatggcattatttgagtaccaaaaaaaaaaaaactatttgtgaaagctaaggtgtcgttgtcccctttagctctagttttgcgaaaaatcttttcgtgtccaaaagtagaagctagtcgagtgttttgacctttatcctagagtaaacctgtcttcacgcccagttgaagaaaggtgagctcaagcctctaggagtcttagttaagccctcgttggtaggcagaccctagtaccgtcacccgctcggtgggagttgtggtgaactagtgcgtgcgtgagttttgtttggtagtccgtgttcaggtgttagaccagttgggataccgactggaatacaccacctatgtcttctgtgatttcgaaaaccgttttgatgtagtgtttttgttttccttcttttcttatcccatttctggttcagtcagatctcagtcgctctgaagccaatggcacattgttctatccgtcagatccgtgcccctaaccgccctggttctaaagaagggtcagctcagtcagaaattcccgatcagccaattagcctagcagatgagcaacagattgagaagtgatcatgcagttgtttctggatcaactaatgatgccgcagtacagaaatcagccccccaacagtggacttttgcccactcatggccatgcaaacccagatattacaaggaatgattcagaatatagttgttatgcaacgacaacacacgcaagagcatcaaccccatatggttcaagataattgtcggtcaagactgaacgaattcttaagatctcgcccaccggggttctcccaaacaactgagaccattgaagccaatgactggatcaaagatgtggaaaggaaattaaatttggtgcagtgcactccgtagaagaaaacccttttatgccgtacatcagttaagaagacataccacaaattggtggtataactactgtgctacccatacagatgctagtaccatcatctggacagagtttgcagaagcctttcgcttagcacacatccctgaaagcataattgatttgaagaaggaagaatttgcaaatatcaagcaaggatcctcttgcatcaacgagtatttgagtcgcttcaacggattggctcgatatgccccggaagatgtggacactgataagaagaagatcaaaaggtttctaaaaggaacggaagcgaaattgcgagtgaaacctttagctcacgactttccaacgtttcagcacatggtcaataaagccttgttactagaagatgcagaaaaagaaatgcaggactacaagaagcacaaggtaatgtccttagaggatcaagcaagagaaggtttgcgtcaagagatagacccgccagtgcagtactatcagggagaatctcagtattccaatggttctgattctacgtctcgttcgacaaagtcaaaatctagtcagcaaaccatagtgatcaacaataaaagccttgaaggaagcaattccgtaccatgccctccaccttgaaaaagacgtggttataaggcatgagtcgaatgtttcatctgccatgagatgagacactattcatggtactgtgtcacgccctgaagttcccctcccttgctctaaattcataaaataaatcgtccgaagaaattgtttaatttaacctagagagaaaccctaaagtaataaatgcaaataataatcggaatcggcatgtggaatttttcttggattctacatgtcaaaatatgctaacaggatttttagtggaattttcagagccctagaaataattttaaccaattaaaaatcaccaaagtgcaattttaattccaggaaaaaaaatcctttttctttttctttttcttttttttctctttttcctcctttctttcggatgggccgccggcccatctcctcctttcctccccctcctccctgctgggccggccgcaggccgaggcccagccggccgcccgcctccctccctcccggggtcgccgacaggtggggcccacctgtcggacccgtctcccacctcccgcctctcccgctcgcgccgtcccgccgaaaccgctgccgccgcacccacttcctccgctttccccgcgcccacgccacgtcgccgcgcccacgccacgtcgccgccctctccccgcgtctcccggccgcgccagcgcacgagagggcgggattcgattttgaatctccccccaccttctctctctcctcccccacgtcgccggcgaaatcggagcgcctcccggccacgtccgcctataaaatgctccccatgccctcctctctcgttttccgctctcaccgctccatcccgtgccccctaccgagctcgcaccgccgccacttacgccgccgcccgtcgccgcactccggccgtgtgccgccgtcgctagagccgccgccgcactaagccaccgccaccactagcttcgccgccgcaagacccttcccggccgctgctctgcgtcgccggaataccaccgaaaccccatttccctcgcgtcgtcggtgagttctctctcccctccgactccggccggcgtggatggtcgccgtgggggttttcctccgccctaattcctctcctctctttccctaggtgtcgccgtcgctcgtccgcacctcggcatcaccggtcttcgccgcctccctcgtttttctccgccggccattgccgcccctccggtgaggtctccctccccttcctttccttcttttttttttccccgtgcgccgccgccctcttcgcgcgctcgccgtcgctttcggtcgtcgccgctcgcgccgccgcccgccgcccgcgccgccgctcgccgtcgctggcggtcgcatgcccgcgccgccgccttgccatggccgcccggccggcttgatgccgggcctggccggtacatcggctcgtggagccggagccgtggggcccgcttgccagccgtgcccccccccttgagccgctgccgagtgggcccgtgtaccagcgcccttcccctctctctccccgtgccgctgaccggtgggccccgcttgtcggcgccgcgccaccccgtgctgacgtcagccctggaatatattgcgcaataattaattaaggactttttctttattagtaaaaacacagtgaatcttctaaaattcataactaattcatccgagctccgattaagtccattcaagtctcagtaaattcataaaaatgtgtagaatccattaaaaatggctttgttatctgtttcagtagtcttatagcatgttttgcttgtgtgctttgtttgtcgcgtagatttcggccgtttcgtcgatccgtggtttctcgaagacgttgctgtggttccatcagtgcgagagcaaggcaagtcatgcaatacaattgatcatattgtacctaatttacaaatgtcccgcatttctattaaatattgcattgttttacaatatcatgtgggatgggtcctattactcagctatatgttgttttccttatgccattgataacttgggtattaaaatgactagatgttggtttaggagatgcttagccatgcttagttcaactagtgcataaaaggggaccacattaaagcatagacttgattattggcaatagctctggattagtgccaccgcaatggtgttggctaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatacgaagggtcctgtcacggcctctttccggtatgtcgtggtggcatgtcggcgcacgggaacgtgtcgtggggctgtgtcttgtgggtacagctgtacacctctgatcagagtaaaactattcgaatagccgtgcccgcggttatgggcggtcgaccagattcaccgtgattagtttcaccctagttagcttttggaactggttagttcaggtggtggtttgggcctgtggcaacgtggtgtaacgttggacagtgattggttaatatggattaattactacaactgttttactgctttcaactactgctttgaaatgccggctttatgcaaaagaacctttagcctcccttggatatatcgtgcatcatacctcctcttccggtatgacttgctgagtacagtgggtagtactcagtcttgctctcttttcccccacatcagagttgaagtccttctcagttgaagatgtctcggagaggttggtttcgtcgctgccgtcaaggtttgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacatactgccctcagaaagtcaagtcaaagcaagttcaaccaacaacaagccttcccaacgtatctggaccaaaaagttcaaagccaccaaacagtggttctgcctcgttgacctcaccgcctattggacaaagtcgtctgaaccatgtgcaagtagaaacaaagggaaaagttttgaatctcgagcaagttgaaagagcaggtgaagaacagattccacatgcaagatcagagccacagtaaaagggagactgctaagtgagtcagagtaccagaccgttttgtggcaagtatgcagtctcgagataaagaaagacccgcagagtatgaagctaagacgaagtttgaagttccccttttggtttcatgtgtgtggtccaccttcgaatctcggggtcgagattcttgtaaggggggtggatctgtaacgctccgcttttcgtgagacgttaaaaactaattcggcaaaaatcctaattgcgaaaatttcgttccttgagtgttgagtctgagttgtgccaaagatctcaatttaaatccctcccttgtctcgataccctgttatcaaagatcgtctcctcaaaattaccatcccaatgtagtcccgaagctcgattccttctattcggaatcccctcctggaaccccatccgtgaactttgtcgaatgtccgaacccttctattcagacttctctccaaaatccttacccacatatctcgttgaatagtcaaactcaaactcccaagttacactctctttctctaaattatccatccccttttgactcgtctccgaatattgttcccttccttgactccttcctattctcccgagaccgagtatcaacctcgaaattcgaatctagactccaactctaaaatctcccaattaaatctctctgtgaaagtctatttaacctccctcataggttggattccttctttctttttccgatccacctcttccttctcttccatcccatctctctcggagtctcgatctatctatctatcgatcgatccatctatctatctactatacctatctatctgtttatctatccatctgtcaatccatctgtctatccgtccctctacctatcaacctacctttctgtctatctatctatccatggcattctaccgctatctcccttgttccatttttgaataatgatcttccctttttgaaatcctctgaaataatccttcgtgccgccaaatataaatccatcccaagaataccaaaattcccgcttttgaagcccttccttgacccctcccttggatccaccttgaaccctcgtgtacaaatacacaaattaaattcaaattcaatctccacatcaaacttctctccaaatcaaaccttccagtaaaagtctattttgcctccctccaactcgctcgggccgaaaccatcctcggcccatcctcttctttcgccagcctctccatcgcacgtgcgccgcacgtgactccctcagagagcgccccctctctctctctctctctctctctctctctctctcggcgtcgcttcccgccgacgccgcccaaaattccggctgcctccttcgattcccgcgcacccgtgcgagtggccgaccacctgggtgccgccatcgccaccctcggtcgtcgcctgccccgatgaccaccgtgtccgcgcttgccttcaaaccgtccccgtccttttgcagtcgtcgccggcgtcatcctcccgggcccggcgccccatgccgcatgcatccaaaaccgtgaggcgcggctcgctctcatccctttcctcccaaaccggaaggagcaaagctccctttcctcctcctcctcctttcgctttttcccctcccgggtagcgagctccctgcctccactccttggcttcttgttcaaaaggcagagccgctgacgccgctgcagcgcctcgccgcccccaccttgaccgcacccgctcgccccgcgccaatcctcccgtgctcgcggttcgatttccaccacacgatccaccgcctccaccaccctttgcatcctcgccgtagctcgttctcgcggcgcccatgaacaccagccgagcgccgagaaaaccgcggccacctcgaaccgaccttgccgctcccactccgtctctataaaacccaccccccgtgcttcctccctcccttgcttcgttccccccccccaatcggcggagccctgccgccatgggaactcctcgccgtcgcgtcgagctctatgtccggcgacatctcgccgtcgcacggtccgtcctctgccgcctcctccctcaacctcggtcgccgtcgcgcggccaaccccggagcgtcgccgccttcttggtcgccgcggccaagaatgccaccgccgcgaccaagggcgccaccgcacgcctccgttcccttccccggcacgcccgccgtgacgcgatgccgcctcggcgtcgcgttcgtcgccgtgcgccgctgctcgtccatgcgccgccatcggccttcccatcctcaactcgccgccgacgccatcacctcccgtcggtgagctccccacctcccttttccgctgtcccagcactcgcgtagctcgcgtcgcgcgtgctctgtttccgccgccgtgcgcaatcgagagccgccgttggcctccctctcggcgactcctctagccaccgccgttcttgagttccctcgctacctccccaagccgctgtttcagccgccggcctcccctctcgccctcgcgtcgcgtcgcccgatccgccgctgccgcgctcggccacttccgctgcgcctcccctgccgtcggcctccctcctatccttgattcccggcgctgccaccttcctcgggcccccctcgacctccccaacccctccccctggccgccgaccttcctcctcgctcccgcgccgtgccgcccctcccgccgccgcaaggcgccgccgcgagccacagcccggcgaccgtcgggtcccgcgtcaccgcatgtgcgccgcaaccccataccgcgtccactaaacccgagcgcgcgagccgcatcccttcccatcgcgcatccacgtcggcatcccggcgagcttcgccgccgccgccggccgtcgtcacgcgtcgtctccccaatccgagccgtggaatcggttcgccttgacctcctctagccaccggtgttcgtcgctcgcttcggctcgccgccgttcgccggattccgccgcgcgccgtgagccgtccgatgccattcccgcccccctttttctctccccatccgacgtggctgcccacgtggcattgaccgggcccgcccctgcccagtcagccggtcagtcgtccccctccccctctctcccctggctcgtgggcttggcccattggccagccttcctcctcggcctaacaaaacaaaggaagtttacctttactccctcttccgagtccggtgctcacacaccgaagagctaaaagtccgcaattgctccctccaattgctcctctctctctctcaccttcttattggccccactcgtcaatgagtcaaagataatcttgagaatgtctttccaatattccacaaataattctctcttctataaattcagtaaatcattttatcttatttcgtgggttaataaatctttttcccttgatcctataaaacaattctctattccaaaatttcatgaatcattttccttataaatcatttcctttggtcccgcacgtcagagacggtcaataatattcttgagaatattatttctataaatttcatgaatcaatccccccttgttccacaaatatcttccttcgccagaaattctaattaaacttccaaaattcgtatctctcgatccaatcgtccgattgaccccgttccacttccagtatttccataaaattgagatctatttaatggcactattatttagtctaaatagggtctttttcttggtctcttgtttaggtttttgtttgtttgagcatagttgcggttaccggattttcgtcgatcgtggatatcttgaagattcgtgaagcttcgtgaagaccctgagcaaggcaagccacccttgaacatactgagcctatatttgaacttaattatattgcttgcaaaatattatgcattgataggattacacttaatttgtttgccccgtctgaaaggcagaccggtgggcctacccaacttgttgcatctgatccttccattgttaattgttatatcatgttcccttgtaaccatctagttgcgcctcgatattcgtgcactctgtgcgagtatcaacggtcgccttcaaacttaaaatctgagtaacttcttgggtaaaacttggtttgcaaaagctttggaaaacccgacgcctgggtcggtgccttgtgaaagaaaatgagttttaaaaataaaactcgcgacacaaggccattcctgggcggaatacttgtgcggtcgcatctaaggaccgattcctttggaattacatcggagcatacaatagtgcgaccacacgggtggaatgggacgcccctggctgagtaaattgctaatcgggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcccttaggtcaccagacgtggccattctacacgggctgggtgattcgggttagtaatgtcgtgtgggtaaagtgtaccccctctgcagaggttaacaaactgttcgaacagccgtgcccacggtcacgggcggatgtgaggtgattccttagcgtagtttttgttttaccctgttttatgaaaaggtgttaaggtttgggaaacctaatgcttgggaagcatttagctgtccgggggacagcgggaccgggtgtccctggaagtgattggtcgtttggggaccactattatcgggaagtttggaaaattggtttggtttgggaaaaaccagatttgaagccaactctgggagttgtgcaaatcttgataaataaatttgttcttctcacctcccgaccaagctgagacttgtctcgctctggttgtggaaagcacacacttagattgttgaaaacttgaaaacaaaactgtttgcaaaataacagccttcccttgaagcctgcattaaccacctaagttcccctggcttgctgagtacgtaagtactcacccttgctctatataaatatatatatagttcctccgtcttgaagaaaagatgaagtgaagcgaagattagagtttcgtcctggatcccagccgtcgcctgtggtgttgggtgttagaccgttggttccgctgcagctgctgttgttggtgttcgcctcgtccgtgtcgtcggttgcattctcgggctgtctgagctgcaacctaagttaaggtaaataagtcctctatttattctaaggatttgcaatgattcatatttgtcaccgtgggtaccagcactatgtcctgggactggtaccgagttcgcggtttcgtaggaagcggttcgcgccgtttttcctacgacacgctcctatcaggtgccgttgtgcggcggtgccggattggggtgtgacagagatggtgtaacatcccggcctagggcttaataggattaatagaatactcatatcaacaagttgcaacttcttttccggaagccaatctccaaagaactccagggttaagcgtgcttggcctggagcaatttgggatgggtgaccgaccgggaaattcttcccgggtgcacatgagtgaggacaaagtgtgcagaaaagatatgtgttggtctgtgagggcagtctatgacctatgaaagctatcaaatgtaagtgggcccggcgaaagctatcaaatgtaagtgggcccggcctgggggaaggcgggacgttacaaaatggtatcagagccgactctcgcggtttcacgggcgcgtgtgtcgcagttgcgcaggcatggtgcgcatggctggtgtagaccgggagtggttacacagcatggcacatgcgctggcactggacacatggacgtggccaagagaggacgttcctggcctagggttgatcgacgggggcgtcgatctctcttaagggggtgagggtgtaacatcccggcctagggcttaataggattaatagaatactcatatcaacaagttgcaacttcttttccggaagccaatctccaaagaactccagggttaagcgtgcttggcctggagcaatttgggatgggtgaccgaccgggaaattcttcccgggtgcacatgagtgaggacaaagtgtgcagaaaagatatgtgttggtctgtgagggcagtctatgacctatgaaagctatcaaatataagtgggcccggcctaggggaaggcgggacggcccggcctaggggaaggcgggacgttacattgggcgggcagtctatgacctatgaaagctatcaaatgtaagtgggcccggcctgggggagggcgggacgttacattgggctgctgttcttaggatcagtatgttaaagtctaggttttcgccggtttttctttaattaaccgtattgttgtaaggtttttagatctggttttccttataaactagatcaactctcttattctatggtgaattgtacgaactccctgcctgtcccctcgaaaaaaaaactttatcatcttaatacttctatatgctatctcaatatctcatatgtgcttatataaatatggtgtacgtatatgcgagtgttttgcagttttactgtatttatatatagcaggcatctaattcatcatatagtattaaatttcaaaaatattatgagaacgcacgcggccgtaccaataccatattagcatattagatgagtccactagcactgtactccctgtgctggtggccttgctagttggtactacgttcctgtcctaaactcaattatcggtgccgttgccttgtcctgcttgcatttgcatgcatgctaattaaagtgttcgttgctgtttcgtcgcatgcacgtacatgatcaggctgtgtggtgaaatcaaaccagattagagagagatcaccgtgtccgtcgtcatcggcgcgcgatgccgccgatgagcatgagctggtggtgggcaggcgccatcggcgccgccaggaagcgccacgacggcggcggcggcgagcagcagccgccgttccggagcgtggcgctcgtggtcggctccaccggcatcgtcggcacctccctcgtcgacatcctcccgctcccggacacccccggcgggccatggaaggtgtacgcgctgtcgcgccgcccgccgccgccgtggtcgccgccgccgcccgccgcggtgacgcacctctgcgtcgacctcgccgacgccgccgccgtcgccgaggcgctggcgccgctaaccgacatcacccacgtcttctacgtcgcgttggcggctccccacctcgcggaggcgcggagccgcgaggcgaacgccggcatgctccggaacgtgctcgccgccgtcgtcccgacctgcccggcgctcgcccacgtcgccctccagaccgggagcaagcactacatcggcccgccggagtccatcggcaagctccccgtcgagacgcccttctccgaggacatgccccgccacgactaccccaacttctactacgaccaggaggacgtcctcttcgacgcggtgacctcctcctcctcctcctcctcctcccgccgcgccgccgccgtcacctggtcggtgcaccgcccgtcgctcatcttcgggttctcgccgcggagcgccatgaacgtcgtgtgcagcctctgcgtctacgccgccatctgccgcaaggagcgccgagagctgcggtggccgggctccctcggcgcgtgggaagggttcagcaacgcgtccgacgccgacctcgtcgcggagcagcagatctgggcggccgtcgccgacgcggcggcgaagaacgaggcgttcaactgcagcaacggcgacatctacaagtggaagcagctgtggccggtgctcgccgggaagttcggggtggagtgggcggggtacgagggggaggagaggagggtggggctgacggcggccatggccgggaaggaggcggtgtgggcggagatcgtcgcggaggagaagctggtggcgacggagctcggcgaggtggccaactggtggttcgtcgacgcgctgttcatggacaagtgggagttcgtcgacaccatgaacaagagcaaggagcacggattcctggggttccggaacacgctcaggtcgttcgaggcgtggatcgacaagatgaagctttacaggattgttccttgattaatttatctcaggtttctcctcaatctctcgtggattaataattataccattagatccgttaaaatataataatttttagctataaatctgaacaaataaaatatttatattttaggacgaaagtacatcggtctaatacggtggcctcgggcaaccaaagtagtttgtggtgttctctctggtcatgcatggtcaatgcttccaggcttccagcgtcaaatcattttgaccaaaaggggttaatggtttgtaaaacgttttgctgtacatttgtccattgaattttcctcgaaaaatatatactccttttaaaatatttcaatgatgatgatgagtggtgaatctgttaccctccactatagatggccaaacgggcggcacggctcaggcccggccgtgcctgggccgaggttagtcgggctggcacagctccagcccaggcatgaccgtgctcgggtcaaagatttattgggccggcacggtctgaccaacatactgggccgtgttgtgttgacccatgtgttgaagcatcggtcctggcacgacctaatacaactcgggccgtgtcgtgccggccggaaggcacgatagcccatcgcgcttcttcaaaaaaaagtctaattttcgtccctcagttctttaggccatgtctaaacgattatgataagtctattttgcatctcttcactcttgggccgtgaattatatggctgcattaagtataattttagtccctaaactacttttcttccctcctcattggattgggccgtgccaggctggcccaccgtgccaaggcatcggtccaggcagggcccagctatcgggtcaggccggtccggacacgtccctaatcgggccgtgtctgggtcgggccaaatggccaggccattgggcctcgggtgctatggtcatctatatctctagtcatgaatggtcaatgcttccagcatcaaataattttgaccaaaggggttagtgctttgtaaaacgatttgctgtacatttgtcgaatgaatttccctcgaaaaatctatactcctttcaaaagatttcgatgatgatgatgatttgttatctcccactaccgcttggtggcggatgagcggatccatggcccgataatcctaggcagctctttgggcttgccggcacgatcacaccattataataccattaattttcagtgattaacatgtataattgttcacactatatgtttgtagcatatataaatttaaccttgtatgtttctgatgtgatttaacacatactacctccgttttttaatagatgacgccgttaaccttttctcacatgtttgatcattcattttattcaaagaatttacgtaattataatttattttgtcatgagttgttttatcactcatagtactttaagtgtgatttatatcttatacatttgcataaaatcttttgaataagacgaatgatcaaacatgtgagtaaaagtcaacggcgttatctattaaaaaatagaggggagtattaatctatctcactatctcgttgaattctatcgtaattatttggatgataggcaaacgtcgagagtttgaaatagttttccattaatttgtgtggcagctcgcaagagaagaagagatagtaaaacgcaaccgtacgttcggccgcattcaagcgaccgtacgtgtgggcgacgaagtcggtcgctcctccgttttcttctcttctccgaagtgtttcgtgcgtgcacgtgacgtgttttctgtgccttcccacaatagtgttcaagcctccatctgattgctctgaagttttgggagccacaccaggatagtgtgaacatttgaatcaacgacacatgtttttgtttgtgccggctcgatcgcagccacatcacgaaacatatctaccccctccgtaacaaattaaataaatttataataaaatagaactttttatagtatgataaaagttttagatgtacatttgtttagatccgttatactagaaaatatcatattctattcagggttggtttatttttatacggagggaatacttaaacacggtattggtttgaccgattggatgcgcatggttaattaagtattaactaatataaacttggaaaaatgtttttttatatttgtaaacaacttttatatataaagcttttcaaaaaaaaatcatgtcattaagtgtcttgggaaatatgtccatagtaatctattacatccgttctaaaatataagaattaaggatcagataatatatatcatattattacaaatctagatatacttcttatcccatcggatcataggttcttatagtttggtatggaggaagtatattagctaatgagtgaaaaagagcatggcccttagactgcactactgcagtggtgatacggatccagctcctctgactttgggctcgtacgtcagaggagcccaatattttgagtcacatactacaatagaaaacagtgtcttgacttaatgctatagcaacagtgaaatgcactgtttgaggttactgtttagatattactatggcatagtgatcgttcacgttcactcgcgacggctgaaaatatccaagttagagtaccgtacgcctctgacttaaaacgccgaggatctcattccgtggtgatacgtggtgacatattgaaatctgtgaccctacctcttcccaccatagcttttattgttctatgatatatatcaaatataaatgtgttgtcacgtatacacatgatcaaagtgagcaatccttccagcaaagcaggaaataacacagctgaggcaaaactatattttatttatttttcctcattaaaacgtactatggtatatatattttgtaagcatgggtatttagtgattatagtagtaggtcggtgcgcagttcatccgtatcagagcaatcccaacctcttggcgcattcgacgctgcagatcaacgtctcctccaccccatacttgtacttgaaacctaaatccacaagcttatttgtatccgcttgcaccctcacgtccttgcctaccaccctaacaaagagaccacacatatatatgatatacatttatatagcacatcctatatcttcatcctaaaatataaaaaaaatttagctataaatataaaccatacatgtatccagatttatagtttaaaatgcttatattttataacgaagcgagtacaattttatctaaagaacgaaaaataacaaataaatcactggtcaaagacacgtactctttgagttttatcgtgatctctgggtatttggtgacgaagtgatcgacgtaatcctgcatattggggtacccaacggcgcagaggaagcggccggcgatggacggctgctccgcgcagaagatatgcgcctcgcagatgtcctcgatgtgtgccagtggcaccgaacctatcagggcctgcaagaacttgagggtgttgtggcatgactcgtcgccggtgagcggcgacacgatcaccggcacgctgagcgagtggtagagctgggtggtgtcggcgtcgccgccgacgagcgcgcacgccagggtgaccacctcgaacgccctgctctcggactcgttgtaccttagcagcagcttctctgtgagcgtcttggatgaagaataatcctataaagccatttgaagtatcaaaaaaaaaaacgtactgcatgtaccattgttaatttgctctatggtatctaataaatcaccaatcagaagtctgagaattactaacatatgttgaaatgccattttcactcggttaaacgaaagaaatattcctgacgatgattgcgaatttgggtgtactgtttaattgattgtactagtataatgatatattatgctgttgaattcttttaatatctatatagatgatatatatactccttccatcctaaaatatacatacttttagatctagtttctcaatgctatagatatgaaattaaaaggggtagttggtattgatttaattagatgagaaagtttgtagagaaatcaaatgagggattactgtgattagtttaaacatgaaaacagacagagaagctataatatatttaagataaattttaaactatataaattttatattgaaggagagataaatttttatatttgctcattactttgtcaacatgaaatgcgtagttgattaattacatactttctctgtttcacaatgtaagtcattctagtatttttcacatttatattgatgtatatatgtctagatttattaacattaacataaatatgggaaatgctaaaatggcttacactgtgaaacggagatagtacatccaccatggtgttgttgtagctgtgggagtgatcgagaggagtccagcatgactcgttgatgaagtccttgtacccctcgccgccgtcctcccggagcggcgacgcggcggtgacggaggccgtgtggatgacgcgccgcaccgtctttgaccgctcgcattgctgcaggatgatgcgcatcgcgtccaccgcggcttcagtggtgttcttgtactgcaaaacaaaacacatgcgaatcaacctctcatcttaattattgtcatctggtagtgtaaagtttaatctaaaacagagcactcaatagtccactatccctctattcacatttactaaagccatcgagacacttggtgcagagtctgaaagtcattaactttcattattacaaaagtaaatgatcgagattatcatttttaagtagctgtgtaatatttttcttcaccagaaagaccgaaagaccgaaggaggctatccgaatatattaagaagaataaagttacaacaaaaaaatccacggaagcagttgagatcggaagtacaccaaagtgcacgaccaagaaccacgtgctaaccacacaatcacaaactatttagatcgaggaacctagcaccaaaacgaccctccgctatgcgtgaccaatcaccgtcgtgcctacgacaacaccaccaagacgagactctggaaacgatactcccccatggaaggtcacggcatcaaagacgttgctatctcgcccatgtaaaaaagatccggtatgtgatgatttcatcttttccacgatagcattcgaggctagcagccgtgtgtaccttggtactgcgagggtcgtgctgcagcggggtggcgaggaggaagacgaactcgcagccggcgatggccggctcgaaggtgtcggcgtcgtacatgtccgcctcgaacagcaccagccgctccgccgcgccagggagctctctcaacggcgccgtcttcttctcatctcctatcaaatcacgtagccatgaaaatttgtattacctccatatttcatattttaatgtatgacgccgttgactttttatctaacgttcgaccattcgtcttattcaaaaaatttatgtaattatgatttattttattgtgacttgattcatcatcaaatgttctttaagcataacataaatatttttcatatttgcacaaaaatctattatattattaaaggaatagaaaaaggagcctccacgttcgctctcacggcctagaaattctcacattaatcggagaaaaagaaaaaacagagtctatatagaaatacaatttagaaatagctgaaattcggaatcaaaaaataaggaatattagaagaggagactagagtccatataaaaatacaatttataaataactgaaattcggaattaaaaaataaggaatattagaagatgagactagagtccatatagaaatataattaggaaataactgaaattcggaattaaaaaataaggaatattagaagtagagtatagagtccatgtagaaatacaattaggaaataactatataattagaaaataactgaaattcggaattaaaaataagaaatattagaagtagagtatagtccatatagaaatacaattaggaaataattgaaattcagaattaaaaataaggaatattagaagtaaagtatagagtccatatagaaatacaattaagaaaaaaataaattcgaaattaaaaaaataaggaatattagaagtagagtatagagtccatataggaatttaaaactaactaaaatttggaataaacataatgaaattaaaagtagagtttagagtccgtataaaaatacaatttacaaataactaaaattcgaaattaagaaaaatatgggaagaagagtttaaagtcaatataggaatacaatttagacgtaactgaaattcgaaattaaaaattaaagaatattgaaagatgagtttagagtccacatagaaatacaattagaaataataaaaatttagaaataaaaataaataatattggaagaagatcatagagtctatatagaaatacaatttacagaaaattcggaattaaaataatatattaaaagacgagtatagagtctatatatgaatatatataatttacaaataactaaaatttgatattaaaaataattaataactaacaagtatataaaatacaatatgaatattacacattagtagttttgtaaagttattgcaaaatttaaaattatgttgtcattttaatatatttaaataatataatgagaaaatatatatactattatatgatagaaaatataatgatgctagccgcgcaatctgcgcaggccaccatgttagtttattatactgtgatatattacatcatccaaaatcacttatattatgttgtacatatgttcttaatgacatagaaatcaatgttgaaaaataaaataccatgaaaaacttaaaaatcaattttaaaattcaaaatatgattggaatgacaagatgaagagcaaacgataaaataagcccttatcgcgctctttttatgcggaatggttaaatacatgaataatttgagataattgtttgaagattaaaaaaaacttaatgcattaactattataaaagttgaaagaaaagaatgtaaaacatttttttaaagaattcatatatagttttttttaaaaaataccatttagaagttcgataaagaatgtgtgtttgttgattattccactaggaaaaaaaggagacagtaaatcaacacgtgatttcttttttgttagccaaatgatttctacgttatagtattgcaaagacttctaaaagggttaaaaaaaggcctttgctagttttgtataaaacgaatgaacaaacgttgttcaaaaagtcaacggcgtcatacattaaaatacggagggagtaaattgtgttggttttatgcttgcagatggctacaagatttttggaaaatatagaggtgatctagctagagaatagtagagatcattggggagagtataccgagatttctcaaggtcgcatgcacgacgcagcctcgctgcagcagcttcttgatgaggcacgtcgcgatgtagccgctggctcctgtgacgcacaccctgctgctgctgctgctcgtcatcgcttctgcttctcgttctgttccttcagatcagatgcgtttggtttctatggccctctctcaacctgtttaaataatgcaaataacgtacaagactgaacttagtgtcagtgtcagttgtttgggaaacaaaatctacttcggctgcgttcttttcagcaaagtcctcctcgttttccgttagcacgcttttcaaactactaaacggtgcatttttctgtaaaaagtttctatacgaaagttacttaaaaaaatcatattagtccattttttttaaaaagaatagcagatacttaattaatcatgtgctaatggatcgctccgttttccgtaatcactgttcataagaagaaagaacgcagccttcctccatttcatattaaggtgtgtttagttcacactaaaattagaagtttggttgaaattgaaacgatgtgacggaaaagttggaagtttacgtgtgtaggaaagtttcgatgtgatggaaaagttgaaagtttgaagaaaatgtttggaactaaacaagggcttaatagtcattttaactttctttctagctataaacttctttagatttaactaagtttataaaaattttaatattcacaacattaaattagtttaattaaatattatgttgaatatatacattgataatatgtttgttttgtattaaaaatattattatattttctataaaaatagtcaattttttaattaaaaatattagttaggaaaaaaaaagtaaaaacagcttataatatggtaaaacagtgtaagggcatgtataaaggtagagtcaggcatgagctctgcattatctagagactaaaatcttacaatagttgatgacaatatggtctctaatcattaatgtatcaaaatatttttcttactattctttcatttctttcaccaccatgcaacgaaatttgctctaataaataaatgctaagagtcaactctgagccgctgtcatgcataacaatcatatttctctttcctcctttctctttcatccatgtcatcaaatttatttgcatagcaatatagagaccactgataaaaaccgttttacatgctctaaacaatgtgagtgttcggcggggacagcctttttttgtggccacatgtgccacgatttgcatttatacttaccaaactagttgtgcgatatctgatccgatctctgaccacaggtttgcattcataccatcgctacaccaaaccagaatttcttgaaaccatatttcagatttagaaaaaaaaaatcggatcaccgtgtctgtaccaattcattaaaagttaaattttttttgaacagattcgagaattccgtcccaggacaaacatgccgcagctagcatacatctatcatggcctggagaaacgaggttcatgtttgaaaaacaagatgtgtattcccgacacatttcgctgttacagaaaatttcaaaaaacatctctatcctggccatgctgatcattgaacaatatatcaagtgaacactgttgattgttagacctccaaattcattttcaaattgttgatcattaaccaatctttcaaaccgaaaacgtggatgacaacacgctacgtccggtccccgtcaggtgcagccgcggcggagccattgagccggccatttctccactcgcgcgggcaggcggaccaagcggcggacgacgacggtacaaggatgcaattttttttttactagcaaaatgcccatgcgttgcctgagtgaagaaaaaaaaagtaattagtgtgtgggagcataaagtcaccaggttaattgaggtctatatagtcaaatcatgcctttcctgtgcaaataagacgctaacatgatataattatttgccgctctaaatccactaacatggatactaaaatttggaaccacaaaaaatatttacttttttgtcatgtattattatgagtcagttgcaatacattattattttatggtactcggtattgataaacttttttcatattgtaaagagtagccatagtacaagatatattttttgctagttatcagatcaacctcactgcactccaattgcataatcactcactcaaaaaatcagaaggaaatggtacaatcaatggaaagaaaaagaagtggtgtatcgtagaataactttcactctaaacaatagaataaatcatacaatgaatggaaaaaaagtgatgtggttagatgtcctacggcgaatgagaaattgatgagggaaaaaaatccggatgtaaacacgagtcattttgttggtgattacatgttttttaaaaagaaagacacatatgattgttttttattttttaaaaataatttattttgttggtaaatagttcatttaaattttgtggtgattacatgtttttaagttataaaatcttttttttatccgatacctggtaggcatgagtccaaactttattcctgcttgtgctgggctgtagctcctctgctcggtgggctcgctggtggctacgactgcttttttctgggccggcctgctgttgcttttgatgggctgcaatatttctccactaatccacaaatccgatctgctttggatgggctttctccttttttttttctcttttatttgcgggcttaagagatcgctgtcagcttccgaatcgtgattagcgacgaaatatcatgtggacccacgcttaatgacgtacgaaaatatttacggaagccttacttattttttaagtagtttttttattttaaaaatctttttaattttgaaatcaaactcttgtgaaacttatttttaacatctgaaccttttgcacatgtcaagcaaattggcgtcacaacacaatactttcacactggtctcgttggcgtgaaaacaatctttggtcacgctgctcgataaaactgttacgcccattgcaagtggtgtgtaagtgtttttttatcacgccgggcgtctggcgtagacaaaaggtttgcatgttaaaaataagtttttaaaagagtttatttcaaaataaaaaaaataaaaagtacaaaaactataaaaaaaatccagagatggacaggactctggccaattcggctttgcggcgccggagcgcacggtgggagaagcatgcacggaacggagccatcgtttttacaaacgaaaagtattttgtgaataaaacttatatacgtgtgttcttagcacaaaatcagctccaaatttaaggttgaaaatttaaattttacctgataagtataagcataagaaaaagatgaggcctgaaaaaaaaaaaggagaaatagacagacggttggtggagtggaagggcctccaggctccagcaaatgacattgtcaaatgacaagatggcaaatgcgatggctctagctgtcgagcgcatatatggtagtccctccgtttcaggttgtaagacgttttgattttggttaaagtcaaactgatttaaatttgactaagtttatagaaaaatatagtaatatttgtaatactagtaccaaattagttttattaaatcaataattgaatatattttcataataaatttgtcttgggttaaaaatgttattattttttctacaaacttagttaaacttgaagcagtttgactttgactaaagtcaaaacgtcttgtaacctgaaacggaggtaatattatcgatgaacaatgttctgatagctttagggtacatttcttagatacggttggagtaaaagggccggaacaaatacagacattaggacagaaattatactgcttggcacgctcaaagtaatcccagcctcttggcacattccacgctgctgtccaacgtctcctccaccgtaaacttgtacttgaaccccaaatccccaagcttgtttgtatccgctttcaccctcacatccttcccaatcaccctaacacagaccacacaaacaaacagatataagatctaccccctccgtttcacaatgtaagtcattctaactttttccacattcatactaatattaatgagtctagattcatatatatgtctagattcattaaaatcaatataaatgtgaaaaaagctagaataacttacattgtgaaacggaggaagtacggtacatacatgacacattcatatatcctataaagaaaacataagatcgagagaacaaatcaacaatgcacttacccttgaagctttatcgcgatctccgggtacttgacagcgaaacggtcgacatagtcctgcatgttggggtacccaacggcgcagagaaatcggccggcgatggatggttgctgctccatgcagaagatgtgtgcctcgcatatgtcgtctatgtgcgccagtggcacagaacccagcagcgcttgcagggacttgaggccgccgtggtagagctcctggccggtgagcggcgacacgatcagcgggatgcttagcgagtgatagagctgcgtggtgtcggtgtcgccgccgatgagcgcgcatgtcagggtgaccacctcgaacgccctgctctcggactcgttgtacctcagcagtagcttctctgtgagtgtcttggatgaaacataagcctacaaaagcacaattcatgtgatgatctatcatttctcatatttgaaccgcatgtatgagagattcagtttgaaaatttacaactcaagctagtgtacaattgtcaataagatctatgttcataataacatgatctatctaagaaataaccagaacttttttagcgtgcaaaatctctcccagtatcaaattataattaagtatagatagatagatagataagacaatattcaaatatactccctgtatttcataccgtaagttgttttgatttttttttccattcaaacattttcaagtattttcgacacaaaagaactattctttcaaaatatattaaatgtcatacttattgaaactaatttagtgtgatagatgtagctatttttttataaacttaatcaaatcttaaataagtttgaccaaaagaaaaaagtcaaaataacttataatatgaaatggagggattacttatacttttaaaattactagaattctttttatttcttatcactaaaatataatggatttgaaaataatttacatatatgtgtagtactattaaaagtatgtgcaaacttttcaaagaaattgataacatttaatttgttatagctgttgtgcatgatgttcgtaatatactagttgcaggatggatacgctccttgatagatagatagatagatagatagatagatagatagatatgtgaacatatattttttgacggagaatgggtagctgattacatccatcatgacgttgctatagcggttggagagatcaagaggagtccagcatgactcgttgatgaagtccttgtacccctcgccgtcctccctgagcggtgacgcggcggtgacggaggccgtgtggatgacgcgccgcaccgtctttgaccgctcgcattgctgcaggatgatgtgcatcgcgtccacagccgcctcggtggtgttcttgtactgcaataatataaaaacataattaacaattaacaaacttacaaacacagcaacctctcatcctgctaattgttgttgcacaatgcacctagtgctgctactgactgcatgcctagaactagtagtagtgaattctaaaaaaaaacagaacactcaaataatccatgatatatccatcttaaactcaggccatcgttggagtttattaattccaggcttctgcatttaatttttttttttaaaaaggaaggatccattattatgaaataaaattacaccctgcctctgcatctgtatctaccagagtgctgcatgataaacttaactttcctttcctttccttttttttttctctttttcagttccagacagtgtgcactgcgtgcgtgggttaccttggtgctaagcggatcatgaattagcggggtggcgaggaggaagacgaactcgcagccggcgatggcgggctcgaaggtggcggcgtcgtacatgtccgcctcgaacagcaccagccgctccgccgcgccgggcatcctcctcagcagcgccgtcttcttctcatctcctgtcgtcagatatatgcatgatcaccaaccatgcatgcatccatgaatgaatcaacaagaatttggaaagaaagtgaggaagagatgggtaagatgtaccgagatttctcaaggtcgcatgcacgccgcagcctcgctgcagcagcttcttgatgaggcacgtcgcgatgtagccgctgccaccggtgacgcacaccggcctgctgctgctcatcgtgtcacacgacctctcctcgatcgattgttgttgttcgatctcttcttcctccagtccagtcaaatatggtggtgtctgtgactctctcggcccggtttaaatagagaaaaaactaagaccgggcttgatacagatgttaatggttttaataagaaaaaaaaaatacgttttgttcgtcctaggagtccgtatcttgaacgtggaagaaacaaaatgcatgtggcgtggaaacggccctcgcaggcgttgcaatgtgtgtttctcacggaaaagctaacgcgcacgcgttggtggcgaccgttttcggatagtttagcctaactaactaagttattagtaaataatgatagtaattaagatatgattttcttttttccggaagattttttctactaaccgattgaaactttcaagttagatttaaaaaaatatgaaaactttcgattgaaactttcaagttagatttaaaaaaatatgaaaactttcgattccgattaaaaactttcgactcgagatttgaaaatattcaactcaaattcgaaaactttcaactcgagatttgaaaatattcaactcaaattcgaaaactttcaactcgagatttgaatactttcaaatcagatttaaaaatttttcaagttaagatttaaaaactttcaactcaaaacattttaaaaaaataagtgcgctaaagattaaaagaaataatcagaaaaaagaaaaaaaatcacaaaataaaaagaaaaaacaaatcgcgaaaaaaaataggctggtgggcttttctgggccggagcagctggcgcgccaacaagcaacgccctgtttctcaagacatgcttcttgtatttatgcataatactgccaaactagcagcccaccgcctctggtcaacttgtgtccattgagaaaatcaccgcactccaaactaagctttttttattcttatctgtatctctatcgctatctctatctctatctttatactattataaaaattaaaaatgttttttccggtactttaatatgttatccgcatatgagtcagtttttaagttcgttcgcttttgaaaatacaaattcgtatttgagttgggttttaagtttattttggttttggaaatacaaaagaagttgtataagaaatttcttcaaaaaaaactcgcatgttaatttgaaatgatcgaactaccaattgtagctcatgattttctagaaaaatatatatccaaacgaatcctcacagtgaatttcaccttaactaaattatataacaataataaaattaaaataatcttcacccaaaaaagagatcattactctatattacagcaaactcagctgtttctttttttaaaaaaaatatgaataaattcgaaacaaattctgctgcatgtacgtatggctggatctgttctaggctaccggcatcggagtcaggcgctggggtcgtagtcgtagtacgtactcgggattttgagtttgtgcttacaacgtttgaccactcgtcttatttaaatttttttaaaattattatttattttatttatgatttactttattatctacagtattttaagcataacttttcgttttatatatttgcaaaaagaatttgaataagacgagtggtcaaacgtttcaagcgaaaactcaaaatctcttgtactgtgggacggagggagtagcagctagcgtggcgggggcgcgggtgttgtcgcggcagagactgtttggttgctaccgtgagctacttgcctgaggaaaagtggcgcctgagagttccctgaaattttggtgcttgttgcctgatggggcatccttgagttggttgtttggttgaagtcctgaactaaacgtgcctgaggaaaattagtaggcgcaaaacagtgtgctttgagtaaaaaagtgtttataacacttcccattagacagcattaatctatagatcattccttctgattggaaaccctaaaaaaaagtttcttctgattgcatcgcacggaccaaacacaatacgacgattgtggaatccagcaaggaggcggtggtggtttgcatcatcgcgtattctcgtcaggcattacgacggtgattatcaaccgatcgatgctgccgcctggagctcaggccacctattttggtcgcttggacgaggctaattgcacgcctaaggtggatcaggccaggcaggtggaaagggccctcagggcagcaaccaaacaggcctttaaccctgccattcgacgcgagcaacccgggcggccaggcccctgcacactgccgcttgcacgcacggcgttcacctgcggagttgtgggccgggggagtttatcctaggaaaaagtctaatatgggtccctaataatatagatctaattcgtatccctcagccgtaaaaaccggtataacgactccctcaactatcaatatcagttcaatttatcttcccaggtggtttgcatgatagttttatcttgcgtggcgcatgttaacgtggtatttatcctacatggcattataattagaaaaaaaagtaaaaataaaaaaattgtatgacccatatgtaagtcctcatctctctcctctttttatttcctccctttctctttctccccatcacgcttctagcggcagttttgtcttctaggagggcggtagcgagtcgggagctgggagggcaccagcggttcctccccctcttttgtccctccctctcctctctctgaggggattggggtgccatggccatcggacgcaaggaagggcgtcattctgttgctgcttattttctaacggtgactcaggacaggaagcgggccgacgacggtggccaccaggctcgagatcgtgtcaccccacgctgactccagcactagcgatcctcccttccctcccgccccccaggtgtaatctctaggaccactactaccaccaccggatcctcctcctatattatgccatctgcgccacgagaggtctcgaacccggtgtaatggagcttgagtgaccaggaggccccactgtcccctctccttgcggacgacgcaacaacgaaggagagtggccgctgctgaccctgagcactcccctcctcttcaactagggaggtgctcatctagtggctcctcttcggcacacaccatgacgtcaaggaagcaatgctgcatccacccagtcatcttcaactagggaggtgctcatctagtggctcctcttcggcacacaccatgacgtcaaggaagcaatgctgcatccacccagtcatcttcttggtgacttggtgtcggaggcaccgtgg

SEQ ID NO: 62941 - DNA, 1231 bp, Oryza sativa
cacgaaagctaaattttatattgcaatttattcttaatggacatcaaaatgacacgtgttttcatgcccaagttcttttagatgcacacctattgaattgattatttggcacagtgcataaaatagaaatggtggcactaaaaaaagagccagtcaatgatggaattgctacaagggcccttaacactttataaaggtcaagcctgccttggttattcatgaatagtgaagaaatggtatttggcgcttgtgtcacactatcacctatttgtttgattagaattcataggagacgaaaagacaaatgcaaaagcagtctgtacccttgaaacagtgaagccccattctggaagacgcgcaaaggtgccatctgttctgtgatttcttgagatgagcttccagtattatcaatttcaccaggagatgagtctgctgactgttcggaagaagcctgaaaagaggatccaccaacagttgacgcaggtggcagagttgctagttcttgcccttcctcagaaatagctgtgcaattaatcaaggagatgcagcagaattaccacattgggtgactattttctaatgaaattggcacaagagaagagagtcattcgtcgaagttatggagaggccaacctgtgtaaccagatacagggaggcactgggtaagatatgaggccgtctgggccagataagacgcagcttggtttaaagctgggacggagaggaagagctgtgaatcttcagtcctgtcggctgaatatctagcatcaacctagatttatcaataaacattaacaaaattggaagtagaaggcaagtaattgtgtggtgtggcaaacttttggcaattaaatgcatacatggtacaaccggagaacgcacataccgatgatgcagaagtagaaggctgccccagcgttgaaggcaaatcctccatggttggctctttatccatgagcggttgtactacatgtgaagcaacgagaatagaaaatgcaataagtagcgaagaggaagactatggaatggaatgcagcacaagttgatgagatggattggtagcgagcgtgtgaggaagtcaggattgagggtatctcaattactggtgggcaagcctaaagtaataaaggaagggaaggtatcccatccatcccccatctgatctcttgagaaacacgctcatatcgtttacccaaccaagttaacgagtactcacaaattattgattcat

SEQ ID NO: 62942 - DNA, 799 bp, Oryza sativa
aaatatgcatatttatttggatgtgacttttggaaagtatcatttaatggtaaaaaacggttattacaccaaaagttcaatcatagctccctgttctatatgtacctttcgaattgtttcagtgacagcaacagcaacccaagttggccataagcagggcaaccatattcaatgtggcaatgaatggggatgcacagatagcaactgttacaccagctatggtaaggatacgaccctgaaatagttgtttaattcataacaggaatcagtaacgaaatttcgagattttttttttcgaaatgaaagaagaaacaaaattagcaaaacttcctcagtcattgcagttttctaacaacttgttggttaggacatttttaaattatatggtttttgccaatgctaataagttgctcagtacttggaatgtagtgatgtagaacatgcaatacatcattttgactacatcgtaatgaactcttcccttcttttgacgatatgagatgcgaattatctcttaattggcaaactgaggaacatatgcgtgtatcagaattacatcagaattcagaaggaaaatctattgaaattttgacacattcttgtcttcaaaagaacaaagagattcctaataataggtcctgggggataaaaaaataaccctttggggtacccatgcctaacaatagatgtttaaatgaactgagcttctattgagccttccccaccaaaacaaaaaggagggagagcctaatgagtcaaaatgttcagtttgcaacatataaagctacttcaccatgac

SEQ ID NO: 62943 - DNA, 721 bp, Oryza sativa
catcataagcaacagaacaccaaatctagacttgacctacctcccacaatcttctttttctttttctttttctaatagaaatagaaaacctcccacagtgttctcactgatttgacatttccccaggcctgactcaggaaagaacccaaatctcctcggacaaggttgaatctttaccaaaatgttgattgagtccagtgtagggctcaacatccacacaagaaaaccttcatgagtcatgacacagatacgcattgatccagcagttatagtatctcaggctcatggatgggacaatcgaacatcaactgatataaacgcactaatgtagtaatgctataacaagacaacgcgtgcacggaccaaatcaatcatttcggcgggacgaaattaacaatccccatcccaaaaatagaatcattatctaggtaggatcaaaagcgcgtagacgaggaaaaaaatgattggtacggacctaaatcatggtggtattcgtagggattgcgcatcattctcttcatggcggtgttgtagtcctccatcctagtgctccccgtcgtggaggagcggcacaggaaaaccccagaggaactccgccgccgttggctcctgcttcctccggcggccatcctgctcctagcagcgacggcgccgcgcgctgggagtcccggggtggccggaaaacacggggcggtggccatggcggccatgtttgcaggat

SEQ ID NO: 62944 - DNA, 568 bp, Oryza sativa
ctcctcctccacctcccctccccgccgcttcccgtccccaaccctctcctcccctctccaaaccctaaccctaaacccctcccaccccaatcccgtcctgtcaatcttgtcatcatcctcaccgccgccgcccggggctccctccctcccgcctccggattcggattcttcaagcttgcctgccggattcgattctgatggcttcggggtgaccgcccgcgaggagggaccaagcgtagatggcattgggggatctcatggcctccaggctcgtccactcctcctcctcctccgccgcgccatccgccgccctgcccaatcaccataccaaccacctcgtcgatgaccacctccccgtggagaatggaccggaccccaggagggacgtgcccgacgaggagccgccgcccccgccgccgccgcaggtcgccttgctgccccaggtggtcgtgctgtgcgagcagcggcacgaggggttcgacgaggccgccgctgcggcggccgggccctccaccagcgggcctgtctccaaatggcgccccaaagaccgggtaatggatgctattct

SEQ ID NO: 62945 - DNA, 881 bp, Oryza sativa
gtgctgtctttggaggttatcaggtgttaggagcaagttgctcttgccagcccgccaccatggattcctcgtgaggtccaacggcaaggaagcaaggagagcatatgattttagaagcaaatgttctttgttttttgcggggacggggatggtaaaagttgtgtccccgttgtgattgacggggaccgtgacggtgaaatttgaaccccacgggggccgggacgcgagggcaatcaccgacggggaattctccgttgccatctctaggcgctaggggcgattgatcgccccttagtaatctcgtgtattaagaccactcaattatgagtacattaaaaactatgtgtcagggttacggataaggaataccctctacccttggatatacgacgagtacggatatggtatacccgtacatatacggatagctccggtatacgttaaggaaatccatcacgtaagaaaaacagagtcagaagtcctactcggataggattgggtctttaccatatcgtgaggggtccgatatctccgagttctacttggagatcacctgatccgcgatataaaagggaccccctgggcagaacctaaggcatcgaatctgaccgccaacatatccaccacagcctacgaagtcgaagcctacaggagcaagacgccgggtgatctagtcgaatcaactcgactacggtctcgtcggtatcatcgagttctgttatttcctttgtaatctgtgatttccatcatataatcccataccaactggagtagggctattaccttccaaggggcctgaactagtataatccttgtcttttgtctgctgatgtcgtactacgtagatcctcatatcaacggaccccaataccctctatatc

SEQ ID NO: 62946 - DNA, 751 bp, Oryza sativa
acgttgacacgggaagccacagtttgccctttttttttttgacggggacggagggagtagaagacagttgcaatttctttcatatctgaaatggataatgtcgccggtgccgttacggaagttgtgagcgcacgtcgccggacttgcgcttttggatggttgcgaggaatattccgtcgtcagcagagtagatgcctgagccgcgcggcgacggcggcgcgattggccggtcggccggtccaagtgcttgggccgtttcgggaatctcgtcatgccgacccatgggaaagcttttcttacttcgctgggcatgcgtatgcatatgcatgtgtcgctgccgccgcctaccgggatgctctagacggttgaagaatttcaacaaggatatgcagtcgtgatctctctctctgcttctttttctgcttgcgtttgcgtttgcatggctaaaaaattcagcaatggaggcgcagcgccacgttgattgtttcatcacgttgctctcctttacttcttgactagggagactgagaaatttgcagctagaatgggcagatttgaaaacttatctgaaaatttcataaaattccgtccaaaattgctcccgtcggccgatccacgagacccatgggctggatcacaagccacgttgggccgggccgtatttttatctaccaagaaaagcaccaagttgcgggcaattttttttaacgactctgaaaaatttttggatctcgtggtcgtaacaagaaaa

SEQ ID NO: 62947 - DNA, 2387 bp, Oryza sativa
taacgccgtgagctcgtgacgttaatctccgtataaccaagccatgttgtcaccatactcagtcacgtattgagttgttttaccgtttgatcgtacgctggtcggacatacaagtcatacgtatagcattgttcgttgtataatttgattacagactacagtcatatgagatgatagaacactgggtgtactgtaccttatttcaggattgcactgtatccctttgtcatcctccctcttctctttaggctcttctgtactttcaatttttcgtcacatcaaatctttcatacacataatttttcaatcacatggttttaatttcaaacaaactttcagaattaagtgtgaactaaacacacagtcttgtttgtttcgagtacaattactgtacatcgacagacctgcatcttcatccgatctacgtgtcgcagaacacaaactgacgacaacgatgggattttttttttttaaaaaaaaagttcaaattgtgaaaccatgtgtggttatagttcttttgtgatgggaaattgacaagtaccggatgtgcaagaagtgtgtgtgtggactaacgttggtcaggttgcgacatctgtgccaagacaacggttgtttggttcatgtgtgtgcaggtgatcggggtcgatcttggtcaacggcggatcgggactagactcaaggaggagttgaggtccaaagcgatcaaggatgccgggtgacaagattggacacaaggttgcacacggtggacgaacaccgtgtgaggaggtctttgcaacaggcttcacaaggtcaagtgtgcaagcatcggattcgcgaagaaatcagaagggactgtgcaagtgcattgctgctacagtacttgctgtaggtagcatacatgcatgtacacgtactgtacttgtgcaaggaggagcttgcactgtactggttgctactagcatggctcggtggaaaagtcaagctagctagctgtgcatgtgcgctgtgattggttggcagggaggccaagccaatccagccgttccacgtggcccaagatggtgaatggctcggctcggcaggcctgcatcgtccaagcagcgacggcccaagacggcggcccatggcgcatgggctcaggaggtgcaggcagcttgcatgcgcaaggacgcgcgcgggaaaaccgtacgcggcaacctccgtttcgcgtgactcgatcggaggcgggtgcaggagcgcgggacccacacgcgattttgcaagcgcgcgcgggagcggctcagcgggacgcgtggcggcttcgggctggttgggcgctggcgagcgcgcgctgaggaaaaggagacggaacgcgcacgacgcggctgggcaacgtggcaagtttggattcgtcaagacggagagcacgcggattcatcagcaagaagaccatgtgagggttcgggtcgatgaggtggcaatcatctggagcttttcctttgagtagaaggaacaatggatggaccagatctgttctaagttagggtttcgccctaggggtatttgagacaatgtcttaggggtcttaggctataaatagagagatggatgcaagggtggaggttgctccttttggtaatcattttgagatgctcggtgagagagtttccgtgtgagtttggagtgtgtttgcccgagaggcttttgtattaggattagtttggagtgtgtttgtccgagagattttaagtttgtgttaatgttcctctgaaggtgtatgtttgctcctagttgagcggttattttgcatcacctataaatgaaatgatttgaaggatttcatttttgccttgtccatttaaattccgcaatttaaattccgcttgcaatttgaactttgcgatgatgagttttgctctctctttctcacctctcttctagtttcgggaattccttttctcttcctcctctagtttcgggaattccttctctcttctttttctctcttcttttctagatccggcttctaatagccgcgattctagtaaggattttgagaaatccggcttgatgagtattttcgggggcaagatttgaattgctatattcaccccccctctatagctgttcttggtctttcaattggtatcagagcccggttaagttcgttgtaacctaaccgtggcaacgaacgcagctatggaggaaaaatactctgcgaaaccatttgttttcgatggacacaattttgtcatttggaaggcacgaatggaggcctacctccagtcgcaagggcataatgtgtggaataaggttaaatctccttacactgtgcccgatgatgctgacatcacgcctgcaaatatggctcaggttgattttaattatcgtgcaagaaatgcaatcattggtggaatttcttctgg

SEQ ID NO: 62948 - DNA, 913 bp, Oryza sativa
ttctctgaaagttgatcttgagtctgctaagaaagagaattcatacctacaacaatctttagagaggtttgctcaaggaaagaaaaagttgaacatgatcctagaccaatccaaagtgtccataaacaatcaaggtataggctatgattttgctgagtctttgaggataggtacccatgagattttaggtgtcacagatgggatgatagaactagctcaaaaacctataaccttcaagtctgcaggtttcattggaaacactagttctagtacacccaaaacctcagaaccaaagatggtacctatgactagcaagtctaagcctgtagagttacctagacccaaaaatccaaaacaagttgagcacaagcaaaaccagagacaaaccaagcctgtagagaaaaccaagtatgagtgcacctattgtgggaaagctggtcatttggtaggtttctgctttagaaaggctagaaaagagcgacaagaacgtcttaggactagaagagctactagagtccctgagaggttcgagtgtgcgtgtcattgtcgttcaagtggtgtatctcgctttcctcgccgagatgtgcaccctcgacgtgacctagcagggttggggcaaaacagacatggtcatcttgcatataattctgctcataacactaaagatgcttgtacttctcgcatggttcagtactggattcctaagtcatttttcactaaccccagtactgaatcatcgagatctgctgtgtctttcttgtaggattttggagtagggagaagtaattcttggcttgtggactccggttgctcacgccacatgaccggtgaagccaagtggtttacttctctcactcgtgcatccggtgatgagaccatcacttttggggatgcgagcagtggacgcgtgatg

SEQ ID NO: 62949 - DNA, 791 bp, Oryza sativa
agagagaggagtgtgaaagttcatggcccctgctgcctgctccgtgctctttttgtgattgataatggcgcttaacgctgctaatcctaaagttgcagggacatgcttaactttcaagagattttaaaaagctgctacgagcaatgcattagcaaactttactgaaaacaacctttctttcttccatttagataagtatatgtgtttgtgttaaagtaggtggttttttaacaacagctcacacctttgtagaatgtaaatttcatgctaggttcctctggcaaaacggcggtgggatacgaaactatgaacccataaaaacacttcgaaaatcgaaagaaatttgtgtatacaaagaaattcgtgcaagtctttctgcactagtagaagtagaactgtacaagtactgccctggctattcttttttattctttcatctgctgtatttttggacgattctgtaacgtgccagtacggggacttgcaccgtgctctgccaatttgaccaagtgtgattcctgcattgtcggcagatttctggtttacaccctgcatttctctcctctctgtaaaacgacggcttatctcatcgtcgtcatttgtgaaagaccaagaacagctatagagggggggtgaatatagcaattcaaatcttgcccccgaaaatactcatcaagccggatttctcaaaatccttactagaatcgcggctattagaagccggatctagaaaagaagagagaaaaagaagagagaaggaattcccgaaactagaggaggaagagaaaagg

SEQ ID NO: 62950 - DNA, 797 bp, Oryza sativa
acatcatattccaaacagatctgcatcagttgggcagcacaaaaaagaaaagaaaaccacagtagtgagtagcatggtgatatgggtcagagacaactaacctgcatgatggctgacgggtttggtcttgatcctggacaggatagttgagatccctggagtcagaaccaagctaaaattaagagaacacaagcatgaattagggcatattccacagtaaacctcagtcacaaaacaattggtatggggcacaatccatatgaaaaacaaataccaaaagcacacaattgatacagatatgcaaataagaaaataaaaagttaagaggcagaaagtgcaaaactgaactatggcaaacagtatgccagcaattttacacttgccgatggaactggcacatgtgggatccatgattgccattcactcactcactcacaccaagcttgactcaataagaaattcgatgtgatcatcatgcagtgctcatcaaacttcttacaactatgtacagtattatcttttaaaataagtagtgtgcaccataaaacactattactaactaggtcgtccttctcacaacaactaatcactgaggatatttcttcatcagacagcaacgaaatatagaagtgtactgaaaggaaaaaggttttttttatataggcatagacattctagttgtttcattatgcttaggaggacactaataaagcagaactttccatctctcatatccaacacatcatttgtttgccgtacatacaaaacagggaaaggatcagtgcaagcttgagtat

SEQ ID NO: 62951 - DNA, 1449 bp, Oryza sativa
agcatatgcgacccgttgaagaaatactcgtcagttccccgttcgatgttctgtgtgatggtgatggtgttggggcgaggcggtcctcttgtgttcaactctgtctttacattctacttcctctatctcacattatatcacattataagatctatttttttacatggttttcaacgatataatttgattattaattatttaatattatgttatcaataactataaaattagtataatataaaatattttgaaatatatagtatgcataatacttagtataaatattgctagtgtaattgttagtcaaaatttaacgagtttgattttcatagaaacaggagtgctctataatttgagacagagaaaagtatttgctaacggtgacatactagtgttggcatctcgaacccaatatggcagagatagaagagaatgcagagagagggagatattgcggcgaaaaacttgcattacactctatgtattggaaaataggcaaagagttggaggcgaggaggtgtggcgtggcaatagaggagtcgggtgattcgaattttgagaagcccagtcgtgatcactgatggaagtgtaggtagtggaagtagtggcatgaggaaaataaaaaggtgtaagtcatggacggacaattaggagcattgtctaaagatacacagatacacatttgtctaggcgggcctctttatgaccatcttatgtgtaattttcacgtgcattaccttaagtggcacacctatgctattagacattaatgtgagttgttgcctaagacattttgcctgtggcacacctatgctattagacattaatgtgagttgttgcctaagacattttgcctgtgtaaatcattgtaggcgaaattaatgtacgttgttttcttttagcatcatattagtagtccaagcctccaaggtagggcctatgaaaattcttctttttttaagtagcgatcgtccaagatatggcaacttaaagcaggttcttttctcttaaaaataaagatgaaaattaagtttttttacgcaaaacgaggtggtattaacgtatgattggttgagttttaattattacaaacttgaaaaataaattaatatgacattttagagcaactttcatatagaaagttttcaccaaaacgcaccgtttagcagtttgaaaaacgtgccacgaaaattttaatcttcatccaactcttgttagaaaaaagaacatggcttactctggtaggactaccaggtgaaaaccttatcttggtcctccttgagacctcaatagacggcgacggtggtgctcatcatcgttcatctcgctggagacatcatctaggtcccttgccaaaacttccctctggcagctgatgcaagctctttctagttgttttatcctcttgcaactgtgtcctagcttatgcaagttggccacgttgacggg

SEQ ID NO: 62952 - DNA, 906 bp, Oryza sativa
tagaccatcatctagtgccccgggcccatatggtttcacaggtggtttcttcaaaaaatgttgggaaatcattcaacaggatctagtccaggctgtcaacagggccttctcctccccgctagaccgtcttagactaataaactcagcatacatcatcttattatgcctgtgaaatacttgcataattcatgaccttgtactagtcccgaagtgaaatacttgcataaacaattccgaagtttgtgcacatgctccggccggatcatagcatcaaaacatactcaatccatcttttaatacagggtatcgttaactttttaaatataacttaaatttatctttacacgtgatttaaattttctttatatttataaaaattttaaataggacgaaagatcaaacgttttaaaagaaaacaacgacgttatatataaaagacgtagataataataggtgtcgccttttgcatgcagtacaagaacaacacggaagcggccgtggacgcgatgcgcgtcatcctgcagcagtgcgagcgatccaggacagtgcgccgtgtcatccacacggcctccgtcaccgccgcctcgccgctccgggaggacggcagcggcggctacaaggacttcatcaacgagtccttctggtctccactcaacctcacctacgacttcaccaatgctcatctggacgtaatgttaaattaatcaccaactaattaacaaactatttcagggaagaggatcctccgacgtgaactaccctcttacgtgatcactgactggtgggcccgtgagcggcggggtccatatctcagtcaccacgttcctctgacttcacgttagaggatcccaatccctatttcagtctccgcatcaactggtactagagcttgacattttctctgat

SEQ ID NO: 62953 - DNA, 6676 bp, Oryza sativa
tattgaacgacgtgagtataacgaatctataaagagatatatatatgtctttgttgcaccactatggctgtgttcgctggagcatgtttccaacctggaacagtatgcacggaaaacggaacagtccattagcacatgactaattaagtactccctccatctacttttgatagtcatatttcatcttaacacacagaccaaggataagtaattctacttatcatccatttaaacatgctactagtcattcatcgtaaacaagcgattcattaatatttacatttctcaaagcccatgtagccaatcatatgtggaaaaatggagagtcatgcattaaattcgagaaaatcattaagatgataggttgttggattgaaatatgcctatcaaaaataaaattttcagatttggaaatatgactatcaaaagtagatggagggagcattagctaattttttaaaaaaatggaccaatatcatttttataagcaacttttatatagaaacttttttaaaaaatcacaccgtttaatagtttgaaaagcgtgcgcgcagaaaacgagggaaacgagttggaaaacttgggggtaagaacacaacctatgttggtttttcaagggacaaagggagtatactattgaacccaaaaggccatataattaacccataacttgtcgttgctaattttcatatgtatcatcagtaacttaatttgttaattccatctctcgcagtacaagaacaccgccgaagcgaccacggacgcgatgcgcatcatcctggaccagtgcgagcgatcgaggacggtgcgtcgcgtcatccacacgggctccgtcaccgccgcctcgccgctccgggaggacggcagcggcggcggctacaaggacttcatcaacgagtcctgctggtctcctcccaacctcacctgcgacttcaccaacgattacctgaacgtccgtaatcgatcgatcaacataattaaccaactcgatcactctcacggtgacactaattttctgatggattttgcataatgcagggctatgtgtcatccaagacgctctccgagaaggagctcctgagctacaacggctcctcgccgtcgccggcgttcgaggtggtcaccctgacgtgcgcggtcgtcggcggcgacacgctccagccatgcccgtggagcagcagcatcccggtgatcctggcgccgctcaccggcgacgagccctcccacaactccctcaagttcctgcaggcgctgctggggtccgtgccgctggtgcacgtcgaggacgcctgcgacgcgcacgtcttctgtatggatcagccgtccatcgccggacgattcctctgcgccgccgggtaccccaatatgaaggactgcgtcgaccacttcgccgccaagttccccgacatcgagatcaggctcaaagagtatgtgtcaccaatccaactcttgatatgctacctccttcctttaatgtatatatgaggtagtattcattacgtatttatcttgattagttagttgttgttgaatacagtatgtagtaactgaatttgtgagattcttttttttttttttttttgaaatcagatcaactttcattgacccggctttgatctgatttgtgttgtgaatttgtgagattggttttgtgttcgtctttcgcagggtcattggggagggggtgagagtgcaagctgacaccaacaagcttgtggatttagggttcaagtacaggtatggagtggaggagacgctggacagcagcgtggactgtgccaagaggctgggagagctctgatagtctgatgtgatgtgttgtgtagcaaaatcccttgcttcgcttgacctgtacatgtataccgtgtgcgtacattctgtgagaacggattgatgaatgataaattcgttcctgctcaattatccgttggtaaattcgttcctgctcaattatccgtctttaactgagcaataaactaaactatagcgacgtttttgccgctccatctcggtagtataatttgttggagcgattcaccccgctccgctccattatttggtgaatctagaccgtttggcacagccccagccaaacggggcctatctagcgagcaaatgcaggtcgattttgctatacatttgtcgacaaatttttccccaaaaatttgacagatgtaattacagtacaattgtagtgtaattacactgtaacttgtatgtaattacactgtaactatagtgtaacttgtatgtaactttcaaaaatctctccgtaacatgttatttcggtaaaatggaggtcgtgggaacaaattctttcacatatgtgtgtgctatgatttgttttcttcctcacttaaacaaatcgtgtaatagatctaacgattcaaaattatgtgacacttaaatataagttacactgtagttacatgcaagttacagtgtaattacatataagttacagtgtaattacactacgattgtactataattacatctgtcaaatttttggggaaaaatttgtcgacaaatgtataggtagtcccaatgcaggtttatcagatcgtgaggggaatctgctgaagtccacagagtgtcgcccgtcgaatcgagtgggccgccatcgaatctagtgggccggaaggcccaaaagcaaaatggctagggcccagcaatttggagcagtaggggtcggagttttcttctccgacgaccccaaccaaaaccatcgtttcctgacgagccacggtgcctgtgcctccctgaacgtttagcatcgtcgagagctacgagcctcaaagagagtggtgaggctggcatatgaattcacaaacaagttgggaagttattgtcaatggccatcgtcaaatcccacagcaaaacagaagtaaataacagtcgaaacagtattcttatccacaccagaaatcacgttaaggagcacctcccactaattataattactgaacctcatcaggcccaaattaaaatttgttctgaaatccaaataaagatcttccctgtatgtatgttgaagcaagcgcagattgatcgatggacgtgatcagagaacgcgcccgtatacgtacgtatacgtatgctagttaatttctctcctaaaaacgagtaagaaatatcctataaaaaagtttctagaaacaaaagaagatatatactcctatatccgtacgaaatctcggttgttacttgttactgcagttccgtttcgttgctgtgttgtggtgcgaaacggtgacgtggatcacccgacttagcgcccacgcatcataccgactcaatcctgtgtatttcacggtctactactagatatcttcagtgctgccgtcacccacaacacaatcctccttcctccctgtctctctctctctctctccactgcagcaaaaccctaggaaaaatctcgcttagcgatcgatcaagcaaattaagccctagtgattacttactccctacttgcttgtgctgcccgatctccatcagatagatcgatcggagcaagaacaaggggcatcggagcgatcatggagggcaagtccagcagccgccatgccgatccactggaagaggtcgagatgaattcggcttctgcgaccgaggacgacgacggctgccggtatgtgttccaatcccgccgcgacagcgacaacgacaatgacgacgaggagggcgtgctgccggcgacggcctgcaagcggcgccgccgcctcgacgacatcctcgcgctgcttccttcgccgcccacgccgtctacctcttccggttcggaggggacgatcagcgaccgcgaccacggcggcgacgtgatcggcgccggcgacgacgacgctgcccccgtggcggcgcgacgagaggcgtcgttcccgtgccacttgtgcaacaaggagttcggcagcaggaaggcggtgcacgggcacatgagggtccatcacgccgagaacgagaaggagccgatgtcgctgccgccgcaggtggcggcgcccgttcatccccaggctcggctacccacacgcggagcatcacgatcaggtggaccgtacaagtgcaagtacgagggttgcatcatggagtacgagtcgcaccaggggctaggtggccatgtcgctggccacatcaacagggacaagatggccaccgccagcggcagtggcggcgccggcaagccaaagggcaagcacccgtgcaacgtatgcggcaaagagtacccgacaggagtggcgctcggtggccacaagaggaagcactacaggaaggaccttgatcttaccctctccctcgcaccgcccggacaactcgccgcgccgcctacacctacacctgctcctgctccagcggccatcgccgcggtggaggcagaagcggaggtggctgaagatggagatggaggagagctagtgccgacaactccgccaaccggagctaggagaaatgtggtcgtgcggatttggggcgttgatttggagaagccggtagatgatgtagaggagcaagatagtggcagcaactaaagaagatcaaaaggatagcaactaaatatagaagattaagaggatagtagtcagcagtgcagtgtttatttagatacttattcacgtgtttgatgcaaagcaattgccgctttgttagtttagatagtgaggattctgttcaattgaaacaaccaattctacagagatattatttacaaagaaaaaaaatatatctttcatttaaaagttcttagagattatgtttttttaagagagagagtgcatgcagccatgcacgcactgccttgcgaaatccctaatccgcacctaggcgcgcgtggcgcccaccgtgtgacgcgccacgtgccgcgtgggaaagacggaagagggccggacaacacgcacgtggaagtgcggagaagagtgcggacggaacggcatagtttttgtatatagacgtatatggactttgtatatatacatataatgggaaactattctaatctctcgaggggatgttccctcgtttgctcaaaaaccatctaaacggttatgaaaaattctggaaaaatttgacaacattcatacaacacatatatacaactccacaaaatcttaagtccaaactcaactcacacgttgagatataaaaaagacaaattcagcgtatgaatagtagcgtactgtttatatctaaatttgtcttttttgtttctcgatgtgtagatcaaatttgaacatgaattttggtggactagtaggtaccattatactctacattgtcaatttttttcagaatttttcacaactatttgcatcgaatttagaagaaaaaggtatacgaggggatatctcctcgagggattagaatccactccccatataatgtttgtgtatatataaaaagttcatataagtattatattttttatacatctctatctctactattataaaaatggggaagatgtttttaccgtggcttggtacgtcagtcgcatgtgtccgattcgcacacggacgaagcagcgagatccatcgtcgttcgacactacgtgcacgatgttggtccatggccaccatgcatggcacaacaaaaagtagcagaaccgaacacggattgacacgcctgactgtagaatccaaaacccagctcgttacaaccgaaggccacccaaagcaatcgtttttattgtgaactcactgaacagagagattggtaatagaattacaacgtgtacatacagacttcgttttgtttttattcgtacccttaagcttcgatcatggcacaaggagccccattgattgccttagttagaaaattttgtatttttaaatttaatttgaagttgtttttaatattttttcaacgttgtttgttaaatctatatctaataaaagaaatacataaagcttccggtttattttttttgttccatccgtttttttatcgtcgccggttttttggatgtgactcccgctcgggcgtccgatgggaggaggttaaaatcgggcgttaacgtcagcgtccgatttacgtgcaaaactactttaaactgatttttcttctaaattatttatccaaatcatgatccgattacaccattaaattcattgtaattaaatcttcaaaacaagaccacacatagatatattccgacgaaaaaattatcttattattgaattatttttaaatattgcacgatattccaccaggtatatcggaattgtttcactaagtagatcgaaaatgtttcactcgtttaaatcgagtgttgtttcaccttatataaaaacaatgtttcagcaaatagcgaaagaatgtttcagttcactgcaacattagatctatacatagtgaaacattgtgagtacattaggtaaaacatttttcggtggaacaaaaaaataaaccaaattcccttaatagggggtttccaaaatatgtgggttttttgttgcaatggaatgtttcgttcactgcaacattagatctatatatagtgaaacactgtgagtacactaggtgaaacaaaaaataaaccaaattctcttaatagagagcttccaaaatatgtgggtttttgttacaaaagaatattttaattcaccgcaacattagatctataaatagtgaaacattataagtacactaggtgaaacatcttttgtggaaaaggggggga

SEQ ID NO: 62954 - DNA, 1093 bp, Oryza sativa
atgggcttataaaaaccaatgctggaaaataaataatagtcttaaaaattgaaatcaactttagagaaggacccttcttgttctccaacaaaagttggattaaactttggatactcgtgacacacgtttttcaaattgctaaacggtgcgtttcgtgcaaaaactttctatatgaaagttgttctaaaatatcatattaatctattttttaagtttgaaataattaaaattcaattaatcatatgttattacaacctcgttttacgtgaaacacttaatcttcatctttatctttatcttcagaacatttaaacaccataaattttacgatcaaattttgactatggagggtaccatgggagaggaaacatacggatcccacaattcgtacagtattgacttctcaagtcatctgcttctacagttccttgtaccaccaccttgttgttgtgtcctcggccgatcgagaccctcgagaattcgtttcagctctgatttcgcggcgtcatcgatgctgcattgctgcgtgctacagccacgcccttgcacatgccgccctggtcccgtcgtgtcccgtggactgtagcgacgacgtcccactcgatcgggcaaccgccacgaaagcccaccaacgctttggacggaggcgcatttacgtgccgcgtgagcgggcccgtcgtcctcccgtgcacatggcacgtgggccccgcgcgggtcgctcgctactacgcctacgtgaagttgctggtcgccgcagcgctggcttttggtgttggtggtctctggctgcaatgcgtacggtacatgggagggaggttgagctgcaatgcaaaggcacgtatggttgttttaggccatttctaatccaagacactagacatagtttaaataaacttcacattattaagaaactagtactagacaatatttttctaatgcaaacaccactattccacacttaaatttaatgctacttatcccacatgatgccttggatgttgtatagaaacagtgtctcatgcaagacatggtttccttctctttcctcatttattcacttgccacatcattttttatcttatgtgacagctta

SEQ ID NO: 62955 - DNA, 6134 bp, Oryza sativa
ttgtactcgatgacagttgaggaccttcggtgtactttttccatccaatctgttctgtccaacgtgggcccgaaggttaactgggccgtgtcaccccccgaaccccccctgattcctctcgcctgatgcgccgcgcgcgctagacagccatgattccagtcgagccccacccctctcgctgccgcctgcctgcatcatccaccctgcttctgcgcggccattactgcctccattaaactcggcttgcctgcgccgatcaccaggcccgcgtgagtgacagtggtgacaccatcatcattcatcaagttcctcacttgctcttgctcttgctccatcatcattggcagctttggctttgggctgtgtttagatttaaagtttggattcaaacttcagtgcttttccatcacatcaacctgtcatacatatataaattttcagtcacatcatctctaattttaattaaaatccaaactttacgctgaactaaacacagccttggcttagcttagctgtatgcatgcctgtgtcctgtactagcttcgtaccaacacactgattggtcatcagagagctgcaggtgcatgtttcacaatatttttttcaagtatcaaccgagaatctgtctcgatgcgctacgcaacaacaagacgcccgacgccgcgatggaacccccacatgggcgcaagaaacggacgacggtttcagcgatgcagagtagcagcactgatgcgccacgttacctaacagctaaagggctaaaatgtcactctgcaggagccacatctgcacaatctgagggccccttcgaatcgtaggaatggaaaaacggaggaataggaaaaaatatagaattctggcagaaatgcaagtgcaaacgagagtattgcaaaacacaggaatagccgtttgattggaccgcaggaaaaacgcaggaattaaaggagagatgaagactcgtaggaaagtttccatgaggtaaaacctcatgctagatttcctacaaaacttgcatggcattaggcattccataggaatttcacatgattctataggattcattcctttgattcaaagggctatatagaaaaaattcctataggaataaaatcctttagaattcctatgaatttcctttgaatcaaagggggcttattcctactatactagtaccacatgttcaattctgcctctcacattttcactctcattttttgcggttttcagagatactgaagggcaaaaggatgtgagccacaaccatcttcagggatgagcaacttgatgataagttgataacagccttaagatggcattgtcccaacaacaaccttctcattccaaccaaccttgagcctacctactggttttccctagatttacaagataataaagatgggaaaaagaaaaagaaatagtgggagtccttgcatgaaagagacagacatcctactaccaaattacagagtacacgacataagaaaagggagtacagaaactcaccccacacaaacacccatcgacaccaaacaagaattggcaggcaatagtgggttttcggatgggatgacatcttcagaaaggatcagggtttctgttcatttttttttcttttcacagatcacattgctcctgcaaccaccgaaatcgggttctttcaatcagcgaaaatgagtgttgcttcaagggtgcaaccctcatgcgatcgcaacgaacgagaggagcacggtgcagaaggtggctagcccggctcttaggtgcaatcccgctgccgcggtgtccatgctgcttgtgcctgttggccctagcccgcccagcccggtgccggtagtagtccctgttcccatgccggtgccggtggttgtgcccataccagttccaggtgtgaaggttcctggggtcattgttccagttgtgcctcccatggtcggagtggttgatgttccagcaccactgcacatgagtatggaaatgttgttaggatattacaatcaacgaaatccagaagagtcttgcgtgtttcaacttgcaaagcatctcagttgccttcagatatatggcacaccatactataggaatccttcaatgatacttgcatcaactatagatcattcaggagtcatgtgtacatcacaaatgcaggccggaaaggcataggtgtgcattttggtatggatgagtagttgaggatgaggtacaagactagctttaaataacagatggacttggttcttaatggtgatgtatacttacttattgactctttggtatttttcaataacaaagcatatacgactttgacaagcaaacaaaagagataaggaagttgtaacacattcagttcattgaacagatggctacattcagttcataggtcttagtattgcagttcagagtgaacatgtactatataatggaggcagatagtgtgttcaaaagaaccttctgctcaaacacaatgcaaaagtttcattggtggttaccactttgaaacgtcaatcatccttagtgatacttaataaaactcagtcagttaaagtgaagttaataatgtaccttgcactagcagggaaggagcagccagaaacacctgcaaccaaagataatatgagattgtgtgaggaatagatatgtctctaaccaatgaagaaaataacaaaaatacatagaatggatatcatcccacactcagatgaacttccatgccagctatcaaaaagatgtcaccgacatctccttttccttttcgtttgtcctaactgaccacaagctcaaatgctagccaacatatcagactgagagaccttataattgagataaggtgacacaagcaaacaagctaaaaaaaacttcaacatactttacggttgaattaaagcacgtcccattacgccatgcttgcattgccccaacgcacgacaaatcttaattccatcatctgtacagctcgtccttcacattgctagtcaccactcccactcatcaccatccaaacatttctaatcgtgcaaggcagaaacacttgccgcaaaaacttgcaagcgctcaatgacattatgacagccagtactcaaacgcgttcttgaacccgaaacgcgagcgcaaatttaatcaagcagtagacagtggacagaaatgctgggaaggaattgaagtgactactactccctctgtttcacaatgtaagtcattctagcattttccatattcatattgatgctaatgaatctagacatatatatctatctagattcattaacatcaatatgaatatgggaaataatagaatgacttatattgtgaaacggaggaagtaatatattgacgtgcaatccttttgcgcattcgtgaaaaaaaaaaaacaagaattgaagtgacttgggtggtgaatcattttttacttgggtcgctggtggtgagggtggcggtgccggtgaagtcgcaggtggcgcccatggccctgttcctctggaagtagctgttggcggcccaggagcagtgcgccaccacggtgttggggttgaagcactgcccctgctcgtggatggagttgcagtccgcgcccgcgccgcacgcgtagtcgatggtcttctgcagcgccgcctgtggctgatccgacctgcacacgcaccaatctgcattcgccaagaaacaccacacacacaaaaaaaaagaagagattcaatgagagagattaattaactcgtgcgtttcattaaaaggcggcagtttttatgccagtttcttgatgaagagatgggatgcggaatgtgacgaaagcaatcaagaagagagagtagcgtctgcgcagaaagagcagaaaactaggagaaaatcggcgtagtaacggttttgcttgttttagaaagtaaaaatgtaaaaaaaataaatcaacttgagaagaacacatctccaactgtctcagaggggagaacaagagatttcttgtccttggtccttgttgagttattttcttcagcaatagatgaacagcaagagctaagcagtacatggctagtactgtttgacatagcaaggtaggaaaggggaatctgaaaaaaaaaaagtagttcacaaaccataacaaaagtagcgtgtactcctacatgcaatgctgatctttcctagaaaatggaagaaccaaacagaaagatctcttcttccaagttccaaacataccaatggatgaaccaagcagaaactgagaaacatcaaagaacaaaaaaagaaaaagaaccaccgacaagtagaagtgtagaatagaacaacacctgaacaaatccccccaaaactccaacaaaatcaaccttcagaaacaaaaagcagcagcctttgcagttcccagccattatttaagaggcacaaactcactcaggacagaaatctaaacgagacggaaagagaaaggttagaaaaagaccctcccccggggagagctgagcttaagctcgctcacctgaagcgacgagactggacgacatgagaagcaccagcgccgccaccaccaccgcctccattatgaaagctaccaccaccaccaagcaagcagcaagaacagagagattcttggaggcctggacgagtagaagagatggagacgagctagtagaggagagtgagtgagtgagagagagagagagtgtgtggtggcctctggacaagagtggcagtggcagcagcagcagcagatgcagagtgagtgagagagacagtgtgtgtgtatgatgcgtcgggtgcgcgtgcgagtttgatctgcgccacgggcgcctacggaatttttaaccttttttttcttcttcttcttctttgcgcatctacggttgcgacccctgggagactgagccgcacccaccgctacctttttgctttgctgcaatttgcagttttggcctcctgtgtttctctgttcgttctcctgcccaccgcgaaacgccagcctattttcgtgaggttaatgcttggcttttttttttttttttgcggggaatgcttggcttttgggactaataaaaaactgttgcaatgatttttttttagtgcaaaaccattcaaacgtagctatagtttcatgtgcagctacggacaaaataacaccttgtgatcctttgatctgcaggataggaaaaatatagaaatagagaaaaagcagaaattgaagtagtagtatgtttcttatgctatgggaaaaataaaagaaagttcacaaaaaggttacacgtcttactatttttcctatgaaatgtgaagcatagaaatataatcctatagaaaatttctcacaaagaggtcacacatcttactatttttcctataaaatgtgaagcatagaaatacaatcctatgaaaaatttcctttctttcatatgaatcaaaagaacatataggaaaaaaaccataggaatttaaatcctatgaaaatcatttgccaatcctataaatcaaaggagccctgattgtttgtttgttcttggtaatgtcgcggtcaaaatttaaattttaaactctctatgtgtttttatattttttttacttctatttttaattttggcttttaaatcgctaagaaacatattcataccttaaaattttttctcatttcactgcttatttttccactactaattaacagtcgaagccaaccaatatagcactaagggcctgtttggtacagctccaactcctaaatttagctctaggagttgggtctggagtggagttgtggagttgcctaaacccaactccacaactctagctcattttgtgagagagctccacccagctctactcccagttttggtggagctgaaactatttggctgagctccagctctatgaggggtggagctagagttgtgccaaacaggccataagctaacttcacaaatttctagtagcacctgtttttttctgtatatttcacaatttttgtacatagtgtctactagcattctctgtaataattttgtttagcagatttctgttgaaaaatctgctagtatcaaatttcagcatggttttctattgacaacgatgcaaaaacaattccaaaacagttccatttcaagacgatgctgcaagccgggttacattattttcggttggtgtgatggtagggcccacgacgccagagccaa

SEQ ID NO: 62956 - DNA, 2216 bp, Oryza sativa
ggtgtcacctatctaacaacgacacccaatggctacctttttgataacgcaagctgactcagataagaagaatctattccattgtaaaatttatactatttcaaagctttttacccgcaagatagatgactgattaccagtttaagaacattttaatgcatacatatataacaaagtcacaaactacttaccataagtacctaggtagaggtatttgttgccgaacacacgcccaatccgagcctcccatttgccgttgtgatgatgcctgaataaaacagctgttaattaactgattctactagcaatgttcagtagaaaactggaaccttcagtgtagattagtactgattaactaccttgcaactcctctgtacttggacacccctcttgagaagccactgctcttcctgcagggtgaaaaaggtttatgatcttaatcaagaagaactacttcaaaacacagcttctcagacatgaatattcactatgtctgatcagagaagcatatttcaatgggttttgatttggatttttctgaaagtttgtaatgatctgaattaacttctctttgttgaaagtcagtggtaacatggggttaactgaatatttacctcggagcgatccgatgtactcttccctggactgcccctccatttccttcaattcctcgtcatatgttgacagctgcagagagttccaacatgagaaaaacagcaacaatcttcctcagaaaaccaaacagaatcaaacaagctgcactgtgcgtgcatttcttgaagggttccgaagaacgcttgtgcagaggattcagttcagagaaagatgccatggatttttggagaggcgtatgccacgtacagggaagttgaggacggtgtcgtggccccagtacttcaatgcggcgaggtcgtaggcgcgcgccgccgcttcctcgccgtcgtaagcccctgcaacgccggcgcacagacagtgaggtggtcagcaaacaatccttctgcgtggccatggattttggtttcagaatgttcagattgggagctcaccgaggtaaactgttcgtccggccacgccaatccgatcgcaaaatcagagcaacaagagagaacgcagcgaaatcagaatgagcaaattgtctgacgagcagctcgagggatgcaactataaggtggattaatggagtgattggtgatgataccttgtctgcccttcttgctctgcgactcgttccaggtgttcttgtcccagagatgcgcctcgaaccgcccgtccaccggtgcctgcgcgccaaaaaaaaaaaaatccaaaccacaaacgctgtcagcccagtgcggcgaacgtacgccggtgagaaaatccggccagccaacgcacgcaccgtgtgacgccgcggaacgcggagctgcgctgggaggggcaatcccgcggggcgctcctccgcggccgcttctgccgccgcctcggctcaacctcaccgccgccgccgccgccgcagacgccggcgctacagtcgtcgctgctcgcggcggcggtctcgccgttgctgcgtcgcttggccattggcgaagagcgagcgcgggaggaggagggagatggtatatatggaatggtggtgccaaccagaagaagatggcagcaggagaagagagcttttaaaagagccggagctaaataaatggcggcaaagttgcagccgccggcacagctttaatatgctcgctcgcgtcgccaaaatggaggagacgaggcgagctgagctgaccggcgggaggaagaagaagaagaggaaacagagagagggagtgaggcggctagccttgggttgcagtggtttctctctcctcagctgtgtcctgtctctctctctctctggatttaccggtggcagtgttgcggtgaattattgacttctttgtcccaactccccccaatgttgctgaaaaaccagccacaaactatccgtcctataaaaaaccaacttactaaatgtgacacatcataatattatgaatctgaacatatctctatttaaatttattgtactacagtatgtcacattcagtactagatttattttttttagacgaagggagtagttgctaaactctctgaacagttaaacctgattaagttacagattttattttgatttttattaatgtattttttaaaactgtaaaatggtgtattttataaatatctcataaatcgatttt

SEQ ID NO: 62957 - DNA, 763 bp, Oryza sativa
actgtgatgcttcattgtgacaataaatcagccatcaacattggaaacaaccttgttcaacatgatcgcactaagcatgtggagattgataggttctttattaaggagaagattgatagtggggtacttatgctagagtatatcaagtcatgtgaacaactagctgattgtctaactaaggggttaggtcctagtgaaattcaatcaatatgtaacaagatgggtatgattgatatcttttacccatcttgagggggagtgttggtgtaaataagtgatgttcctaggacccatttgtaaatgttaagagaatataaaggaggagacgtgggaacaggggagtaaccctgaaaaaccccccaaaattagacaatatcccctctgccaactatatcttcaggtctgcaaccgcatctcagttgtatgcagtaatgcttatgcacggagcattaccacgtttgaactccttcctacgttctgttggtgccttctaccccggaagtgattctccaagtcagatgcagatgtgcaattagccttgcaagtgctgcaactccatcttggcacaaacttttggttcttttcaacaaactgcgccacttcctttgcatacacctttgcttccatttccttgtcttctctcttcagggcttctaagttttcttggtgcctcctacctcttaggtgagtttttaagtccagttcacttgaacaattggctttgcaaataccataattccatgttggtggataatgccgtgtg

SEQ ID NO: 62958 - DNA, 975 bp, Oryza sativa
ctatatttttttataaactgaatcaaaataaaaaacgtttggctagaaaaaaaagttaaaacaatttataatatggaagaagtattattccatacaatagtactattataaaaataaaaccccatgcttattcgatttatttttctatggtcgtgctaataaatatttatagattcatacaaagaaacatttttagatggttaaccagcagtgttgataataaacacaaaacagcagcgtgcaggaagccaggaagaggaaaaccgacggcgacgggacgcaccgggccaaaattttcaaacttgttactagtactgttctcttcccttctctccacttcgcaatggaaaaaaaaaaaccgggaaaaaataaaaatgtttgggcgtaccacggtggttgtacctagcagcaacgcgggagcacgacgccgttaacgcgctcgcccgcgcgaaatgacgctactaccctcgttgctcttatccactcgcgcctcgtaccaccacaaccctcccggtttccctcgtaaatccggaaaccgagcggaggtaggatggtcaattcaccgcgccgtccgacttccccaccgtggcgttggatataatcttctcgtatcgtctcgtccctcttccgttttttcccccaatttctcgtctccccccttcctccaatatatcggcggcgatcccggctcgaggagaggaggctccgccgcgattttttcggtgtcgcatcgaaattatggtgagttggtttcctccctccccctaattcccgatccgcaattcgattgcgatctccattgcttgggttctgccttttttgggggaatattttgggcgatatcggcgaatatatgctgggctctcgcgcgattcctttttgattatggtggttggtgttcggtgcgcttttggttgaggaatcctggctctaattcggtgccattatgtgggtttgtgtttaatttggggatgt

SEQ ID NO: 62959 - DNA, 2379 bp, Oryza sativa
ttttcaaaaacaaagaactcgcaatgccacacttgctgacgaagatcatgatgaatcaacaaatggataggatgcggggcaaaagatttagcgagattagtgctgtagccttcccgtgatccttgtagctctgctttcctctctgctccctcttgtctatgcgtctcctctgttttttcttttggtcctttgtttctcaccgttatcggtagtgttgctgtacagtttcctccccttttaatataaaaccagcaaagctggctcaggtttcataaaaagaattaccatgttcatatttatattcggttcattcaatttaatctaaagcctacaaagcaaaaaaaaaccggtttccgatgttggactggactgtcagtgactatgctggtctggcgaatgtggccggggcacagagccacagattgtggtaaactacggcctgttgaattaagcccatatcgaactgggcctggatgtcacggccggcccacttttttccagtccgaatctctgtcgcggagtcatcacttctgtggtaacactggtactccgaggagaggatatcgcggcgcctcggcggtgcgaactccgaatcagaacgggagtcgaattgattcgtgaggatataaggcgcgctcggggacgtagcagccaatcaattcgacgtgtgattccactccacagcgcgctctctcgtctccggttcgcttcgccgcacgtacaactgtctctctcctttgtgacatctcgccaagctagctagctagccatggcggcagcggttctcccttcgctgctcccgacgccgcccgcgagcaagttgccggcgctgctcccgaccccgctgaggagccagatgctgccgctgctcccgacgccgtgcctcatcatcctcccgcctccttccgcgcgccgccggtctccgatcccaagcccggccgcgccgacgccgtcgagaggtgggacgcacgcaagaaagccggcggttcggcagcgtcgtcgtcgtcgtctagctccagcagcgggatcccctgccgcgccgacgcttgcgaacgctgggacgcgaacaagaacaagaaagccggcggctcggcagcctcgtcgtcgacgtcgaaggccagcggcgggatcagcccggccgcgccgactcctgcgaacgctgggacgcgcacaagacaccgggcagccctgcgtcgtcgaccggcagcagcgggagcccctgccgcgcggactccgtcgagcgatgggacagcaacaagcggccgctgagccgcgcgtcgtcggccgagcgctgggacatcaacaagaagcctcgcccaagaaagacgctgtcggcagcggcaagaacaactccacaagccagacgacgacgatggtgaagcctccgcagccgttctctcaattttctggtccggccttcttcgcttcgccggatccgggcatgcttcccattccaccttcttgttggctcactagtcactagtgtggttcctgtcgctgagaatgcttgcttctagttcaacatgggtgtcgtgtgtaagtgtgttcaggttgtagagattggaatggtcgtcgttgcatgcatggtgccccggccgcatgctttgtgctcaatcagcactggaaatttcacacggttgtgttagcctaattgcagttgtaatgttagctagataaatcgaattaatggttttgaggatgaggctgtccttgtatgatttgttatattttctgttggaattaatagatgggctaaggcccatttgaagattaattctttagaaaatcacaaaagcccacctcataagatggcatgcatgtggagtttagtaccaccttgcttattctaggagagggggacctcctaaaaagggaggatgccctcctagctacttgaagcatgtgtggtggagagaagaggggaaacatgcgcttgctcgccatgtctggtaggcggaaaattggttcctcacccttgcgcagatgcagcctccttttgcagttttgttttgctgcgggaaattcggatttgttttgttttgccttttgcagttttgttttgctacgggaaattcggatttgttttattttggaaacattccgaaaaatccggtgcgtgaaaacgtccttttgcagttttgttttgctgcgggaaattcggatttgttttgttttgccttttgcagttttgttttgctacgggaaattcggatttgttttattttggaaacattccgaaaaatccggtgcgtgaaaacggcatggagtccggataggttacgcgcgacttatccggttcggtttacgcgggcgccctgatcaggcgatctatctctatataaaccgagccgccgccttcacgcaacacacgcgaaatca

SEQ ID NO: 62960 - DNA, 684 bp, Oryza sativa
atgtcagattctatatttatctagattgtgaatatgtgactttccaaaacagttttgtacgtcgatttgtcaaatgataacagcaagtatggatgagcgataactgacgatttgtgaagctgtttttgtatgagatgattcctgtgcacagagctggtgtgtgtgtcttgtgctatgaaacttgaaggcgtgtgatatgacctactgttttgattttgctgtcgtggtctagtacctgccatatcctgaactgaattcatgtttgtgaaggctcgcattgatgcggccaacgacaagttatgggcttcctgggcgctggatgaatctgacatggatgtaagggtgtagttcacgccaaaattgaaatgttgattgaaattggaacgatgtgatggaaaagttcaaagtttgtgtgtgtgggaaagtttgatgtgatgaaaaagttggaagtttgaagaaaaaattgggaactaaaccaggcctaacttgttggagcgatggcttgtgtaccgctttgttttgtgggtgtcagctcaatctttgtgcctaggcctagctgccactgtgcaaggaggcatcaaaccaccactctaatctgagagttaactgcacactaaacaggttttagccacgcagaaagcgagaggcagcaagaacatggcagtcacatgaccaagggggatc

SEQ ID NO: 62961 - DNA, 739 bp, Oryza sativa
catgttcctttatattgacttcatctaccaagaatctgaatgtcccccattgtctttgggattagggccttagttttccccatcagcggaattgagagtttgaggcccatctaggcgaggtgttattgggccatgccgcctctttctccgccatccagcccagagcccaatattgatcgttgccagtgcctgggccgcctatcggcaattggcccatcagaagcctgcggcccggagcccgcacgagcacacgcagccgcatccggcccagcaaaaacactactctcgtaatattgtgggccgtggctcccaggtcgggaggtgagtgggccgtcgcgcgtgattctccgtcacggcccaatactgggccgaattcacaccattgttcggcccggcctgctcgtatggagagtttttttttataggtgaagtatttgagattgtgattagactctctccgtccttaaaaaaaattacctaaaaggaaatatgatccattcgagtgtaacaaatctgaatagcaaattatctagattcattatattagaatgtattatattcttatttagaaatatgatccattcgagtgtaacaaatctgaatagcaaattatcttgattcgttctattagaatgtattatattcttatttaggttgagttttttttaacagatggatacccttctggacccaactcaggctatggatctctaaggatggtggtggttgcacctcgcca

SEQ ID NO: 62962 - DNA, 2148 bp, Oryza sativa
  unsure (1)..(2148): unsure at all n locations
tttcaaaagtttgagtacgagcagtaacataactacttgttaattaggaatagtaatatagtagtagtattagtttctgatgcttctgctgacgctatatatgttcgtactagtcttctgacaccgtgtttagctcaggatggcgtgttactagagttgctggtattagtgttttatctatccaacactgtagtttgtacatgggatgagcatattatgagttaacgatcacatgatattagtatatttattgtctatctttatgaccagagttaggctatactatcatcgaagtcacttccttatgagaaaatccattatattgctctgagtttgttataggtatatgatttgccactgattttctcatgttctacaatatgatatcgacttttacgtaacttctacaatttactatcgccttccggttagccttcattagtaatgtacatttttgtccaaacgacaaaaatctccttgggacaagaacttccaaaatttgaaaaataattcagaaatattatattataaacataagattgtaaacatcaaattttttttgccaaaatttggttaaaaatttcaaaatatcaaattttaagttttttgccaaaatttatatgtttacaatcttatgtttataatatgatatttcaggatttttgtccaaattttgaagttcttgttctagggatattttgatcatttagataaaaatgtacagtactagcgaaggttaaccggatgacgatggtaaatcgtagaaattaagtaaaagtcaatgacatattgtagaacatgacaaaatcagtgggaaatcataaacttgttgtaaactcagtggcatataatggattctctctatctttaaagaaagaaatgtgtctgtatactactccttgcctccttggtatacgtgttttaatacagtgctctaatgggtgtgtttggttccntgcatcgcacctggctcgcatccacgggtgcaggcctgtggtgtttggttgcctgcacggccactctagcctggctccacgcgtgcaaatcgggcttccgagccaggcccgagagaaacggtcgatctgagattcgctcctcatccgggctgagcacgtgcaggcgggggacgcgtgggtgcaagctcggggacgcgcaggtgcaggaggcgagaggggttccagcttctgctcaccttcccatctcatttgtcgctcggtgcctcccgtctccatcgccgcaccgtcgtcgtcatctccatcatcgtgccatattcgacaaagccatcgaagcttcctcaaccagaaccgctagagctcctcccctcaaagccgccgccgccgccaaatccagctccgcttgaagccatcgaagtcgaatccggctcctaccaaagctaccacttgctctccttcatccgaatccagatgtgacgacgagagagggttgtcactgctgacgcccggatcttcctcctagtcgccgctgtcaccgccaccatcgccactgccttcgtctacagctgctgcatcgggccctcttcctctccttctttcgtcagatccagagcccaggagctcgatctagtggcctcaggcttctggttgccggatccggacgcttcctctcccttcttccatcagatccagagcccaggagctcgatctggtggcctaggcttccggatccgaatgcttcctctcccttcttccgtcagatccagagcccaggagctcgatctggtggcctcaggcttctgattgccggatccggacgcactgatggcggcgaatcgtcaggatcccgctactgccggatctacgccctgccaccgcggcgtagttggctgtctcggcgacgaggccacagtcacctgccctctttttccttttatttatttgctgttttttctcaccgcttggatgaattaattgaacataacaaagttgatgcaatactgtagcacccgatatggttcatatactattttattcgtcagtgcaagaaatccaatgacttgattttatatacagggatacactgactaatacaatcctatgcatatttcgcatatgttaaaaatcgatatcatatactgtaaaaagatcagcgttgagatgatagaaaatttcatccattagttatagatgg

SEQ ID NO: 62963 - DNA, 1105 bp, Oryza sativa
gccgccctgggggagggcgatttttgcctcccccctataaagcccagcccctcccctgtcaaatttcattatattcactaaaaatccaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacactgcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaatgtcaagtaaggtcatatttcagatagttcacggtgaaggaaatattagatttggtccagatggtgttgatctgtcagattttgtaatgacatctaagggcatcgataggcctgcggagagaacatttgagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtac

SEQ ID NO: 62964 - DNA, 626 bp, Oryza sativa
ggagtatatcactgttttgagagtggtttgcactgatatttccccggttatctgagcccttgtgttttagatgaagggcccagattaggcctaacgcaccactctgcactggtaatacttccgtggatccgcatcgtcctccttccttgtcgagccgagcagcgcatcatctccatcccgcctcaactccgccgctcgatcgcctccacccgccgccgttccgtctacctctccgacccccggcgggcgccgccgccgccgccgcgcctaccatggtaacctcctgcccccaccttatcccgttccctttctctacttacgcctctctccggatctggcctctgggccggcgccgcatttcccctttccgcccaccgcgacgaggcctcctggacccgccagatctcgcctcgaaacctgaacccttcctctggtctactccacggtatattgatggatcgacggagcccttccgataaccgatcacggattctagaaggatgggatgagattgtttgtcgctttggttcgagattgcattctatttctaaaaatcagattatttgtggcgtttgctttggaagtatgggtgagtgctcatgtgtttgtgctattgtaggctaata

SEQ ID NO: 62965 - DNA, 4884 bp, Oryza sativa
aggtccttgtatataagtagactatagaaaataatatactgccttttatcgttgtagaatggagattcaaagggcccgacggcggggggttttcgatactggattcatcgaccctcggaaagtaaacgtcgcaatgctcgaccaatatccacaagccacagaggacaatctcgtccatctcctgaaggcgcagcattacaagacgttcatactgttgccgtacaacatagagttagtttaatttacctgttttcctataccaaatttcattccggtacgaacttgttaagtgtttcatatgtaatgcatcccacgtacattgcagattccactgggtgcttttactcttcgacctgtcggcctgcaccgtcaacgtatatgactcaatggataaaaaagagtctacgtttgacaaggttttcgaacttatagacaggtaccgtcataagttcctctgttaattaagaaaatcttgttatgttaattgctactatgaatcatagctttaaactccatgtagggcttggtatcggttccgtcatttggtccgggtaaatggagagaaagacttaggcggaagttcaaatttcctgtgagtacacatgctctacatttatatttctccgattcaaatacatacaagtgtatattaattagatctctcattgtttgtcatttattgtagtgcgcaaagcaaaagaagggaactaacttgtgcggctattacgtgtgcgagtattgccactgccttgcagaccaaatcatcaccataagaaagctcaatgtacgtacaaataaattcaaaatttcattacgtatcgatttcttgtttaattactaatcaatttcatacattcatatagtttattcgcatgagggataacctgaccacgcacaaggaatttatcgcggcggttcaagaacaactcatgggattcatcaacgaacaaatccttgatcccaagggtgaattctactacgacggaaacacaattcataggtccttagcttctgagctagcgactactactacgtcgaaatcgtagctagctagaacatataatggattgtaattaatacatgactacatatgtttctatatgcatgtgtacacattttctataatgtaaatatattttggtcatatatatatacatatgcatttgcataacatatatatgtatatatacatatatattatgcacatgtacatatgtattatatatatatatatatatatatatatatatatatatatatatatatatatatatatatatatatatatgtatgtactgaaacatggtttatatatatatatatatatatatatataaaccatgcagcaacagggccatgcaaaaaaaaaggtcagctcgatctttagtcccggttggtaacaccaaccgagacggatgagccatctttagtctcggttggtaacccaaaccaggactaaagatcgatctttactcctggttaggtagatgcccggtttgggttaccaaccgggactaaaaatcgatctttagtcccgattatttcacccgggactaaagatagcgatctttagtcccggattggtaatcccggtttggaaaccgggattaaaaggggttataaaccaggactataaagggtttctccaccagtgtatcgcccagtcctaagctaagtacgtctccgttttatctgccgtgcgtagtgtatttttttcttttagcgtcggtgttccaccgtgttagcttgaagccacgcgaggcgtgagtgacacgagacccagagcagctgaccggctgcctcgtctaccacattaatctggacaactggattataagtaagatattgagtcgatactgaattactggtggtcaactgtttaattgcacacatacatgatcaattgaatataactatcatctatctattatattattaaaagaataaaaaaatgagcctccacgttcgctctcatggcctagaaattctcacgttaatcggagaaaaagaaaaagcagagtctatatagaaatacaatttagaaatagctgaaattcggaattaaaaaataaggaatattagaagaggagactagagtccatatagaaatacaatttagaaatagtttaaattcggaattaaaaaataaggaatattagaagaggagactagagtccatatagaaatacaattaggaaataactgaaattcagaattaaaaataaggaatattagaagtagagtatagagtccatgcagaaatacaattaggaaataactgaaattcggaattaaaaataaggaatattagaagtagagtatagagtccatatagaaatacaattaggaaataactgaaattcggaattaaaaataaggaatagaagtagagtatagagtccatatagaaatacaattaagaaaaaaaatagatattcggaattaaaaaataaggaatattagaggttgagtatatagtctatataggaatttaaaactaactaaaatttggaatgaatataataaaattaaaagtagagtttagagtccttataaaaatacaatttacaaataactaaaattcgaaattaagaaaaacatgggaagaagagtttaaagtcaatataggaatacaatttagaagtaactggaattcgaaattaaaaattaaagaatattgaaagatgagtttagagtccacatagaaataaaattagaaataataaaaattcagaaataaaaataaataatattagaagaagagcatagagtctatatagaaatacaatttacagaaaattcggaattaaaaaaaagaaatacgagtctagagtacatataagaatatatataatttacaaataactaaaatttgatattaaaaataattaataattaacacgtatataaaatataatatgaatattacacattagtagttttgtaaagttattgcaaaatttaaaattatgttgtcattttaatatatttgaataatataatgataaaacatatatgctattatatgagagaaaatataatgatgctagccgcgcaatctacgtagctcacgatgctagttaatataatctactaattaaaatagtcgattgaataaaaataaatttaaagccctaatttacgtttcgttctggggcccactgatctcacctcggtggaatcgggctcggcggcgagagcgaactcggtcggcgccccctcccattccacctgcgcacggcccaagcgcggggcgtggccggcgagctcccgtccattccctcgtctctctggataggggatctggaaaatttgctgctctcttgatcgaacggtgaaactttctcaccattcatccatccggcgaaacttccactgatgaatcggacttcccaaacctttccacgctctcgctccaaatgaccaaaagccagaggaggagggtttcgcagcaacaacgtgggcgcccacggcccgcgcccggtcagcgaggaaacagatcgaaaaaaaacaaaagccgctgacgtcacgatctcgaggctcgcgattcccaacaatctctttaaaaagcttcctctcgccgaatccccctccacctccaccacccgccgccgccgccgccgccgccgccatggcctccgacctgcgcccgccggagcaccaggtggcggggcaccgcgcgtccgccgacaagctgggcccgctcgtcgacggcgaggggctcttctacaagcccctccaggccggggagcgcggggagcacgaggccgccttttacgccgcgttcaccgcgcacccggccgtcccgccccgggtccggggcgccttcttcccgcgcttccacggcacccgcttcctcccggccccagccagccccggcggcgcgccctacccgcacatcgtcctcgacgacctcctcgcgggcctcccgtccccctgcgtcgccgacgtcaagatcggcgcctgcacgtggccgccgcgatcccggacccctacgtcgccaagtgcctcgccaaggaccgcgagaccaccagcgcgctcctcggcttccgcgtctccggcgtccgggtggtcgatgcccggggcggcgccgtgtggcgcccggaccggtcggagctgaaggggatcgacgccgccggggtccgccgcgtgctccgccgctacgtgtccacgggcggcggcgacggcctggactgcgcgctcgccgccgcggtgtacggaggggagggcggcgtcctggctcagctgcgggagctcaaggcgtggttcgaggagcaaaccctgtaccacttctactcggcgtcgattctgttcggctacgacgccaatgcggcggcggcggctgctcccggaggtggaagcggcggtgtaagggtgaagctggtggacttcgcgcatgtcgacgatggggacggggtgattgaccacaacttcttgggcgggctctgctcgctcatcaagttcatcggcgacattgtcgccgaggttaccgagaaggcgtcttcagatcattcttgaaaattttgtcagcttggagatcagatgattaaacggtaaagcaatgcccctctatgttttgttctttttgttttgttagatttggatgacaatgttagacattgagtcagtaaacaaaaggaggatgtaaagcaaaacggcaaatctcttgtgtcttggattatgttctatactgatggaagaagattaaagtataaccagaaaaagtgtcactgtggtctgggggatgcatgaacttgaaaaggagtagaattaaatatttatttaatttattgcaagaaagagtagtagtagaatattgccactttaatgaaagttatgatgctacgaaacaaagaattggttgctatgcatctagagaacctg

SEQ ID NO: 62966 - DNA, 7571 bp, Oryza sativa
aaataccatctccacactcgagagttttgaactggcattagttcccaataaaaaccctcagttgcccgacttactataacattgattgttatgtcacttgtctgtggatcaactctcaagcccctcattaaccatccttttatagaaggtacactcctctcagctggtctatcaattcccctttctgatacaataaaatctgacagatctaccccagttggcccgtaacggacggaatatttgtttgttcgacatatctgtcaacgaaataactagatcatattactctttcatgcaataaacatctacaacgtaatatcttcttgtgtaagccaatgcaatggtaatgtattgattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctacaatcggcgtctgaatccggcagggcttcgccccttcttctcttctcctcccctctcttctttttttttcactggaattgaggagagaagaatgagggctgggggctgggcagcaggccttttataggcagcgaggcctgccgcccagtcagagggcggcaaggggccgcctgcaaaatagccggccccgactggcttttttgcattcgggccccttgccgccccaccagagggcggcaagggttttcctgcaaaaaaccctccctccgtcaccgcccgttcctcccccgtttgccacgtcagcttgccgccccagaggtgggcggcagggtctatttttgtaatttttttggccgatagattatatttctgtaaatatttttttaaaaaaaatctaaaaccgaaaaaaattcggtttttgagggcatcatttgtgggctgcggtggtcattgggctgtatggccatgtagtaagaataagtctactctgcatccctttactttacgtcgagtttgattacatccctaatcccaaatacaaggctctacactatacaaaaccgtgaacttataggtcttatggtagtacagagcccaattttctcttacgtggtagatgtttagcgaaaacaccagtgatcgggcgcccaatcagcggtagaaaaatcgggcgcccgcctccacccgcgcgctcccgcactgtccccccatactattacaacaaatcacccgcatatcacggaaacgctctagtaaggaaatccgtttcattttttattccatcaacaatgtttcagcaagtgtactcgtgatgtttcattatgtatggatcaaatgttatagttaattgaaacatcctttcactatttgctgaaacattatttttatatattatgaaacaacgcccgaaaatgttttcattgcaaatgtttttatatagtgtgaagccaatcttgctacgacttcgtatgggatgagaggaaattcgtcatgctcactggcatgaggtggcgcgctccgtactgttatagcttcggtaaacacacactgcatccccatttctctactataacaagtagagtactccctccgtcccaagataactcaatctaggataggatgacaggactcatgccacttcaactgggactcattttttttagataatggaatatgatatcccggcctttgctcaaaaagagctacaaccaattattacaaagttccactccaaaagagagtgtagttcaagacaagttgaacacaccgaaccgaaacacaccgaaccggaaaagagaggacccatactaagaaaagcaaaacaaaatgtgtagctagaaggcctcgtcaaaacctaggactgaagttcgaagccaatgcatagaccattaacaaaatccttgcacgaacaggtttctccaaagtggtgcccccaaggaggacacgacgtgccaccgctcgttcagaaccgaacaaggttttcacccggagaatatggtagggaaaagagaggggtttgctaaaacgacgcctctaaggaggggaacgacaccaaacggcgttgccgtcatcagccggccaaacggctcggcaaggctttcgcccgcgattccctgcccaaacccacaccaccaatccgcgcaagaaggatgtcaacaacattgtcccttcagcgaatcggccaaggccaccgcccatagttcttcccgccgtcgacggcgcgcccgcacccggactcctccttccccgccgccagactccttccccacctccacatgccgccgccgtcgacgacgcaccgtcagccccgggtaatggccttgccaacccgccatcgccacagccaccactgtcaccagccgccaccgccatcgccacagccaccaccgtcgccagccgccaccgtcagccaccaccgtccagccgccaccgtcgccagccagcgccgccaggcgccagtcatccagattcagccggggtggcacggatctggaggtgcagcgcgcagcgcgggtcaccggcgtcatggaggaagctcacgcttcaatttggtgaggagaaagtctcatttgacatgaggcatccaactcaccttcctcactgtcgtatgatttgagcctgggtggatactgtatcaatagactatactatgtcaggacgggatccacttttcctaatctgttaacgagactatacctttcctctgctccagtccccttacgaaactttcgttattgggttagccatacacttcacatgtttctagcgattcacatggcactaataaactgagtaaggtcaatgcactaccccatttctactacagctagctatatattattttataaggaagcactagcggaccgatcactaagtggttagtacctccagcaaaacctgaaatcgagttgagttgaatggggttcaagtcaactagatgaagggtttctttgtagcgagggaacgctttacctttttttaaagaaatgtatgtgctcctcctctttctggacaagacatataaagagacccgccgaagatttgtgcttgtgggctagggtgaatatagcgggcgagtgctatgatggttgtccaactctagaccttacgacaaagaaagagccagaaaccttacttgaatgatccccccctccaggggtatcatcccagtaagcttctatagataaggcggaacgtccttagttcagcattatagcacagggaagaacccttctgaaaaggaatggaggtatatctttactcggagtgcaacgcagagatagagatcgaagagccggtggttcgcgaagcatctggcttaccggtcatctcccattcccgtcgtcgagagactaaaagaactatagcatgccagaaacggagagttctagcacgcacggcctttttcatatagcaccaggatgattaagacttttcgaggttgtccacgagcggaggcccctcgaagaggcgagcccggaaacattcgccctttactagaaggtaaggcgcgcagctgctggtctttcacttggaatggaacaggtttcacgggcacggcgttcatggccggagcattaacgagggcgccacgcctccctcgtggcggcgaggttcttgacacggtcaccggcgtcgcggcacgcgccgcagtccgccgccgtcgtcgcgaacttcgtcgcagccacatccaccaccatcgccaccgccagccacccccctgccaggtgtgcggcagccggcaccggagaacgctcctcggccgagccttcgctgcggcactgcggcctcctcgtgcgccggcctccgcagcctcctcaccgtccgcggccagcacacacgccggcctccagccgcgtctccccgcgcgtcgacccccaccgcctccgccgccgtggccttgctcgccgctagccgccgccgcctccggccagatccggccaccccggagaggggcaaccggatctggcaactccgtcacccgtcgctggagccagagccggagccgaccgccgcggagagccccgccgccgtcgccgtgaagagccctaccgcagcgccgtcgccgcgccatccccgtcgccgcgacctcgtcgtcccgccgccatcgtcgccacgccctcaccgggcgagatggagccgaggagaatggccccgccgccgccatcccagcgcgtcacccggctttgccggcgacgagctccggcagcggcgaggcacggaggatggaggaggaggggcggcggcggctagggtttcgcccgtgccaccctgtgtagctaagccaccttgccacctgctacttcgccgcccgctgttgtgcctgcgaccacttcgacttctctttgttctacaaatagaaaatataaacagatgcttgcttggtgattggctggacacgttttatgatattgtggagtttgttcaccatttcctagtggtgatgtttagcaagcccatgaatgccctgatgctttgtatgacaatatgacggaccatttcttagcggtgatgtgtagcaagcccatgaatgcccatgatgttttgtatgacaatatgacagatcaattttggaatgttggttccagtatgctattagagatattttaaacaaactacatgatcatcatcttaagatgccttagaatttgaggaaatcaattccatcccaataattccaccccctttctcacacaatctcatatcaattcaaaagaaaaaaacatatcaaaaatatttaataaacatcaccaccccaaacttcttccatctcagcgccgccgtcggtgaaatggggagggcggcgaagttggcgagcatcctcgccgccgtggtgttggcccgtcggcggtgacttatttactacttaaattttccttacaagtttatatatagttagtgtctaagcggtgacttatttactaaaattttccttacaagtttatatatagttagtaaaaaaaatatctatgcattgcaacaggattgataaacactttgttaatttaaacaacaaactaaaataaaacaaaacaaaacaaaacaattgcaaacacaaagtcaaaaaatcatatatagcaatgaaccaggttacgcccactttatacgtatcatacaaaaatatcccttgtatacacgtttctatagcctcacaaattaattgggtgactttcataagttaacggcggtgcattttgctatatcttatagatcaaaaattaaaattttcattattcaattagcaaaagctttttttactgtagatggaaagcatttgcaatgtaacaaaattgttgcataaaaattatttgtgaagggagaaaaaaaagaatagagagaaaaggaggagaaaagaaaaggagattggtaggagagggagagtatcagaattatcgagagaaaagaaagaagaaaaagagaacgaaagaggggcgagtgaggcttgtgggatggtgtggatcggttgggttgggctgagaggaggggttgcgctaggatatgagcgtataatagttattctagactcaaattgaattggatgcgaacggcatataaacaactcaaaaccaactcaaatacgatgacgtaccaaaatttcgacgaagcatcttcagtatttataatagtagagaagtaatggactggtttactagagaaatatcttttacaattttcgtgggcatgctttgttcggtacgagccatttgttcctttggtttcatgcaaactcctaccttttagataaacaccacatatccatccacttgattaaatgcacagctcgacattgttaatcttataatccaaagtttaatgatcgattgattgcacggatttgatagatcatgcaaactttagatcatacaaattaaatttgataaacgcataatggattttaaaaaggaaaaggtacgaattaccccatgaaactatcgtagtcgatcgaataaccccctgaactcgaaaaagtacaaaatacccccttgatccaatcctaagtgattttgtcatagcccctctacctctcttcctctatctatctcttggccagccagtgggtggcgacgggaacatggatgacaacaagacagggcgaggttgggttggatagaaacgtccccgcccccgcacgctagcgggttcacccggccccggagggaagaacgggttgaaattagtccacgcccctgggcccctccgggccccgtactccggccgggttcccgcatccccagtgcaaacggcagctgccagcggctgccagccagaagaaaagaagaatgacgagagtcacctgtagccggaggaaagcacctggaaggagagaacatgggatccacatggaccccacatgtcagcgtaatccacgccatcaccctctttctcctcttctctctttctaagcaaggcaaagcggcgggaggccggcaggcgaggcgggagagaggagggcggcggcgccgcgacggtggccggcggcgcaacatcggctggctcccggcggcgacagctgcagctaggaaacacgacgacgcgggaggaggggagcacggcgacagcctcgattcgttccgactccctcccatcgccgccttttccttttcctccaaatccaaccccccttctccggcgcggcagcgacggcgacgacaccggaggcgccggcgctccctcagctcgacaaaaggtaaccccagccatccctctcttcctccctcctgcttccgttctgaatgaaaaaacacgatcaatctgcagccatggcaaacctaggcggcgccgccgaagcgcacgcgcgtcttctcgctcaccgacgacgtccttgtttagggtggaaaataaagtctaggaggtcggtgccgcgcagaagcaatcgatggagataaacttgatttgatttgttagttcgttttgtttctctgctgctgggccatagtccggtgacaagcgcatcgctagcgctcgcgccaagcaaccaactcgatcaagttgctacagataaaatcaattggtttgttgtttatctttttattcatctgattttatctctcttccgctaatcacctcactcataatcgagcaccatatatgtttgtgcattactatgcatgcatgcatgcacgtagttgcttcaccgtccaaataacatagcttgctcttgattctcccgggcgaccgacgcggcggagccggatcggacactcccccgtgcgcccctccctctacatgcgtgtatgcaggctctaggccctaccgtattctctgctcccacctgccattacaacaaaaaaatccacatattttggaaacctcctattaattaagagaattcgttttattttttgttctgtcagggtaggttacggataaggcataccctctatactacgacttatggaatataccgataaccttcacgtgcacggatcgtttccgtatatgctgttaggaatttatctcaaactatggaaaatatctctatgagttaagaaactaccggagtcctactcggaggggatagaatctctactatatcgtgccagattacatatc

SEQ ID NO: 62967 - DNA, 3824 bp, Oryza sativa
accggcggctccgcgaggtaataatcactaaccaaggtccaattattgttcaggattattcgctgattacgtgcgctgttagcagcgcgatgccgtcgctggtgatgctcgtggagaatgatgttccatgagtaatagtgattgccttgatgcttacgggggaatatataacttggttgttgtcgaaacatgaattcggcaataataaaatgggtagcgcacgagacctaaaagtggatggatgcggagacaaagtatttagacaggttcaggccctctcaatgagaggtaataccctactcctgtttggggatttgaatccgccgagtgtgtattgatctgacgatcaggttgtctcatgcccctagaggggctccctgcccgccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattttatatatataagttatcccctataactagtcggataaccatgccgtgtgggtatggggtacccataatctccacagtagcccctgagaccttcacagtcagaaagataatcttctctcgaactagattactccaaagccgagtgcttcaatcatcctcgccatgatctcccgagtacttttaccaaatatgaagactgtggagggctgaaaaaataaagtcagatgcatcgactagatgcacctaataggtgtaacccccgactatgtggtttaattgaacaaaccaaacatataatcaaggaataaataatctaaccaaccgagtggtttcgataattgtagtcaaccaagcgacttaatattaatatgtagcatatgcggtgtgaatccctgaataatatgatgatccaagtgatataccgactgctttgtaaaatatgatgagtgtaacctaaagttgacaacatctttgaaaattcacatagcaaaacagctataaagaagcttatatgctgtgaataaagaaatttccaaagtattgggcacacaccatgcgcacactgctttaacagatgtgcttaagtccctaaaagacacatggtttcaccacacccggaaatatatggcatatgtggtgtaaaatccgagtaaataaacttataaaggatttaccaaccgcctggaaaatgaccataatatataatcagcctaagcaataatattggtcaataaaaatacacacttacgtggcaaaaagcaatgatattgtatccaatcaattgcttaaaaacccaaacagcaccttgacttatataaaaaagtcagcgggacagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatataacatgctcccgagtaataaatcttccgggtaatatagaccaagcgtagctcatatgaatagcttctgatctgagtgattatcccttatgggatactccaaaatagatgtaacaattgaatcccgactggcgcaagtattcagttgataacccttacggggaataataaatagtccagtctttgagcatataaaatagacccatgatcatgaattcatgttgcatatatccggagcaagtccaaattgaagatataatacttgtatttgagctagtaagcccctgagcacgtagtcacaattgttcattgatggtagctgacgcagttggcatagagacaagacgaccaatatagagataatattgcccaacagaggtggcaaaaatattggtggtagtgaagatagtgataccaatcaaaagtgatgaagttgcacagccgtggaggcgaagaaaccagtcggcaacagtcaggtcagccatcaatgaagatgaaggcgcccagcgataaagttgtgtagccatggcagcgaaataatcagtcggtgacagacgaggcagatcaaaggcgatgacgaaatccaccaatcatgaagatgaggaaaatagtcggcgacgacaaacgtaaccgacagtaatgatgataagcatcaacagagatgatcaaatatgatgacgaagttgcctatcaatagcagtagagtaagctatgataaagaggtttgacaggatgttgatgaagatgacgatgtcggtgatccagtcaatagcggtgtaatagccgatgataatgacgaagacgctcatcagcgtttgcatagtaggtcaaccgtgaaggcggaatagcaagttggcgaagtcttagtcatccattagcaacggcggaatgtcagagccgatgaagcagatgtgctggtgatgatgtcagtgacaataatccatcaaactgttgtagatgcttcacttggaggaaagtatatgctgttgttcaactcattgaatctgatatgagttgattggttgatgactccaaactcccagacatgtaaatttaatcttgacctactgctctgaagcgaagacaaaattgatgactcccagagttgacttgttggctgattaattgattgcttcatcttgacataaagcttgtcaaattttgagccatgtatttgtgtagcccccgactctttgattagttgggaaacaactgaacatagagtcgagaattatagcttcttgttgtcgagtagtcatcacttgattgaagatatgtgttgaagatgtccaagtagaaatcctgaatattggagagccacttgttgtagtaaaataacatggcattgcatgccgagatgtcgaggttcacaaagacgtcgtggttggtgaaatagtaaaacttgcgaagtagcaacaatagagtttgccggtgccgaagataataaagatgaagtcgctccaccatgatgacaaagttgtattgccgtaatgaagtgaacacaagtcggcggcaacagaagcaaaccggtagtgaagacgcgcagttgtgaagataaaagcaccagtcggcggcggcataatcagtcggcgacggaagatgatgatgtccatcagtagtggtagctgtataaaccagacgtagaggcgagggcactagtcagcagcagacgagacgaccagcgatgaagatggtaaggccaatcaacactggcagaatcatgcagccatggaagtgaagaaaccagtcggcagccatgacaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgcaggcggaaacaccagtcggcggcggtcgaggcggccggtcggtgaagacgtagacgcccaacaacggcggcataaaggccagccgtgcaggcggaaacaccagtcggcagcggacgaggcggccggtcggtgaagacgtatacgcccaacaacggcagcataataggccagccgtgcaggcggaaacaccagtcggcggcggtcgaggcggccggtcggtgaagacgtatacgcccaacaacgg

SEQ ID NO: 62968 - DNA, 15316 bp, Oryza sativa
ccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataataggccagccgtgcacaagccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcgacctaggcatttcccaaacatgcatatgagtgatatgagttcgtcattaatggaacaaagtttcacggattagaatttactactcaggtacttttgcaattattaagagcagaaaataaatttatctcatctctatgcttttgatttattccgaataatacttagcaccttgcgttactcggtccatccaacgagcccccaggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtcgtattccctcgatgacagcagaagtagccgatgtgggaataaagcagtccatcaatggtgacaaaaataccagtcggcgccagtggaaccaagccagtggtgtagatgatgaagcccattaacagcggcggagtccgccaaccgtataggcaaaaacaccagtcagcggcggcagaggcaggccagcggtgaagtcgtagacgcccaacagcagcggcataataggctagccgtataggcagaaacaccagtcggcggcggcgaaggccagccggtcggcgaagacgtggacgcccatgaatggtggtgtgaccaaccaaccgtataggcgaggacaccagtcggcggcgacggaggcaggccggcggtgaagtcgtagacgcccaacagcggcggcataataggccagccgtgtaggcggaggcaccagtcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccaatcggcggcgacggaggcaggccggcggtgaagacgtagacgcccaacaacggtggtgtgaccaaccaaccatataggcgaagacaccagtcggcggcgacggaggcaggccggcggtgaagtcgtagacgcccaacagcggcggcataataggccagccgtgtaggcggaggcaccagtcggcgatggtgaaggcaagccagcagtgatgatgaagatgcccatcaacggtggaggtgacgtacccgacgacaaataaaacgggtcctctgcgttgaactatggtaggtgcaggtcattgccgtggccgtgtatatcatccgcacggctcaacctcaatccaaccaatatatgcaaacacagaaacaccaggaagagttgattagcgatcaaaaatataaatgcttaatatctcatatgcatggcatgattagatgaattgtgcacgttgatccatgcacgtgttttgatggcatgattttgctagccacgggagctgataaggccgtgtcaattgcttgtcgatcaaatgctggtgctttttctttgcccgagtcacagcaaggctgaaagcttgacgatacatgatcggactcgccaacaatcgacattaaacagaagacaaaggaaagtcaggcattaacccgtgattagtcatcaagaataaaatattgataatcaatatagaccagaaggattaaattaaccagggaagggaaaaacagactcggactaatccggtcagtatatccatccggtggcttacgcggccttcaacatcagacacccggtgggtgaggttcgcacgacatctgcccagctagttggctcggtttcgccgactcgacctcccggtgacatgtctatgtgaattaaatcccggtcgccggcagtcccgagtgcaatcagcaacaattgatccgatgttctggttgctggtcgtctcgatctcagccggtgtataaaaacaagagattaacagtagattaatccacaattaaaaaatcaatctaatgaaagttagattggaacgacaaaccaggtcagagatttgagtcattgaaattgatctcagtgcttctctttgaaattgattccatcgcgctcgtcgacgaggtactcggcgctgcccctacctggcgcgccaactgtcgaaacatgaattcggcaataataaaagggggtagcgcacgagacctaaaagtggatggatgcggagacaaagtatttagacaggttcaggccctctcaatgagaggtaataccctactcctgtttggggatttgaatccgccgagtgtgtattgatctgacgatcaggttgtctcatgcccctagaggggctccctgcccgccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattttatatatataagttatcccctataactagtcggataaccatgccgtgtgggtatggggtacccataatctccacagttgtgttcagtctatgatggggactgcgcctaatgctgccttttctgaacttgtggttgacatgtagttcgattctgtttcagaagctgtactaaacatcttacatattttagttttctttatttatatgattgtaatatggacctcaacgcgatattatgtatgtatttacttgctggcattcgaagttgcttgtccgtgcaatttcagaatttcttgaacttcctgtagttgtggtccttttactagatatttgagacggcacatggattaacataatgtcaatgacctttttggtagtgaggatggtagacttagctgggattattcaagtttcaaggggaggaggccttctatggaggatcggtttagcataaagatgactacgatcaacgaacagacagtcagcctatttggtgtatttgatggtactgtccttgaattttctttcattaagttattttcattccctaatatgtctttgttcctaacatttcatacattaggtcatggaggatcacttgctgctgaatatcttaaggaacatttgtttgaaaaccttgtgaatcaccctgagctccttagagacacaaagcttgctataagtaatgttctccctcttgctccagctgtacttcttccgaacattcaggtccagtgctacagtactgatgttatcattttcttgaatgcttttgcaaaatacaggccaaacgttcctgaaaactgatgctgatttcctagagtcagtgtcttctaatccttttagggatgatggttcaacagctgtgactgctattttggttggcaaccacctatatgttggtaatgttggtgattcacgtgttgtcgctctaaaagctggcaaaggtaatatttgattggttgtgtttctttgttagtgatgacacttcacttcagatttccatataactataaacggttgctatccagtatgccctgaaacctttctgtcaactgaaaaatatcaaaatatgacgcactaccggattctaactttcaaatgactatttctatttttcctgagttacaaaggattatgtcacatgtagattttatcaatgacactgaggaattgagcactaacttttgatatgttgctatataccactttaataagttacagcatgccaaataatctagaaactgtgaaatgacatttattctcttgtttgtttttccgttaaaatctcgtttctttccatgcttttttagctgtcccactgtcagaagatcataaacctaacagaaaagatgagcagaagagaattgaggatgccggaggtattgttgttttcgatggtaagccctttaatcatgaaaatcctcctgatgtatttggccagctttagcttaatctaataggaagtatgaatgaaaacttgagaagtttgatcatgtcgaagcagatacatggagggttaatggacttttggcaatgtcccgtgcatttggcaaccgtgcattgaagcactatgtgaaagcagaaccagatattcaggtatctttttaaagtttagttttttgcactggatccccgccccttgcatgtttacatttttatgtggacaaggaccagcttttctgtactggttttgtcttactaaaccataatacccatttcatatgcacttgggtatcatgaaatagtctgtacacatcatcaacctgaatgaaatggatctgctgcaatgctaaacagcctgcaagtgcagtctatctgggaaatgttgatgttcctgattgatcactttaatctcacctgtgatctgggaatgtcgatgttcctgattggtcatgagaaaacccatgtaattcagcatttcaaattctcctgctacatgttcctcctttgcatatgatcctatccttctacttaattgttcacgcactgattccttatatgccacaaaacctgttaatggaaaagcctattgaacatcacctatgaatcttttgtgatgttttactgtaaatatgcaggaaaaagtggtcgatgaaagcttggaatacctgattcttgctactgatggcctttgggatgttatgcgaaatgaggtatcatttgttgaatccctgtttgttgattatgcgacctagaaaaaaacagcagaaatatctgcttacatgaaaaccaatgaatgacatccactatgttcacccctgacacacagctttgccctcgtgcgagcgcgtatctcattcggtccaatgctaactagcattttacatcttttgtcaacaaggatgctgtttctcttttgaaagcgcaagatggacccaaagcagcagccatgaagctgacagaagtcgcccactctcggcttaccttagacaacatcacatgcatcgtgctgcagtttcaccatggaaaatcaaccaacagcaactgatgttaacaaagttttgtcaccagatatcttgaaacgagagttggtcccctgatccgcggttctacaagattattactagattggttgagtcgtttttttcgtcatgtaggaagcttttaaatctgacgtgcacagtttactagcgaaacgtcttatggttgtttgatttcggtttcggatctcttgctattaggggtagccggccctgaaatattaagttatctatagcataagaaatgttctaaattttttaggtggctaatgatttaatgtctgtgcctatatacttcattagttattgtttgccaaatcccggcgtcgctaatagggatgaaaaccgtatataattttttctatcataccaatatcatttttgcaaaaaaaataatattatttcttctgtaattttttttaatttctctatacgtcatattaaaattatcactaaatatttaattttattaatataaaaactaaattcctgaccgttaccttttttaaaaactaataaaaaataatatcgttttcgatttttcatgcctatttgctagcagcagcagcaagcatcgcaagcttataatcacgattgcgaagctctttcttcttcaaaactcatgtttcacatgaagaacctttattttgaaaggaaaaaaatcaatatttattttgaaaggaaaaatcaatatttattttgaaaagaaaaaaatcatctcttttgcacttctgcttatgtaagtagggtatatgtcctgtgaaaacacgtgaaagttgaacataaaaagttttataatttcatgaaaaaatactagagataggtattgatatgaatacattctcaccaaacctcaaacttatactattaacctgattttttattctttagaataaagttgagcttagacttaagatttggtgggaattatttcatattatactgatctctgtagtattttttttattaaattaatttttttattaatttagagaacttctaggtctggtttttacgggttttactttttttaatggtaagtatgttcgtaacggcttacactgcccaagcaatttaagctgctctaaatcaagactctttcttttgttttgaactttgcttcaacgatatgataatgcaaaatatccaaaatgatttattaaaaaaaatcaaaaaaggactatctaaaaactaccacaagttttttgagtgaaaaaaaatcaaatctaactatagtatgatgtaatttcaccataactatatattataataagataagttgtataaaaaaatatatgtagctttatacctaagttatacagaggggaaaatataattaaaatatagttgtagggtaattatattataactacaatttagttacaatttaattaaaatatatgttgtataattatattacagtaaacaccataactgtagtttctattctactgatcagcacacaaacagatgaacacagagctgtagaccacagaaattataagcgagtgaaagccttatttcttttgaaattgattacaatctacataaggagagtcgaggtgctccaaagagatctatctcgccttaaccttgagggtcctatttataggcggagaaagctgatgatttacggtgtaagctgggttctcctaaaagctaactttttggcttccactacaagttgctggcttacgctgcaagcttccttccgtgataagatatcttttggtttcttctggcgtaagcttctttctatagtaagttttccactcatacttactggttctacttgatcttatttatctttttattctatttatggaatcgtccaaccaaaaacaaaaaagagtctctaccgccatgataaagacgcacggaagaactttgatatatgactagcgtagcacgtggaggatccattcgttgagagtgtccattgtctcagtaggaaacatcgtccacaataaaatatgtttcataatagttatatttttaatttttttttaaaaaaagttctaaaactcccaaaaaaaaattttgaagggaacttttgcgacagttgtttagcggttgcaaaaagaaaaatcgttaaaaacctaaacccagggccgctgtctccgcctccgcctccgccatgcggcgccaccacctcctcggcctcctccgccgcgccgcggcttcgtcgacgtccgccgcctccagccgcgcgggcccacaccccagtctccatgcccctggcccgctgcggaatggcggctccgccccccgcttcttctcctcgcgcggcggcgccggagctgcttcgaagggcctgggcgacgacgaggtcgagctctactcgctcctcctcggcgtcagcatcggcgacgaaggcgaggcatcctcacgcggaccggctgcctcgaggggaggccggagggggcggaactcgaagcggcagccgccgaggtcgagatttgacggcgatggagttggctgtaggtgtgtattttacctgctgcccagttgaaattggcttatctgtgcaatttcagaattccttcgaatttctctacttataatccttctattagagatttgagaattgagaggacatgatatcaaatacttttttttttggcagtaaggatggtaaattgagctggggatattcaagtttccaggggaggaggccttctatggaggatcgcttgagcataaagtcaaccacggtcaacggagaaacagtcagcttatttggtgtatttgatggtagtgtattcaatcttttctttcattaagttgcactagtaattttgttccctatcatatctttgtctgaagattgcatacattaggtcatggaggaccacgtgctgctgaatatctgaagaaacatctatttaaaaacctcgtgaagcatcctaagttcctgaaagacacaaagctcgctataagtaatgttttttccccttcatttcggctgtacctcttctgtatgttctgattcagagccagaaagtaataatgttctcatttcgttaactgcttttgcaaaatgcagaccaaacgtttctgaaaactgacgctgatttcctacagtcgatatcttctgatcgttatagggatgatggttcaacagcagtggctgccattttgattggcaaccgcctatatgtagctaatgttggtgattcacgtgccgttgctctaaaagccggaaaaggtaatattttattggttgtgtttctttgttagtgaagaaactcccattcaagttgccatattgttgtagctataaatggttacttttcagtatgccctgaaacctctttgtcaactgaaaattaagtgtttcttttttttcctgtgttgcgaaggatcttgtctctagtagtttttatcaaattgcaccaattttgatatgtttctataccattttcagaaattggcacgttccaaatactctagatactgtggaattctcttttttgttcttacatttcaatcttgtttatttccatgctttttagctgtcccactgtctgaagatcacaaacctaacaaaaaagatgagcgaaagagaattgaggatgctggaggcattgttgtttcagatggtaagcacttttaactatcagaatactcctaatgtatttagccagctttaatttaatcgaatacgagtaagaatgaaaacctgaaaagtttgatcatgtcacaacagatatatggagggttgatggaattctggcagtgtcccgtgcatttggcaatcgtttaatgaagcgctatgttaaagcagaaccaaacattcaggtatcttattgaagttcagtttgcagaggttccctgccccttacatgttaatagttcagtacttcagttttgtattggttttgtcttacccaccgtttcttatgcacttgggatcatgaaatagccagtatagatatcatcaacctggatgaaatgggtctgctgcagtgcttaacagcctgcaaatgcagtctatgtgcgaaatgttgacttccctgattaatcactttaatcacacctgtgatctggaccactgatcgctgaatcaaacagttaaaaattagtaacatgttgtaacctatgagactcctgaaaacttatgtaatccagcatttaaaattcacatgctatgtgtttctcccttgcatatgattttacccttctgaaaagttgttcacagtactgatttcttatgagccacaaaacttgttcatggaaaagcctgttgaacattgtttatgaatcttttgtgatattctactatgaatatgcaggaaaaagtggtcgatgaaggcttggaatacctggttcttgctactgatgggctttgggatgtcatgcgaaatgaggtatcacctgttgaatcgtaattgttgattatgcgacaaagaatacgacatcacttaagtaatactattgtgctctctactagagccatatgaatatttgcacttacataaaaagaaagaatttccattcactatgttcactctcacacgcccacctgcccgggtgagtgcacgcacgcacacacagttcacgaaagctcgcatattggttgtatctcatttggtccaatgctaactagcgtttacatcttttgtcaacaaggacgctgtttctcttttgaaagcacaagatggtcctaaagcggcagccatgaagctcacggaagtcgcccgctctcggcttaccttagataatgtcacatgcattgtgctgcagtttcaccatggaaaatcaaccaacagcaagtgatgttaacaaagtttgccatcagatatcttctaacgagagttgctcccccagatcctcagttctacaagaattttcagcaagcacgaattattagattgattaactctttttttcttattattatgtataaagcctttacatgtgacgtgcctgtttaaattgcatctttcacgagctataaacggctgatgtttgttttaatcggcgctgtaaattttggggaggcttatgatatatttctgtgcctatatatatactactacttcagttattttgtttccaaatcccggcggttgccacaagctgtaaccgttggaagcttataccaaattcatatgttgcattaagaactcaattatttcttaaccttccatcaaggatatgacaatgcacatgaccaaaatgattcccatggatatggttgtaaacaggtaccgaaggttattcggcccatttctttacatgtcgacaccgttgttgattgcttccgtgcttagccctttcattgttcacaatcgtcttctctcacttcaaactagtctgagagagagctcgaggtaaactcacttcatagccacgttggatgagtactacctggctgatatggtctaccgtaaatccacgtcaaaataaatgggtcaaatctcaaaactagtgaccattgaaatggtttatgctgttttaccaaattgttcatttcacttatctctttaatgaaattaaggaatacattgctaccacgtgtggcgtgaatcaaaggggccaataagaaaaaactttgtacatagttgaattctccaaaatttctatgccaattgtcaattcctatgactggctggaagttcatgtaaaatactgccaaaccacagacttacataaaatccaaggacgtgaaagtgcatgtgtactagttattcttaactggctgccattctaacctaccataaaaatagcatgcatctctttcccacgtgggagtatgcatggaaaatatattcctaaaatttacttttgaattacttatccgacctacaaccgaattatactattatattcgttgtaatttgttgtaattcaatctttataacaagattttacatgattatattctgataaaaattactttaattagatatataaattactttcaaatttgatttatttaataattagttattatgaaaataaattcaataaagcttaaagtaattatcataaatcataattacttctattttttcttatttttttgggaaaattgtttcttattttaaaattatcttgcagtgtaggtattttgtcgaatgtttagtcctaactctaagaaaatattactacctccgttttaggttataagaatttctagtattgtccatattcatatagatgttaatgaatctaggcacacagattcattaacatctatatgaatgtgggtaatgctagaaagtcttataatattaaacggaggaagtaatattttctagagctacttttccctagtagtgtactacttacttataataacttctatattctcttataattacttcatatatgaagataaatttgcttttctaaaaaaagacatagtgatacattaaaataacaaattaaattgtatttactcgtgaatcttctctacattttactttgcataatgccttatttcaacaccatccactacatttactttcaatgctatgcagagttacttccattataaaacctaattatttccacaatttaagtaaattacttttgaatgtttgaatacaatcaatattggactcgttctgttacatattttgtgtggagtacgatggttcaaatggatcttaaaaataatacaaggtttaaagaatatttatcgccaaagattccatacccaaaagaaaatagactagtgtaataaggattcaattgttaattggttggtgttgacctccgcatgtaaatatgtgccacgtcaactagatagcgccgatcggactttgcatgtatctcgcgataaacctaaatagtgtataactagaatttacaaaaatttcaaataaaatctttaaaaaagaaacgatcaaatctgaagagtcgagtactaaatctgaaaagaaacgatctttaaacctgaagtgaagtgacttggataatttgatacagtactagatctgaaattctgaaccgtcgcggctcacaatcggacggttgctagatctgaaattgatagatctatcaaatcggacggctcacaagctctccccatttcctctcaaaaacccccaattcctcagcccgctgtcctgtgttaaaccctaaacccagcccaccgtccatcctccgccgccgccatgcggcgccaccaccacctcctcggcctcctccgccgcgccacggcctcgccgacgcccgcctcccgccgcgcgggcccaccactccccggcctcctccaggacccgctgcggaatggcgccgccgccgctggcccccgcttcttctcctcgcgcgccggccccggcgccggagctgccgcgaagagcctgatcgaggacgaggccgagctcagcgactggatcagcgacctcaagaccgactcgttccacctcggcctcagcagcggcgacgaaggcgaggcctccacgcgcgggccggctgcctcgagggaaggccggagggggcgggcctcgaggggcccgccgccgaggtcgagattcggtggcggtgatttcggcggcgataggcgtgggtttgagaggagggggaggatggtgagtaataatgagctgggtgacgacgatgatgatgaggatgaggtcgggtttggtcccgcgaggggaaggcgggatcggggagggagacagtcagaattttcacatagaggaaggaggggaaatgatcggggagggagacagtcagaattttcgtatggagggaggagggcaaacgattttgatgatgatggtggtgggtttcggtctacaagggggcagcgcggccgaggtgggaggttggcaaatgtgtcgcggaggggatatgattttgatgatgagcctgggtttcaatctccaaagggacagcgcggccagggcgggaggtacagtgatttggatgatgatgaaggtgggtttgggtctctgaggggaagacgcggtcgcggtggaaggatgtctggtgtatcgcggagaggtgggaggggaagtgatttagatgacagtgaggatgatgaatactcaagaggttcgtctccaaggggaagacgtggtcgtggtggaaggatgtctggtgtgtcacggaaaggtgggaggggaagtgatttagatgacagtgaggatgatgaaaacgattctattgactctagaggcagaaggcgcgaccatggcacgagaggcaggaatgtgggaagtttgggaccacagagaggtgggagagggggcgatgcagattttagcgataggcggtcgaggggtggtaaaatgtttgattttggcttgtcagaagatgacagtgagctgggggaagttgatgaggatgatggtccatcaggcttcgaggatgatctctttgatgacgagggtggtgagaagaatctggtggagagtccagctaaaaattcagctccttttgagtcaattaaaggagagccaattgatcaggagggtgttgtgcacaccagagagagtggaggtggcgattcgtatttgagccagacgaggtagctccacctttaaatgttttctgatgcaatgttgcctgttttctttgattcagctctgaaaaaaacttactatctccatcccaaaatatagcaacctttctagttcggaaggagtagatcagtagtctataatcatctaggtttttatggttgggctaaaagcttacatcattagtggattgccacttatttgatgaagcaacaaattatgcatttctaatttgtccgatccttgttactggggctgctacagtctgcagcttttccttaacgcaaattgatgcttccacagtttgatgtcctacttgatgaaaaatgttataaattattgaatccaaagtaagttattgctatgcttgtctcagtgtatttgtgaataatatggctatgatctatgattggcattgtgcatagatcatctgctatttctctgaatagttgcaagcatgtactgaaaatttgaaacactgggtacaactgatgattatgcacgtattaatgttggtccttttggatgttctcacattttacatgataggtttgatgaatgctccctgtctcccttgacactaaaaggtgttaaagctgctgggtatgaacggatgactgcagtgcaggaggccactcttcctattatacttaaaggttgatcttagtagttcttctttgttatgtgctcaacattgtagttttatctatagtatttcacattttcttttgcaaacttgtctcaagagtttataaatctatcagactcgtattcactaacttccttcacatttttaatttcgaatctgctatcttcacatatttattgaacttcaaattcatgtttatgtttgttaatttacaaacatcatgtgtgaagacaacgtattagttcccatcctgtgcatttgcacccagtaccacacaagcagatcacacaaacttgacctactgagctggcatagaaaaggaaaccac

SEQ ID NO: 62969 - DNA, 645 bp, Oryza sativa
caaatatgtgataagaggaaatggaatgccagcatatcaagtaacttgatcatagggtgcatccatatgttgcaaaacagaaacaggtaacacgaaaaggacaaacaacttacgagggaaaatgtattcgaaatcggacatgttggtccccaagatacccagcctggttgggcaatcctgacaatagtaatatatttagcactttgctaggaacacactctggtcttagatttaattaataattgcataatttacctttaccccttaaaactataacctgccctggttgaactcctttgggtatctgaaaaaaattcaccagatatcaactacgcaaaatacgaaaattcacacttcaaacacaccatctcatgaaatttatggtaacatggagacatgcttgatgcttccataaagtcaggccaagttaccgggcattataaatataaagggatacattctatgaaacattgcatggctaggtttgtaaatacaatatgtaatgaagaaagtccaactttggtcgctcaagacttcatgtcttaactttttccaaataggatgatgtggatgatatgtgctaactaatgatctgtttcgcaaaagaaaaacgaaaagtaatggcgcgaagccacataaacgcaa

SEQ ID NO: 62970 - DNA, 1368 bp, Oryza sativa
aatagccggctcgcggttattgagcaccgggacatgtattacacttggctagactctaaattctttaacttgtgtgggatgggatattgcatgatgatttttatgctgatggagccacttcctgagaggcgggaatatggacgtcctcagaaaaccataacgactcaatggcgggaagctatccttgggatcacaatggatggtggacagaaccgtcattgtttaatatgaacactggtattaaaacttgatcagtccatgctaggtcttaggcttgtgaaaagaattacaaaatttactttgcgcaaaagaaccatagccatcctttgaattcctctgtcatgtgcatcattgctgtggtggcttgctgagtacggttggtactcacccttgcaaatataaaattaatcagaagcgggagatgaagcctcggaggatccctatgcctactaccaggagggagatgaagacgatggtgctcagtaggtcttagtacggtcgttgcctgtggcaatggcatgccgctgcctgaattccgctgccttatctatttctgcttttggatgtattccggaccgcccggtccgatgatttaagactacgcctgcgggcttatgatgtaataattcgtattagacactcgtgtatgtgcacttggtatttcagctatgaattcgtgtgtaccagactacttgatccagggaaatggtattgtttacacgattgattcctgttataaaaacgggggtctacatgtttcgtgttagaacaattcaaaaaatagtaatgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccatgttcatcgcatttgctgcaacgcttcaccctgccagcctccgactcgtccatatcgttgcgg

SEQ ID NO: 62971 - DNA, 2060 bp, Oryza sativa
aaaatacagcaggattaaccaaattaagattattaaaagactaatccctccatcccaaaatataatagacggagggagtaactaataagcaggagtactctactagttagagtacataagtggggatgtagtgttcaccaaagctataacggcacgacctgtgcttgatgatgtgaagcttgtcgccgttgcagcgcaccacctccacaccggtgagcatggtgcaaaaccttctatccctgtcaaagtcgcaccaagattcgctgcaggtctcgcggcgcgcgaccatgaacagcttagcgatgcacaatttgccgtcgccgaggtgcacgacgtatgaggcgtatggcgtctctagcactgcaaagcccttgcacccgcggtgcgccaccactggctgctgctggacggtggaggacaggtcccaggcaccaaagacgtcatcgttggcggcggagagaccgaaccagaggccgtgctcggggacgtactcggcgcggccgcagaagggcagcgcccagtcgccagctttgctccacgcggtgttggccgtggcgaaggagtaggtgccatagctctgggtggagaccaagatgtgggcgtcgccgaccaccgcgtacccacggatctctccgctgctgcctctgtagccggcggcgtgcacgcacggaggcggcggcaggggccgccagtagcactcgtcctccagcctgcccccattgagggggcgtcggtcacggtggatgagcgcctcgaaagaatgccccgaccgtcgaccctgacggtcgtcacccttgtcaggccaaggtgtcatatccatgaggtagagatcgtcgccgatggcgagcgccttggtgttgaatttgggcgctagcatggagggcaagacgcggacggagtgctcggcggggtcgtagaggatggcgcggcgagtagtccggtcgacgccgacgatcttgtcgtcgctcctgcgcatgaactccgtcgacccgcagaaggtgatctccgtcggaggcagggggaggtcctccaccaccgtcgccgccgacgacgactggggcacgggcagcgcatccttggggaagaagagatgtgatgggttgatgcggcgtagcctgtagggttgagggccgtagccggctttgtcgaagatgtcgaccatgtagaggaagcgacggatcatcgtcgtccctaatttgctaatgcggcggcggcggcggcgggggaagcaaaagaccggcgatgggatctcaatctgcggtgcggacgggtggctgcctaggtttttgaggaatttttttcgtttttagatttttttttaatatttacagaaataatctatcgacaaaaaaaattgcagaaatagcccctgctgccataatggtgggcggcaagctgacgtggcagacggtgggtcgaccgcgccgtctgccgccgtcggccaaaattgcgattaggcccttgccgcccatacaggggctaattgcaattttggccgcccataaagagcttgcggccgtactttggggcggcaagggacccagatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcatagaaacattatatggcacttaaacaaggcacaattatgtaacatgcaagaaatagtagtacaatttgcaacatgatacgcactatcttgcattgccggttacatagcatgcatattagcattcgcaactaggcagggcaggtagtggcaatagcttgcaacaccaacgacgatgtagtaatgggcacaaggcaagtcatgcacagtagcaaattttcaatatgtccaagcttgctccgcataataccctaatccctctacgctgaggcatctcctctcccttctctcaataccgcgcctttagctaa

SEQ ID NO: 62972 - DNA, 2329 bp, Oryza sativa
agttcacgctaaaattaaaagtttgattgaaattggaatgatgtgaccgaaaaattggaagtctgtgtgtggaaaagtttgatgaaaaagttaaaaatttaaagaaaaagttgaaaactaaaccaggccgtagtactacatgtataattttaggacgggatggagtgctgcaagtctctctctagatctgaatctccgacaacggttagaagttgtgttcttctgtgaacatcacgtcacatgtactctccgtgacattgtttcaatcaagattagttcaagctagagttcaagtatagcatatccattatatattaatactgagatttactctgtactagtatatctaaacaatcaagattcaagagctagtactgtagtagtaggtgttgtttacggaagactggcattgcatgcggttgtacgtgatgcacagacatttaatgcgcccgatgcggttgtacgttttggagttcggtgtactgtttaagcggcggccgatgggcctgaactctatgtgggccaaacgtgaggcttggctgggttgtgtcaccgggccgagtatactaattgggccggcctaaatgcctaattatcaaaggaataagttcatccgaggtcccttaacttgtcaacgaatccgattttcgtccttgaaccccaaaaccagatacaacggatccctcaactatcaaaaccggtgcagataagttcctctggcggtttagagggcggttttggctggcgtggcgcttcatggcaattcgatccagaaaaataataaaattagtggggcctacatgtcagtttcacaaaaaaaaaaatggtgggacccacgtgggccccacgtgtcatcctcactgctccgttcttcggggaatcctctctctctctcttctttcctatgatgtggactagggcggcgggcgaagtggggcgacggtggccggagcgcgggcgcacgaagccagcgggacaaccgctcaccggtggccacttcgatgatctccagcccctgtacctgcttcggcggctgacctcgtcgagtgcttgccgggcctgggcgtcgccgatatccggtcggacgacaggcgcgtcacgaaccttcaatggtgtcgtgtgccgggctgcggctgcgactgcgtgggcctcgcccgcgactggagcaccagagccccatcagcatggaaaacgaggcgcgtggggtgacttcatcgactgcttcgggctgaggccacccagctggacctaccacaccgtcgagggaggctttcgacccactggctgggaatggacggccacctcatcaggtacggcgaggacggtagcagcctcgtcagggtgatgaatctgcactacgacgccgcagtagccgccgccgaaatccggtggttcgtaagtgtgtagatcgaacatttgtttgtcatgctgcaacagtgtgatgtgagtaaacattttggcactgaattttgttcaaatttcaacgggatttactgagggaaataatggattgtatcgtgagtagaattgtagaaatagaatcgaacagcaactgcagcaagcagtttccaatccctgtgaaatcgtggagaggggagaaggagaaaatggcgacgtgctcaccattcgcttccggaagctggtggccgaccagataaatggcgcccgacgccgatgatgccctcctccatggcgccgcttgcgtcccgacgccctgctcctgcgccactaccgccagtcactgtcactaccgcttgcgccctggccctccttgacgccgccgccgcttgcaccctgtggccccgcgcgccgccactgcactgctcccgcgccgccgacgcccaatcgccgcatcggtggcccggtgccctcctcaaacccgtcgccatcagtgtcgtcgtcttcgatagcggcggcggggaagtaggtggagagaagcgggagctcgcccgccaccgcccatagcgaggacgccgtcgaggtcggtgagcggcgcggaggacggtggaaacggtggcgggggccgcgatggtgaggtgtgcgtccttctcctagcggaggacgccgctcctttctcaccggtcgccggccgcctcctgcgcatgcgcgcgctcctttcctccctccggccggcgcccgtgcgccgcttcttatctgtgccagcgagaggagggaggagaggggagagagatgaagacgacgagagatggggagagatcaggagaaagaagatgaggggtgagaatgactcgtggggcccacgtgggtcccaccatttttattaatttgtatatgaaactgatatgtgggtctcaagggtttttttttt

SEQ ID NO: 62973 - DNA, 5408 bp, Oryza sativa
tttgaaatatttaaagctcactagaacgcagtctatgaattccatatgttaaagaatccaggatgttatccactaagacataaaagaacaaaaaaggacaactattagttccacagaattacgtaaatgcatgaatatgaaaaggttgcttacccccagctttaacaatatcaacaagatcatccatcaaaattataggcatcgaacggggtatagacccaacacctagaagctgtatattttcttggatttttatttcttggtaatcatggcaggttatgctatcttctatcaattggaaattggcacctccacaaccttttgcactctggatcaatagcaaaattagcaagagcaacttcatagtagtagcagaagttcaagcaattacaaatatagaaataacaatatataaaatgtgataaccagatgtgttaaccacaggtgaaccgttataggtagaacgagaaaaataatgccaaggacatgaaataccttggatttgcaagatgcaggaagagttatacgattcccagcctcaagctcaggatgaaccgtaaacctgttcaagataccaaagaagtcaaaggttcagtatggctagagtctagcacgaacatatatgagcatgctaatcaacacaaaccttgtaaaaagtattgaggtcatcatgtcttaaggtagcacaaaatgcaatattatgttcatattaaggcaatcacgaaattgctctgatctttgaatcccctcccgattcttcaaaatctactgctttcaagaagttaaatcctcatgcattttttttcaagtcgttatctagaaaaatgtttttccaagtaatttcaagagaatcttaaccccacttgcgtagatacttaattttacttcccagcttttggcttacaagcttaggaacccaaagaggccagtgttacaagtaatgtataacacaaatacacaatgacaatcctgccactttgcgagcacgagtggaactgtggaagtactaaaaacaatctgttaacttttgctttagaaaagctttctatggttctgccaaaccagctctgtcagtagaccactgagcggtgagcaccatctaaaccgcagaattaatatgcaagccagagccagggatatatacatcacaacttcacaagcccactggttctaatagaagaagcaaaagcttcagtcttcaactaatactggtataaagccctgagacatgcataacaaacctgcacttgcatttcctgcactgatacttcctctcgccttcgatcatcttcacgccaccggacctgatcacggtccccttcaaagtgagcagagttcccctgtgcttcaccctcaccttcccaatgctcggggacgcttctgccgaacaccaccattaccaccaaatcacgatagcccgtaagcaactgcccaaaaacaccaaaaaaaactacacgggcattacgccgaacacaggtgtcgcatgcgtgcgctcaccagggcattcgagtgccgaccccgaggtgttgacgcgcacgtgcacgaacttcttctccattgtctcgtcgcccgccttcctctgagaatcaagagtctctgagaaaaaaaaaatggggggaacaagcaggtgcaggtcgtacggccgcctggactactaaccttgtcagctcgtcgagcggcggcatcgaatttgtcgagggcgcgttgcgcggcggcgtcgaacagctcgagcacgtccttggggtagtcgtagagttggtgggcgacctcggggtcgaactccaggagctccgcgaagctgcgagagggaggggagacggggttagggtttggaggggggagagaacggcggcagctggggaggaggacgaggactcactcgatgacgagggggaaatggagcttgccgtccgggaaggggaggaggatgcggcggaggtcgtcggcgtggaagcggttgaggaaactgtctaggcgactctcgaactcgtcgaggtcgtcgacggcgaactcctccgccggcggcggcatttgggcggcggtttgggccgcgtatggtggccgtacgggcaggaaagggcggagaaaagctggccgcggagaggacacaaggcggtgacgacggctgacgggactgactgacgcgaggtcacggtggtggtggtggcctcgatttgggggaatttgggtggagattaaattgggccggttcttggtctagaaagctaaagcccactatattgagcccgttaggcctctcgaaaaatgtggcccatataaaagttgcccccgttctttttcttctgaaaactcagaagaaatgtgcctgtctgttgttggtagcagactaacagtaacattttgctttattttcaccgggtaaaccagtgtttgttatttctcagccactttaaaaacgaagttgtctgttttcatagtagagcaggataatagtataactcacttcctacaattagcccattttaaagccaacatatataataaattagctataagattggctcttctcatctctctatctctcttagagcaagtatgataaagggttgtaagaggctgaatgcttaagtggatgagagaggagatgagagagatgggaaatgggttgtaagctcatagccgacttaagcacaggaaccaagaaaatatgtaagatagacatgtggactatatatttatagtgaagagctaaccaatatgagtgagctaaggctataaagatttatactattagcagctggctgtattattagccttgctcttatacatctaatatatttatcttgaagtttgtgttaagttggctcttacgtaaaagataacacctttaatttttattttattatagctcactattatctttgctcttgtgcctccatctccatcgtggaggtcgtgtgctttctcatgtgacaaccagtccacctccatcacaagatccactgctttattatcgaacggtcactgctttatccactgcttcattatcaatctaccgacacacagtcaatccctaattataggtttagctcgtgctttcggggttttatcctcaatccagccatctaatcaatccctacatgggctggtccgttgcaaagtaacattattagtggataatagcaagctggtctttgtagcacttccagctacaatagagattactacctggaagctcctcgttggtaaaaccacaagtccacaagatgtgccactggttttgccggttggcggccatttgacctgagccagcatgaagcatgctcgagctcgacgaggcgcctaccgcgcatactacgtgctatcaaacccaaaccagtaagattcttgagacaaaaacgcgcggacaatctaacaaccatcactttgctaatcacctttgtcacatgtgaagtgcgaacgtgctcgctcgcgcgctccagcgaatacgaatacacgcgcgcccttgcaaagcaccccactttccgcacaatcagttgagaacttgagatgtgccctgtggatcagtgatgtgtcatgtggaggcctcgtcatttcccctcccctgctggctgctgcagactccaggccgcagcgccactgcgccagcgggacgcgcgaccagcggcgggcgaccgagccctgcatatgcacaccggacagggagacacaaaagcgatgggaaagcgcccgtggcagcgaggattgccggctcctgtcctgccacggcgcgagcagcggcgcagcgcatgcaggtgccccaccacagtgttgccgccgcgcgcgcggtcgtcaacgaccgagaagttgaacaaaaggtacgactagtacagtaggtactcgggtcgggcgtgcgcgcgaactgcggcagccgatggaccagcggacgcgagacggagcgcgcgcgtgtggcaaactaccgcgcgtgggagcgcacgccggcgcgggcggaggcggtctcggcgcaaggggacaccgtacgcgagggggcgcggcgtcgcctggtctcccgaggtcgcacgcacgcacgcacgctgcggcgtggcgtgcacggaggtgggtgcggaggcctgtgcgtgggagtagtttgtgcacggcacgcacacgttcatcggacttgacaatgatccgccggctgaactcatttttctaaccggctttcagctctaactctactagtaggtcctcgacctcagcatatcagatcgtgagcttcgtcttgaatacagcgcaaggttcgtgtacgggaccatcttttttcttctgttgatctgttcatggcctgtttagttcagaaccaaaaatttttacttatcatatcgaatatacagacgcatatttgatatattaaatatagactaataacaaaacaaattacatattccgcctgaaaactgcgagacaaaattattaagtctaagtaattcgtcattaacaaatatttactgtagcaccacattgtcaaatcatggcgcaattagacttaaaagattcgtctcataatttacacgtaatctgtgtaattagtttttttttatatttagaactctatgcatgtgtctaaatatttaatgtgatagagtaaaaagtttttgcataagaaggcctcagctcatttcctcctcgctcgacatccatgggtttagagcaggtacaatagcaggctataagccagctgcaaacatattttaagaagataaatgaggagagagaagagcagcgggctacagatttgtagccagctgtaacacggactttaagatacagtgtgtgcatgacaagtgggaccagatattaatagtgtagtatgtaactattgtatgaataagctattagattggctatagatgaattggagctaataattggctatactactgaacttgctcttaggtggcgagcaatattgttagcacgccggcactgacggatgaccgtgagctagcgatcgaggtgtggcgtgagcgtgacacggtgtcaactgtcaagtgtgccgtctcccgtctagtatgttcaaacattattccgcatgtgtagccagttgcacgtagaggacatatttgtattgtaaacaagagagtaaacacgtactactacttaaaaaagaacgcacggtattcgtttctgtaatataaaatgctccattatttggaattggtgcatacatgaacacaacaaaaacagctcaaacagaagataaacttatgtcctacattgcaaatggcgataaatgtatagcgcaaaatacctactaaccacgtacggagtatgcccaaatcaatcagccacctccagtgcgtcgttctctcgaccggttaaatcatgcaaccactcgcacaccacaacacacacctgccggccccatcaccccgaaatgatccaaccgaaccaacaacaaccacaccggt

SEQ ID NO: 62974 - DNA, 4314 bp, Oryza sativa
cttgttaatattgttataaaaatgtattgaagttggttgttgcgcaatttcatatgttaagtgaggtattattttgtaccttattcgacgtattagtactcggataatttatataggcctatcgcagtctgggtcatagaaacattatatggacttaaacaaggagaattatgtaacatgaagaaatagtagtacaatttgaacatgatacgactatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggattcatgtaattaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacaacattgtcgttcataagccgcttttctctataagtatttctcattactttccgatgcgaaataccagcgaccttcttgtaaacaagtggttaggtcaagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcatacagtactggaaagtgaagcaagtaaacaaagagaagactactctactggccctgccccgcgccgcgaccacgcttggtcctccgggcctgtgctcgcacgtggtcctgggagtaggtgaaacgatccggtggcacagcacgggtagcacgagtgtcccgcggaggagtggcctgtgcctggtcctgcgtctgcacctgcggtgcgcctcccagctgtgaggggccaatgacgtcctctgtcgagccctgaagcgaagtcgaagtcagtgatgtcgaagagcacggtggaaggcagcaagcggtccgacgaggtccaagcatggtccagtggtggaccctgactcgacgtgccggctgcctgtgacgctcaccctgcagcctgggagaagtgggcggcctgcgtcatagcgaactgggtgaaacctacacatcgacaacgggacccttgtaagctaagacataaaatgtatgtaaattgattgtggaagtaatgttgtttttttaagtacctgtggggggcacaacagaagacctagccgaggaaggcggggtgctgaacggtgcacgaaaccctgaagcaatcggcaagtgaaacggctcacttatatgtgcgaggcatgtacagaaatagtaataaaaatacttacctccgtgcggagggggagtcggcctaggaacgtgcgcagctggacggggaccagtcggtacgggtggccgctgtacagctgcgtctgcccgagcaacgtcgtctgcacgacaggtgagcactcggagaatcgagcgcatcgactccaccatccgcgtgtacgtcgtcaggtgctcctctacgggtactggaatccccgcgctaaacgttggatcgtcgttgaaccgtcagcgacgacccggttgatgtcgtcaacctgcatggttaatttgttcgtaaatattcgtaaaatttgacgaagagaaagacatgaaaacataaaggaatggtgcgatgcagggtactcacagcacgagcgaagtcctggtcgcggtgcctggcatagaggtctctagtgctcgcaacgtggggctgctgctccaagggagcgaaggtgaccctagtacgggtgtgtggctggtaccagcgtaggtaggcctggtacgactcctcagtgtgtggctctccctcgtggtccacgacctcctcggttgcgagtaactagtcctcaacaaaagtcgccaacttggcgggccagtcgccagctgactgctgacccttgcgcgagtacctacgaattaatgtgtaatattagtgtgaaacgacagatgttacaaattattgcaacaatggaaagcgtagtgcaagatcttaccggtgaacagcagctgggacggtggtcggaaacggtactggaaagggctgacggaagccgaactgccgcatcacgcggaaaggggcgtgaggctcaacgcagatgtcgaagaccatcggaaccgtagtcatccagtacgcctggtccctggtgcagagtgtggacagacccaatggcgcacgagcctgggtagccgcggcactgtagggctcccacacgacgtcagtcggcagaaggcggtcgaactccataacaaactcaggatacgaccgcctaatctggacgtgagcccatcggcgctgcaatacgagatgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcctagatagaaagaaagagagggcacccaccaaaggtcgcgctgggatccgtcttcgtgcaagactcacaaagtgcatggtacagagccgccaacaacgcggaaccccagctccactgaggcacctcgcctaccgcggcgtcggcgatgctcctggcgtagtgcacgagtcccttgtcgaccgcgtgcccgtgacggccacagaacatcacccagccaaaaagccagagcaagtacgcctccaaacatcggctgtaggagtactcgtcggcctccgcctgtagctgctcaacctgcaagcagtcgataaaatgttaggcaccttaactgcggactaaagatgtaatacgattgtcatttcggtacaaaaacactcacggtgaactgaagcaaccacctcttcgtaggtccagtgttgcggtggtgtgccaacagcttgagcgggaagtgcggtgcgcgttgtactagtgcgaaacgtgccgtcagatcatcctgccagtccacagccgtggtcactggcccaacagcgtctcccgcgagcggtagccccaacaagtacgatacgtcctgtagggtaggggctacctcactgcacggcaagtgaaaagtgtgcgtctttggcctccatcgatcgaccaaagctgctaggagggacctgtccacagtccatcgtctagccgggttcgcgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccagaacgtcccaagctgagccccctgcaccgcagtaaggtgagaccggtgtcggtgatctatcgccgggtccaacaactgaggtgtatcctgacgtgccatctctgaaaaatatagtgttttgtaacaccctaaaaaaaaaattcgaccgacaaaatcaaaactctaaaaatacggattttcaaaaacttttcaaactaattgcatcatgccgatcttattcgcctattttacctggatttgatctcgaagattattaatcgtgagtaaagaacagttaatcaggaataaaccttaaaaacaaattggtaaaataaatataaattaaaaataaagattaggtgtggatagtattaaataaaatattatcgcgaccatatttgaatcaattaaatttaatcgcgatggaataagaattaaccctaattaaaactcaaataaattatataaaaataaaatgtgagtaatattaatctagggtgaattcattagttaagataacacgaatattgagtaaaatgcatatatgtaaaattaggaattgtggaatcaaatttatatggaaattacactaa

SEQ ID NO: 62975 - DNA, 15767 bp, Oryza sativa
ttgaatataaaatcggccacgagagggccgagtttatttctcataaaattttcacaattgttttcaaaagatgcttctaacttattctttaaaacaatcatagattcatctattgtatgagcaacttgttgttgaatagattgcgataaatcctcaaaagttaccttatcaatagtagatgaagacaccaaatctggcttgaagatcgtgccttgacgagtctttgtacatgtcttcaaaagctcgtcggcgtacttcttcatgtgttcatcgaaggccttgcgtgcttcctcatcaagactctccctcgtaaccggcatcacgttggatggatccacctccgacttggatggcggcgacttcgtcatggcaaagttgaagttgagttgacgttgaatagatttccccagcggagtcgccaaaaatcatgttggcaactttttataacaagttgacaagcacgatcgcagcaccttacgccttgcggtgatcttagagtcgccaaccacctcgatctagcaaaaactagaccaacatgggttttgataactaaacgggctagcggagccgatttctagataactacccgtctcgtgggaaaacggaaggttttcatgacaaacctacaaagagatgttgcactctcgcagcggcggtggacgatttacagcgcaaatcgacaaagatggacaaactaagagaaaactaaaagcaatatgaaaaacgattcgattggttgattgtagattgattagttacaattgaaccggccatgtcccttatataggggttggtcttgccctctacaggccctcctccacgtctaactcggggtagaaaccaaaggaaacccgaaacgtgccttcccgagcaaggaaaccttgagacccgacgaaacacattcggactcggacctgctggtcagaccggccacatgccgccggtctgaccggccctcaaccggcggtatgaccgctcaacacacagtggtcagaccggcccactcggagaaaaccggcagacttccaaactttggcaatttttcctattttatctctaggtgccaaatttgggtgtaaacacccttctctctcgcgctccgctattctcgtccgttcccctcacccatcactgccgcgattcttgcccctgcccctcgccaaccgtcgccgcacccaatccccaaaccctaccccgccgccggcacgcccctgcccctcgcctatcaccgccgcaccactccccaaaccctaccccgctccggcactgcgggttacggatgccattgcacctcctccattgagacgagccaccatggaggccgccatctttgctccccaccaggtcgccatcctagaactgctagcagtggaggcggaggcgaccgccgccactgcaccggggaggatggccgcgaacggcatgagctcgatatccaagggcggggctgtaatgaggaggtacacccatggaccatgacggaccggtgtgtggagcggatacgggcaaggagggaatcgtgcagctggtcagggcaagatcctatctctctctgttaatctcgatctcctcatgagattgctactaatttaatggtgatattttttctaaattttgtgccaattccaggagaactcggaacctatggagctccttgaggagagggagtacgtccctgtacttgattccctgcatcagttcatcccttctgttgaggctttgagtggcaggggcttttgatgctatgtgctcttggtttgattatatttttgctttgttttggtgcatgcagcaagatcatagagttgagcgggaatgggccagaagttgtggctcgctaactggcagattgcacaggcaaattcccatatgttggcagtaagttttcccctaaattttatcctagaaacttcaacgtttagttgccaattgaaatctgtgcaatgagttattattcgtttctcgcattttgctggtgaaacttgcttattgtctcttttttgttctgcaggagcgcaaccttgggagggatagagtcagatcatggctctctgatcattttgtaaatcttatggcatctttagcatgcagctgatttgtccccaattttttttccttgaagctaaaatcattgcaacatcagtttgcttgctcgagacctataataatagccaaaatatcataattggaggtttggagatgctcctatactggctggaaattcagctggtcacggctagtaagtttaattattttctattgtaatttgccatctccagattaccctgctccttgcaataaatcaatctccctatggtattagatttttttttctactcttccgtcaataaaaacgatggcacatgattggtggagctgtataggtgaacgacggcacacatgtgttcatacttcataccggcataggggcacattgcagaaaaaaaaaagagaagtagatctcaggttcaatcgccgctgcacccagggtctcacgcatcgatctgcatgcttatttgtagtcaaactaatgcagctccatggttctgatttgatttcatttgatttgctagtgtggagattatgggtaccccatacccacacggcatggttatccgactagttataggggataacttatatctatgtaatatgtaacagatcatgacttgggtgttacgtttccttgtatattacggaacggcctaaagtcctgatttaggaaaccgataccgtcttggttaaggtttctatcttgtaatcctgccccccatcctatataaggtgggcaggaggccctctagggggcatagatgacacaacctgatcgtcagatcaatacacacccggcggattcaaatccccaaacaggagtagggtattacctctcattgagagggcctgaacctgtctaaatcctttgtctctgcatccatccacttttaggtctcgtgcgctacccctttttattattgccgaaatcatgtttcgacagttggcgcgccaggtaggggctgcgttgagcttcctatcaacgagcgcgatggaatcaatttcatgagtcgccgacttcgtttttgctttgggagttttcacttcctttccgtcgaccacttcttcaagctcctcttctctgacttgatccaaatcagtcagggggcaaactcaatctgatttttatcattatttatcatattgatttttaatctcagattaatctcttgctattttttgttgttgttcgcatataattacgcggcactattgaggcgattgatgctggtcatggactcgaggcgtctcaactttccggtcgatcggccgcgagtccactctgccggcttgtcttcgccaccgccattgctgataacaacaacgacttcaccgccggcctgcctccgtcaccgccgagtggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgactggtgcctccgcctacacggctggcctattatgccgccgctgttgggcgtctacgacttcaccgccggcctgcctccgtcgccgccgactggtgcctccgcctacacggctggcctattatgccgccgctgttgggcgtctacgacttcaccgccggcctgcctccgtcgccgccaattggtgcctccgcctacacggctagcctattatgccgccgatgttgggcgtctacgacttcaccgccggcctgcctccgtcgccgccgactggtgtcctcgcctatacggttggttggtcacaccaccgttcatgggtgtccacgtcttcgccgaccggctggccttcgccctgccgactggtgtttttgcctatacgattggcggacttcgccgctgttaatgggcttcatcatctacaccattggcttggttccactggcgccgactggtgtttttgtcaccattgatggactgcttcgttcccacatcggctacttttgctgtcaccgagggaatattacaaagctaagtcatcatttattttattctttatatgatattttgtcttttccttcgcctcactacatcaactggttcgccgttgactagtgagtcgggggctatagatgttatattgtattttttaaacaattttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattactcggaagaaatcaaaagcatagagataatataatttattttctgctcttaataattgcaaaagtacctgagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccatatccagatatgcataaaagggattcatggctttaagcttatctcttacgctccaggaatggattagtcagaacaccaccaccggctcgcctcgaccgccgctgactggtgtttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgcctactggtgtttccgcctgcacggctggcctttatgccgccgttgttgggcatctacgtcttcaccgaccggccgcctcgtccgccgccgactggtgcttccgcctgcacggctgacttattatgccgccgttgttgggcgtctacatcttcaccgaccggccgcctcgtccgccgccgactggtgcttccgcctgcacggctgacttattatgccgccgttgttgggcgtctacatcttcaccgaccggccgcctcgaccgccgccgactggtgtttccgcctgcacggctggcctattatgctgccgttgttgggcgtctacgtcttcaccgaccggccgccgcatccgccgctaactggtgtcaccgcctgcacggctggcttgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgcctttcgtctcgtctgctgctgactagtgccctcgcctctacatttggtttatacagctaccactactgatggacatcatcgtcttccgccgccgactcgtgttatgccgccgccgactagtgcttttatcttcacaactgcgcgtcttcactaccggtttgcttctgttgccgacgactcgtgttcacttcatcacggcaatgcaactttgtcatcatggtagagcgacttcatctttattatcttcggtaccagcaaactctattgctgctacttcacaagttttgctacatcaccaaccatgatgttgttgtgatctcgacatctcggcatgcgatgccgtgttattttactacaacaagtggctctccaacattcatgatttctacttggacatcttcaacacatatcttcaatcaagcaataactattcgacgacaagaggctacagttctcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttagacgagttgggcaacaacatcaactctcctccaagtgaagcatctacaacagttataacattaatttgatggattattgtcactgacatcatcaccagcacctctgcttcatcgaccctgacatctctgctgttgctaatggatgattatgttttcgccgacttattatttcaccttcacggttgacctactatgcaaatgctgatgagcgtctttgtcattatcattggttgctacactgctattggctggatcaccgacatcgtcatcttcatcatgtcggttgcgtttgtcgtcgtcaactacacaactttatcgctgagcgccttcatattcattgctggctgacctgactgccgccgactggtttcttcgcctccatggctatgcgacttcagtacttttgattggtatcactatcttcactaccaccaatatttttgccacctctggtgggcaatattctctctatattggttatcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttatatactcaaagactggactatttattattccccgtaagggttatcaactgaatacttgcgccagtcgggattcgattgttacatctattttggagtatcccataagggataatcactaagatcagaagctattcatatgagctacgcttggtctatattacccggaagatttattactcgggagcatgttacatgcgtcatcctttaaagggtgtcgaaggcatattttttggcctaggcctaatatgtctgcaacccatattttcaggtgtggcatgtcacgttctttttgggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttatttactcggattttacaccacatatgccatatatttccaggtgtggtgaaaccatgtgtcttttagggactaaagcacgtctgttaaagcagtgtgcgcatggcgtatgcccaatactttggaaatttatttattcacaacatacaagcttctttatagctgttttgctatgtgaattttcaataatgtagccaactttaggttacattcatcatattttacaaaacagtcggtatatcacttggatcatattattcagggattcacgccgcatatgctacatattaatattaagtcgcttggttgactataattatcaaaaccactcggttggttggattatttattccttgactatatgtttggtttgttcgattaaccacatagtcgggggttacacctattaggtgcatctagtcgatgcacctgactatatttttcagccctccacagtcttcagatttggtaaaagtactcgggagaccatggcgaagatgattgaagcactcggctttggagtaatctagttcgagagaaggttatctttccgactgtgaaggtctcaggggctactgtggagattatgggtaccccatacccacacggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcatagatgacacaacctgatcgtcagatcaatacatacccggcggattcaaatccccaaacaggagtagggtattacctctcattgagagggcctgaacctgtctaaatcctttgtctctgcatccatccacttttaggtctcgtgcgctacccctttttattattgccgaaatcatgtttcgacagctagattttagaaatagcttaacaaattgttctattcaggtgtctcagcttctgcctttgtttcaaatgtgtttagctgttaaagaaaataggttaggcttcacttccgagattatgcacttgtttagaaaatttttacgatctgatagtcccagtttttctgcctttgttacaaattggcaccatagataaatttgcttgtgttaaaatgtattgccatcatagcgttgtaacttataccttgccttcatggaaaatagtagtttattttaaatggaagagagtaatgtgctttgtacaaattgatcttccagatgcataggtttataaaatgctatgatctagatgaataggtttcctgtctattgttgttcatttaaaatagaaccaaatatgctgaaactattcaacaaaaaaagtcaaacagaagaattctactgtcacactgcactttcaaaagttttggttgatactggattttattatatatcagaattaaatagtttacaagaatatgagtgagaattatattattattgatccgtttctgctgtttgccactgtaccacctatgcatgcttgcctattctcttaatgtacagtcaaagttatatgtagaggcaatgggctcgattgccattcatccaaattagaaattaaatggtgcatgctttctttggggtttgatcatatatttctgtattaagagatgctgctggctctatttggcctttgatctctcggtttgtttaacattgcagtatttatttttttctttccttgcatctgaacaaagatgactccgagctaatctctcagtttgtttaaaatggtatgaaatggtaaatggacccggttagctttgtcgaatcagtttattataaaaactgatataaaaattagtgtcttctacatcttaatgtgttatatatataacggttgtactcaaattcagggttttctaatatgggtcaatagggattgaggttctgtgagatggacctaactcatttacataaacaaaattgcagccatgtaaaagcctagcgctttcagttcaaataaataatttattatcatttgctattaaatgcttaatgcctatatatttgctttgctacatatttttgcctcagtagaaaccaggatattttaccaaatatgttgagagttaaattactaatactaagtgatgaatatgtctttataagcgtgtacctcgtggtagacgaacgcactgtcttcaatatggtgcttctcctgatatgtgttcgatatagacgttcatgtggcttcttgaggtgctctataaggaggaaggtgaccagtgaggagcagaagttgctgaatatttccaggcgatgcatgtattgcaaaaaatagcacatgtaaaactttcaggtgatatttgtatctgtatgtggtataaaaagttagatactatgagctattgtttgggtttggaaatgtttcactcagagtgatgaaaatattgcagaactccattcatggccaactttggaaagttattgacagtataataacattcatgagaacaatacaaatctctctatcgttattttattcgtgatcttaaatattaccttttggtttttgcattatcaattatcaccattgcgttagcacgggtatattacatgtataaaaaggagttcaccctctagcaatcttacatgtcaaatctatatactaatataaaaaggagaagttcacctctagtaatcctacatgccaaatcatcaggttaaatccctaccgtccattcgcacctcaggtgtagtccgtaccatccaccctctccgacgacgatttcaccctctccacgcacggtctctgcgcaaagaatacgcctcgtcaccctcttaacacgcgactcgctcctcctcctcactcctcctcgcgtcgtcgtcccattccgtcgccgccgccgccgccgccgccgtgcactccaccgcctccgccgcgcactgaaccgaggcgaggtcttccccaaccaccgccggagccgtggtcttccccatctgccgcgactggccgcagcaggagccgacgtcgtccccatccgccgccgccgccgccgcaatccaccgctaccctcgaggtcgtcgctttctttcaccgccacgcactgaaccggaggcgaggtcttccccagacccccacggagccgaggtattccccatctgccgccgccgccgtgcactccaccgcgatttctccgcccatccgctgctccatcgcgatttctccgccgctgcaacctctgccccgccgatcgcaccccatcgcgtcgccggtttctcacgcctgttgccgagtccaagttgatccgattggttcctccgtcgaggtcgcccctgccagagaggccaagccgatccagcatctgctccacctactggcccctccccgttctctgctcctgacaccgtcggaaatcaaccacaggccaccagcaactgcacctgcaccctgttgctcgcatgattgtgatgacacataatctcgatctgcaactcactgtctccattttctcaagccggaacattggggatattatggcaggagcagcgtggagtcaaagccctactccgtagagggctcgaggctgcgcggatcgcttcctctctttgaacacagctggggtgtgcgacatggctgtggtggaggatctgcccccacccaggtgaaccctcactttagactgtagattgcaacagctatatgtaaattacaataacgatttctctattaatgaacctgcagtttaatctgaaaatttaggcaaaatgtaaccgttgcagtcctttgttttctttctcaaacacaccattccagtcttttggaatgacccttagggcctgtttggcacagctacagctccagagctcagccaaacagtttcagctccaccaaaactgggagtggagatgggtggagctctctcacaaaagaactagagttgtggagcgttgtttaggaagctccacaactccacgccagacccaactcttgaagctaaatttaggagttggagctgtacgaaacaggccctaaagctgaccaatcacttgtgaaggaatcctctactttgcagaagcagaagcgttacttggcatatatactttgcagaagcagaaacacaacttggcggtggctggtttatttagcaatctctacttggctttgatggccagtgtggtaattaatttcagaaatctccgattcttgttgacaaaatttcttttgcaggttgaacatggtgatttcagacatttatcaatgatggattatctgcttgcctattctttctgttacatcagttgtgggatgtttttctgttaaattaatctaggttgctctcttgatctggtctagacagatcctaagcaaaggttgcaataaggaaaacaaaaggaaaaggtgagagaggggcttagtatacctgttgactgtagctgtgtcaattttagttcaaatgtttattggttttgtcatgtatactgcactgtggttcatgaagaacacgaagaatttgtatttggtctacttaattgatctaaattatgtagaacttcatgatttccttcagtgcaaaatatttattaaaaactgccaaatgtagttttttttcttttttttttatccctataaagaactgctagaaccttttttaccacgtgcaaaataacatttgcaatttttttaacaaagaagcagtcttacatcatgtgtgaggccaggtatcaacattttcttcagtgcaacagtcttttctattctaatctgctactagaagatcatgtgcctcacattttacaggatcattgatgatatgaatgcttaaggatgctattttgaattgttggttttctcagcaaacaaaagtttccatggttttatctgatttatttttattacctcacacttaggatatatagcacattgcattatgttatctgatttggacattcttgaactgtagccctttaaaattaacacttatattttagttaaagaatcaagttttatgacttggtttaagttatacatatctttcttcaaagtttaaaaataaaaattgtaaaatcgtatatgcctgccaccttatcttgcataagttgaggctgtttaccgtccttaggaaaaaattgtccttcaggtattggaagtataacatttgtatttgattttacaatgagggcatgaaactcgctttctgctggactcaaactgaaccattttggttgataccctaacattttgctctaccatataacttatttcactattacaactttatttagactgaaaaaaatttctggagtttggtgcatagctgcctgaagcctgaaggcttacaatttgtttagttgtgcttactatttgaatttattatgttcaaagtagtttcaaaatactaatgattcttagttattttttgggaaaaatcggttatgctcattcaagaatgtatgtctaacaacacatgtgatactcttttccaaaaattatacaaatacttattcagtttgagagtatttcaatgttcctggtttagttttcagttttttctccaagtagtgatattctttggttaattttgttttttttaatgcagctcaaaatatccatgtcaacttgaagatattgtggattgcagattgtgagggttacatttgaagttattgtggatgacacgaatcaattgtgtagatacttgtgttattttctcttacttagtggagttctcttgaatgcatctgaagacaactcttttgctttgagcctttcaagtgtttgttaagttgtggaaaattgtatccattttgtaatgttggctactttgcacctccacaacaagtgtccaagagggggtaaccaaaataggctagatcatgttagaacatattgttcttaaacttgtgtatttgtatgtttcatgcgacatttattggggaaaacacaataaactatcagggtattcacatgtttcttgctatttaccatatatggaaaacgtgcaaagtgcacgattactagttttggaaagtgtaagactgcagcagaatgtgatgtaagaagactttggtagtgcatcaccaaaaaacaacagctactgcaactaaccctttcgttttggctaccctggaagtaaacaggcataggtttcaccagagtaatccgggtatcaggcgcaaggcaggacaccaaactgctaatcttccatgaatgctatgcattccaactaaaacacacgtctgatgcacgactgcatgcaggactgcaactcaaacaaagccacaacagcctgcaccctgctggcgaaaagcaagaccaaagatcgttccatcaaatgcagcataactgaataaacctttgctcccctcattctgacagtgaggtgagcactggcaactgaaaataaagcatctgagcagaccaaaacagatactaatgtactagtatacataacagtagtgatcaggcggcatatgtctgcacattccatgatctggtatactattaagcttggcagtgaatgcatatacatggcattttcacctccatattcacaaagatagtgactagtaggctgaaaaatggacactggctaattcacttaatcagttgctgtaacagatgcagcttatacttcacataatcatttcccaccatagtaaccacttatttaactgttactagaacaacgccactaatatgacaatacacaaggacaagacccttcttgtgtctgttgttttacagaaacaggaattcgttgacaaaattagaaataacaatgtttaagtagttcagttattagatacatgacaagttatcaacttccaatgatatgaaaggaggtgtgctgctagcatcaacaacgatcacttgggtatctttgtattaagacttaagagaaatagcggatgataaccatcacttgtcccaaccattttccagcatagtaactacagatttaactgttagtgaaatgatgcccactaatacgatactaatatacaaggacaagaagaccattctagtgtttgttatttgacagaatcagaaatgtgtagataaagtttgagtagttcagttgtcagatacaagaaaagttatcaacttcaaatgatatgaagggggtgtactacctgcttgcatcaactactattgcattctgcagtgagacctaccaaacctatgtaaaccaaccaccaatcaggaaccaggaacatcagattaaataaagactttatggtcgaaaagaagcaccgtgcaatgactagcaagatcaagacatcacactatcggaactttataaatgactatcggaactttttgtgctatgccttagatacaatagtttcagttacacaatgatgtctgtatcccagtctggcatcataaaaatccacttgtaaaagtacatatatgtagtcacaataccattgctgacacggatcagatgaaagatgaactgaggcgtcaaattaatatgcacaattattataaaagtgcagcattattcctgacaatgttgtgttacttgaaagccaacagactcaggcagaaggagaaggaatcattatagactcacaggaggctatatcaggcaatactgttcagaaacttggattgaacgttgatataactgggacagtatgcaggggcactgatcgaaggcatgtaatatactcaattactcattgaaaaatattaaagtaggatgaagtaggatgtgcagttaaacctgcaagttgcaatgaagctgaagaatccccaccttcaaagagtttgttatcaaaatccattgtgtttgccaaacttatctagtatgacctttcttgcagttaaaacacatggaccaaagaaaagataactggatcaaggatttgatccagagaaatttatagacattcttgaagttaatcgcatggaaaatggtgactaaatgtttttggactggtataatcaacagagagcacagaaggatttgttaagactatatattttcattttaattcactcttatattttgttaagagtatatgtttgttaacagttaaaaattgcatacttttacatgcagcaatatgggtttttcacaaaaattgcacatttacccaatgatgattgaagaaataagtttttcacattgcctgagatgatccaatgctatatgcgcttatgcagcatgataaaagaatcaaaatcatagagacactaaa

SEQ ID NO: 62976 - DNA, 1936 bp, Oryza sativa
tataattttgcgatcaaaaagccgctcaacaagctgctgaaagtcatgaaacttttaaagacatcagatttatgcttaaggagatatatccaagaaaacttgctatagctatcaatgaagctaaaataaaatttttttcctcgaaaagaggtggaggcggtcccccatacatctgaataaataagttctagggttttattggacacactcaaagaatgggaatacggtaattgattgctcttggccttttgacaagcatcacacactgactctttattagattctctaagacacggtaacttatttgaactaatgaccttcataacaatgggatatggaaggatgcccgaaccgactgtgccaccgctcaagcgatggagcaactgcaaaggcctgcttggtggatgatgtggacggaagcggatagagaccatggcggcgtggccccttaagaccgcgctccttgtggttcgatccttaataaaaaatacttagactgaatctccacaaaaacagagttatcagaggcaagtttagttgctgatataagatttttagcggcctgtggcacatgaagaacataattaagatgtaaaggacaagttggggtatgaactatagcatgaccaatgtgcttgattttcatacctgcaccgctagcggtgtgaatctgatcatgtcccttgtacacctcccgtatgttgagtttctccagttgactagtgatgtgatcggtagcacccgtatcaacataccagttcgagttagcgccatggctgtatgtagctgcggcgacgagtttgtcatctgggacgtagtcttcgtcaaagcgatgccagcaatctgcagcaacgtggccacgtttgtagcacacctggcataaggggcggccgtcgttgccgcgctgttgacttgagccacgcccacggccggagccgcggccgcggttgctgttggcgttccggcctcttcctgcgccaccacgtgaggagaagcccccacggtttctgctggctgcattcgcggagccttgcgtgacgaagcgccaatctgctctcgaagctcaggagctgcgagacagcctctgctactgtgaccgattcagttttggccaccagcgcagagacgactggatcaaagtcttcatccagtccattcaggatatatgcgatcagttcatcgctatccatggacttgcctgctgttgctatctcatctgcaaacgatttcattttaccaacataatcagaaactgaaagattacccttcttcatggtgatgagggccagccgcacgttcatggtttgagcatgcgtttttgctgtgaacatttgctggatcctctttccaggcttcgcccgtcgttgcggcagtaccaacttgccccagcgtttccttcgtcatggaggaaaacaggaacccgaggatctgctgatccgctgcaatccattcgtcatgccctggattggaaaattgaacctcttttctttccaccgtttggttgattgtgccggattgtcctgccgttcccccgtgatgggaccctccaagcctgcgccacgaatcactatgagaacctgtgctctccagagcgcatgattctgcttgctcaatttctcggagacttgaaccccgaacagcggattggaaactgcggtagaggaagagctggccatctagattgaattggttttctctcgctctgataccatgtaaaacagcgaaagtgagatgggttgaacgtcgccctttgtttcggtgcgacggctgcgtgttatattggcgcaccaatcggcgctgagattataggattatatagcctctaatctagccgagatttgatctaaaggatatacatcttatctaaactaacaatctaaatctcagctagatcagttaggcaagatatacattaatacatgcatgttgtttaaca

SEQ ID NO: 62977 - DNA, 6038 bp, Oryza sativa
tcaggttctcggacaggcggttggtgcagaaggacttcggcgcggcacgaccggtggaggggctcttccgatactgccaccgccactcggtctcggcggccggcggcgagaggcgggcgttccggctggtgcggttcgccggcgcggcgtcggaggagattcgccggggcgacgccacgttccagcagctgggcctccactgctggaccctgcacctcctcttcgggttcggcccacgggcccatggtgtcggacactgactgagcaactcccgagtccgaccgagacgacgatttcaccctattgtggattatcaagtagttgttaggagtagtattattattgtctttcgtccacggcgtttctgctgtattcgccaattctttggacatggttagatcgtgcgcgctagcggcatatcgctaaccaacgacgtccttctcttccaaaaaaacagttactagtacactcaacagtacacgcctttttttttcttcctagagagttttctcctaaattacttatccaatctataatccgattacaccattatgatcgttgcaattaaatctttacaacaagatcttatacgattatattctgataaaaaatatctatgttgtaaatacttttattatatatgtaagttacttttgttctatacataaattacttttagatttaagctttttaataacttatatcttttaaatcacgtattattttcatgatctatttacatcattgtactctacataaaatatgagacaaaacaagatccatgttaaatatattcaaatatttcattaatttaaaagtaatttatttaaattgtagtagtaacttagctatgcaatagatgtaacttagctatgcaatagaagtaagttagcacaaaataaaagtaagttgttacaacattagaagtaaattcgagagaaaaatattttgtatctaaaaattaaatttaaagtccataaattatacaattgactaaaaactataataaacataattgacttaaagcattatgaatatataaaaagtaatttagtcaaatctaaaagtaatttatatatatgataaaagtaacttaagtatataataaaagtaatttacaagtataaatattttttatcgtagtataatcatgtaagatctagttttgaagatttaattgtaacgaacacaatagtgtaatcggattatagatcggataagtaatttgagagaaaactttgtaagaaggggaaaaatacatgcatgtgtaatagaaaaaaaggcatgcatgtgcgctggcttctccacggcttttatggttggcgtcgcgcgataagacaatatcgagaggcctcgccgattagtttttgcgcaattcttttgtttctctctcgttgtgagagcaaatttcgaattcaatttgtgtcagattcttacttcgatttgaatttgtgttaaccgcttagaaggttcttaagagaacaaggcatcaagggaagccttgatgaacatgcaccaagtggacttgacaccatgtgccaaattgataggactaggggttatttatttggttgccacactttaccacaccacactttagtcatgccatagttttttaggcatctgtttggttcgctgtcgcaattgtgttatgccacactttcttaactttgggacccacatgtcatgctctcaaatttagagttaagcatgtcacacttgtggcaaactatttataagccacacttatgccaccatatcacaactaacctaaacttagttatggtaaggttaggcatcaatcaaacatcccctaatatttataattatttagcatatactttataagttcaattttgtttgaatctgttacatgttgcaatgcagccattggcctatatttgcataacatcaaatgcttagattcagatgtaatactaccaaacgaggacagcaattaatccaacaaaagttggattaaattttggatactcgtggcatgctttttaaactgctcaacggtgcgtttcgtgcgaaaactttctatataaaagttgttctaaaatatcatattaatatatttttcaagtttgtaataattaaaactcaattaatcacacgttattacaaccttattttacgtgaaacacttaatttttatcttcatctcatattcaggacattcaaacaccaccttagtttggtgcgagggggcaatgggcatggtctatgaggacaggcatcaatactatatactcctttcataaaaaaaactaaattctaaagatgaatctaaacacatatgtgtctaaatttattcttataataaatctttttaggacagagggaatagagatgtagattttcatatgcaggaggaggacggggcgggcattccggttggtgcagttcaccgccgcggcatcggaggagatttgccgaggggacgcgatgttcgaggagctggaccttgcatctcctctttgaactcggcccacgggccaacaatgttggacagtgaaatcatattttcttaaaataagttcatatgaggtccctgttcaacaaaaagtgattttcatcctacaaccgaaaaaccagatacaacggattccttaactgtcaaaactagtgcaaaataagaccaaaggcggtttggacggcggtttcagctaacgtgatgcctgcgtggctaatttggcttggtcttcatctgacgtgacattgacgtggcgcttacgtcgttgtttgatttgggaaataagaaaaaccgtagatctatgtgtcagttacgaaaaaataattaagaaatgatgggcatacgtggcccccaaatgtcattctcatcccatcctttcttcctcctctctccccatctcccttctcttcatctctcccctctctcttctcctttctccaggcgagccccgccggcggcaacgacccaacggtggcccaggacgtggtcaccctgcacgcactcgacaaacagttctacaagaacgtgctccacgccgagtgctgttcacgtcggacgccgcgctactgtcgttcttggcgacggcgaggctggtgcacgccaacgtgcggcacccggtgtcgtgggcaaagaagttcgcaaggacgatggtgaagaatggcgaggattgggctcatggccgcatatatcacaatgttactactccctccgtttcaggttataatacgttttgactttggttaaagttaaactactctaaatttgactaactttatagaaaacaatagtaatatttacaacaccggcatagtttcattaaatctataattgaataatttttcataatatattaatcttgggttaaaaatatttctaactttttctacaaaattagtcaaacttagagtagtttgactttaactaaagttaaaacgtcttataacctgaaacgaaggagtatatgtcaaactcttgtaacatttttgcgagtgaacaacaaatgaatagcaatacaaatctgatataaatcaattcatgcgctgatgtataaattcagttcataatcagttcatttttgcgtgcaccgccaccttcgtctccagcttagccacgtgggcagcgtgtctgctgaaaccgccgtctaaactgttttcagacttattttgtaccgattttaacagttgagggacccattattactggtttttgggttgaagaatgaaaatcggattcactaaccgttaagggacctcagatgaacttattcctattttcttcgataacatgatagacacataaatagccactgcacatgtaacaccaccctcgcatctatacggtgaagttagttaagctgtttgtatattcgatttctttcgtctgcaatttgcaacggctttgccatgtgcgttatggtcacgagatcgacgttgtccacttgtggaggcaatcaggcaaaggtagcttaagcttggtgggttaactgtgaaatggaagagtactatagctagtactagcaataatgtttagatgatttttcttttttgctgattagaatttggtactgtttttgtctacgcaatttagggttgatctccacaaattttcgctccgatctcgtgcgccgcgtgcatcacattattctcccgtgtatacattttatatacctttatgaccaagtaaccataccctatatctttatggacgaaatagcattccaaaatgcagaaatttcagtgatcaattcaatacttttacaaactacgaaggctatgtttggatccaaagtttagatctaaacttcagtatttttccatcatatcaacttatcatacacacgtaacttttcagtcacatcatctctaattttaaccaaaatctaaactttggatccaactaaacacagccaaatttgttttctgcgttccaaataggtaaaatgaaggcaagcaaatgcaagcgtccacatgtcttcaagcccaattaatgccacttccgcatagtaaaaaggtctgcccaaacgaccaacgcctcctagctttctttcctcctcaatcctggtttccttgctcagagctttaggcctggtttagttcccaatattttcttcaaacttttaactttttcatcacatcaaaatttttctacacacataaacttccaacttttccatcgcatcgttctaatttcaaccaaacttttaattttgacgtgaactaaacacaccctcagtaatgttcagacttaaaagagacaaaatgcttatgtcggtttggacttcggagacattttaattggagaatgaaccacttgttgactttaaaagtgaaaaaaaatatttagagaataaacaaaacacaatacactcatggatgattggatgcttaacatgtagtgttaataagaaattaatctaccacttgcggatctacgtacaacgtcgttgcctggaggaacgaagagcggctgcaatttaccgtgctgacagcactgtcaaacaaaacgaaattacgctacccaagtcatgtgaatgtgttctagcttgcgtgttaatttaaacgggtataattaaaaagcagcgcactgatacatacatgttgcccatacacaagcagatcagtcgagtgtgcaggaaattcccagtaaatttccatagcacttattttaataatatatagtcaaccaatcaatgaacactgtgaatgcactgcagttattgtgtgctactacaaaaactgttgccgacattgttcagcttgatggtgacgttccttttttttattttgtttgaaggtgaaaaggatctgtatacgtggtggtagagacatttactgataggaaaatgcatatattagcagtttagcgctaagtcctcttaattaatttgtgttacacatcactgacttgatgaagtgtgtgtgtctggctggaggtctcccgtacttcactaggagttcaaacagtgcagaaaattaaagagataataaaacaagaattctttgcagttgaattcacttgagacgtatatgtatcattcttttccaagggaaaggcgctgattattgaatatcgatgacagtttaagcaaacagttatcccaaacagaaaagttacagatatctgaacaaaagaaaaattggttgctgctaaacattcgtaaattcacctggattttctggactgtacgtgtgccggccagataatgtgaaacaggatcaaacagcttgaatttttcactcacaaatagaatatttagacgaaattcaatgaagacgtacgtcagtacattaggcttctctccaagtagtttcccccctccttcccgggaaataataaccagtccaattacacttattcaataacagtacgaagtcaaggccaaggttctgaacaattccaagagacattttgtccttccattttaagctttggtccttctccaaaaccctacaaataccaccagatcgagctgccatgccaggcatctccacaggttcattcattcatccgccacattaatttctatcgtcacttcttgttttgagttatttctttcttc

SEQ ID NO: 62978 - DNA, 31999 bp, Oryza sativa
aaaatcatgtaatataaactgttcatattttctaagatatttctcatgattgcagcttgaattgcaacttttctagcccataccatgtactaacaagccttatatatataggtaaggatgttcttgcaaaagcaaaaactgggactggaaaaactgtagcattcttggtaactaccctgcttgactactgaatttttcttgctcttttgttgttctaaagtctgaacctgcaaaatggtaatttgtatttgtgaatgttgtatgtgtagcttcctgccattgaagttgtctccaaattgccccctattgattgtgataaaaaaaggcctcccatcagtgttgttgttgtgtgccctacacgtgagctggctgatcaggctgctgcagaagctaacaagctcctgaaatttcatccatcaattggagtgcaacttgtaataggtggcactagaatggctctagagcagaagcgaatgcatactaacccttgccaggtgattggaagtaacttactgaattatcctggatatttctacatttggattgtgtgatgtaaaaatgctgctgatgtgcagattctagtagctacaccaggaaggcttaaggatcatatggagaacactccagggtttgctactagattgatgggtgtcaaagtccttattcttgatgaagcggatcgcttattagatatgggattccggactgatatcgagagaatagtggctgcactcccaaagcagcgtcaaacacttctattttctgcaactgttcctgatgaggtattgccactgctataggtcaacacttctgtttggtcgaaatataatcaatttctactctcttttctaggtacgccaagtatgccacattgccatgaaaagagatcttgaatttgtgaacaccgttgaagaaggaagtgaggaaacacactcacaggtattttttaaagcatatgcatgctgactgtttttccagattccaagtttctataaattttgatcagacatgttaccttttgttaccatgtttttgagcaatcttttgttaccatattcaggtgaagcaaatgcatgtagttgcaccactagacaaacagttttctatcctgtatggtcttctaactgatcatatttcagaaaatgttgactacaaggtaagtgaattggcatattttaagtgtctcctgtaaatatgcgtacttacaatgagaaaaatgcaggtgatcgtgttttgtacaactgcaaaggtaacaagtcttgttgctgaacttctgtctgaattgaagttgaatgtacgcgagattcactccagaaagccacaaagttacagaaccagaatatccaaagaatttaaggaatcaaaaggtcttattcttgttagctccaatgtatctgctaggggcgttgattatcccaatgtcacactagtcgtccaggtaacgaacttctttatggtagttattgagctgtttatttgttgttgcctatcttctttgctatttgatatacaaatatgtaaaaactccagatcgtccagcactggaagattttctttttctatattccgcttgtaaacgttttgttgaaacaaatacgagcatgtgcatattcttttcttttatcatatcctgcttatataccaatgtcagctgattatcgtcgttattgcagatgggagtgcctactgacagagaacaatatattcatcgacttggtagaactggccgcagaggaaacgaggggagtggaatcttattattggcaccgtgggaagaatacttcttgagaagtatcaaagatctgcctattacagaggcaacattacctttaattgatctggacactaaaagaaaggtaattaagcttatttactagttcagatatgatagttggtgcctgtttaaggtaatcaagcgtacatgcaatagtaacgatcatattgttactatttgaaaacttttttgttaaaattctgaatttcgtcatgcctgagaattgggcagttggttctaattgatgtctgaataatataatctttcgactatctaactaatttccattcaaataagtatttaaaatccacaaaccacagatgcaatgtccgccccaatcttgaggtgtgttgacttgtagattgtgcaaattggttggttcacactattttttaaatgctggttcatcagcacttgtttacctagcatataaaatctgcatcatgaagagaaaatacttccaaatatgctattccaccagttagaattttggtattgtcactattatgcatgactagtgtttggatttcatggtgaaattgagcttgacaccatggcttcgttgtatgcatttatgcccttcagatgatctgagtcttacaatgttgctacttgcagtaatatttgcttaataggccagccaaactatgcaaatttcctcttaatgctcttctgttcatgttagaagggatattgtttgacacaaatatatcaactgcaattctgatttttttttggtttacaaggcatagttagtgagtggtacatatatgtgtgcttgattctgtttccagtaatagatggtgatgataaagccagtttttgctgggaagcatcaccaggattcaaaccccatgtttacacacccgcaggtggactttagtaggaattttgtgaggctcatgaatttatccctggtctacccttcatctgtttgagcttgtgttcaaggggcatactcacgggtctttgtgcatgtatgtgttcttataattgcagaaaaaaagaagtaaaaaaaaatcactgagcaaggcatgatattctatattgtgggataattcttttgtacgtattgttgtttaaccatcaaaaggctatgcttctgtaatgatatgtgtttgtcagtggttctttgaccaaagatattttttaacaacaaaacatgataattgactgagggctcatttgcgattgttgcatcgggctgtggagctagtgaagggagtcataccaaatactccctccgtcccaaattatagggcgcccactttttaaggaaaattaaactcggtagtttttgactaataatcatactaactatatctatactaagtatgatgcatgttatatcactagattcatattttgaagtactttcatgtgatgctaatttcatatttgttgggatcatagaataaaataaaatactggtcaaagtatgttatggaagaccgtgtaaaaaaaatatgggccttataatttgggagggagtaacaattatactaaaaagaactgttttgcacctaaaactaaggctgataattgattattgtatccaaattcaagaatagcgaaatgaatgtgatttgaaaaagcaaccgcaatatcaaatgtgaccccatgcgggttggctgtaggtttactgagttaatgatgtgtgtattgtcctatgtctggtgattgttcttgcttagcttcatcatgcactgactgttatactttgtatgccatttcccgttcaaaatactaagaatgatatcctagttgttggtatttggcataatgctcagtattgcattttcttattgtttgtaggttgaaaaggctcttgcacatgtggaggttaaggataaggaacttgcctaccaagcatggctcggttactataattctaacaagttcattgggcgtgacaaataccagcttgtatcacttgccaatgaattcagcagaagtctgggcttgaataaccctcctgcggtgcctaagcttgtccttagaaagatgggactgaacaatatcccaggtctgcgatcaaaatagtcttcctcgaaccaaagttttcttgaatacacataccacaatattatcgtgcttcacagtggtatgagttttggagcagtctagctggtaaactaataaacagctatgattaaaggtcataatgggctactgggagcacaactaaagcttcagtctcaatttttttctcctgcaacatggaaaatatgccttatgaaggtgaatctgtacacaagcgatatgtagttttgcatgcccagtactgtgatgtttaaagcctgaccatgcatgatcaggctgatgtaaacatctgagttggtggcacacggaattttactttctttccatttttgtgtgcccgtgtatctattggatagaagcacaatacccctgtgcatgcgctatcgtatttattggacaataccattgtgcatccgctatctggaagattgtgcaagagctctgttctccatttggcctataaatatggtatttgtgtaatgttgatcaccaaattgaacatataatctctgttagtctaccttttttgacaggatagggctacgtagcctgtgaacaaatatttgttagttttgtagcatgcattggctacgtgtcgtttttgtctttttgtagtgtatgctacaactcttggcactttatacaaggtgaaggtgagaaggcaaaacatgcaagaggctctctcgatacattatctatgagttgtttgtcagcctatcccatgatttgaatatttgagttacttcttctggcttgtgcctcaggacatgagtgtccttgcgctaaaaaatataggcaatcttagcatccgttaaaataaaaaaactatttttgagttagtttttcatcatatatgctagagccaatttttttttctaacgctctaacactaaaccttagttttgttccaaacctaacaaaaaaaagacctatgtttgcaatggttaaattcaattctgagaggaaaaaaaaatctaacaaagaacaggttaggaatataataatattattggaattttcttttaagaaatgtttttttaaaaggcaatgggcattattaaatcgtaagaaataatttaaccagcggaggtgttgcaatcaaacaaaattcttgcatccaaaattgtaacaaacctgaatttgtaaaatcatggcaaattagagtaatcaaaatttccaatttatatttattgtggtgaaacctttgtttttggatttctcatgcatcatatgtttcattttgcgtacattgatttatcttcgaaaatagaacaacaaatctctatgttcagcccaatggaaaactcggtgcactgcatgttctaagcctttgcatgcattagtacaaattgcaagaggagatacatttcctgtagttttatgcaattgatttataaaccaggtccagttatcactagtttcagcatcaatgaaaccaaaagcatcaatgaaaccattagggcagttgagtctatactgaggtatggcctacatccaattagaagtccaataatgcatgcacaaaagaatctgtgaaaataaacattcccatcaacttcctttgtgtcaatttcaataacactaccaggagacctctccatgattgcaaccctccacctatacaacaaatggaaattatcttcccaactgccatgcaactagatcatagccaaagtcccacccttagccacagtatcataattgattttgtatttctgatcctcttccaacttggtttgcagttcttcagggcccatacttgaatccttcctaaggatatgcatggccttggaagcaacctagtcgctggttggtgtggtagtcttccttctgccgccagatgtacacgtgtggttgttaataaactttgttacttgcaaaaacaaatcaaataaaacatggcattagagaaattttttttaaataacatacaaacaaaaatattaatgacatccgctaaaaagtaccattgtggtccactcgtcagcctgtttacgcccattaacatgccaaggacaatcaattgcccctttgcatcctcctacaaatctagtacgatctctcgcctttacccaaagtttgaactccccattgatggcaaactgtctaaccgccaacgtaaagaccttcatgttgggatacatagtacctttcaccaaggatgagttattcacgtcatacaccatcatcctttctcccgcaaccttggagtatcaaccacaccctcattttcatcatcattagcatttttagcaccattggcatcggtacctctagcctgatcatcattttcagttgtagcctgagccaccgctcgtgcatactcggcggcttcatcctcatccctcaaacccaaaaatcacgtgcaacaggtccccatccacgatttttaatcttcctacgacatctagtgattcatcgatatgtaggttttcccaatcaacaatcggtggttgtggttgtggttgtggttctgggtgtagttatcctccttgagtaggaggagaactactacccctagcaggttcataaacaggggattgtacaactactaaacgactctcaggctcctcgagcctagagaaaacaaaacaaatgattgcaaatagtcagatctgtatatcccttactcccatgacatgagagagagagagagagagagagagagagagaagtgcataccttccaacaaaatctagccaagtggagtcatccatggagccaaaccctaaccacacaaacaaattcagtgagtgccaaatgggcactgaggtcggttatagatgaatgggggatgctaacctggggcctggggtaccactatttgccagctccattgcatccgcagatgtcgacacagattgtcgccgtttgggttgagtgggcacctgataaaccctgagtttcactcgatacgctcaaggttgttgttttgtccgatctttcggtgagttgagataactacgatttagaagaaacgttgatgatccgattacaaccgtactagacgttgttgtgttgcgtcttagcgatcgatgcacctctccgtgggttgttgatcttcccaatgcaaatcaaccttattcctgcaagcaaatcgaagaaacaagcaagaataagataaaagtaatctgaattgcaaataggaattcaatacaaatgataagttggggttccgaagaacaagcagacgggcggtctagctgacacgcgcactgcaagcaaatagcaatggctaaactttaatctaatagaacccgagaaaccctgaaggtgtacctaattatttaaggaggtgggaggacgacctagggatctctagggtcgtgctccacctgtttggggcacaccccacatgggccccacttgggccggggtcccaaacgaagttttaggcccataggccgattataggtgacgcaacatcttgtttctatgattgcagccaaacgatatggaattcggagatgaggctggatcccttggaaagaggactctgagagctttctatcaagtactcacgggttgaaaacaaaggtcgtatacagatttggcggccatttgaagtcagcagtgtagcaggttgccgaatcggattccagcacttggaggacttgattttgatatcttcttgttcatccatgatgtgagcaacgattgtatccatagtagccatggtcacatcagcagcggtgacacgaatgaagggatggcagcggcatgaattgagggatggcggtgacgtggtaggtagaagtggaggcagattaggtggatgagggtcggtgccagtgccacggccggcacctgtgcaaaggaagggttgagtgggcagcggcggcatgaatagatggatggcagcagcgtgagtgaggtaggaagcggaggcgggagaggaaggaggcagagcaggtgggggaggggcaggggtcggcgccggagctgacgacggggtcgtgcctcccggaactggtgcgcaatttggagaagtgatttgctgggcgtgggaaaaaggataagaaagagaggggaaggggtattttggtctagagaaaaaaactaaaatagagcaaaaacatttgtattaaccaaaaagaataaaaatggcattttggtcaacaccctcagtttaggatggcattgtaatgaatcagtttgaagcgatgacattctagcgaaaccactttttttgcgatggtgtaatcccaaatttctccatgacagtggtggtgggtggtggcacattcaccactcaccacaaccattgggtttttttaaaggagtgtagataataattaattgcgcatgaattaattaactaataaatctattctggttgttatgaaattgaggaggatgccactgagagcgtctagggctgcgttcggcagccaaggttggcaactaatcacttctgcacgaaaaacagaacggtctattagcgcgtgattaattaagtattacctatttttttcaaaaatggatcaatatgattttttaagaaactttcgtatacattttttttaaaaacacaccgtttaatagtttgaaaagcgtgcatgtggaaaaaaaggggagtgagttgggaaccatgggtactgaactcagcctaggtatagccattgtaccaaacaatgtctagactaggactccgatcgatacaaaagaaaaacgatgtgccactgggtacatgttacaaacatctaatataaagtccgtattgatctttaccttttcagagaaagagaaataatgtcatatagcatgtgaagaaggtatagttcagttttgaatgtagcctgtactgactgcctccctacctagaattcaagtttgaagtgaagtgttgttcatccttgtgcagggcatgctagaacccttgacactttgtacaaggtgatagacaagagagggttggagcatattaaagaaaaaaggtaagtggttcctgtagtacttggcgctaaaaagtatgagcatgagatagactcgcatatatctctcaacctttgcaacccttaaaaaaaataaaagaaatacttctaagtttgcttttcgtcatgttagaggcaaaaaaatggttttctactttatgcttcaagcctccaaaatcttaaccttggattggattgaaacctaagaaaaaaaagaagtcccatatttgcaatggtcacacttgattcgaagtatatatataaaaaatcttatgttctcctatctcacatggctttaggtgcatataaaacagtaaaaattaatgaaatatttgacaagttagaatgcaacaaaaacaaaattggattttcatcgagaacaattataaactatgcatgattcttgcacaccatttcgatctagaaacaagttgttattaagaaggctctaggatgactgaactagttttgggctgttagcctgttatgctaagaaccagttaggaactcaataatttcattggaatttttttaacagacggtgggcattatatcagggaaattaatttaatcagacgaagtattgcaatgaaataaaattcttgttttcgaaatgctgttaataatatcaattttaccattttgagttttgagaccaaactaacaaaagatatggtcgtgtcctaggaaaaaaaaatcaaaatgattgcaataaacagcctgggatggcatgtgactgccaacagtttggtcaattatgtattttttttataacaaaagtgtgcaaaacatattcagtttttgtacacagacacatttggttaattaaatgccttgcacacttccatgaacccgtccgactagctttcttcccccaccgcctcacataagtacatcaccatggtcaagctcatgacattccagcagctatcgtggaggcttcaagacaagccatgccacagtttgcttcacacaatgacgaagcagatcaccgaaagggttatgttgcttgtcatatatataccacccttgtgcttgctcgcctgttccattccacctcaacagattggattcaagagctagcagtcatcatcttcccctccttcctagttggtgttgctgtgtttctactgcctaccggagatgaacggctgtactggtggtgctggaggagtggcagcagggaggctcccggcggtgagcctccagcaggcacagtggaagctagtagatgagcgatgtgagctccgggaggaggagatggagtacgtgcgatggttccaccgctatgagctcgttgcaaccggtgcaactccttcgttgccaaacacatcagggtgcccctctaaactgtaagtagtgataataataacaagcatcatctcgtttttttgatcatgtagttatatatatatatatatatatatatatatatatatattgattatgatatggaattaatgcatgccatgtgctatatgtggattttttcttcaatgattaggtttttaactattttgtatttttaattatattgggattggggttgcgctaccctaatagggatagggattctattgttaactattttgggtggtcgatatatgtgatttcattgcacgattcagtttaggagaataattatacttcacatatagtttgataatgcctgaattttagccttgtagattttgagtttgcggattaccatgctaaaatactatcttatgaaaattgtctatatgctccctcctgttacgaataagcgacctttgggatagtgacacggtcacgaccaagacaattgtatgattactaattactagtgtaatatgtatggaaaatgtaggaaggttataatattctgatactatttttaaagaatatcagtacataccaaatttaaaagttgaatttgaaatactcaaagtgatattgttggtataattctaaacatgttgattacaggcatttcagaacatcagctaattgtgactggtcggagtatatgtacttatattatgctaggataataaatatgtattgtaattagagttatataagattacatatggatataaacttttagttgttagcacctgtgtaagtgtatatcctatatacaacatatatttttttaaagtaatagtgttgatctaaaatgccaaccaaaaacaaatcatatttcatcttgattaagttgatgaatggttttcaatctgttgtccgcaacacacttccatacagaaatgttttagtccttcataatttggcgtagtgaatcttccatgtttgtctttatatataattcaaaataaagggatcctttaaaaaaaaccttaatgaattcaatgtggtaagtgcacaatgcagattgatgttcaaattgtatttataatgtcaatacacgtttaactgtattaatatatgcttgaattggtaccaataattgtttttagaattacataaagtattatcacttggcagtaggattggttctcaatacttctttcaaatatttaatatcatttcagagaacattatgtacatgtttatttcaataccccacactcgcacgtgcgtgcgcgcgcacacacacaaacatttggacatgcagcttgtgtgttgcatctaacatagactttggggttttccctccaaaaatgatttactttgaagctagctaattctcctttgccatacatgtgaaaaccactcaaactaatttttttttgcaacttctgtgaaaactaactgatgatactagttatgttttttttatactcttcaatctcatcattattatataggtttggtcaattgtgaggaggtttgatccgccacaacttttcaaaccttttgtgagaaattgtgtaatgtgaggaaacattgagaccaaaagtgttagggaggttggcgtcaaatagagagtagcttaaacggaactcgcacaagaggactgccctaataaaataacttaatactgttcaaagtgggctcccatccacaaggagaattgaaaggttagggttccctgatgataatgatcacaccctccgtgtcaagtttattggtggtgatcacatgctaaaggtacaattcaatatttatcaccattccaagattttcctgtgttttgttattgctatcaagccaataaatttgatacacaatatagatatttttatttgagataatggaaatatatagctttttatggataaataaataactgtaatattctatatgtgccttggcaccatatccttacttgccactagaaaaccgggtcataccatacttgtccataatgtctcactgaaatgtgggccttagacccgcatgttgtttagagaatggcatcaaataaggaaacatttcaactttaggggcaaaaataatgattttatcattttttatttttgcatgtattttgttgaagatctttatttgtagtggtcctgacagtcgatttttttgttattattccaggactactcatccaccttgattatccacttggaggtcatcgatggccagctagtaacactagtgattgagtcatttgtggtggacattctagaggggaacaccaaagatgaaataagctattttatcgagaacttgctcaagtttaacctaaggaccctccgtgtctgaggagagcctagccggtccttgatctcacattccttctttggtgattgttggattaatcgagatatcaaattggtagaacttgttaaaactccgagaaacaatgcagctctttgatcaacactgattactaaagcttcttctaaagaatttagttaccagtgcaatcatagcactcactttagtttactacatatacatatccaactttcatgtttatttcgctttggtgtttgaaatgttgaactaaaatgaaattacaatattttgaaggattgttgccggacttcatgtgcattcatgtgtcttacacttggctatttaaataatgtacccatagatgcatgtccctcttatcaccgagttccataacttctttgaattcaatataaacacttatttgatttattgtcttaaccatggcacaatatgtcaaaatgcaccacgcacattgtattaactaccaacactactttgtgcttagaagaaaaatagatcgtggcatcagatttcaagaacaaaaagaaaacttgaatataagcatgtagtacccgatagtgtggagatcttgtcctgtggacaccgaagaggacggtcctcatctacgtgctcgtcctacctctacctcttcatcaaagacccaacagtcagggtgctttccacaaagctagggcatccagtggcctctgcctcctcaccgtgagatctggcagtcccatgatgaggggcattacatgtgggtctcagaaccatcgccatcatgcaccatcactggtgatttttttttgggtttataataattaattacgcctgaattaaataactaataaatcagttgttatgaaattggggagggtgttgctgagagcgtctaggtatggacatgatagcaaactgggacactgatcggtatgaaagaaaaacgacgtgctacttggtacatgttgcaaacgtcccaatataaagtcaatattgatctttacctttttagagaaagagaaatgatctgataatgtcatgtagaatgagaagcaatttttcagttttgtacgtagcctgcactagctgcctgcacacctaggattcaagtttgaaccgaaatgtcgttcatccttgtgcaatgcacgctagaacccttgacactttatacaaggtgaagacaagagggggttggagcatatttaggaaaaaaagtaagtggttcctgtggtacttggtgctaaaaaggtatgagcatgaggtagattcacatatatcacgcaaccttttcaaccttaaaaataaaagaaatatttcttagtttgcttttcatcattttagaggcaaaaaagcttttctactttgtgctccaaacacccaacaactgaaccttggattggattcaaacctaacaaaaaagaagtcccatgtttgcaatggtcaaactcgattcgaagtagcaaaaaagtaatcttatgttctcctatctcacatggctttaggtgcatatcaaaactaatgaaatatttgaccagttggaatgcaagaaaaaacaacattggattttcaccgaggataattataaactatttttaactcttgcaagttcttattaaggaaggatctaggataatttaactcgtttttggctagttaaccctgttatgctaaaaaccagttaggaacatactaatttcattggaattttcttttagggatttttccttcaacatactaattgcattttattagacgcagtattgagttcaaatgaaattgttgcaatcaaaatggtgttaataataccaatttaaccgttgtaagtttttggagaccaaatgaacaaaagatatggtcgtatcctaggaaaaaaaactaccaatatgattacaacaagcagctcgggatggcatgggacagccaacagtttgatcaattatatattattttagaaaacaaaagcgtgcaagacacattcactttctacacacagacacatttggttaattacataccttgtacacttcaatgaacctggccggttagctttcttcccccgccacctcacgtaagtacatcaccatgatcaagctcatgactttccggttgctatcaccgaggcttcaagacaaggcaagcacatagtttgccttacacaatgacgaagcagatcactgaaaggtctatgctgctggtcattatatataccactcttgtgctttctcccctcttccattccacctcaacagacctgattaagagctagcagccaatctcttccccttctcttcgctggtgtcactgtgtttctactgcctaccggagatgaacagtggcgctggtggtgctgggggagcagcagtagggaggatgccggcggggagcctccagtgggcacagtggaggctagcggatgagcgatgtgaactccgggaggaggagatggagtacatgcgacggttccaccgccacgaaatcggtagcaaccagtgcaactccttcattgcgaagcacgttagggcgcccctccaaaatgtaagcagtgataataatagcaagcatcatctcgtttttcttgaaccattattaggtcattatctattttgtttttttaattatattgggattggggttgtactatccattgatggagttagattttattgttaattgttttagatggtcgatatatatgattttatcacttgattgaatttaggaaaataattataattcacatatggtttgataatgcctgaattttagccttgtagattttcagtttgcgggttagcatgccagaataccatcttttgagaattgttcatacgctctctcctgtaacaaataagccacctttgggatagtgacattgtcaccaagacaattgttttttttattgaaatgaacactactggatttaccctgcagttatgattctataaatagaagaaaaaaactttatgttacaaagtaaaatgagaaaaagaactatactgattgtaaccagtctaaaaagattacttttagcttcattcatcctgcaagtatttaagaaaacttcctttttaaaacttgctagctatctgcccatatttgcaggatttttctaaaaaaaaatctgggaattctactgcttccgaatatgccaactggctatgattaatatgtccatgaaccctttcatccggaactgtatccgtgcaagaaaattgtaggaaggtataatattatgaaactatttttaaagaatatctacccataccaaatttaaaagttgaattcaaaattctcaaagtgatgttgttggtcaaattttaaacgtgttgattacaggcattccagaacatcacttattttttaccagtgggagaacatcacttatttttgaccagtgggagtatgtaagattacatatggatgtaaatatttagttgttagcaccttagtaagtgtatatcctatatacaacatatatttgatttttaaaacagtaatgttgatctaaaatgccaaaaaaaaaaacaaatcataattcatcttgcttaagttgaattgttttctatatgttgtccacaacgcacttccaaaaaaaatgtccttcataaacagatgtagtgagtcttccatgtttctctttatatataatttgaaagaaagggatccatcaaacataccttaatgaattcaatgtggtaagtgtacaatgcacgttgatgttcaaattgtatatattacgttaatatacatataactgtatttcagctatgtttgaattgataccaaaagtaaagttgtttttggaatcgcatgaagtattatcacttagcattaggattggttttcaatatttatttcaattatttgacataattttagagcacattatgtacttgtttatttcaataccctacacacacgcacacacatgcacacacacaagcacacacaagcacacatacgcacacgcacacgcgcacacacatgcacacgcacgcatacagttttggatatgtagattatgtgttgcatctaacgtagactttgggtttttccctctgaaaagggtttactttgaagctaactaattctcctttgccatagatgtgaaaaccacgcactcatactaatcctgtcttactataaagttattccccactaactccttaagcttaacatgcaaagatgccacatcatcatccactaattaacaagatgtcacatcatcatccactaacaatcatcacatttaaacatcatgcaaacatgctatatctttatagtttttataatttaagaacttttcaaacacaaacatgttaaattatcatccaacataattcacataatgtttcaatgtatatcttcatgcaaagataccacatcatcatccactaattaacaagatgccatatcatcatccactaacaatcatcacatttaaacatcatgcaaacatgctatatctttatagtttttataatttaagaacttttcaaacacaaacatgttaaattatcatccaacataattcacataatgtttcaatgtatatcttcatactaaattcccgcaacaatgcgcggggtttcacctagtttctttgtaacttctgtgaaaactactgatatgatactagttacatttttatttgatacccttcaatctcttcattattatacaggtttggtcactggtgaggaggtttgatcagccacaaatttacaaaccttttgtgagaaagtgtgtaatgcgcggaaatgttgagaccggaagtgttagggagatcattgttcaaagtgggctcccagccacaaggagcattgaaaggttagagttccttgatgataatgaatacatcctccgtgtcaagtttattggtggcgatcatatgttgaaggtacaattcaatatttataatcattccaagattgtcctttgttttgttattgctatcaagccaatatgtgaaacacacaatatagacatttttcgagataatggaacaatatatgtacctaattatggagaaagaaataactgtaatattctataaataccttcgcaccatatccttactggccactagaaatccatgccataccttacttgtccctattgtctcacagaaatgtgggccttagacccacacgttgagggaatggaagcaaataagaaaacatgtcaactttggcagcagaatcaatgattttacaattttctcaaagttgcatgtatttccaaagatctttatttgtagtggtactaaccatcgttcttttttgttattatgccataactattcatccaccttgactatgcactctgaggtcatagacggccaaccaggaacagttgttattgagtcatttgtggtggacattccagaagagaataccaaagaagacatatgctatttcgtcaagaacttgctcaggtgtaacctaaggaccctcgctgatgtgtctgaggagagccttgccagtccttgttaaaactccaagaaacaatggagctccttgatcggcgctgattactaaagcttcttctaaagaatttagttatcagtacaatcatagggctcacttcagtttactacatatacatatccaactttctgatttagttcgctctagtgtttgaaaaatgttaaactgaaatgaatttataatattatgaaggattgtcgtcggacttcatgtgcattcatatgtcttactcttgtgtttccaaataatgtcccgatagatgcatgtccctctcattatcgtgttctattacttctttgaattcaagacaaacacttatcccatcttcttatatagttgatacccactacaacattaactcctataaagcaagcatcaggtgaagccacgtcatcagttctttacagctgtcggatcaacatttcaacaactaaccaagtgcaaattgctgtctactcctgctggtcaggcccagctcctcagcccaaattgctctttgtttagctgacctcggcccattctcatacggtgatggaaagcttccccgccgcctcgcatccgcatatgttcgacatccagagcactaacacaagtcgactgttcaaatccacggcaacacgaggaaggaaccgaagggacatggcagtggctccgtttccgcttcagcttttgcatccgattcatctttagattctgccataatagctgtcgggcaaagtaactgtgcaccagaaatcaccgccatgaatgggggagtctcaatacaaccatggttaatcctcctagcctttttcagttcaccttccaatcaaacgaaccctgactccctgagggacatgcacccagggagctggtttcagatcctcttggttcttgccatgttcacttgctcgaagggtagtgtcctacctccatcggagaaggtgaatgtctgagtgccgcgcggaagcaatagtgggcatgggcaggaagcagagcggaggtggcatgctatggtagtatggcatatgggcgactggcttctcaccactgccagaaaataacgaatcaagagcgagctttgtagcctttcaacaatctgactattgcagctttctaggtagaggagacatactatgggcgattctcttcggtcttgctccaactattgcagtcttgcagcctcggtgagctttccaggctttcaaagaagatctgaagtccaatatatttcttccattcttcgtgagtattcttctcccattcattttgttcatcttctatctgcatagtttgttgattgcaacaattatcattttacttggttaaataatagatctgttaatccctttatgtcttgaaccacattgaacaaaatgtaagctctgtttcaatgcatgatgccattcactgaaacaacaatgtggttcactgaagaaatagcactgagaagtaaacgtttcatgcgggaacaaattagcaagatcaaggtgagtgtttttcttaaatatttattttgatcatgaatggtttaacaaaccagttggtagaggcccagagatgccttgactcagcatcagtatggttgtgctatataaagatgttgtccgtattctctcatcttttgtataatccacttcttttagacatttggtggaggcaaatagattgcagcttaatatttccttctatttttagttatctactgacgtacgttctcaatcattcaatactgttggcacatctacaggcatggttctacatgagttagctaactcatgtagaaaatgaagaagagatttactgcattggaaagcataatttggtaccgaacgctttacgccatatgatgtccaataacaaaaggacaaagtctctactcattgttgtccaaccaggtacctatatttcccaaccggcacccaggaggcggcactgattacccagggtcaaaggtgctagttccaaaactggcacctttgaggcgtccatgagaaaaaaaaatcggctcaattcatcgagtcgatgcattgagccgtccagccgatcccatctaatacccaaataccaaaatttcctcaaatccatgaacacaaactagtcaataatcctcaaaaaaacaacacatcaacatcacattcatcaagagcacaacaagaacgaacacatcaagaatcggatggaggaggagggctccactgccttcaccaccactgccactgccgccactgatgtctccactgccaccaccgttgttggatggagaggaggagggcaccgctgccttctccaccgctgccgctaccgagggaagtcaccatcgccacctcctgggccgtcggaccattgccgcctcccctcctgccgctgagccgtcgccgggccgccgccgccacctcccctcctgctagatctagcggaggggagggcgccgccgtcgggccattggatcaccgctgtctcccctcccgccactgacccaccgccgccgcatccccttttgccgtcgggctatcgacgccacctcccctcccgccagatctggcagaggggagggcaccaccgccacctcccggtctgtcggaccactgccgcctcccctcctgccaccgagccgctgccgccgccgcatcccctcccaccgccgcacactgtagcggccactgcctccgggtcattgccgagagagagagagagagagagagagagggggaatggataagatgtggggaggagaggaggggataagatgtggagcagtggaggtcagttcggctcggctcggctcaaatttagggggtgtcagtttttaattaatcgacacattgaacatattaaatgtttgtcggttattatttagaaccggcacctataattgtttaaaggtgtcgttttttgcgatttcaacccgtggaggtggggaaaacgcctataggttccggttttagcacttccggcacctatagtgccgacatctatttgatgttttgtagtagtgattgtacaccacatagaacaagttgatcttctatcttccaaggcttgccccatacgcttctttttcaacaaagattgatccttattaacccatgacttcttatagcctcgattggtacgtcggtgttgtaccaagcacttactccttcaacactacattgagtcctcggtgccaaaactctgcttgtccttctcccatgcatgttccattgcgtcggcatgtattaccaacatgcttaccacatcacaacgaaacctcattgtatttcttcttctttatcatctcatcatcatcttcttcatcagactgatcccctatttatacactcaataagcacattagtcccctaatcgtttgtcatcaattagcaaaatccagtaggggcctaggtgctctttccatgcccttggtagatgttctcacgaaatcaaccaaccagctcgagatataaattgagctactcttccctgaatttaatcgttctttcaaactaaaaaggcttgaagatgacgacgatatagaagacatgactctcagactttgcaaaccatcggattgacatggtacattaatctcataatttttgtttatatttttttgaattgtattaaaactaatagtaatttaatttctaatgtgtagggtgaaacttctaaggtgctaacgaaaagctagcttgcaatacatcttacttcatgcgatgaatgagcttgggctacacattcactccacctaggcctatttggttcaacgacttcaaacgtactagtcctacatctattttgtgttcaaagcaacatctatactaatataaaaagaaggagttgcccccctctaatcctactagccaaatcatctcatctaatctcttccatccatccaccatctcatctcatctaattcgccaatcccacttattccacctcccatcatgcgagataactccgtcctggcgcacgcgatgactccgcccccgagagcgcaatgaccagtgttgtggaaaacggatagtacggccgttaatacgtccgttaattcagtaacggtgagcagtccgtcacgacatggtgatacggccttcattacttggtaaagaacgcgtaaaccccataattagcgactaatcggacgttttctgattaatcggccgtataatcaccgttattacatggcccagcccacaacaacccaacccattactgtgttctgtagtatgtagctgtatatttgcccttccgaatttcccgcaactcacagcaacatgttctttccatctaatcctctaccaaatgtaatacgatatccaagattttatgttaatcttttgtttaaatttcaaataggtctcaagaaaaaaaatctcaaatatatatgaagttaatgtattttcctctcctaaaaaggcaaactattatcaactaggtacatatatttgtacaaacgttaaatttccgttaaattccgattaatcgaccgtattccgattaatcgtttgacggtaccctctccgtccaacatccgcataccgtcttccacaacactagcaatgacaacgccacgccaatccccgtcgcctcctcgctcttcctctcagccgcgcaaatccccgccccctcactcgctccgcttgattccccccgcggccgccacagtccacagtcctcagcggtgtggcgcagcggtatccggcgaagtccaatagacgtgcaggcgccgccgctcgtttctgactgaggcgatgcgaatcggcgagcgagctctccggctcgacgtggtcacgaactcacgaagacagcagcggctctcgatctggcaacatgcagcaacggcgctctaccgtccgttggcttgaacagcggcggatgcactcgccggcgcattgcatcgacgacaacggcagtccaagctgtggggatctcacatgcatcttgctgtttcattctcctgtgttccctttcttgctctgctactccgttaaggtgtaggtcaattttccccaattttgaagtttaaattcaaattttgcttgaaaatttcgtacgaaatttctgaaaaaaaatccgaaatttcggtaatttcgtaatttcgctgacccccaaaatttttcctctttccgatagatcaaaccctggtcatgcctccatcgtcggaccatctcactcgctgtcgtgcctcctcgcgactcctcgctgcacgccaccgcatcgtgcccctgaaggcgccgtggtggttgccccttccgccccagcgccaccacagttccatgcaactcagtttctcacgttcaatgagtggatgacaagtgataataacatggtacatttgtatatatatgtttttccaatgtttcttgattcattatttagtttatttgcttgattgagcagcttcttcaagtaattagtcatatgttgactcggtttgattgagatagatgatgcattatcagtttttgaccatccaaaattctctttagtgattaggatgcttcagtcttctgctctatcgacaagataagtgtgtgggggcatgtttaagaagcttctattcagttcatcaaattggcttccaaaatattaggcacaccaattgatgataagaggagctcagattcttcattatttttgcagactaaggatgcaaaagaattgtgcccaacataattttgctttgtataaacccttctgaataagtaataataaatctgaaaacaaatgtgaaagagtgcatgagatttgactattttcttttttactcattttattggctacatggatttcatgtgcacccttactattttcttgatgcattaatgttgtgagtcgtaagttgtatgccctcagctatatcagtttcaaaccatgaattcattgcttcattagcttaattgttctgtaaaaagatttttaagaaaaaaatggatctgaactttattggtgagataaatggctgtagctccatgttactcggctactaatagatacttagtactagggtgatcaatgaaaagaaatgataattagttctcccgtaattgttcaaccaaacattcatccgcgactttcacattgttttagactgagaaactgcaggttactgccccatagtctgcttaactgtaaactgtgacctttcattgttttaggcagtgattgaaattattttcagcactgaagtctgtgatcaactaaccaattcttcatagttcataggcataaagaaaagaggttgccccatgatcagctgagaaagtatagagattcagttcaggggaggcaaaataggaggaaaataatttgtacctataggcatgttttaagaatgttgctgtcgagggaggacacatctatactaatataaaaagcaggagttgtacctttgcaatcggatggccaaatcacttattcccgctaattcatccatcgtgcaacgcagtaatccagcgcgcgcattcaccgccccatccccaccgacgtacattcatcacgcgcttccggttgcccacccacgcggccgcacctaacctcctcaaacgacgccgagatgccctcctctctgcccctcccccgtcaatcacgctcggccggcattactccctgccgcgctttgtggcttcgttccacatctcccggaccttccatccgcagcctgacgaccagcccttttagacgtgatatccacctccgggcaatgcccttgcccttgttgccgccggcccgccgccatcgccgacatccatgcatggaaccatctcagccccagcccctgtcgctgttgcaaccaaatcggactccagtactccagcggctctgccttgctgcgctgcccggctgtacagaactcctgtcctacgctctgcgtggtttgatttgtcgctccgacgacctcctccaatgtgcggccgatgctgctgcatcgaggagggaggcggcaggcggcgtgagctccatacccaagggtggggctgtagcgaggaggaagacgatgtgcgacatcacaaacttgatgcgcacatcagcggccgtggagcagggcgggacggtctgtgccgtggatgcgggcatggaaggaatcacgcggctggtcaaggatctcatctctctctaatcttctcaatccctatgactgcttctattaattttagagttggacctgtttgctaaacggtgatgtatttttctgtattttgtgccaattcctgaagaacttggaacttatgaggctccttgaggagagggagtacgtccctcataccaccttattcttgtatgaattcatctcttttgttagaggctcttatgcatctgattagccacattatcgtttttcgtgaagctaaagcacatcagcttgcttgctcgagagctattagcacagcaaaaatatcacaatcagaggtttcaagatgcccctgtagtggctggaactggtcacaggtggtaagattaattattttcagttgtgatttgccatcttcagattaccatgctttttgtgataaatcaatcttcaatggtattataattttttttctactcttccgtcaataaaaacggtggcacacgtttggtggagctgtataagtgcatgtgctcatacttcataccgtcacaaggggcacattgcagagaaaaaagaaacagatttcagtatcaattggcatgtgaaatagattttagatatataggaggagatcattccgtgaaaaataacccgaaatttttttattatagctcataaacatgagcttgtgacttggcagatgctatgcatattctgagtatgtaggcttggcggttgtgggtttgacgctgttattcctgtaggttgatggtcagcattctcattctatactccctccgtcccacaatataagagattttgagttttttattgcaacgtttgaccactcgtcttattcaaattttttttgcaaatataaaaaacgaaaagttgtgattaaaatactgtaaataataaagtaagtcacaaataaaataaataataatttcaaaaaaaattgaataagacgagcagtcaaacattgcaagcaaaaactcaaaatcccttatattataggacggagggagtatgtatgagttgtatgtgtcgtgctatgcatccttactctcagtagctctgtactctgatggcagattattttcgatagcagcaaaaaatatgtttgattgtagacaacaattttttggttttattcaaattggtcgctacgtgcattgcacgttcaggattactagtcaattcacaatcttcggagatgtaatggatcagtatgttggagtaaaaaaaagtgcttacatgcatgcattaactatactacatagatcatctttggagttgacatctagatagaaattacactttatatcgatatttgtcaatatatattttgtttctaattgtttgtatggtgtatgtctatgatcgacttgcaaataatactacctctttatctatgtgaatttgtaatgtattgatgtctctatatgctgataaaaaaatatactagtttcgtatgagcatgcattgcttcatagctgctgagctacacgtgacaaatgttgacataatattgaatccgatagtcctatatatgtagaaaaatcaatttgcacgagaattaacaaaaagacaaaaataaatgcaaaattagcacgtgcatgatgagcactagaggcaaatctgaattgaaactaaattgaatttcatctcgcaaatgcagacacactcgtacacagagagcccaacacgtattgtcgactctagtgctcccttggctgttcgctctgtttctgctgcatgctatacttaattaatttcagcttcaacagttggtcggtcgaaacatgcgtgagtcatgtgaacgtttgctgaatcacctgtaccaactcttcagcgctgagctcgcactcaattccaatctgcccaaagatatactagaaaaatgtaagcacagtgaagattttataatttaccaaaatattaaatcataggaatgttaatttcatcttataaactaaaacttatcacatagcattccatatatagtttcttcacagaaaggaagtgctttcatgcatcaacccaagagcaaaacaattacaatctaatggtccaaaaactaaataagatgacgtgaaagcgtgacaacactgcactaaatggaaactgacatatatatgtttacatgatttacataggtcatatttaattgatgcatgatgttatggccctatttatgaaaataaactaaaattcagcccagtataatctaattaaataggatggaagcgaagaaacccgaggaatttttgtaagaatgcctatataggaaaaatatataggagaaatatgcagcggaaacctgaaaactaccgtaggataaaaaatgttacgtgtaagatttgtcaatgtcatgataaactttcactcctagatactcgaagatgccacaaattttagtattaaatttgtttccaatacaagtgtaccaatatattataccatgaattaatgtatgttaccaattggcacccatcctgaagaactgtgaaaatgcagatataccaccatgtaacagtgaaggcatgcagtgaagtaccagtacactgtctggtctctgatatatatactatactaccatacagatgtccgggcagaacatagacatttgtataccctaccacatttatgagcagtgcagcttcattgcttcaacatgcttgggcagtactagctgttaagctagccatacatgcacttcatgggaaactcacatgaaacaaatgcatttcttttgatacggcactgtaccctaaacagtttcctttcaaatgttccattcacatttactgtgtcctccacacggcctcaagcagtgcactcatctatgagatcttttgttcatgtgtacatatcaacaatcttagtgacaataatatggttaattatatgaaggcttctgttaattataaatggtagagctgaaaatgttgcaacgattacacttgcgacttttgattttcttttctaaatgaaatgcagagctcgtacctttatttaaaaaaaatactaattatgagaaaaatttgttaaacattaattcagttttaatttttttaaataattgtgattaggacacatactctctccattttaaaaaatctagcaactttcagtgtactattagaactttgaccactaattactcttaaattgttagattaaagtgatcaaaagtttcacacttaataacccttatagtgtttgtaaatattttgcaaagaagacaatttttcaaaattttaaaaataaatagtgcacgtatccggtgtcaatcatttaaaaatgaagggggtaataataatcacataatgagcgcaagagctgaaatagctgtgccatgcagtagcagactagcagtacacaccttgacagtgaaggagttgacggcggtgtcatcgacggtgctgatcttggcgtgaagaatctccagcgatcggccctccagggcggcgatgatcttcaccgcctgccccggcgaccgctgcgacaccgtcttcagcaccaggttcgcgccggcgaactccaccttcacgtcggggaggaggaggccgccgcccagcgcctgcctgctggcgtacgccgacagctcggcggcgatggcgtccagcgacggcgccgccgtctcgtggtgggtcggcgtcatcgccggggacgcgtagttggagccggacgccgggggcggcggcggcggcagccggaggagcctgtagggactaccgggcgtcggcggcgtcctggggctgatcggcacggcgagccgcgggctgagcggcggcgtggacttgagcagctgcggcggcagcctggggctgagctgcggtgggcgcgggctgcagcacgacgccgccaccgtcgccggcggccgtgggctgagcacctggtcggtgtagaccttgcgctgcttcttggcctccagcgagtgcaatacttgctgcagctccttgatgtagtccaccactcctcctatgatggatgcctggtctccctgatcaattcaaaatttcaaattaatacatgtcaaacataactatatatatgtatattatttcagagaaacaaatagtgtaacttggtctaacataactatatatatgtatattatctcagagtagttatctattgcaccaaataaataaatagagcctaagatgttaactatatatatatatatatatatatatatatatatgcatggttgcattatattccagcgctggcaaggcaaaaaaaacatgctatctataggagtgttagtttcaattgagattctctacttgagtatatgcattcgtagaatccctgctctttgcctgtacagctgattgaattaaagtctaaactgagaattttcacggagtaggtcggtccatataccatatgcattgatgcatgagacagtattggtagtactgtcgtactacgttacgtaggaccggatgcctgtgccaataagtgatgtgatatgatcgactagctagcagatagatggcatagtgcgtgtaggatcataaatgattgatacccaatccatggagactagttggagaatctaacttgttcgtgcaccaatcacattagctagctagatattacatactttctcaatctaaaaaaatgaacttctgactagaagtaaactatgctattccaaaagttcaactcaggctatatattatatactttctttgtcgtgaaaaaaatagcttctaattagaagtaaccgtaggctatgtccagattcatagcaagaaagtttgtatacattggttttttaagacacatggggtagatcacttatagttagaggcttatatcgatgtgtagacgatcttacccgcttgacgtagaagcatggcatgagggagcgaagcacggcgaggttctcgttcatctgcttcctccggttgcgctccacggcgatgtgcgccgtcttgggcgtcgtcgccgccgccacgtccgtcgtcgaagactccggcgagcagcacttgcgcctcttctgcggcgaaccgtcgtcgtcgtctccgtcgccgtcacggtccgccacctcctcctcccgccgcttgttattggtggctggcacggtcttcgcggcggcaggttccggcagctgctgatgattctgcccaccaacaacgccggagatgcaggcagcggcggcaataggactacctaacgtcgtcgtggtcgcgggggcgccgccggcgacgacgttggcgcagccctcccacgtctcgaggatggtgaagaggtcgtcggcgtcggcgtcggcgtggtgggggatgaactcgccgccgtcgctgtccaccaagaggagctgatcacacagcgcgtctcccatggatgatggatgagtctagctacggtcaccaagggaatgttgcttttggtggcttaatttgtttcaagctcgatcgatctgatggtggtttgaggtcgaccgttgtttgatgacaagcgcagggtggtatgtacgtagtcgaaggcgaggtgacataaatataggaaacggcgttgaggtacggtagaaggagggaggagagccagagtgtgtgggcccaccatctatggtttggccatgcatgcatactttgctgcctgctgggcacgattgattcgatcgatccgtcaaataaggagcctttcctcatctaaaccttgccacaaatacagaaatcgtcaacaataccagttgaaaaggcatatcagtgccggtttcctaaccgacactacagctaattaggcactgatgaaggggttgtcggtacccattttaaaaccgacattgatgtgttccctcgaataaataaaaacatagaggatggcttgaatcaagtcgatgcttcaagcggctctctaaaattcacagcccagcacatcgatgccctcctattccgcatccacaatacaaatcaacaacaagaacacaagagcatccgtgtatattccattatctaaaaaaaaaaagagcaaccgcacacatgcatcaaggcatcattgcaatattcagactggaatatatgaggaaacccaccggtgatgatgttcaacatatcatagaagaagtggaagaagtgctcaaacagttagaaagcaatgtacacacatggagactatggtgcagcaacaatcatcgtggaggcagtggcatcctgtgaccggtggatttggcattgtttgttcggtgtagcaggatcaaatgatgagatcagtgttttgaaccaatcccatacattcacttattaactcatgggtatatcgataaggatgcgctacacagtggaaattaatataatttgggatactatacgccaatggaatctatctagaatgggcaactcttgttcagtcgatctggcatcgtcaattggagaaggaaaaaatgtttcctcttcatcaagaatcaacgagaaaagatgttgaatgtgcatttggtatattaatagcctgtttcgaggtggtcactactcttactcacttatgggagcaatcgggcattatcaatataatgacgagatgtattataaaacacaatatgattgtgaaggatgaatgtcacctagggcctatggacgcacatgagtttgagcaggggcggagctagcacaaaataaagagggttccacttgcttgctttactctgatttgaattaaatttagcttgatacgggtgtctaattttgaactaacagagtatatatatggtgaaaatagacaaactatagctaaaattttttttaggcaaaatttgctatatgacatccaaaaaacgtgtaattagctggaggacaccgtaaaaacgtgtatttgctgtagggcatcgaaaaaacaagtaattggctgctggacactcgcagtattattttattatttttggaggaaaaggaaatgattaaaaacaagattgccttggctcatataactccaacgtgggccccacatggaagtcccctctccttctccttcttcccagacaggtctggtagcggagcggcgatccgtggccgtggcaacagtgacgatcacgttcgttgtcgggagggcgcccggggggggggggggg

SEQ ID NO: 62979 - DNA, 1076 bp, Oryza sativa
tatatgttcgttttatatcaaaaatatttgactaggaaaaagagtcgaaacgacttagagtatgagtatttttcttaatcctcctgcacaaatctaaaataatacatggttcatattttgaaaaagaataaaaaaaacagagagacagtagtccgtccatgaagcgacgagatcaggagcaagcgatcgcgaagctgacgagcatcggcggtggcggggcggcggcgggagagacgacctcctgatcatcttcatgtggaccaagaaggccatgctcgccgccgtcgtggtggtcgtggccaagtgcagggagctctgggaaggggtgctcacggcgggctccggctgcggctgcgtgtcgcgttccgccgccgccgccgacgacgacgacggctactacttcggccggagctacgagttctcgtgctccgccaccccggtcgccttcgctccggcgaaagggcggcggcgccggcggcgctgcctgctgctgccaccctgcgtgggagccaagcaggcgagggagatgctgcgggaggcggcgatgatgtccccggcgccgcctgtcggtgccggcggcggtcgacgctcgccgccggagcggtcgccgcagtggtggagggagcaggagatcgacggcctcgcggaggagttcatcagccggttctacgagcagctgaggtcgcaggtggcggatgaggagcggcggcgggcgccggagtgcaagagcagggcgtcgtcgtcgccgccgtccccgtctccgccataggcgatggcttaattacgtgcgtgcaggttgtgtgcattaaatacgtacgctggtgtttgcgattaatgtcatgtggatgtgtgtgtgttttcgatgatgagagggagttcgttcgttagtgcagttttgaactttttgatatctttccttacggctttcacgcggtttggaattgcttgtctaattatctttgtcccgtgcagttttgcgcgaagctaaataatttacgtaaagttagattaaatatgtaataactctgaaattttaatttttttatgaactattatatggctcttaccttttatat

SEQ ID NO: 62980 - DNA, 6860 bp, Oryza sativa
aggttctgaacggtgcaattctggacaagaacaatatgacacttgccttacttcaggctcagtctgaacaggggacttgataatataccctgcatttcttatcaccaataatttgataataacaacgagttattccttggcttattttgttgaaactaatgtactagaacaccaaagcacaaataaaccatgggtttctgcagatcactcatcagaatattcaccaataacttgattggcacctagcagatcatccaattgtctgcgctccttccaccattttcccatgcttcttgccttaccctcatttctagaatttattcgctggtgctacataatgctcatcacgaacctgaattcctcttccatgctcccaatatttcacagttttcatggcataattctaactttaggtgacccggcaccccaaccaaccaaccaaccaccacccacccatgtgcctgcttgttttgctacaaacacaataatcatcttcagataatatgcttatacacctaaattatttacatgccatattcatcataaatgatagtttcatccgattgggttgagctcagaactttttaaaagccatgatacatattatgtggctacatacaacttttcaccttttcctaaaaccaatgcatagattgttgtgaaaatacaagtattttagagctctataacatctgagtagcatttctcgttgtagtatgcgagagcatgacaggacaacaatacatgaagccatggagcaacaaacaataagcattgcaaaggtatctggcctctttgatttaaacaattattaccatttagtgaactgtggcacccattaactactgcactttgattcagcgtcatttcttctttattacaggctggattagtgacaacactcaacacaaggactacagtgtttggtgccactaacccaaaaggacaatacgatccaaatgaatgtactgcacttgcacatcaagctcttatgtcgctttgctacttaaccaaaactgtgccagaccacatagtattcaaggcatatttacttgcacattctactacaccaatgtgtagtttgatactatggtgccattatatgcctctaagctgttctaattatcctttgcagtgatcttatccatcctgaccgttatatttcttccttttcttttcagccttatctgtgaatacaacactttcaggaccactgttgagtagatttgatatagttcttgttctcttggatacaaaaaacaaaaaatgggataaaatagtttcatctcatatattagctgaggtattttcattgtttttgatgtttgacattatcttttgtttggtttcttgaacaagctgcactatgggtgtgcaaacaacttagcatagcattctaaaacaaacttttaaaaattgtgcagaacactgaagaaaagaaaggcaagacaagtgatccggaagtaatgtggacactgtccatgttgagaaggtgagacaattgattccaaaaagtaatgtcgatgacctccatgctgagaagatagaaagttgtttttaatgttatgttgatatcaggatatgtttacctcccatgtcatgataaggttgagcttagagacctgtggtacgctatatgccaatattgaatgcatgcaattcattatttttgttcaacacttagaaattgttttgttggcttcagcaaatgttacttccgcagaccataacataataataagtagctaaaagttccaattgtagttggctggatagcactgagaatttttattatatttctttgtcaatactaaacaatgacgcttcaatcttttataattccaggtatattcactatgtgaagcagcatttcaaacctgtgctgaccaaggaggctgaaagagttatctctagttattatcagcgtcagcgacaatcaggaactcggaacgcaggttagccggacttgtttttgtttcttgaagtattttgcagcctctcaaaaataagttttgtgcagcaaggacgactgtgcgcatgcttgagagtttgataaggctagcacaaggtatgctttgtaatctacactggatcactcaccttctcatgcccatcttgtctcaattcttttacactttatcttgtcttttctgctgtagcacatgcaagactaatgttcagaaatgatgttacgaaacttgatgctatcgctgccatattatgcattgaatcctccatgacaacatctgcaatagtagatactgctgggaatgctctgcactcgaattttacagagaaccctgaccaggaatgtatcctgaaatgtgattccatagcttacttatccaagaatatcaaatatttaactgatgaaatctcgaactgataatttttactgtagtgccacgtatatggatgttcttgcctatgtctctggtatggccttttgattcgggcaagcaaaggtgatctgttgttcctataaacgttaacactacagtactttccacttcatgcagctgattggctcattctgacgtgaaatattttcttatggaaatgcacctttaaagtatagattctgtaaactgataggcagctttctccactccttttgtttgtcttgacatattatagatattgaacaggagaagaaaatccttacgcaattgggagttagcgaagactccccattgttataaaatatcattaccaatatgaagatttacaagcaaacgtggcttatataccatgctgcacaatgaatcaagtgatatgccaaggtgataaccactcttgcttgggacatttaactattatggtcgtcttgttcttataattataagtgagtggtaatggggaatatgggataaacattgcagggaatatgtgatttgcactagattactacggtcagtttggctctaccaggtaacggtattggaaattgtaacttgttgttttagatcaatgtactggaacttgaaggtctgaaatagcaactactccctccgtcccataatataagggattttaattttttgcttgcactgtttgaccattcgtcttattcaaaaaattttggaattattatttattttatttgtgacttactttattatccaaagtactttaagcacaacttttcgttttttatatttgtacaaattttttgaataagacgagtggtcaaacaatgcaagcaaaaagtcaaaatcccttatattatgagacggagggagtaaaaaggttctctactttatattatggcaaattatattatagacttttcattgtcactcactcttgacatttccttttggttgcaaggcacgccaagtagggttattttgctgtaagtttttttttttgtcatcacagcaaaggacatttgcagttcacacaccgcaccatatgcacctagatcataaccagattggaatgaatcccaacatacacaggtgaggctaaaaatccatgacatagataggacaacaaattaacaggaagtcaattcaaacacagcatccaactactgccagctcaccacaacaaaagcaccagttccctctgtgaaaagaaacctcaactcacttcctgaacaaacacttgacacggtgtgtgtcgatgtctaaatgacatgcaacctaacagcactgcctccaccctggccttggccctagaagaggcccagttgcacggcggcaagtcctgccaggcccagcatagcccatgacctggccctgagcccagctgcaccggcggactgcttggcgggcggcgcgagcaccgttgctggggttgtgggcgtcagaccggagcttgtgccaggggacgccggtgtcgctggtgtcgtagatggagtcgtcggtgtggtggacggggcttttggggctggggctggagaggccgcggcaacgtccacgacgagcttcatgccgttgctgcagtggccggcgatgccgcagatgaagtagtgcttgccggcggtcttgagggtgacggtggtcgtgccgctgctgtcgctctggagcgcgttgctagcggtgcacgcagcgtagtccgctgcgctcacctcatccaccgagtgcgccccaccggcgtagttgaacactggagaaaagtaaaagttgcttagaaatgcatttgcaaggcagcatatatagcaggtgaactggtgaagtgcagcaagttttgatatgcattttggtactaggaagcatcaatattcaatatcaatgcacatgttttacttctttttttttcagtttctgatgcaagtcatgtttactagttcttttttttctctagtatgatgccgatgcacattttagttaactctgttagtggcttgtttagtaagaaatctatcagattaactgatctctcctggcaagcacatgatcaaaaacaatgtgcagcacttggacaaacaagtgagaacctgaacacaagaatgttaaaagtaacgcagaggcttggttacatggcgctcaccgagggtatcgcccattttgaatttcttgtcgctggcccaggtggtgtaatccgcccccatcgcccagccggacgtgtcgccgacggtgtacttggtcgccgccgccgccaccacggcgcagctcacgaggagcagagctaccagggccagcgacgaagccattgcagcagccagaatcaaaccaagaaagggaattggcaatgtgtgagtttgtgttgctctgttgagatgcaatgcagagaggattgcaagctagggcccttatatgcatgaaactgacgaggtgacgagatgagtgagtacaacgtcgcagcagctcttcagctgagagagttggtgaagtggctttcgttggagttggttgggagcaggaaccggtccatgccttgcaaaacgcattgctttcaacaggtacttctcccaaagtctcaatagtagacagaaattgccttagaaatgactctactctagctgttcggttcattttctttttgccaaataccttttggaaaagaacagtttcttcatggtcataaagctctagttagtttgcggctgaagcttgctgctttgatgccttttcagctgcaacatctttctcatgaatcatgatgcacacacgtcgcatgatattcttgcaacgaagcagagaaagatgaggaacacattaattcaactggtagcttggcaatgtcaccagactggccattaatttgttctaccaacattgtcttccttttagaccccataaggacattttccccttataaaaatagtaagcagagtatttctatgcttgcttaatccctgattagaatcagcaatttgcaaatcttagccgccatgaaaaagccacgcgaataattggtgatccgatcatcaactttgggggcagagtaacaggtgatctatagccgtagcagctggacgcctgaactaaatagcaatatatgtttggtgactagccatctcgtactgtcatatgggtcaaagcgaggattttgccaagagatttgatgagagattgcaacggcttctggttaccggtgaagcaattgatttctggttatcggtgaaagcaatcttacttgctgatccagtagttctcgagtcatttatgtgcaagagcgacttgcaaccagaaaattttccagataatgcaacgagatggtccggaccctgtcccgaaggcaaatggaagttttggtggttgtgtgcaggattcatctacaggaggtccaaaagattaaggaacaagctagctatcaattcccggaggtcaatctctaatccggttggtgaatggtgatcacgtacctaacataaaaagattagtctcgctttagggtttggtagacaaagggcagttctgttgttaatcttgtttcgtttgtcaaaggagcatatgctgttctgttcttgtagtccctcaggtaggaagcttcaggcttcagttactactttgcttatttccagtgaaattctctgtgcagaacagtagaaagatgagcacaaacccgggttcagacttcagaagtgttccagtagtccagccttctacactactgccatggatctatcagtccatgacaagatcaatatttagtttgttgtttgcagcacaggagattgcatccaaacaatgaagcatcatcagttgtatgggtcatttcttttcttcaactctaaactttgaactagcttatttttttttcaaactgttaaatggtaattttttaaagaaaatctatataggagttgtttaaaaaaatcaaattaatctatttttcaagtttaaaatagtcaatatttaattaatcatatgctaatgagttttctcgtttcgcgtgcacgaaaaatctccctgcaacctatgcatttttgtaaatgtttatgggcccgtctatatataaacgtttcgtttatataggagttgcttatgggcctgtctattttttttggaataagttcactttagatcccttaatttgtcgcccaatctgattttcatccaccgtccagaaaaccggatacaatgcatccttcaacttacaaaaccgtgcagaagaggtccctcattagtattgtgcctggttttggatgacgtggcgcctacatggcttcctttgactaggtcctcgtcccacgtgacattgatgtgacgcttaagtggcaattggatcccggaaaaataataaaaaccgttggacgcatatgtcagcttacacataaaaaaaaattaaaaaggtgggacccatgtggtcccacatgtcagcctccctcttctctctttcccctacattgcaagggagaaggggacgggcggagcagaggggggtgggggaggggttgaagtcgagct

SEQ ID NO: 62981 - DNA, 1937 bp, Oryza sativa
ataaaactatagatttaactcggtgtatcataaaactatacatttaacataaaatttatcacaaaactacacatttaagatgtagtgacacaaaattacatgtttagtaactaaattatcacgaaaatgcatgtttagaaccaatttaatcacaaagtaataatgtttataactcatcataacaatggtgctagggatttaaactccaaaagttgtagttttgtgataagttcaatattaaatatgcatttttgtgatacttaacctaaaatctgcagttttgtgataaatttagtgctaaatatgtagttttgtgatacaacttcttaaatctgtagttttgtgataatttggtcaaaatacctgtagttttgtaaaatttactctaaataaaactatatacattgctaagactgaaattaaagtgctatgcaatgtgtaattttaattcattttagctgcaatattgtacataattttaaaaattttatgacttataagtttatttcatgtaattttttttagaattacacagtacaacacagacactcaaaacgcacgcacactcttgtatgtcggaatattttggtagtaagcaatagcaaagtgaatgagtgatatgaccattggattaatatattatcatccaatgtatgggaaatttaaatatactgcattatatttaaatgcaatatatgtaattaatttgtttggaagaaaacaatactggttgaacagatatgaacagttaatagaataatcgaccgattgtctcatagaaaaatgaatggtacatgagttaaaccaaagaattcaggcctacaatgaataaattcgtctaaggaaccctacgctacattagatgaattcatctcaacaaacagctatggttgtctacgttagagcaagggcagggtcctcttcttccactggaagagtgtattcatccctcgagaaaatacccttgtttcttttatgccatctaaatagttattaaaaattaaaaattaacaagatagattaatataaaatatatcaatccacagacatgcagatttaaattcaacttctacaagttataagaaataattatgaaattttaatttgttttttataacttgtagaggttaaatttgatcttacatatttgtagcatgatatatcccatactccctccgtttcaagttttaagactttgactaaaccgtttcaagtttcactaaatctatagacaaatatagttatagctataatactaaattagtttcatcaaatcaataattgaatatattttcataaaaaatttgtcttgggttaaaaattttactactttttttctacaaacttgatcaaacataaagcagcttgattttgaccaaagtcaaaacatcctataacctgaaacggaaggagtattaatctatctcatcaatttttaattttttattactattcatatgacatgtaagaaacgaaggatgtcacctagacgaagaaaatccatctctgcttccactgccgcccatcaacatctgtgtggcgagccgacaccgccatgtcgccatgatcctctgtggcgagccgcgcgcatcgacgagcgaggctatggcgagaagaccacgtatacgatgcagcggtcgagccgcaggtcctgcagcgacgcgtctccgcgcggcgggatctcctccgacgcgccgccggcgagccgcaccagccggaacggccgccccgccatgccgcacgcggcgaccgccgcgccgcagtagcggaacagcgccgccacgggccgcgccgcgtcgaacaccctgtcgaacacgcgcccgtccgggaggcggacccgcacggcgcacgccgcctcgccccgcgccgccggcccgtcgtcgcacacggtgacgtcgacgagccgggcgacgagctcctccatatcgtcatcggcg

SEQ ID NO: 62982 - DNA, 14025 bp, Oryza sativa
gcagtgtaggagagagagagaggagggatagagagaagagggaggctaacatgtgggaccacatgggccccacctttttttattagttttgtgagtagcttacatatgggtcccatggtttttattatttttccgggatccgattgccacataagcgccacgtcactgccacatgggacgaggacctagtcaaagggagccatgtaggtgccacgtcatctaaaaccaatgctgccgagggacctcttctgcgcggttctgtaagttgagggatgcgctgtatccggttttttagaccgaggatgaaaatcagactacgcggcaaattgagaaacctaaagtgaacttattccctatttttagcatcatcagatgtacgggctgtttgtggctcatatttcttgatttaagcatatgataaatcgggtgaactctgtctggcagggtgttacatattccatttccctgctttaaaagagcgcattttgtttgtcatatccagttaattataacctttgatttggtggatagtttttttcttgaacgcgcaaaaagattacacgtcaatatattagaagaatagaatgtttgttatacgacgcaatcagtcagaccgacttatgccaagaaaggggagaaaaaaaagactaaaataaagaagagacgaaagactactgtgacggctacacacaactccaaatagctgggagggggcagagccactaccttcccaggagaaccccaaaattagcgataccagctaaagaccaaaggtggccctcagagaggatggactcaaggacctccgagaccgatgacaatgcagagtcgaaaactctggagttccgctctttccacagttgccaagagactaggaagaccatagaatcgaaactggcccggagatgccccggcaagcaaaccctagaagaaggccaccaatcttggagacagctacccccgggaggagagagggcagtccaaccaagaggcgacagcacacggagccaaacttaccgagcgaacacggaatcgaggagaatgtggttcgctgtctcaagcgaacacgcaatgaggatttggtggatagtagcgatgggacaaggtatttccacactagaatagtaggaaactttcgatttttcaaccgtcggatttgttttgagatgcatactagggggaaaagaaaaaaattcacgtagaaatgggggcaaggggaatcaaactcacagcatgctgcttgcgactgcggaagctactgctaggggaaatgattaacactaccgctaggccagctcacagtttaatcatatacttcctcatccggtacttatattattatattatagggtagaggaagtatttataatttatatacaagttacacggtaagtaattgcactaatgatattatctaatgacactatagttgcatttgaaagtttttctccttaaaaaaatgtcaaatgttatatagctactccttttccacacaccacgacttgattgatatggcttgttcaattaatttgttgccaaaacaaactataccaaaatttggtaatataattttgttagtgcaacaaactcaacgagactttaccattgtaacattgtcaatttgtaccaaaatttaataaatccaataatttttattcacaaaactatatcaaaatttagtaaggtgtcaaagccaaacaacacctctacatcttgaccttgacaaaaatttggtagtgcaaaatcttggctttaccaaaaaaatttgaaaatgtttattttggcaataaactgaacatgcccatattgttttttaatgtcacaacatttgaaacctaaattcatctagcatggtaggcctgatgccaaattaaggatgactttttttctcccttttttatggtaggcatttgtacaccacaaattcttatgtgacaatttggtttcatagctaattttccttaaggttatatttttgttgaccaaatttttttaacctactcatcgcaaagttaatcatgaatcaagcatgtttaggttaggtttagggaacactaaccctctgtcatttaaggatcaggcatacattctcacaccactggagatggattaatcggtacggttaccttgcaagctacgctgactccaactacagctcatccccttcttccctctcacaactttccctcacttgtgacaatggggagataaaggtccagcggcagttgatggtagacgatttttcttcctttaagattagacactttgtagatacagtctggatggaagaggtgtctgtagtgcaaaattgctacaccttcactcatatgcaatctagatggaagatattcctgtagtgcagaactgctacctcatctctagcggtgcactcagggattcatctgctacaccttcactcagtgtggatgcacgcttcgtggatgcgtgggcctgttcactttgatgtcattttcaaccttaacaaattttagtaaagttgccaaaaaagtggctatatttaatttgctgccaaattttggtagctatataaaaaatcctaccaaaattttgacaggcaactataccaaaattttgataatgacaaaatttggtaaggttttttttagcattaaagtgaacagacctataatctggatggaagatgtgtccgtagtgcaaaattgctacctcatccgcaatgtgttgtactcaattcttctgtacatgcagaaggatgttcgtagtgcaaaacggctaccacgtctgcaatgtgttgtgatcaaatgatgcatatgtaacgatgcactatgatgcgtagcaggtttgcataccaacatcctcacgtatgtcatcgatcctctttaattagtgggtatgtagcaacgggtaaatgtaaagatcgtatgcgatatagcgccaaagttgtcacatgagaaagaccaccatgactatcaccatattaccacctatgatcctaatgatagaaataaatacatgagattgtgtgaagtgaacacgccaaggtgtttaaccatccagtaaattatatttatggtatatatatcaatgttaaattttataagagattgtgtgacgtaatatgcggtagcgctaatctacgcgctacacgcggaatattagttcgagcgccgcacaacgctccctccttctagtttttcccttttttaccaccgtacctttactccacatcccacatttcctcagttcatttttttttgttttttaccaccacaccttccgtgtttcttttttctcttttccatcttatccgtgctttatcaaaggatccgttaaaatattaaccatctagatttttccctttttctttccttctctctagtttttctgttttcgcgttttagtaaaatatttaccgtttagtttttctttccgagttttatttttttctagtgtctccccacgtttcaaaagtaacgaatttactcctatactcgcatgaatgccctttcaaaagtaacaaatttacttgtatgaatgcctccacatcgtacgacaccattcctagatggttataaaataattactaccaacttacaacgctagcaattcttttactggtgttataaatattgtctagatttcgtggtctacgagtaaaacaatgctaccttcctctcgatatagcccatgatctcatagccaccgtgtaataatatgtttagtgatgtgttcaatacatagcataagagtaaaaactaagacttaatggtctgtgagtaaaacaattaccacattcatcttgatatagcccatgatctcgtagccactatgtagtaatatgtttactgatgtattcaatacacagtaatagtattgttaatctatatcacaaaatggttgtacgaatgaaaaaattataggctcaatcacacataagtgataaaaattacccacaagtgaatcaaactagaaaagaaaaaaaaatgattcagccaaaaatccatcgtgaaactaggatcctggtggctttgttggatcttactataaggactggtggctttgttggatcttgctataaggatggagaggttggtttgtgtcttatgacaggtagtggagagggtaaccgggtggcgagtggtagctgacgatggaataatggaaggatgtagcggcgtggtatagagatgggctcgatgttgcgcagtagcagacatccatcatctagcaagcacgaaaaaaatgcaaaaacattctcgttcatgtcatagagacgacgagcaaaagaaaaatagcaaacaatctccatcaccgacggactccaccctatcctctgtgaccagccacatggagcacgatgtgcaaatatgagacctatgcagcacatcgatttagatcagataatattggagattgcacattaatttgatttgaaaaaggaattggggcttcatgcgtgaaggtaatggagagtattgagatgtaaatcggagtgccatttccttacttgcttgttctgttaatgtcgctgacgtggagcagccgctggttgttgctcttggcctaggtgaacacctccttgctggttaaggtgctacccaacgtccagcaacgaggcccgaatcagggcctttgcctcaaccaccaccggccaccgctcgccggccatcgccgtcaaccgccacgatgtcgttgttctcctccatggtgctatagtgtgtcaccgatctatgggctgggatggtagatcaatttagatcaaaaaaaagggaaaaaatgaagtggggcgagagtggttggttgggtacgggaaaaatagaatatatatcggaagcaggaagctatttttatcgatgtaaatcatttactccgataatagtgggagtaggatgacagaacgtggggtaggatcggaagtagggaagttgtttttattatcaaagtaaatcgtttactccgataacagtgggagcaagatgacgggacgtggggtgaggtgggcggactaatacatgtttggcgctcggaatactaagaaacacgctgtgctcctaataatagtactacgtaatatgctattttattatagactacatttaacaaaactactaaacttgacaaaattatgatataattataaaatttgtcatatggcggacacagcaggggacacgtgcccccttactaaataggaactgccaagcttctctttcaatcttgtgtcgtcgtttccaacaaacactctgttattatccttaagttttctctaatggcacacaatttgaaatcaaaattcaacaagcacaaccacgatgcagtgcccatggctatcccctggagacatgaaaccatcaccgtatgctaacaaaactaattatgctcagcactaacaaagctaatctctattggctaaaatttatgtacagcattcctgatcttgtataacccacaacatttaatttgatcccattttactattctttactgaagctaatgctgaaactgatcatgtaaaccaccatcctgaacatattgcacatttctgctgctctgaactgaaaagatggtgctctgatctaacaaggcagtgctgaaactgaccctgcaaaacccacatttaattttaatctttaattatatcatacttcctggtttgttgctgatgtacctagtcaaggctgatgttgagcatgcaagatcccagtgaatttcttgacagttgacacataataattacgtatgcatccttgttgtattctcaaaataattcactctaactatatgtggcaggtctggttaatactcaaagctactagactgccataggagaaggacatggtctgagtataagaggatttatttgctagtttgacaatatagaatatttatgttttcaaactggttacacatgtttaaacatatttgtagacgaatggactatggatcatggtcccaaaatgagttcaatcatcactacatatctatatgtgcatccatttgctatatgttcaaaatgcggcacagcctaaccatccatcagaattcagatggtggtcattcctgtttgtttactcctcagttcttcttgaaccacctggtgtttgtttgcaaatcacctgctgtttgtttgacaatcactagtacttttatttgcaaataacttacttccttggtaaataaatcctcttgtactcagaattcagatggtggtcattatagaatgacaataaaccactagtacttttatttgacaatcaccatctgaaccacctgctgtttgtttgacaataaaagtatctgtaggatcgagatgtcgactagagggggggtgaataggcgatttaaaactaaatgacacataatcaaaactaacctaagttgctaggcttggtgagggtcaactctaactaagcaactaaattatgttttgcaaacctagggtgatagtgactcaattatatctctagaaaagtaaatcacactcctatgtcaatgtttagcaatcctagggtgatatgatctcaagtatgtctctagaaatgtaaattgcacaaatgtaaatgcgacaatcaaatgagataaggagacaagagatttttcaccgaggtttggaaactcgccagtttcctactccccattgaggcgagcccaactccaccgctcaaccacgaagccaccgcacgcccccttcatcaaggggtgggcaaggcgggagccggcccacggagaggactacccaagcctcgatcactagggtagttcttccttcactccgaaggtggtgaactccaaaccactcacaaaccagcaccgggcctcctccacaatcttctcggaaaggtcaccgggcaactcctccacaagctgtctaggaggcggcaacctccaagagtaacaagcaatgacccggcgtggagatgatcaatcaagtgccacactagctctacaatggaagcaatgcacttgactcttggctaattaaccctctaacacactagatggatgaacacaaagctcaagtgggtgtgagagaggtgcaaggggtgtatgcaattgaattgggtgccaagagagcccccttgctgctggagggggagtatttatacttccaccaaccaaaagtagccgttgggggcgaaatcccccaactttgtgctctgccggtctgaccggaggtatgtggccggtcagaccgtgctactctacaacggctagaaaactagccgttgtagtgttgtcagagggccccgtcggcctggccggtcagaccgaggttgagtggccggtcagactggcctcggctgaccgactacggctccgtcggctctgtatcggccatcccgagcagcaccatcccggcctccagggggccggtctgaccgcgcatgtgccgtcggtcagaccgccgttgtgtgtccacaattagtgcttctcattaattaccaaaattaacaacgggggcctagatgcttcaatctccccctttttggtaattgatgacaaacaccacaaatatatatatataatcaaaagctccccctaaacatgtgcatatcaatcatagacaacaaatatggagccaatgcacattttaatttcacatttcaacaagcacaaacacataagcaaaatttcaatgtgaacttcaagaaatattcatccatgagcataagatggtcacatatatatcaatatcacatacaccatccatcatcgcacaagttcacatcacttaaccattcaaatcacataagtcacaaatcattgctcacaaataaacataggctattaagaccatgaagggtccaaatgacatagagagtcaaacaaaatgataaagaacacacaatatagagtaatagcccatacccatacaaaatatagcctaaacctccttaacctattagatatgaggtgactaacctcactaccactaatcccaacccacaagacataaagcgcacttttctcccccttttggcatcaagtaccaaaaaaaaaggtcttcattcttgtggaggagaaggaggacgcgccgaagtggaaggatgaggagcatcacgacgacgatgatacacaaatgcttgggagctctccaacatttggacttgagaatccaatgtacccactctagtgtgcaatctccccatggaagcattcaagtctccaacatccgtgcgcaagccacgaacatcctcatgtcatgcttcatgcccggtagacaagcgttgaatacttttacttagggtattaatagccccaagtaccgggttgaaatattcattgggttgaattccaaagtaagtatactgtggatggaagaaagcatttggatcatacccatgaggaggaggaggtgctgagcttgagctagctccaagatgagaagagggcaccatcctaagcatgtggagctccaagctgaaggcggggcttgtactgcttgtgcttcttcaaattttgccagcagccccaagcttgtcttgaatcaacctcatgatgtaaggggcataatagattccctgagtgaatgtccccttggagatggcaatctcctgcatcatgagagacacaatgtcgaactgacgaccctgaatgatcgtatcgatgatgtgccaagccacccctctaatgtcatcattgttgccaaggcgagggaggatagtggctctcacaatcctgttaaccacactggggatagtcctcaatccggcaaccttcccatgtgtgtaccgcactccatcttcataaaactgagagagatagtctatggagagcggattgtgagtgtgctcctcatgcaaatcatatccaaagtctaggcgaatattgaggagccgccagaattgcctccgagagatagaacactggagggtatcggacatccacttcatctcattatagtccccagccacccacactgtagcatagatctgtcggatcaaatcttcattgtagtcttgcttgagagtcacaatccggtcaatgccaacagtcttgaagagatcctacaagccctcaaactctggagtctcgttgatgtctctccaagaaatccacttatgctctacaaatgctttccctgcataaacctgctcatacacagacttctggaaagcggtgtgaaaacggggatccggggtgtcccgaggccttaaaaactgatcatgatgcctcaagatggtatactgcgatggattcctcatgttcacatcaaactagatggagggatcaacgtgcatatcatcacttccttcatcctcatcctctccacttccactgtcatcatctccacttgcctcctcactagccccctcaatatttgcttcaacctcttcatcactttgagcgtaatcctctccgctcgattcctcaggctcactcacgggatccggagtgggcgcacaacgaccatggcgagtgcggggaggcatcactgtcaaagagcaaaggatgtgtaagcaatgattttagaaaccacatagtgaggtggacggaaacggttgtcggccagtcaggggcagtcagaccgcggaccgatggccggtcagaccgacggccacagccagtcagaccgcgagcatgccgcccggtcagaccgccgtggtgcggccgtgttgacgaaaaaaatcgaacacaccggcctgggagatctgcttagctcatgtgcaggtccaaatcttgatgagatgcgagcgtgccagtcagtttgatcctgcaactgacaagatatgcaaatagtagacaaaacagccgatcggttgacaagtcgatggagtatttccagccgatagccgataaatagccgatgctgataccagccgatagcgatagggtttaagcaatcggctatatgtccaatgtagatagtgatataaacgcaattggctgacgacgatgtaataaaataacaatataatccagtagaaaccaatcggctagaaacaagatataataagtactgatccgaaggttaaagcacacatcggctcgaggtccgatgtcatgaaatccacaagattagattaaacagtgaaacctttgttgtcatcggctaaatccaacttatatgtatatgcaatccttatgagccgatgcaacatccagataactcatcggctgaaaccccgatgaaacccttattggcaatcaagaagcaggctagagattatggttctaagcacgacttagtagatgaaactcaactgatgcagcactaagtatgaaaagaaacataatacctagacaatcaagccgttgactgagttttcagggtggtagatgtctaagctaatctaatctagcaatgcgttttagccgataccggcagaaaccctaaaacgagaagcagccgatagagctaaattgatatgctaagactagattaacagagacatatgataaataggtaggcaaatatatcatccaaaccagagcaatccaagaggtcgaatgtaccgatgcagccttgaacgatgccgatgtagatgagacaattgcctgggccgacggaacattggacttaccccttcgccggagatcgaacaccgatgcagccccgcgtcaggtgccaagtcccgccggacgataaaataaagtagaaaaggtaaaaggtggcgatgcgccgaattgtattgatcgtggagatagattacatagaccccgggtgtacatatttatacccatgggttgatacaagtccttgtcggacaagaaagaaatttttctaaagataaaaggaaaagataaagtccttataggacactaaacacactttcctaaagataaaaggaaactaacaaactatttctaattaatagataacttgccatgctgcattctctttgaactcggtctcttctggataatcttcttttagtagatcaatttccttaaccgaatatagcaagaatgcgacaactgacgacttgacaactctcatcggctaatctcaggacttcgaagccgatgctgactctaagccgatgactactccgggcttaccaaatttcactgttaacaggccggtcagaccgaccaggagccctcggtcagaccggcgagaggcagccggtcagaccgcccctagggctagccaaaccgccactgacagggtcaaccaaaaattcatccacaatcacacagttgattccaacaaaaaaatgctaggacagggttgcacaagattggaatatgaacatcaaagggtatggcctatttcatcaagactggaacaactacccatagccctagggtgaaatagatcgatttgagagaatgcacaagagggagagtgatttaccggttggaggagttgaatcacaccaagaaactaccctctattgacgcaaatcgaagaacacctcgtgcttcacctagggttccatgccatggatcaaaaactcaacaaaaacacaaacaaatccatggaatagagagaggaaacggaggagaatcacttacggtgtaaccggagagaaatccacggtcaaaccgaggggatttggtggagggatgtggctagggtttgggagaggagagaagaggagtttttttcgagttggggaagaagatggctgaatgagaggagatggagtcgggtaggggaagaagagagaaagaaaaggaagattcctaggcccaccattcccggctggtcagtccggctatatgcggccggtcagaccgctagggtgcggccggtcagaccgggccctagtggccggtcaaaccgccgccaccaggccggtcagaccgcctggcccccagccgactgtgcacagcccttgcacagttcggttacccccactcaataaaattcaacaaaaatttgatttttggagcaattttgaaatgtgtgagttgaaatattgccaaccattcataacatttgaaaattataaagatttgcaacgaaactcacttgagtgctaggaggtgaccttttatggtctataggagtttttgggcgaatttgattttcaaataacttttgaatgatttggtttttgaaataggtttgaataccaaaaacatttcaaatcttcttctctaccaactttgttttgaaacttttctcaaattccttctcaatcttattttggggataaatctcattttggccaaaactaagaatctagattcttcaaaagagggccaaaatggcatttttcattcaaaaatcatttttcttgcaatgtgaggcttggaaaacatataggaaaccttttgaaacatttttcaagagatagttttcaaattacattgattttgcaaaagctttgacttatgttgacttgggcattttgaaaatactactagcaccactagttgatttgctcacatataaagagaggtagagcacatgcaagagtgcaaaactctcccttaatgtgacatgctccattttcgcaatgaagaaccaaatggcaacaaatccaaagcataggagcaaatgagagcaaatatacataatgcaaaagaagcaaccatggtgcaccatctcaagccacattagagaaatctatgacatttaactcattcctcaacttgcaaaagcgggtttcatcaagaggcttggtaaatatgtcggctagttgatcctcggttcttatgtggctaatgactatgtcactcttggcaacatggtctcttaggaagtgatggcgaatatcaatatgcttggttctagaatgttggaccgggttattggctatctttatggcactatcattgtcacatagaagtgtgattttggtgaaggatatgccatagtccaacaaggtttgtttcatccaaagcaattgggcacaacaactacccgccgaaacatattccgcctcagcggtagagagggctacggagttttgtttcttggatgaccatgacacaagggatctactaagcatttggcaactaccggatgtgctctttctatccactttgcaaccggtataatccgaatcggaatagccaacaagcttaaacttagcaccttttgggtaccacaagccaatagtagaggaatgctttaaatatcttagaatccttttcacggccaccaagtgacattccttaggagcggcttgaaaccgtgcacacatgcaaacactaaacatgctatccggcctagatgcgataaggtaaagcaaactaccaatcatggaacgataaagctttaaatctaccagtttacctccctcatcaaggtcgagatgcccgttggttgccataggtgtcttgatgggcttcgcatcctccaagccaaacctcttcagtaaatccttgatgtacttggtttggctcacaaacgtcccatccttgagttggttgatttgaagtccaaggaagaagctcaactctccaatcatggacatctcaaattccctagacatcatatcaccaaattccttgcaaaatacctcattagtagaaccgaatatgatgtcatcaacataaatttgacacacaaagaaatcatcaccaatgatttttgtgaaaagggtggtgtcaacttttccaattttgaaatcctttgacaaaagaaaatctctcaatctttcatatcaagccctaggagcttgttttagaccataaagagcttttgagagtttataaacatggttaggatttttaggatcttcaaaaccgggaggttgttcaacaaagacaagttcggcaatttcaccatttagaaaagcacttttcacatccatttgaaatagttttatatcaaaacatgatgcaaatgcaagaaggatgcgaatagcctcaagtcttgccacgggggcaaaagtttcaccgaagtccaaaccttcaacttgtgtgaaaccttgtgccaccaaccttgccttgtttctcaccaccaacccgttctcatcttgtttgtttctaaagacccactttgtccctatgacattgtggtctctaggtctttcaaccaaagtccacaccttgtttcttgcaaagttgttgagctcttcatgcatagcattcatccatccggatcacaaagagcttcatttacatgtttgggggatccac

SEQ ID NO: 62983 - DNA, 2070 bp, Oryza sativa
ttgttgcttgaggactccccaactccatctcccgaaggtattggcacatcatgagaccccactttgatggtaatcacctccgaagtccttgcctccaccttaacacgctttccttccctcttttcttcattaacctgattttttccataaaaccggctattatttggtgaagacaagcgctcatgaattggcctccttggtcctccccacctttggttgaattgcattggaggcatatgattgaacattggcggtgttgccccccatggcatgtagtaaagataaggataacccggcggcggcattgggtaaggcccccatgacatgtgttgtgaatgatgatatggaggtgattgcgaccgtcttggtgaatggccaaatcgctccctaggaggtgatcttggtctttttcctttgttgcgagctctctcatcaccttgcttctcatacttctccaaaagcatatccaaagtcgccttagtcttcctaggagctttagaagttgaagcctcactcccattctccttccacagaccaacctccggtttctttggcactatcatctttggcctaggctcaccaatgatcacttctttccccttagtagattcggcttgctccggccgaatcaacaccttcttatcattgaaattaattgtattcaccggaaaaggatcatgatcaagcttcatcttagaaccatcggtgaacttcaatcgcccttcatccatggccgattgaacctgtcgtcgaaacacattgcaatcattagtagaatgagaatgagaatcatgccatttacaataagctcgacgcttcaattcttcttgagaaggtatgatatggcctttaggtaatctaatttgtttttcttgcaaaagataatcaaagattttatcacatttggccacatcaaaactatatttaacctcactttgccgatcttacgaggagtcggcataaattaaaaggaacaaaaggcttattttttgtaatccatgaccacttgcaacatacatatcatgatcaccctcatcttcactatcactagcttcagagtaatcaattgcattaacattaggcttcttctcatatggtctaacaaattttttattatccttaacccggctttcctgagccaaagccttttgcatgagttgactaacatcaagaaattgttggccatcaaatctttctttaataggagcaattaaaccattaaaagcaagatcatccaaatctctatcagttatattcaagctataacatcggtttctaacatctctaaatctcttaacataatcaatgacagattcattatacttttgcttaaccgatgttaaatcagataacctaagctcagtttcaccagtatagaaacaatcatgaaatctttgttccaattgagcccaagtatgaatagaatttgccggtaaagaagtaaaccatgtaaaagcagtaccggacaaagataaagagaataagcgcaatttaaaagtatcactattagcctctccagattgcgctaaaaattgacctacatgctcccatgtggtcctactatcctcaccactaaatttggtaaattcgggaaccctatgaccacgaggatatggcacattatcataataatcaggatacgacttttggtaaaccttagcacaattcctagcttcaatcccaaatttatccctaataatcccactaatcaattcctccatattatcaagcctatgttggtttggtagtggatttggttgcctaataggttggtgttgcggcgcaatatgattatattggccttgcctagtatcaggaggataccccctagaaacatcattataagcattaggaatatgtgggggaacttggggattatttgcagcagtagatacaggaggatcaaaaattctaagatgatacaaataactagcattagtcattggatctaccccctgaatcggcactattgcgccggtctgaccggtccagggcccggtctgaccagcatccagaggagcggtcagaccggcctgagtcccggtctgaccgccggagtaatactcggtc

SEQ ID NO: 62984 - DNA, 1399 bp, Oryza sativa
ttagaattctaatatttaaacaataatatctttcacatcgcatattattttttagaaccgttttattgtctcgttgtaacgtcgttttacagcgttgtgagaacggttctaaaagttactacacgatgatcgacacaaaaatgcttttataacgttgttactgcggaaattagtggtgttactgcacattgatcgtcgcgttactacgccgttccagcgacacgagaacttaaaaaaagtaaatcccaatctttagagagcaatatcgcccatgagagaggggggtgtagaatagttattctaggaagtaggggaggggtatatatatatatatatatatatatatatagtaaatttgtttggtgctccatggtgcccgggcaccattgttgaaattgagtatatacccaattcaaatgagtatgaaactttttcaattacttaggtattaacattaactactttactaactagttcaaagcaagtttgaactgaatttgaacttgtttttgttagattttgattataggtatatagcatccatatatataattagttagatatgtaatcatggattgtgaaataaagttaaatttgagttgttttgttgataagtataggtatgaatcgaattattataactaggtatatactcacaatttgaaaattttgaaaaatttgagtgattttgtgcattagataccatggtgcccgggcaccatggtgccccatatgagtgtcctatatatatatatatatatatatatatatatatatatatatatatatatatatatatatatatatataacacacaccgtaacttttaacacttaagctataattatttttttagtacacagtatacaagagaattaagataaataaaaaataattgattggctatttaggaaaagagaaagaagagatataaacatataagagagataaaaacacatagggaatcaagtaaaaatatggtatatttttagcaaaactgatttttctttttttttctttttcctttcggagaaagagaggcacactctgccacttccatcaatagaaatggaagtttaacagacataaaacgttttccaaaatatcggaatatttttaagcttttaggttaaactggttagtgcatgcagataaattattatttttacatataaccctctaagcttttatagttttattgggagtggttggaagagctagctggtgcagtacaatctatagccgcagccaataaaagcatgtaagccttatatgtaagtccataattatttattgaaattattttatttaaatatgaaaaaatgttaattaatttcccatggtaaaaggttaatcggtttgggggtttggaggaatttcaatttgtacaaataggaaa

SEQ ID NO: 62985 - DNA, 6231 bp, Oryza sativa
aggaagctaaaaaaaatgtaaagaaatgaaactaccatggggcccaacctgcattggttaccaacacattaattgttccccatttatcaagagcctggtagattaagtaatcataaacgagtcatagagtgaagaattgatataaaagtatatttaaaagtgcatttgtattacataaagaaactgcacttactgctttcatcatagaatccacatcggcttctttgaaacatctcccccgaaggtaatagcctgaccaccacatgcttcgatctggaaaaataacattataattatctgatggaactaaggatagtgtgggaaaccaaaagtagttttctatagtatgatttgtatatttgtaggtagatttctctccaaatttcgcttgaactgccctttttgaccacggcggtatggagaactttcaaattgatctaaaataactacatttataagtaaaagtagttaaatatggttgaatcaaccacagtagagattcatctcactgtttcttgctaattattatcattattattactatctactagttttgaaaataagttacaatgtgccaatgaaacagatgaagataggaatgcaattagattttaaattgctctgggttgacttccgaaatgtgcaattgttttggagttgcgttatcataaacgtcaagattattcagcaagatttgtaaatgataatactttaatgtattcctgtatgaggctaaaagacaggaaaatgaaaaatagaattaaggaaatccaacaatgatgagaattaaggaaaaaaaagttatccaaagcataaactgattgcctgtagtaaaactaaaatgactaacaaatagcattagatagtgaaaatgtccacacacacacacaatggttacgatttagaatcaccttagggttatccttatgttaagatttgacattaagtgacaggtaaccaagtaataccaaacaaagtctatctacaaatactaaatttgggaatcgacaagctcacctctttggagacttcttcagcctcttttgaggatcgggcatagttcaccaggacctgaaaggcagtggcaagtctccgaggttaatcttatcattacacaaaatataaggaaaaagagaaatggtcttttgcattgttgagaagccaagcgggtaggcaaaagtgtaaaattacatcacaacatgtctatccctctataagatatcaaagacaacaaattggaaagcaacacatactagaactagaaccagaattccaacacgagcagtaccgcacaacacaagtacacaaacaaatcatatcagctgttgaacaagctgttcagactttagttgtgacgctcaccttgcacccagcttttccaagagccaatgcagtcgcctttccaatccccctggaggcaccggtcacaataacaactggagcttccaactttgtagcatcttgcacaagtgcttgctcaacagctgcaacatgggtctgcacgcctgcagatagcatcgcttagcattggataccaagagtgtaggttgtttgaatgagtttgaaaaggaggataaattcaaaacacagctttcctgaagaaagctcttgaaaagaatacatttagcatatgaaaagatgtgaaaattttaaattaaaaaaaatgaccctggacacagaacaaagacacaagtctatatagatttttttaaaaaaaaaaatacataggaacatctgttatttccaaaacaaggcaataaacagtaaactccatcttgacaaataccatgcaaatgtctgtttcaatcagacttagttcacatcgaatgttcaactttatcaatgatgattacaaagtggcatctgcaggctaagcatatcatatcattgaagtgtagtgaagcacagctacttttcctatgtgctctattacagatgttactggtcctgaatttgatgatgccatatatatgttgatgatacagtagtttcagagtacctccaaaagggcatgattccaagctatcaaaaatagaaaaataactccgctgttctgtttccactttttaatacatttggatgtctattgcactgtagataattaggaccaaatattgttaatagctcaacttccactgtcaaatgacatttgacaaatactgtgggatctgtagattttgtcagaaaaaaatctttacaagtacagttcaacatttacattcttatgctgaagcatttggaatcatcatacagcttctgacaaaagattaagcttttgttgatttgttgcataattttccactaagacacaatacatataacaaagaactgacacctatggtcatcatcaattccattccatggcacgtgaataatgctagaatagattgctgcttgttgggttgctggtgcaagcaaagatacaaaagaataatattttatgaaccccaaataaaacattgtgttcttaatgcaccaattagtgtattagatatttcagtttgctgataacaggattaggcaaaccgtgtgatattggggaaaaaacaaagtgatgctgacttccctaacaaaaccagaccgcaagccacttcagctatgtaaggaactacttcccagtggactacaaagtagtttatcatcgaattaagatcccaagcacatagacaaaagaataaaatctggtctaaaacatactcttgtatttttttttagcattaccatatcctatttggcaatgaatttcatatactagagtatgttcttaagattggattgtctaaagtgaaattcattgccaaataggatatggtaatgctaaaaaaatacatgattttgaactaacagaaacataggctcatcaaacataagttgatccataaatataaggggtactcctacattttacaccaaatttaagagagctctccatttgatgtcaacttgtaaaataccagcatgaaattttaaaaatataactgaaaaataatattataccaggcggagcatatccccaaaacccacacgtttcacccagcaagtgcggatcctaggctagcacgagcagcgaagcgttcgccacggcgttcccagatctccatgcccgagctaacccagcacaacaacgactaagtccacccgccgctggagcgagacaaagagaggggtgggggaaaaaaaagggaagtgcggccttaccggagaagccgccggaccgcaccgcgcgcgagcgcgcggccgccgccgcgccgaacgagacgaaccctcgccgcgccaccgccgcgacggcggcgccgcgcggggccaccgccggggaggccactgctgctgctgcccctgcggtcgcggaggtcgccatgagtgcgcgtagagaagacgcggcggaggaggcggaggcgaggaggcggtgggccacagggagcggcgtggcgggcgcgcggggggttggtacttgtagccgcggcggcgtcggagtcggcggaggcggcggcggcggagggaagtttttttttttttcttcctgggtagctcagcgacgagagggcgaggaagggtagataaacccgtcggtgtcgttggggggcggagcgcacgaggagaggagaggagaggacgacgggaagaatactctattggagccccttcacacctactccatccctccttaaaaaaaaaacctaggtttccacatctaacattggatttggatcgtccgtcttattttaaaatattataaaaaaattaaaaagataagttattaatcatattttatcatctaacgacaataaaaatactaattataaaaaatttcatataagacggatagttaaatgttggatacgaaaactcagggtttgtctttttttacagagggagtaaaatgaagtgacagattaacacataattaataaaatattagctatgaaaactttaaaaaatgattaatatgctttcctatagcaacttttatataaactttttataaagtatgtatcgtttaactgtttaaaaattgtgcacgtgaagaacaaggatattatgagttgggaattcgcgggaaataacacagtcgagatctgcaagcgaaatgccccctgatttctcctgattttctcagcccgttttggcgggtggcggcagctggccaccctgatttgacgtgaacaaggctgatgatacagatgtatctgtattctgcttgcttttgatttcgattggatctgactccttttctcttcgtctcatccagggcatccatccagcacaatgggttttctcttctttttttcgtcagttttaaggacgaacttggtattattacggtgctgttttgaaactcatcgaagaagatgaagattaagacgacgcacctaaaacgagaaatctaatagcgtattatttagttaagttttaattattacaaactctttttttaaaaaaaggattttacattgttttctattaccacctatatcctccgtaaaaaaagacaacttctagaaatgtatatatataaaggattgtctgatgaaatatatgcttcttgcgaaaaatttctttatagcagttgctcaaaaatatcaaataaatctattttcagctttactataattaaaagccaattaaccatgcactaacgattttttttttgttttgcatgcccttccttaatcttcatccatagggccttagtaggtcatatttaaggcatttttctaaagagctaattgagtttagccactcctcatttttctgttaacatgttttttcaaacagcccttgcctgccagacgtaggccttgtttagttctcaaaatttttttttccaaaaacatcacatcgaatctttggacatatgcatggagcattaaatatagataaaaagaaaaactaattgcacagtttgaatgaaaatcgcgagacgaatcttttgagtctaattagttcatgattagccataagtgctacggtaacttacatgtgctcatgacgggttaattaggcttaataaattcgtctcgcggtttccaggcgagttatgaaattagttttttcattcgtgtccgaaaaccccttccgacatccggtcaaacgtcctatgtggcactcaaaaattttcttttcgcgaactaaacatggccataatgagacatgtttttcaaacagcccttgcatgccagacgcaatgaaattttggtcgccattatatattgccatggaagaacatgtacgagacaatgagagaaggaactccttaataatgataatatggcttggaaaataaactaacttggagattcaaaagtgttagggaacaactccaaagtgtttttattgggcatacatgtatcaacatggcaataatgagagaaaatccaagaaatatcattaacaagtgtcaaatttcaaaaaatatcattgacgagtgagagttccgtaaaatatcatcgtgcaagctattttatcttagaaatatcatcattgttagggtttcgttagtagccctccgttaagtactatatgatgaacaatacatttaatgatatgggatggatggaacactaacaatgagaatggttttttttttgggacaaaatcgcgtgtacgattgtattcttatgaaactcacactcgttgataatatttttttaattggacgcatgtcaatgttattttttttggattttctggaaaaatgaagagtccatattgcaagagcgaattgactagtagaatgatgttgagtgttctcacgcagatatcgtgcgtaatgatgtcattttgtgtgttttttctttgtgctgtttaattcatgcaaacgatcccgcgcttctagttatgcgttgattggacgattatatagcttgttggtagacgctaatagctgatgcccaacgaatttggaaccttggtttatagtaatacgataatgctcaaatgtccccactaatagatactaattgtgtactacatagcttctatatagtttaatagatatatctgagatattgtacataggtggtccacattggagtgtcaaacaaaatcggcataagttattttaaaaagaaaatcagaatgaaggataacaatacattgaattatactagtaaaacatgagaaaacaatagttttagtctgttagggagggggggggagaacaagagataatagactattcttataatataaaggtcgtaaaatatttcacccccgctagcccatttaagc

SEQ ID NO: 62986 - DNA, 2090 bp, Oryza sativa
taatttatgagtaaaatttcatacttatgtccgtagcgatccaaaagtaaatgctataacataaactacgatgataaaccgcaaaactgcctcgaaaatcaagttttaaagtttaaaaattataaattttggcttatacttttcccccatcccctttggtgcggaagcccgtgatgccccgtgacgtggtggtcgccgatatgtggggtccacatgtcagggactaggcccccctcaatcccccctctcgtcggcgtgatgacggcgtcggctcctcgcgagttctttctcccgccctccgccgcccgctgcccgcgcgggtcgccgatctccatatcgcgagcaaagcaaagcaggaaatgagatatactagtaaaaggtgaagtactcgagtatcttccccttccttctccttggcgtaagagagagagagatctcccgtctcgtcgtctcctccgcttccctcgcgccgagacgagtcgtccatctggcgagcagagcaagggagggggagggggaggggatcctggtgagcatccacatcctctttctggttcatctctcagctcccacccggaggagtacttttggtctggaatttgcttgggctcgttaaccctaagccttctcttctagttctagatctggaagaagcgagccttaaccttaatacaagtagtaacagtttgtttgttcccgcaaaagtttgggggttcaactgaacccccatgtcccaaggtgaatcgacatggagatttgtatattggtggccatttaggaaaatgggtgcaattttcccaccctggacaattagcttttttttctaaatgaacctcaaaagtatgcaaattaatggtgtcgattgaaatgaaggctaatccgagatcaatgtaaataagctatagtaaaataattgctcaaagcgcgatgaatccttttcattcatgcgaaattcagaggggacccacccatagtttttccccagtaaaagcagaattaatgaagccgaaggttctggaggtttatacgcaagatgaagttaagggttttatggcttctcaataggcgcctgttccagaactgagtacacaagagcatgaatgggtgggtaattcattctgactgcttcacttctgttccttccattattagtgggaattgctgctatgcttcttttatgtgtatgatcgtgtagatatgcactatattggtgttgcacatgttacaggttaaaagtgtcttcgaagtgctccaaggctttgacaccgtcttgctctactgggaccaagactgcgcccgggatactgggagaaagcacggatctatgtttcgcaccttgtcacagacgagcctcagagctgtgctcaagccttttctgtttgctgcaacatgcttgaagcaggtggagctctttgttgggagggtaagatcgtgcggtcatggaactccgacgctgagtgcatttgctagttcggtcgattcttggctaatggtgaggttgcaattcagactgcatagatttttcggggatgatgtttgttttgtccgaaattacattgttgttatgttaatatcagaggctccgcaaagcagctctgaaggaggaagagcagttgtttctttcagttgaaaggactataactctgctgggattgactgattctatgcaaggtcatggtctattctactataacattacttttcttcatcagagtgaccattactttagtcaaggacctcttactgttgtacgaaatggataactaggttagcttttagtagtgatgttgtatgttactataggtgattctagagatatcagcaactctatgtaatgtgtgatggcaaaaaaagttgcatagagatatgagattatagagacatgatagtatagtctttttttttcctttttaccattttaggtagttttctaaaagccggagaggactgtacaactgacaacctgtgttttcagtttcatgcttctttatcacttgacagactgtggttttcactcaccccataatataaaatcttatgcagtttatgttctggagcagaacatttgtatcaagttgtgcaaggagctg

SEQ ID NO: 62987 - DNA, 1582 bp, Oryza sativa
tctgaacctgcgggaagggtgaatgtctcgagcattggggcccacagcatctctttctccgaatctgggacaaagctctcatgatctccgcgtgcccttgttctgcgccagtacaccgtactgacaggcacgttatcccgcacaacccaaccgctatgacgtacatagttcttggcggcttctgccggggcactaggtcggccatcttcgtccacttccgttatgatgtgccgaccctcaagcttcttcgtggcacctcgttgcccgcgtgccctcttctgtccagcggagggttaacttgcactatcctcctccttctggttcccctccacatccctttcaacgtgcccctcctggttcccctccgcatccctctacatgttcccttccttgttcaaatactggtttggatcctctttcccatctttttcattccagtactggctgcttccctccgcgattgtatcgtacaatatctgttcctcatcgcgatcagccatctgttcatacatgaaacagctgctaagtcatgagacatttatgttttaacaatcttatatgctaacaatcatgtgctaagtctaggtgacgtatattacaggaccctagctagtcaataaattatatagtaagtctaattacaaatctaataatcttatattaaaacttaaataatcttatactaaaactcaaatagtgataaatgctaagtttaggtattgtatataccagacccctagctatcaataaattatatagtaagtctaattacaaatctaataatcttatattaaaacttaaataatcttatactaaaactcaaatagtgatatatgctaagtctaggtgacgtatattataggaccctagctagtcaataaattatatactaaagtctaattacaaactataataatcttatattaaaactaagtctaagtgtcgtatattaaatctaatagtcttaattgcattacaaatataacaatcatatatatataattacgtcacttgcctgcgcgaattccttcgagggatagctaccactccggcttgagggacgactccgacaacgtcttttctgcaagatacaaaaagatgtattaggataaacgcgaagtaacatatattgcatttgatgttcacgtttcgttcacgatcgttcacgttcgcgttcttgttaaggtcacgtttcattcacgtacgttcgttcgttcacattcattcacctgcctatattgcatttcacgttcacgttcacattcgttaacgttcgttcacgttcgttgacgttcgttcacgctcgttcgttcacgttcgttcgctcattcacgttctcgttcacgttcgttcgctcgttctcgttcacgttcgttcgctcgttcacgttagttcacgttaattcgttcgatgtcgtggcggcagcggagcggcggtgtggcggcagctggacggcggtgtggcggcagcggacggcgccgggacggcccggtgcccgcgtggcggcgtggcgcgtggcccggtggcgacgttgcgcggcggcggcgaagcgcgcggcacggcgccggcgttgcgcaacggc

SEQ ID NO: 62988 - DNA, 5602 bp, Oryza sativa
tgtgccaccggccgcgcggcatcctggcgtttccttcccctccgccgcaaccaccgtggccagttgccgacctcgcctccaaccacgcgtctaccgccgccggcatcctagcgctttcgtccccaactctgccacaaccgccttctcagtcgtcaccgcaaacaggcggccacggatggcgtcctagtgaatgtataccatgtataatgagttagggacaaataggtctttttacaacactaacggatgctaactgggctgtgatggcacgcaatagaggttaaggaaaactcgatggcatattattcaacttgacaaagtcagtggtatattgtagaagtgggcaaaactcaatggtactgagtgaattctatctttagttttacgcagttgagaggaatgagccatgaattacgccggacacggagaagtcatggcagagttaagtaacacacataccttaaaaatatactactggtacagatgatcgatcgatggatgcatccatttagggggtgtctagatccaggggtgtaaagttttggcgtgtcacaatggttattatacacggtgtctcatgggtgttcgggcactaataaaaaaattaattacataatccgtcagtaatcgcgagacgaatttattaagcctaattaatcagtcattaccaaatgtttaccgtaacattatattgtcaaatcatggagcaattaggcttaaaagattcgtcttgcaaattagtcgcaatatgtacaattagttattttttagcctatatttaatactttctgcagatatttaaatgttcgatgtgattggtaaaaaattttggggaaggatctttatcccatcgatcgaattaaaggcaacagcaacccatattaagtgacgatcagccgtcgtctgacctccacatttactcccacacattaaccatcatcaacctaccagaatgcgtgccaaactttgtttatcatttcgtacgttcctctcatccgtcatgctcatatcctttgtcccgttgtcacatttgcattatactccatccgtaaaaaaaaagaagtgaatatagtactgaatgtgacacatcctatataataaatttggacattgtgatattaaattgggtttttatgggaggaagcgcctttcgtgtgatatcacaatgcgagtgatgtgggagccaacatgcatgatttcaccggtacttataattagagagaaatcataataccatataatatacatgggtatattttcataaggaattaataatattgcgtataagtagaaaatttctctgtgtaccactgaaagttcgcccaaacccatatatgcccttaaaatttgcttattcccttctgtatccctaaatttctcctattctccttctccttcagttagttgacagaattcctatcataaagtgcattttgccctttgggtataaataaaatataaatttatgaagcatatcgatggagtgtataaatttattgtatgcgactattatctatatgagtttattttgtgagatactatttaacaaaaataatttttatctcacataacaactgtaaattatcataaataatagagtaaatttcactttggtcaacctttatttaccaaattttcacattggactagagttagacttatattttcacttaactccatatatagttaccatcatttgcactttggaccgggttttacaaattacacatagtataatagtacaatgattgtagatctgatcttatttcttttttgtgttagaaaacttagaattcaacaatttgtactaacactacagttgggtattgtaaaacatgtaatatcttttctaaaaaaatagttattaaactcaatatttctccaattttgtctctagtataagggttgtgaatgttcatatgtagtagtaatgaagtctcattaattgatagtgacggagctcgtggctcctcaccgggagaccgcacaggcccccctttgccggttcggccgggggcttggggtgaaatctcaagctctctcggtatgtggaaagaacgccagctaggaagaaacgcgagacacgggcgatgtatacaggttcgggccgctgggaagcgtaataccctactcctgtgtttcggtggatttgtgtatgaacaagtaacaaagtgtcaaccagcccccaatcgctctgggatcggatctggagaaggccttgtgtccaaaagtcctccctctatctaagtgggcaatgtcctccttttatatctcaaggggataccacatgcccctctccttctccaaactggactgttcttctcttcataaatggacggagatcggtacggctgctgtccgagtgcccttctgacgggacggcccatacctacccccacttccgccggaaacaggtgcgacgtgggattatggctgtctgttgatgacgcgaccagtgtcagaccggtcacagatcagtcatccttgtccaccacgtgtcagcttagcaacgtgcatgtttgcccttcttcatgtagcatcttgcctgtaatggttgggatgaagcctggtataaatctaaccagggctaacgtgccatctctaagagattacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgcactacgctgcatgcagcgtgacacgttcgaccagaccgcaataaatgtggttaggtgaggcttaccgtgttcacccaacccattcatgtggcgctaactccacaaggggtcggggcgcctcggccctcggggccggggcaggagtcacccgaccccccctcggggaaatcaggaggagggcggacacctcaccctcgggcccgacgtccccgaaggtgccaggccacgtgggcgattgtgtctgcctcaagcctctggtcacgatactcccggtcccatatcaccgacagtagcccccggcgttatgccagggcgatcgcccttctcaagggaagcggtcggtcgtgacgccactcctaaagcctggtgacaggtgggaccggtctccatggttgggcagaaacccaacggtctcaaatcatgcacatcggtaatggtgacttggctgtccataatgggcggtctcttcaagactgccacatcacttgagcggcgtacgaatctgggtgagccgatttgcttcgcctggagatatggtaacgtcgcttcggtcggcgagcgtaattaacgcgcgcacgatacgatctatctcgactgccacaaccgcatatccacctcatgcgccgcaagcgggcgaatgggattagtggaagcgtgggcacgagaaacgagggagcgagatagtgagaaacgagggagcgagatagtgggcgcgagaaacgaggagccgggcacagcgatggcaagggtatgaagacaccgaggaaaggatttgctcccttcctttcgccattattccccttgccttcgctgcttgagccctaactctttctctgctgcgccctaccttcgccacacgcgctcgctttcaatcacctcttcctccggcgccatggcacggggctccgctctgctcgacggtagcgtactaccgccttcccgcattgtgagcgagaggcatgccgggctgccgcgccgctttatgccggaatctgccaccggccgggagatagtgatgctgggcgagggacgcccggcaccagactacccggggcggtccgtcttcttcctccccttcgcaatggcagggctggttccgccattttcttctttctttatggatggcgctggaagagttccctcccgggaccgaggacgacgcgcgcgcgcgggtccgggatgccgccgaccacatcgtccacagtttcgaggggtcggcccctcggctcgcgttcgcccccaactccgacgaggagggcgatgccagcggtgcagacgatcgtgacgacgaggccggcgacccgggcgcatcggactgagcccccaggcccccgccagactccagtttttcctttttctttcttctaaggccttcatgcctcttttttgtatagatcaacttaatctgcaatcaaaaatgatgaaaaaattcgtgtcaattttattttgctatgcgtatgagatgaggatgatctgtgccgtggtcctcttttgtgtcttagcttgatttaagggctcgtgcccaagtcccagtcctctaatggctcgggtcggggctagtgcctggggagatccacatgtcgaggctggccaggccgggaacgtggtgaccgagggttatgggtgacccgattgtgggtttttgccgattcccccccgaagttcaccacgccccggggcacggctcggttctgggccccgtttggcgattttagctgaccgaaccgagcccccgagggcaaggttgagcacgagtgaccttatttcaagtcaagattcttcaaaaggaaaaaacggcacagacacaacctttaggaaattgaaactgcttttattgaaatgctgaaataagagaaataagaatgtgcatgcgtggtagcccccggccaaccctgcacacccgaggggggtgcggggttggcccgagccaaaacctgacactcgacccccccctcaggggtagaagcgacgaaggtgttcgatattccacgggttaggcagctccgtgccgtcgcccgtggccagccgtatggagcccggcctggggacaccgatcactcgatacggaccctcccacattggtgagagcttgctcaatccagcacgcgtttggacgcggcgtaagacgaggtcgtcgacgcagagtgatcgggcccggacgtggcgctgatggtagcgccgcaggctctgctggtagcgcgcggctcggagggccgcgcgcctccttcgctcttccaagtagtcgaggtcatctctgcgaagctgatcttgatcagcttcgcagtacatggtggcccgaggagacctcagggtgagctcggatgggagaaccgcttctgcgccgtagacgaggaagaaaggcgtttccccggttgctcggcttggtgtggttcggtttgcccagagcaccgctggcaactcctcgatccacgaatcgccatgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagtgcagagtgcttatcgatcttgacgaccggataagcctcgggccacttagtgaacttgtcgatcgcgacatacagatactcaaacccgcccggggcccgcttaaatggtcccaggatatcgagcccccagacagcaaatggccacgaaagtggtatgatctgcagggcctgggc

SEQ ID NO: 62989 - DNA, 27034 bp, Oryza sativa
gtggatcccccacatgttttggctcaagacaagaaacaaacgagtaatgttcacaaatcgaagcgacacgagatcgagtttgaacacccttacttatgtcacccaacacttggtcaattgggtgatccttggaaagagcggtgtgtatccttggaggcataggtggatcttgtgctttctcctcctccacctcaacttgagcttgacttggcgtagcggaagtagatggcttatcttgagtggaggtggatggcttgtcttccacttcaataggcttgacatctccaatagacatgttcttcatagctctcatcaagccttcatcacctacatcatccaaattctcgtgcccctcttgggagccattagtttcatcaaattgaatatcgacgatttcttccacaatacctttattcttgttgtagacccggtatgccttgctatttgaagcataacctagaagaaacccttcatcacaccgactttcaaatttggttagtctaacaccctttcggtaaatataacacttgcaaccaaaaactcgaaaataggcaacatttggcttcctcccaacaattagctcataggaagtctttttcaagagacgatgcaaataaagccaattggttgcatggcaagcggtgtttatggcttccgcccaaaaggaatcggaaacaccatattcatcaagcatagtccttgccatctcaatcaatgtacgatttttcctctccactacaccattttgttagggtgagtaggtagcggaaagttcgtgtttaataccaagatcatcacaatagtcctcgatattggtattcttaaactcggaaccattgtcacttctaattttcacaagagtgcaattaaattcattttaatccctttttgcaaactttttgaaaaactcggcaacaatagacttgtcatgcaaaaagaacacccaagtataacgagaataattatcaacaatcacaagacaatgactattaccaccgatgctcttataggttgttgggccaaacaaatccatatgcaagagctccaatggtctagatgtggacatgatactcttagtaggatgagaacatgcaacttgcttgccggcttgacaagcactacaaagcttatctttctcaaacttcacatctttcaagcccacaactagatcacgttttgaaagtttgctcaattgattcatgccaacatgggctagcctcctatgctaaagccaacccaatgaagtttttgcaactaaacaagttttcaaatttgctttactagaattgaaatcaaccaaataaagatttccatatctaaaacctttgaacacacaagacttgtcaagaaggctagaaacaataacttcttgcgggaagaaagcatatgacaagccaagatcacaaatttgagcaactgaaagcaaattgaaatttagagatttaacaagagagacattatcaattgacaaatcattggagatagcaattttacctaacccaattacctttcctttgctattgtctccaaaagtcactttctcttgttcattccctcctacttcaaatgtggtgaacatagccctatcaccggtcatgtgttgagtgcatccactatcaagcacccaatggctcccaccggtgcggtagttcacctacaaaagaagatcaagctcttttaggtacccaaacttgtttgggtccttggaggttagagaccaaaactttgggcacccaaatgacattctttttaccaccgagtataggggaacccacatatctagcaacaatgctaccatcatgagtcttccaaagcatataatgagaatcaaacatgcatatctaaatacatatcattgctcttgacaaaacgagtggcacggtgagaaggtttcttacccttctttggaatgaatccaagtccctccttgttaaggatgcaccgttgctcactcaaaatcttatcaagagtgttcttacccttgaagcacctctccaaactcttgttgagcttggccacttgctccttaagctcattgttctcaacaacaagtgaggcatcacaaatagaaatacaagagctagagctagagctaggcatatccacaagaccatcacaagaggtagaaatgctagatgatgcaacatgagcaatatggcaagtagcactatcatcaagcaaatcacaagatatgccaacatcaatgagagctccatgttgagtagtggaaaggaggttgtcatgagcttccttaagcttctcatgagaaatagtgagtctctcatgagaggtctttagttcctcatacaagacctctaaagaagcatgatccttttttagggccttgaacttgacaatctccttctcactataagcatggagctcctcaaacatactcacaagctcatcataggaaacatcatcacaatcatcatcactctcactatcactaagagatgttaccttagaggagccctttgccatgagacaaagtggagcgaagagtgatagagcctccttgatggcaacaacggccatcttcttcttcttggagcttgcatcctcaccaccttcttcctcggacccggatgaggcggagctctcctcatttgagtcccattccccgatgaatgcctcaatcttcttgccttccttcttgagcttcttcatgagcttatagcctccactcttcttcttggatgacttgtctccatcatccttggaagggcacttggaagtaaagtgtcccttctcaccacactcaaagcacttcaagttggagagagtcttgttgggtcttctatttcttctcctactggagttggagccccttcctctctcctttctccttcccaagagatcattgaaccttctagtaagaagggcaatctcttcctccaagtcctcattggcttcattcactttgcccttgcccttgtcttcaacttcggcttggagagcaatgcacttcttggaaggtgaggcttcctccatctccttcttcttcaacttgtacatgtcattggtgttgatcttccccaagaggcttgcgggtgtcatccttgacatgtcggagttgatgagcatggtgacaagggtctcatacttccccggtagagccctaagcatcttttgggcaacctcaagatcggtgtagtttgccccaagccccttgagatcattcacaatgacattgagcctcccatacatgtcattcacactctcatgaggcaacatggagaatgtctcatattggatcttgaggaaatgaagcttggcatccttgtactcgcttgtgccctcatggatcttcgccaacttgccaacttgttccaaatctcatatgcggtctcaaggtggctcactctatcaaactcctcttggctcaaagagttgaacaaaacattcattgcttgggcattgagttggaggttgcggtgatcaatctccgtcaagggcgtgccggtgatagcaaagcctacatccacaatactccaaatatggaagctcatagctttgaggtgagtagacattttaattttccaagtggaatagtttgtgccattaaatatgggagccttccctacatggttcacctcgttcgacatcttctctctaggcagtgaaacccaatcaagagagaccaagctctgataccacttgtaggatcgagatgtcgactagagaggggggtgaatagacaatttaaaactaaatgacacctaatcaaaactaacctaagttgctaggcttggtgagggtcaactctaactaagcaactaagttatattttgcaaacctagggtgatagtggctcaattatatctctaggaaagtaaatcacactcctatgtcaatatttagcaatcctagggtgatatgatctcaaatatgtctctagaaatgtaaattgcacaaatgtaaatgcgacaatcaaatgagacaaggagacaagagatttttcaccgaggttcggaaactcgccggtttcctactccccgttgaggcgagcccaactccaccgctcaaccacgaagccaccgcacgcccccttcgtcaaggggtgggcaaggcgggagccggcccacggagaggactacccaagcctcgatcactagggtagttcttccttcactccgaaggtggtgaactccaaaccactcacaaaccggcgccgggcctcctccacaatcttctcggagaggtcaccgggcaactcctccacaagccgtctaggaggcggcaacctccaagagtaacaagcaatgacccggtgtggagatgatcaatcaagtgccacactagctctacaatggaagcaatgcacttgactcttggctaattaaccctctaacacactagatggatgaacacaaagctcaagtgggtgtgagagaggtgcaaggggtgtatgcaattgaattgggtgccaagagagcccacttgctgctggagggggagtatttatactcccaccaaccaaaactagccgttgggggcgaaatcccccaactttgtgctctaccggtctgaccggaggtatgtggccggtcagaccgtgctactctgcaacggctagaaaattagccgttgtagtgctgtcagagggccccatcggcctggccggtcagaccgaggttgagtggccggtcagaccggccttggctcggtcagaccgccatcggctcggtctgaccgactacggctcagtcggctttgtatcggccatcccgagcagcaccatcccggcctccacggggccggtctgaccgcgcatgtgccgccggtcagaccggccttatgcgctggtcagaccgccgttgtgtgttcggtcagaccggccaggacacgacagtcagaccgccactatgtggccggtctgaccgcccctgatcaggccgaacccagtgaatacaaaggtgattgtgtgtgtgtgtgtgatgaaaatgtgagcacaagtgaaaatgcaatgacctaatgtggcaatttaatcatctctttgctaggtcattaccccccttgatagtacgcgaaactaacaaataaactagcaaatttgatcgcccttcacctcgatcaattttaaaactaaaactctagttttaccgttttcttttcttcgctccgcgccatcaaatcttaatccatcgatagtcatccatgcgcacacatgacgtggacctaacttaaaatatgtctcaatagcaacggttagtccacaattagtgtttgtcattaattaccaaaattaacaacgggggtctagatgctttactatcgcccgccacatccactacatttttgcaaagaaccccctggcgaggctttcctcttctcccattgaggggtcagggccatcaggcacacaaaacattttcctgtcgctgcaattgaaggggatgccctcaacggccgcggcagcgacgccttctcgccgtcaaatttgaaacatacaacaatgaatcaagtaacgagtggcgtttcaggttctctccaaaaccaaatctttaaattttttcgctccccctaacttggtcctcaactaggcttgtagatcgcggcggctgatagcggtcgcatcggtagcacgatggcagaagcagcggcagcggcggaggcacaggcagccagaaatggaggctaactctgtgatgtgcccccttgctcccgtgccctcctgcatcgatccagccccatgagctcacttttttgatgaagttttcccagagcagccaatttgttgaagcacactactagatgatgtgcaagaacaagattttttataacaaccattgctacttctaggtggttcgcaagaacagtaattagcaataacaagaatcaagaaacatgttgacaagaatttcttattttgaaccattctgaattttgagaagaaatatggttaaggctgccaatttgtcctagttgtgaagctagatgtattgaagaatcttgctgtataagttgtaaattcatccaataagcagctggtgattgacaacatgcatcttttattacttttgtttttccttttttctatatttgagagatgtgccagcaagcaatacactggatgaaaaatcttctaaacccctgaaactgaatgcaatggtttctgaaagactgttgatatgaatataatagattttgtttgcttatccattcaagtaatagcacgagcatcatgtttaattatatgaacgtgctagtcatcttaattaatatgcatgttctgaaggctgaacgcctgaacacactgatatactttgcactaggatcacctaggttagatttagtcgggtggttctatttgggattgatgaacgacattgtagatgaaagggagaggggtttagataccgaccggttgaggtgttcgtggaggaagaagcgccggacatcgtcgttgtcgtcgcagcttgacgtggacggcggcgacggtgtgcttgacggcggcggttgtcgttgcagcggtggtcgtgggcaatcccggcgaggtcgtggcgcggcggtggcgtttcccgtcactagctgcgccccctcgatcggattagagtttgtagggcggagttggcggcggcgacgaatctcgtaccttgtgccgtgccgacctccacccctcttttatatggcgcagtgtgacggggacccaccagccattaggctgggcgcccccgatcagggcgcggtcaaggtccgttgtgccgttgggcccgacgggtgggagatctatctaacacacatcaacaaagaaaacgaggtaagcaaaagaactgggaaatcataacatttactttaaaatgaactgaattatcctgtcaaatactaagttcttgtgttgaactgaattatttttcagctgctagccgcttccatattcttttgcccccatcatcatttaaattgcttgcatatattgcacaagcgtacgtgttgttttaaactcttccctgctaggatgacaagctcctccagagtctccgtttttgcttcaggcaagaagaatcgagggagaatgaacgtgtggggaaaggaatttttggaaaacgatgagggccttgagccgccgctggaagacgatctggttgatctgaataatcgtgggatggataaccaagggtcagggggttctttgcaaaaagtagtgtatgtggcgggcggtttttttttttttaaattgctgcatccggttggcagcccttggattgagatcgagaggaccccattgcacgagtgcatgtgtgcatatgatggctcgtgtgcacctgatacgctgccgtgctaagcagctgcttggcgcaatatatatgtaacaatttgagtggtttaggccaactcaatttgtgaaaccatacttaccttgcaagctttcatatcagcatttcttaaaagtttaaactcggtgaatagtcattgggattcgagcataaggtcatattcgtttggacacttttctaacttttcctccctcgtacgtatttatagagttgatgaaatgccgagatgctaattctgcattaatcgtcactgccctataacaataatataaatacgaaacccccatgcctcatcatgacgattctcaaacccgttcgtgcacggaccataagcgcgtgttggccaaattaatagggtttgcattatgcaaagtctaaagacaaagcatttgcagcctacttccagctaaggatgcaaacaggtcaacccacgaacccatttatagacgaaattagtggataacccactgattgattcacaggttacctactaatttaatctataaattaatttattatatattgaccacttactccctccgtctcaaaataagtgcagttttgacaattcatgtctaacctttgaccgttcgttttatttgatttttttaaataattagtatttttattgttattagatgataaaacatgaatagtacattatatgggactaattttttttatttttttcataattttttcaaataagacggacggtcaaacgttggacacggatacccacgactgcatttattttaggacggatgtagtatatctctaggtgtgacaaaccaaaccaccacgtgaaaatttacatgttaccatttacatgtaagtaaattcgtggatccgcttgctattttagcaggtcagcactccgcacttcagtactctctccgtttcataatgtaagttattctagtatttttcacattcatattgatgttaatgaattagattctataatgacttatgctgtgaaacagacaaagtactcagcacacgccgccttcgtatgcgtgccgcgacgtccgtcgggacagggacgacgaccgggtgtatggaggcaacgtgccgcacccgcccccaccgtccggacgatcgagatccacgtggaccggaagactttcccgcttcgcgtgaggcggacggccgcgggccgcccggccggcctgcagccctgcacacgcgctggacgaagcggccgatctctccacgcgcgctaatccgcgcgccgcggcgttgcaaaatggcagcctcgatcgctctcccgtaccacgtcgcgtacgtacgcgcgccacggtaacacgatacgggagctcaccgatcggccggttggtgggggtggggtggatggatgtcacggtgaaagtagcagtggacaagttgatgttgatttggctgatgcgcaaaaccaagggttggtttggcttgaggcctatattggccttaccaatatttagcaattttaatagtgtttattgtctatttgttttggagccaaattttagcatgcctaagaaaatataccatttcaacagttaatttaggctattttggcttcaatccaaacacaattttatttttgccaaaattagccatgctaaaagttaccaaaatttgatattgataaaaattggtaaggctaatttaggccaccaaccaaaccagccccaagtcaacactcgagactagcgtgcacatcggttcggttcaggaatcaggacaggagggttcactttggttgtatcgcacgttctggaagcggatgtacttagtattactgtgagtacgctctagtgctctacacactggaagagccacttgtggagatcaattacaaagagccaatgtgccatgttcttgacttgaggacgtcaccacaaaccgttatcaacttgtcgacttgtgagttgtggcgaccttcacaaaatgcagtacaaaccggccgaagtccacccacctgcacagcagaaataaatatactactagcacttatatttaagcatcctttaaagcacagaattttgcaggaatcagtcacattcccaacaagtctttaaccccataggtacggagtgagtactccgtagcttgatatacacctttcgtttaaaaaaacaatatttactataaaactgaacaggtatatttccagcttcagtttgtatcaggttatttccggacctcataatttgcaggacagtcgggacagacagacaatcgacgcgtgcacactgtccgtcaagcctacagctgcgtgcgttctccccagccacgcacgacacgaggttcgcaagtccaacccacgcgccgacgcgagacctactcgaaacacctggacggcccggatcccccgcccgcgcccggtcacggacgccaagacgccatctcgtctcgtccattccaacccctccaaacccaaaccccccaattctgaccgcgcgaaccgcgactcgcgccaccaccagaccagacgacacgacacgctgcgccccaagtcatataccgcccgccgcgacctcgtccaacaaacgcaacgcaaacactcgctcgatcgccacatgccgacgcctcgtcctcgccaccgccaccatgcgctcccgctcgcgctcgcgctcgccgcgccgctgctgctgctagccgcggcggacgggcagccgaacgagtcgagggacaagaacaacggcggcgggggaggtgggttcatggcgcccagcggcggaggcggcggcatgggctctcagtcgccgagcttcagcgcgcccatggtggtgctcctcgtggcgctcatcgcggccttcttcttcatcgggttcttctccatctatatccggcggtgcggcggcgaggcctccacggggccgaccatcccggccgcggcgctggcggcgctgtcgcggcaggagcagcggagccggcggcagcgcgggctcgaccccgccgtggtcgagtcgttccccaccatgaagtacgccgaggcgagggagctccgcgacggcggcaaggacgccgtgctcgagtgcgccgtctgcctcagcgagttcgacgacgacgaggagctccggttgctgcccaagtgcagccacgccttccacccggactgcatcggggagtggctcgccggccacgtcacctgccctgtctgtcggtgcaaccttgcgcccgacgcggcggcggcggaagcgaacgtcgtctccggcgaggtggatggggagcagcaggaggaggaggtggtggtggccatcgacgtggaccgcgagggcgaggaggaggacgaggagaggcggagggaggcgatggagctcgagaggatcggcagccagcgccgcgcggtgcggtcgaggtcggggcggccgctgccgctgccgcggtcgcactcgacgggccactccctcgccacgacgcggctcggcgacgccggcgacctcgagcggttcacgctgcgcctgccggagcacgtgcgcagggagatggtcgccgccgccggcgaggagagcctgcgccgcaccgccgtccgggaaggccgcgtcggcggcggcgcccggagcgcgcggatcgggcggtccgaccggtggccgtcgttcatcgcgaggaccttctcctcgaggatcccgttctggtctgcgtcgaggagggtactcgacgccgcggaggccggagctgacgccgccgccaccaccaccaccacgacgccaacgtcaacggcgaggaccaagcgtgacaagacggccgccgccgcagatggctccgtgagctcagccaagggcagcgtccgcttcgactgtctcggcggcggcggcggcggcggcggcccgagcaacagagtcgtcgccttcgccaacgacgacgaggaggatgacgacgagaagccaatcgcccggcaagtttgagctcgcgccatgcgcggtggcggcgccagtgcatgcatcatctgatcagaaaaccaatccgcggcggcttctcgcagcgatccgccatggctggaccttcgatgaatcagctcgtgcacggacacagatcactagaaaagatcatcaatttgagttgaaaataccactcctaaattagtactagattgttaattatacatttttctctccattgcttctttggatagagaagtggcgtggaaacgttcaaagatccaatttttcttcccctccgttgaaaaactggagcggggttgtacttgtaccggcactgtattcaaatattcatgtgattattcgtatccttcaaacgagcttaggttgctggacttatcaaacactcagctcaagcatgccagaatttgtttttttttgtttttataaaaaaaaacactgatactagcagtgttccctccaaatggaaattctttagcacgttttccctccacatggggattcgttcttctgatcttgagttagttgggggagtatgattgatggcctagttgaagaagaaattacgcatgcagtgacatggtcatggtctgcaactccgcatcagctcagacgatgcaattggaacgtgtcgtcagtcaaatgatgcacttcccaactgaattctcaacgccgtacctgtacagtatcaacttattacatgtcatcctcatttataattattcgttatgaattatgatatcaggagctgcctagcagtacttcgtttcccaaacggcatagcataaggtcggaaaaataaactatgatgaaaaaactctaaaatcaactacaaattttagattaaaaatttaaattttgacttacaagcataagcgaaaagatgaggatgttctcttctcctggctaggaattcaggcccagtttgagattgatgagattaagattaagtaaacataaaatgagagagccattagtgaatcattaatttactaatcattaattgagttttaataactattgcaaagttaaaaaaattgatttgtcgtgaccttacgtcacggacaagttcggggataaacagaaaaattcatttttcctgcctatcctaagaaataagctcaaacacaaaatgcacaactttggtgattgatattcctctattaaattatgtccccccttgctacaagatttcggcaagcttatatagcctatagccccgtatatgtgagattacaactttgcccctatgggcccttgtgagtttatatccttaccatgtcagcaaccctaagggcattttgctatattttggaggtcattatggtcttttgacgtcagctagcacgagtggttgcgagtggtccccgtggaatcttcttttggcatctttcttgtccaagtagtgttttccctcgagttattacattgagcgtatttcccatcttgagtcgtcttttttatctcgagggttcgaacacttcttcccacctacctggctctcggaattttttttgtcactagttagaaatctatctaaacaggacaagttgtttcagtagcacaaaacctttcgaatagaactttccgactcgaatagtactttaccgttcgagtagtattttaccactcgaatagtattttaccgtttgaacacttagggtgtgttcgctagtacaggttcccaactgggaacagcacgtgcaaaaaacagagcgatccattagcgcatgattaattaagtattagctattttttttcaaaaatagattaatttgatttttttaagcaactttcgtatagaaactttttgtaaaaaacacatcatttagcagtttgaaaaacgtgcgcgtggaaacgaggaagagaggttgggaaaaggaggtgccgaacacatccttagagttttcaagacctccttttctttagtattttgaccaaatagggaggatggtgttgaccccgtgctacaacatgatttatttgatattttaaatcaacttctatataaaagtcttttgtacgaaagacaccatttagcagtttaaaaagcatgttaacgaaaatcaagatagaatctatatctgaattagaaaaaaaagaggatggatggtgaacactgcttttctttttctttacacgcctttcaaagtggacacaaaatgaagtatacttagataagaaactattccctctgttcccaatatttatcactatgcactatttaaatttcaactttgatcgctcagtcttttttacaaaaaatttaagaaacactcaaacaccgtttaaaaagtattaccatatttgtgtcctaaacataagaattaatcttccgtttatcgcaatctaaccatttaaaaattattagcggaagtattgataaacagagggaatataagctgatttaaccctaaaaaatgcgattatatatgtcgtgtctgcttttacccttcccccttttgtttcctctgtatcatatataccaattttatcatgtgactttgaagagaatttctctgctgatcgtgcaaacgctaatcacagttctacaacaacaaaaggaaaaccagttgtgcacaattgtcatcgtaccacaacatttcatgatgtactccatggccaaacgcccaaacggtacatgacagtataggagtactgaacatgttggtttcactataatacctgaggagatgttgacctcgatcttctagaggcgagaaaacgactcttttgactcttgaggtgagtgttagctcctccaagcctacaattaaacaacgggggaccctagactctgaaaattcatgtccttctagatactgatgcgggtgaagtgtgaactgagtgataagaaataattaagactcggcacatggtcagttggggcagctggttatgtgcaaactcttgtcattttcttccccatttcagtaacgctaggtcatttttcagttttcacgaagcttttcttctgaagaacttggtctttctttctttctttctttttttattctgaacgtatgttttcacaaagcatggtgattctcgcacttatgtcgatactccctccgtcccacaatataagggattttttgagtttttgattgcaacttttgatcactcgtcttattcaaattttttttgtaaatataaaaaacgaaaagttgtgcttaaagtactgtagataataaagtaagtcacaaataaaataaataataatttcaaataaatttgaataagacgagtggtcaaacgttgcaagtaaaaattcaaaatccattatattatgggacggagggagtatttttctataggaaaggtccaacttatacgaccttacacacttgtggttgtaggaaaatcaatgctaaactacataactgaatattttacagccttagacccataaaattctactttaaagactttactttgggggttgctatgtcaactggaaaattgtgatgttgccaatgccaaaaatttaagagtaaaaagtgaacaacaataagaaagggaccaggcacttttatgaaaactagtaatatatccgtactttgtaacggattagaccaatataattagggaattgcctggctgggtggattgagaataaattattggatcagtggttatgtacatgcgaaggagcggacctcttacgataaaagggacatggaaaaaagatgactgcacttttaaagtaatagaaaaaaaaagagaataataggcaaatacatttctgggtttgtctatagagcatttggcttggtagtattgctcaaggttctgaccgattgaaccacggttataaaccttagaaaaataatttaaaaaacccttagaaagatgaaagaagtttggagaagtggagaactaacgcaaagaaaacgtgcgctatagtatccggctcgttttctttgctgcgttccctagttgctcgtgcctgctcgcgccagaggtagcgaggcaaagtttcttgctacctcatcctcttcttgccgttcagaaggagcctcccatgcgacgagcacgtacatcttcagccagacatacaaataagggccccgtttagttcgtgaaaagaaaatttttaggtgtcacatcggatgtttgaccggatgtcggaagggttttttggacacgaatgaaaaaaataatttcataatttgcatggaaaccgcgagacgaatcttttgagcctaattaatccatcattagtacatgtggttactatagcacttatggctaatcatggactaattaggctcaaaagattcgtctcgtgattttctctctaactgtgcaattagttttttcatttatctatatttaatgtttcatgcatgtgttaaagattcaatataatgtttttgagaaaaaaatttgaggaagtaaacggggcctaagtcgacccacgaacccacttatacacacctaccttcacggcttcgcatgagccccttccgttgtttcgtgggctatagctccacctgtttctcttttgggcttggctctagcgccctctgctcttcctcctccaccacgcaactacgaccaccacctagtaaggcctgccagcgacgctgcgccctggtgtgagtggcgccacctagatccacctcctattctccaatgcaagggccactcgagcccactggaattgatcttacatttcttctctcactgattttgaaaactttaagttgaaattttttaaatcttgatttgaaaacttttaaatcttaacttaaaaactttcaaatttggacttgaaagttttcaaatctcgagttgaaagtttttaaatttcgagttgaaagttttcaattttttccttgcaaattgaaatttcaagttgaaaatttttaaagtttgaattgaaagtttttaaaatttgacttcaaaatttaaatcttaagtcaaaagtttttaaatctaacttaaaaattttcattttgttagtaaaaaaaatctcaggaaaaaaatatttcctaattactctcattatcgttaacaaacagagttagttacgtgtaacaaccctccctccagaaccgtgtagccagcccatccgacgagcggacccacttacactttcgtcatcgcttcatgtaaaagggttaacccgagagcagtgttgtggaaaacggtgttaacggccgttaatacgtccgataatacggatacggagatcagtccgtcacgtcacgccgatgcggtcatcattagtcggtaacgaacgcataaatccgatcattaccgattaaatcgtccgtctccgtctaatcagccgtataatcggcgtgatgacaaaggtcgattccacaatccagctcattagctgtgccctttactactattgactagaagtttgctcttccgaaattctcacaaggcagcaagatgtaaaatgacaaggaactgacttcctctaaagtttgaacatgagttccttgattttgacgatgatcaggttattggagtttgtatttgatgcagccgatacatatgctatttgggaccttgattacggtcatttatgctatgtactacattctcttgataattcatttcatgcattatgaacaaaacccatcactacgtcagaattgagatatacagtaacagctatccattatgaacttatttaaatatcatatatggttattctatttaaggatatatagaaggaatatattaagttatatgcatttgtttatcaaaaagggaaaactattatcaactatgtacatatattttcaaaatgttatatttccgccaaattccgattaatcgtccgcattccgattaatcgtttagcggtaccctctccgtccgatatccgtataccgtcttccacaacactgcccgagagtgctatgtttaaagggacaagatcttataagttggtttcacccttgctaaactagcagggtgatactaaacatgcgcatacagcttacatgagccacacatgccttatccaaattgtaccaggatatcacataccatatccacaaccgcccccgctctagcggctacaccaaatgttgtgccgcccatcgccatttcaattaggagtgggcatttagtctaaccgaaaatttcggtctcggtcttcggtcttttcggtctttgaaaagtgaagaccgaatttcagcgaaaaaagttaggaccgacaaattcggtctcggtcccggtcctgaccgaaattcaacaacattttcatatatacaaagaaataatagaaattttcaacacaaaaatcacaaaaaaaattcgtaaacacttatgagtaaagactcttattaggttgcatgcctagaaaaagtagggatgtgaaaattagagtttaatcctattaaacatagtagattgtaggttgtatttagacattttttgaaatttggtcttttcggtatattcggttacccgaggagactaaccgaattgaccgaataaaattcggtctttcactacctaggaccgaattgatgaccaaatttctcagtcttggtcttttcggttcggttttttttctgcccacccctagtttcaatgcatatgcgacctttctctaatctttatgaccagtgaacttttttcttcctccattttactttcctcacctaccctgaaactattgtcctcaaccaatcctaccaatctagcacctgaggtcctgggttcgactccccgtgggagcgaatttttcaggatttaacggcgttgtgctttcagtggtagtcgacgtacccgtcgacagcgaggcgcctgtggtgacttcgttaatctctccaggatttgccgggccagtctttgaagatgctcataggggtagggtttacatgcgtgtgttcataggggtgagtgcgcgtgtgttgtgagtgtctgcgttgtactgtgtaattctcaaaaaaaaaatctagctatctcgttggaggcgcttttgcagccgctcgctctttagagattgattgccaactcataatggaaaaactcatttatctttttattagcttatttaccagattattgaaacgagttatttgttccacttttttaaaaaaactttcttctattgcacttcttagataacttattttgagctatttattaattttttttgaaatatttaatttaccattataattaacttaaaaaatccgtgacaataattcgcttgataatataaatcattttgagttcaactggtagtagggatggcaatttctctcacttcatgtggggccagggccgaggctgcaacggggccccgaaatattgagcaagagcaacctgcttgctatcaaaagccatgtagcccacttaaattcgtaacaaatgcagcccaagtacttgccattagaagcccatcaagcaagaagcttatgcaggaagttttggtgcagatatagggctggttcactttgataccattttcaaccttatcaagttttgacattgctaaattttgataagattgccaaaattttgataaggttgtcaaaattttaacaaggttgccaaattttagcaagatttcatatgtacttagggctggtttggtttgtgacctaaattagccttaccaatttttgtcaatgctaaattttagcaagttttagcatgactaattttaggaagacaaaattgtgtttggattgaagccaaaatagcctaagctaactattgaaatgaactattttcttaggcatgccaaaatttggcttcaaaccaaatagacactaaacactattgaaattaccaaatattgataaaccgaatttaggcctcaaaccaaaccagcccttattaaaatttggcaacaaactaaacgtagccaaaatttttgtaactttgcttaaaaaaataatatggttaaaaatgatatctaagtgaacagccccataaacacaccagcaaaccctggcccatcaccacagtgcatcgacgccggcggcgaacaatcatgtgagctgaaaatagtcccttgctcgccgccacacgccgcaacgcgcgattcgctccctttccgcccgctcgccgccctgtgcttaaagtgctttggttggtttccgcccgcccgccactagcgccatcgagctttccctccatcccgatgaagcgatccatactgggccgccagcccacctacgccgttgaaacccaaaacctctttcttctccggggaatttaactatttgccacttttacgtttgccaattgttcaaatatcccttttaggtttgcagttaactatatgccattggagagagaagtttttctaattttttgccacttttcgcactgtacaccgccacatgggcttgctagcgtggaatgggcacctgaaatgactagtatacccctgcatctgaaaccctaaatcaggggatcctctctctcccgattccgttcgaccgccagccaccatcgacgggcgacgccgtgccgtcgacccctgcccgccccgcgtcggccccgcgccgtcgacgccggcccggcgcgcgacatcgacgcccgtcccgcgccatcggcccctgctcgcccagcgtcggccccgggccgtcgacgcgccgcccggcccgccggctcaccgccccacgccggtcctgacgttctccacccgcagtccgccgtcgacgcatttgtcagatccgcagctccggcatcatcccggcatttgttcttccccaacagcacatcgtgacctggtagggcatcgtcgccatcgtcctccggcggcgatgaagccctcagtttgtccttcttggtaagttcattttctcccttgccctccctgcttgtattgtgttgcatgcatggagttagatgtgttctaactccattttttttatgaatctgtttatgtcaggattgatcctggcaatgcgcttagatttcttgttagggttgctaagtatgttgcgaatctagagtatggaatgctaccaatgtcagagcaagactatgattggtgggttgatattagcagtgggtataatttggataaatttcatgatgaaatggctagcaagataatctgggggccaagccaagaaattagagtttggggtttggacactgaaattggcactgaatgtaagttgacaaccaatgaagaatttggccagtggatgaattctatgttggatgataagctggtagagtttggtgttgaagttatttataaaaagggatatgaacctattgaaggcattgcaaatccagttgattcagctattcaaggtgtctctggtgtggtaactgcagatccaattgatcagtcaagtgctcaagttctctctgctatgattagtgctgaagtttcttctcctggtcatgaagaagggacgggtgatacctctagccatccacaaaatgcagaagaggctaatgctgttgtagattggagtaagttggctatacttgttgaacctgagcaagattgtgatgttaatttattgttggatgaggatcaagtttttgaggccatgggcttcaaagcagcagatcagagagcagcagctgctgcagcagctatggaagaaactgcaattcctattattccaaccgagattcagcaagacatgttagatgcagccattgtagtggacgatgaagtacccattgatgtgttggattgggacagggatgacccagatatgtcagtggggacattttacccttctatggatgagttcagaatggcaatgaagcaatatgccattgttcatgagtttgaactagagactgaaaattctgacaaagaaaggtttagagggaaatgccatgcaattggttgcccatggataattagagcaaagacccaacctaataagagtgtcagggtattatactaaccatttaaattacctttgcaatttgacaccttgcttgctgaattcagattggagtaacttttgcatagttgctaatattgtttgcttttgcaggtccaaataaacaaatatgatcacaagtgtgcttcaagaagcagagttcgtggaaggatggcatctcaagcttgggttgctgagagggcaattccatttctcaacaagaagaatgggatgggtccaaaggaacttcagaaggagctgcaggacacctacaagataaccataccttatcatacagtttatcatggtaggaagagggcaacagacaaattatttggtaagtggtctgattcatttgattggttgtataggttcaaggcagaggtggaaatgaggtccccaggtagtgtagttgagatagacacagttaaaattggagataaggttcacttcaatagattcttttgtgcatttaaagcatcaattgatggtttcttaggggggctgtagaccctacattagcatagattctactgcccttaatggatattggaatggacacatgcctgcagccaatgcattagatggacacaattggatgtttcctttggcatttggtttttttgattcagagaccaaagagaactgggtttggtttatggagcagctagccaatgcaattggtccagttccaaaattagctatccacactgatgcatgtaaagggttggaaactgcagttcacaaggtatttccatgggcagaacagagggagtgtatgaggcatttgatggagaacatgaagaaattatttcatgggtctatctatgcgaggaagatgtggcctgcagctaagacttacatgcttgagaagcatgacaagtggatggatgaagtgacaacagctagtccagaggtgaaacaatggcttaaagaatatcacaacctactgtgggccagaagcaagtttgattgtgctataaagtgtgactacatcaacaataacctggcagagtcatggaacagttggatcaaagacttgaaggatttgcctgttgatgctcttgcagatgccattagggagaaaactttgatcttgtttgagaagaggaggaggatctctacagctctcaatggagtgattcttcctgttgtcatccatcagttgaatgaagcctcaaaaggtttaggccatctgaaggttactaaaggaaatcctgaccaagcagaagttacagagacatacaaggatgaggaagtgactaggcatgtggtgtaccttgataagtggacatgtacatgcagggaatggcaggtcactgggaagccctgcccacatgcattggcactgatcacaacaattaggcagccaaatatggagaaatatgttgacacagcttactctgtgcacagatttcaggtagcatatgcaagtgttatccctaacatcacagacaagaagcagtggccaaaagttgataaaggtttcaagctcctgccacccgttcccaagaagagaggagtgggtaggcagagaaagaataggatcccatctgctcttgaaaagggcaaaggaaaggccacaaggcaagttcaatgtccagactaccaacggtttggacataggaagggtagtataagatgtgaactgactggaactaggaagaggttagttcagctatgatttactttcttttagttattgtacaatgtattgcttaagctaaccaatgttttgcaggaagaaaaacaacaagacaaaaacaaatgtgggaaggaagaaagcaaagggtgccattgatgcccaagctgctgcagttgatgttcaagcgaatacgccaagaacaagagctgctgcagttgatgttcaagcgaatacaccaagaacaagagcagctgtagcaaaagaagcagctgcagaatcacaagtgcatgcaacacaaacaagcagtcctggaccaatcactaggaggtaaggcataattgtgttgtttttcatttcatttcacttaactttggttcatgtcttgcttacacccatcaaaaacaacaggaggctggcattagaggttggtcaaagctccgttgaagtagcacttgtacccgtgcaggtgcaagcggcagtacagccaaccaagaaattcacaccaaggaaaaaactagctagcaagccaaaaaggcatcaccaccaaagcttctgaaataaaatgtgtcaatctgctatcaatctgcaagtattttgctatgtatggctgaaatgcgtcaatctgcaagtattttgctatttatgtctgaaatcgtcaatctcgaagtaatatgaacttctaatgtgcatggcctgatgatgtatttttgcttttgtaatgatgtatgccatgatgaacctgttatatggcaccctaaacctgttatatatagaccattgtatggtctgatggccctgatggacctgttatatgtatagaccaatgtatggtctgatggacctgttatgcatggcctgcttttgtaatgatgtgtggcctacaatgaacctatgaattgtatggttgatgaattaagatatttggatgggacgtgatgaattaaggcacttctgctattgtgtgcatgttcagtttgttgagatatatgtctggatatgtatgctgacaaatattaatccttgtacatatatgtgttgtcatgaagttgtatattatgttatatattgccaaaaaaaatgctattgttcttgcaatcctatatatatgtatggtttcagtcaaatgaactatacatttagctagtagtaataagttgtatcattttacctaaatattgtttcagattcggctctatattgcagccaatggctattaagggtatactagtcatttcaggtgtccattccacgctggcaagcccatgtggcggtgtacagtgcgaaaagtggcaaaaaattagaaaaacttctctctccaatggcatatagttaactgcaaacctaaaaggggtatttgaacaattgccaaacgtaaaagtggcaaatagttaaattccccttcttctccccaatccacgatccccctcccctctctcccgaggcgactgtcgaggcagctcgagctgcttctggaatcttctcgaaccctccgcttcttccgcgatcctcctcctcctcctcgtcctcccactctctcgcgctcgggacctctgcccctcgcgcttcttccacgaggctccacgggccacgggcaagaccagccgcccgttcgccgcgtgcgccgccgccgccgtggatgggacggctggggtggctccggctcgcgtcgaggtctctcgcgctacgctccggcgaggtgaggcgatttcgtctcgtgcgatgcttgtttccatttccccgatttggtattggggggctttgggaaggtttagctgttcattttgattggagtttgtgcctgcaggtggctgcgcaggggagcaaatggattcggcattccacgcgtaatttccttcgtcctgataagctttgttctatctcgcgttggtttggttttgcggaatgatttatcggttcgttcctccgccaccgcgggcgagctacagctaacagctagatccaaatgttcttttctttctctgttttttcctttcctcttatgtgatttggggatttttgactgaaagagacaaattaatgttcagattgtatgtattcttcaattgaacgctaatcaacaatgcataaaaattgtcggtgtgtttcctcttgaacagaaattgggtggcaacaatgtgcatcttttcattaagaaaggcaatgctacaataatctgtagaagaattgaaattcaataatgttacaatttttttctcagatgggtcatgctacattctattggcatgcatctcttttgcctaggagaatttatttgtcaacaaagtggtgaaaaaaattctgaataggggcattctagtctttatacacttagttcagataatgagcctatcaacaatcaggacataaattggcaaattattcaaccaacagattctttagatagttccataatctataagttgattataatctataatctgtataatcataagctgtcccaaaaggggccataaactgattttctgctgtcgatgtgtctgtttgggatttagcacataattctttaatctctacttgcaaatgttgttcgaggttgaatcttatggatccgtaagatggtgacaaaggcacatgattttaaggttgttgtttgcattattcaggttctatttagactatatgtgacttctttcttcttaacttgtggtgaacagtgaacttgactacatggctgcagaataatagcttccgtatcgtacaatacattttaggaaaatgtgttggtgatattgattactattgggatgttaatgtagtatgggattagagaataatttgatatgctatgaggactatctcatgagtcgttctccagaaagagaattaagattttttgtctctgcaggggtacgatgctgatttaaatcaaacatatcgtctattggctaaattgaggccatgggaattgaactgtttcaaatagtgtggtttatgtaatcaagttgatgttgtttgtaaacataatcctgtaaaattcatgtgttccaaatgggccccgtcttttttttcctcctgtcattctctgctcgttaacacttcccacttttttttgtttcatctggcgatgcagcttgcagctccagtggcatctatattggtgataaatgctatggacggttcatgttgacatcatttacattgagcaggtcttttcatgctacaggttgctgtcctggtgttacatgaatctcggtaatcatattatcttgttatttcaaacacaaaggccaatcaagcattttctgtcgcatctgccaggtcaacacagttcaccagagaaggactattacaagattcttggtgttcctaaagatgcttcgcaggaagaaatcaagagggcttttcattcagtgagtgtcacattatagttctctttaagtccacaaggcttgctcagtttttttttttggcatgggcatgagcatgccataaagttaatataatttctcaggtggtaatattttccatttctagcattcttgtgtgttgcagtttactttggaggaaaaaacacattgccgtgttattttcgtctgtctctgtgaagaatcaaagtattgtcttgagttgtttctgatgtatatcttgttgatcataccaacaatcagtccaacagcttaaaaccatttcttttattatacagaaaatgccgccatacctccataggtagatgttttaagaagtggtttcagactaggattaagataagataaactagatgcactggtagttgacttgcgttagattttgatgatgttctacttgaattaattacagattactacttgtatgtagcttgcaaaaaggtaccatccagacacaaacagggggaatactgctgcaaaaaggacatttcaggaaataagagatgcatacgaggcaagtaagttaccacatctattttgctttgtaatgttttaatctttgtgccaaattaacagtatcataagtttgataatgctggactctagacattgcgcgacccttcgaagagagagcagtatgatatggtaataaatccctacctgctgtacgctatttctttatcatcttccccttttttagggaatgtggtatctttggaaatacatcatttgataaacatctcaagttaatagtttatggaccattgttttgcaagatctttaaatagcatgttaatatttgaggtctggtagtatgtccgtgaagttcatggtctgttgtaatactgcagctattttatagagggtctgagacaaattcctcaaagagtgggatggattttgatggggcctatcaagatccattttcaggattccacaagcagggtcataatccctttgcagaattctacagacaagggggatc

SEQ ID NO: 62990 - DNA, 683 bp, Oryza sativa
  unsure (1)..(683): unsure at all n locations
atgttgaatcaacctactgaagccatgggtcctggcttatttaactccataaatatgagatatcttgtgcaataacgagattattaaataaaaaaagaagaagaatattttgtcctgggagtaacgtgaaaagaaaaaacacaaacctttctcgccgagtcagacgtcgtgaactccttccataaatcctaaaaaaggatgaacacaaacgcgtagcgcaattagtccaccgaacactccacagcagcaaagcaaacgaagagctgaaaccgcggaggcggaggcggtggcggaagactcacctcgaccttgtcgagcttcccttcgtcgagcaccttgaagagggcgaaccccgcgggcgtctcgaacagcaccagcattctcttnncctttctccgcacgagaacacctacacctggatacaaacccaaatcaaaaaaaaaaaccacaagatcgaaagcttgggtcaaaccgagcagctaggatatatacaccctcaagaaaagaaaatggcgcaaaccttggctcgattggacgcgaatcgacgatggggggaggagagcgcgaggcgaaggtccggctgcggcgagatggtggggagggggagtaggcgccgccgccgccgccgccgccgcgagggtttagagcgaggtgttgtgggatgcggcgggagagggggtgcc

SEQ ID NO: 62991 - DNA, 13906 bp, Oryza sativa
atctgtgaggtatgcttggatctcagagatccaagcaatcaatctaagggagcttggagcgctcccttcgggtcccgaggcctggactccgacggggctcgggggccggtcaggcgcatccgtctcccctaagaggtcgggtcgcgccgacggctgggtaagcctttcttcaaaggcgcccggtggggtctgggctcgcgagaacgcgagccgtgagagttcgtcggcaaccatgttatcccgtctgggtacatgccgaagctctatcccgtcaaaatggcgctccatacgccgcacttggcgtacgtaagcgtccatctgtgggtcagagcaccggtactccttacagacctggttaacgaccagctgggagtcgcctaacaccaagaggcggcggatccccagtccagctgccactctgagtccggcaaggagtccctcgtactctgccatattattagtcgctcgaaagtcgagacggaccaagtatctgaggacgtctccgttcggagaggtcaacgtgacccccgcaccggcgccctggagagacagagaaccgtcgaactgcatcacccagtgggcggtgtgaggcagctgagaggggtccgtgctggcctcggggattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgggggtatcgggtcttggcgtcccggagggcctcactaacaaagtagacaggccgctgcacctttcggcggggccgatcctcttcgctaggggccgcatccccggggcgttcttcgtccaagtggcctctcggggcgcactcgtcttctgtgccgatgacctcggggtcggaggatgacaggagcggccttcccacagtggcctcggggccgtcctgggggtcgggggctcctggcgtcgtcggacaagcaggcaaagggcctactccggtcgtcaggggcctcaggcctccgttcggctcgggggcctcttctccctgctttctcccgggtcgagtcagcacagggttagcctcggggccaaagggcgataggtgcggccttcccgcagtggcctcggggccttcctgaggttcgggggcacccagcaccgtctgacaagcgggcagagggccgactccggtcgtcaggggccttaggccaccgttcgactcgggggcttctcctccctgctcgctcccgggccaagtcagcacagggcgggggtgcgcgaaatgaggatggtcttcatcgcgctccacaaccaacgctgcactaactacttggggggtcgccgctaagtagagtagtaggggctcatttggccccggggcgactagaactgggggagagctgagatctgccttcaactgagtgagggcacgttcagcttcctccgtccaagtaaacggccccgagcgcttgaggagcttaaataagggtagcgccttctctcccagcctcgatatgaaacgacttagggcggcaatgcaaccggtgacgcattgcacatccctaagtttgctgggggggggcgcatccgctctatagctcgtatcttctcggggttggcctcgatgcctcgggcagagaccaagaacccgagaagtttgcccgcaggtacaccaaacacgcacttatcggggttcagttttatgcgggcggagcggagattttcaaaagtttccgctagatctgagagtaaagtctcttggttgcgcgtctttacaaccaagtcatcgacataagcctcaacattacgccctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcggtggagtcgacaatctgatctatgcgaggcagggggtaagggtccttaggacatgccttgttaaggtcggtgtagtcgatgcacatccgaagcttgccgttcgcctttggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatatccgccggtctccatgcgaagacgtcagcgtttgcccgcaggaaggagacgagcgcgtcttcctatttgccatccagaagaccaccgatccgtgtggtcttggatgggccgtcgcccagggcaacctccttgaccgggacctcggcgcatgtgacaatccgctgcctcggggcggtgggggcggaggtgccaagcctctcgtcaccaccctcgggcttggacgcagcagcgaggtggtccgcgcgctgctccatgcaagcgagcgcgactttcaggtcgccatggacagagatggggccaccggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggctgatccaccaaaggtgaccggtaggtcgatgtgacccaacggccatgtgtgccccggcgtcacaccgataatcggttgggacggctggagcaccatccccggggccttgatggcatcaaaagccgcgggggaaaggatgttgagggccgctcccccatctatgaggacacgccccaacttcacgttgcagatggtgggggaaaccaccatcgcaatctgccctccccgggcgacgcacggtgggtggtcggtctggtcgaaagtgagggcaacctccgaccaccgcgcccggcacgtcgcctcatgagtaggggccgcggccagaagctctcgcttcatggccttgaggctccggcgagagacgtgagcacacgctcccccatcgacagtggcaatggtggccccaggttcttggaaacctaggtcatcatcaccgtcatcgatgtcaacagcgggggccttctgtttggcctcacttcgccgtttgccggagggagttgccggcgacttgccctcacggcgttccttcctcctgtcctcctcccacttcctcgttcgctcagccaagtttttgactgcgcgacagtccgcgagatcgtggagggaggtgttgtggacggagcaccacttgccggctgggcgctccctggtgggagtaccagcctctttctttttgtcgctcgcaggcctcccctttcgggtggcccgcggagcgccctcgacggcgaggacatgaccctcgtcgccggaatggaccgacctcttcttcctcctcctgtcacgccgccctgtctgagcggcggatccgggggcggccgaagctgccactccggaaccggaggggttccaggtccatgcttcctccttacgagccactcggtctgcgagctgaaaaagctccgcggtagtctggggctctttggaagcgattttttcgagcatgcggttgtgccgcacaccccccctgaacgcgtagatcaccgcgtgtgcagggatgcatggtatggtattgcggacttggcaaaaccgctgaatgtacgagcgaagtgactcatcatcccctcgctgtaccgcgtgcaagtccgcttcttcgcctgggcgcggataagtgccttgaaagttcatagtgaactgttggcataaatcctcccaagagtggaccgacgcaggtggcaggttcattagccaaccccgcgcctgtcccttcagggccatgggaaagaaattcgccatgaccctgtcgtcacccccagcggcctcaatcccggtcgtatagacctggagaaactcggtggggttgacactcccatcatacttctcggtgatggtgggccggaaccttgggggccaacggacattccgaagactcgccacaaaggctctacagccgacaccaccagccgggggcacggagggctggtcctcacgtccatgtcgaggtgacactctggacgaagaggcgccctccgttgcgcggggagtacgccggctattacgccggcgctcgatgtcgaggcgggcatccggctctccatgctgatcctcccgagtcggaggtgccgacgagggagtggcagccgaatggcgtgcaacagccgccgctcgccgcgccctccggcttgacgacacggagccggtagtgacggcgccggaggtcttggtggtggaggaccgtccaccagcacccaggcgatgctgggctgtcatgaccaagttggccacgtcgtccagccatcgttgagctggagactccgggtcagggacgacgggcgggtgacgtaggagcgcgccagcagcctgaagcgcgccctgaggcgtgctgccgtcgccgtagacgaggaggcgacgctccccatctcgccgttctcctgcatcacccgcgaccggtgatgctgcggatttatcaaccctctcgagcgcctccccctgcttaggactttggtgtggaggaggtgggggagtacgagctcgacggcgtgggtttggctccccgtcgtcgccgctcacactcggagagaggtcgtgcgcctttgctcgctcggccattaggctgaacaaggaaaacttggcgcacacggaggagtacgagagctcagaaaacacacgctgagccccctacctggcgcgccagatgacggagctcgtggctcctcaccgggagaccgcacaggcccccctttgccggttcggccgggggcttggggtgaaatctcaagctctctcggtatgtggaaagaacgccagctaggaagaaacgcgagacacgggcgatgtatacaggtttgggccgctgggaagcgtaataccctactcctgtgtttcggtggatttgtgtatgaacaagtaacaaagtgtcaaccagcccccaatcgctctgggatcggatctggagaaggccttgtgtccaaaagtcctccctctatctaagtgggcaatgtcctccttttatatctcaaggggataccacatgcccctctccttctccaaactggactgttcttctcttcataaatggacggagatcggtacggctgctgtccgagtgcccttctgacgggacggcccatacctacccccacttccgccggaaacaggtgcgacgtgggattatggctgtctgttgatgacgcgaccagtgtcagaccggtcacagatcagtcatccttgtccaccacgtgtcagcttagcaacgtgcatgtttgcccttcttcatgtagcatcttgcctgtaatggttgggatgaagcctggtataaatttaaccagggctaacgggccatctctaagagattacacgctagctccggcttgagacgagtgcctagaggctttcgtcttgaccggatggggcaaggcgtgcgtcaaaccgccagtcgccacctaacccgtgatctgaccggtctgtgactggtcacagaccggataaaggaacgcgctgcactacgctgcatgcagcgtgacacgttcgaccagaccgcaataaatgtggttaggtgaggcttaccgtgttcacccaacccattcatgtggcgctaactccacaaggggtcggggcgcctcggccctcggggccggggcaggagtcacccgaccccccctcggggaaatcaggaggagggcggacacctcaccctcgggcccgacgtccccgaaggtgccaggccacgtgggcgattgtgtctgcctcaagcctctggtcacgatactcccggtcccatatcaccgacagataggatatcctgtaacatgttacaatcattatttttgcgctaagcatatttgcatggcaaaaatttccatatcattgtttcttgtaaaatgcaaagcacctagataacaactcgtgtgatggtaactataaaaccagatccaaagggcaaagaatggtaattatacgtggtgttaagtgaaaacatgagcctagctctaacccaatgtaaaattttggtcaataaatatggtccaaagtgaaatttactctaaataatatcttgcatgacaaagtcataaataatatttataataatttatttttagatatgacataaaaataatatatatataaactatttatttagcacataaataggttttatcttataaaaaatgtcgtactactataacaaaatatgctttatatacattatttaatgataaaaaatattaattttttgttatatctaaaaataaattttgtcatagataaaaattattttgttttgccttcgcggaggtgaaactaaaatattattcttgctaaataatatctcacaaaataaactcataaatatgatagtcacatacaatatatttatacactccattaatatacttcataaatttatattttcttgataccaaagggcaaaatggactttatgatagaaactcaacggtcaactaatggtattaacggaaagggtatagaagggatccaaactgaaatttaggggtatggaagggaatgagcaaatctcaggggcacaaaagggattgggtgaactttcaggggtacacagcgagttttctcatctcttaaatatatatactcctccttaggttaccttcttcaagttccatgtattcagaaagaaataagaaataacagttctatatcgagagaaccatttgggcacatatgtataaatggataaatatggcgtgttttcactatgaataaatggataaatggataaatttagttgggttcatattgttgccatccatattttgtcttaaattggacacactcacgagtttatgcgtgtgagatgtatgtgcatcttctatgcaacaggaaatagaaacagcaaactaagagagagaaagatggggggaacacttacactgatgcatgcataaatatacatggatgcatgcaatataatgcagtggaagtgtgtgtgctttgtggcatgcaaggatgtaccaccatcaccatgcatgcacacactgcgctcagaggagaggagaggagagtactggcactgagatctttcatggcttgtcagggaggaagaagaaaacaacagcgagacgacaaaaagggggctctcctggcctgccctgcatgcgttggcgccggtgaccacgaaacagaattgcaggccggccattgcaacaattgcatactactactacatgcatagtatatgtcagaaaaacttcaattttctcgtggcagaagctagcagtccgtattaattagggttttaattcgctgcgaacatatatatcccgatcgatcgatcgatcgatggccagttatcctttcccgtaaactgttcatgcagtacgtacagactacacagactagtttacgttgcgtgcttatagcatcatatcctagcacagcaactgtatgtacatcagattctactagtgtagtataatgcatatatatataagcaagaatcattctctagtacttaaatcgaatatgcatgcttagaattagcactgtgttaacgccaaatatttgtcatttatatcattaagaagtatgcttaaatacaacatgcatgcttagaaccactgacgttgttatgttacattgataattaatttgcttattttttgcttgtagaacctactgcagaattacttattcctcataagactatggccctgcttagatttcaactttttttcttcaaactttcaactttttcgtcacatcgaactttcctacacacacaaacttccaacttttccatcacatcataccaatttcttcaaacttccaattttggcgtggaactaaacacagcctgtatggctcacctttgtggtccatcaaggtactacacctatgtactactgcatctgttttaacttggtgttttagacatttcacacaattttcagtgcacacatgttctatctttttttccctaatcatatatttgttcaaaagattaaaatatggaaatgtttaacatggtaaatctgcctagattgataaggttttatttatataacatgtttatatcattttattgtacctactcttatattttggggaggcatgaaattgctagctatagggaaaacgcttgcatgcatggaaacatatactccctcgtcccaaaatataacaacttctagcatttagattttgtcccaaaatataacaacaacttctccaccaacgtttttttctcaaccaatcacaaccctccaccatttaattttctcacatacctccacttctcctccaatcacaacactccctcatttaattataccaattttcttaataaccatgtccaattctaaaaatacttatattctaggatggaggaagtagctagctctaataattaagaccctatagctctgtacatagtacaatggtacagtttcggtcacatgtattttcgtgctggttgaagcttcattgaatccaagcttgcccagcgcattgaatggcaaccacgaaagaggtatgacacacatacttacatggagggaagaacttatattcatgcgtgttgtagctagggttcaggagcttggaaaggtttgtactaatgcaaatggggagaatattttcatatattttttcgtcagccacgtactagctacatccatgcatggggagaccatcgatggaggcatatatgcagctgcagctgcaggtccacacacttaatcaaggagcttgaatgggcttaaatgagaggaaatcaagggcgtgcaggagcaggagcagcagctagcactgtatatagtgtagtgtagctcgctagctatagtagcagcatgttgtactgctgctgctgtatggttttgcatatattgttggttggtttggggttcgtcagatgaggagatcagctatgtgcatccgagcttacagctaggtttcgccgggatgaatgtcggccgtgttcaccggtacccaaccctcctatttaatgcgtgaggatgtaaattgattaagatgtgagtcttctgaagcacttgtgatcatggctgatttcagcctctgcaggcatgcatatgggcttctgagcttgtctctcgctgtgctttatggcgttgagatctagtagtgatgagcctcgattctttttcacaatcgtcgacaatgctagatttcttgccaaagatttttttttcctcgaaagttttgatttgtacaccgttagatcgtgttgagatccttcatccttgcatgaagatgagaaaaaaagtcgtgttgagattcgtacaggaggaagagaaaaaaaaatcaaatgtaaggagattctgggattcaaactcccgatctcaagcactagcacaaatgttggtagccaaccatcatcccttgtaagttttttcttttgaccaattacatataagttacactataattatagtataattataatgtaattatactctaattatatcatagttatatataaaatatttttacctaaaaattatcaaatgttatgtagcttctcccttcacaatttggtcccttttcgaacttgtttcacaggtagatcctctgtaaaacttattgtgagaatggatccatatctcgatgcccaaggtcgttattggtaccgaagttgaatgtctcacagccagttggtttggtgctgagccctctgctgcatagaaacaacttcccccactactctctctctcctcctaatcatcttaaatcatgttgatttgctgtcaaatattagaaaattaatcatcactcggttacgctaatttgtttttatttataaaaagggtatctctaactgtcatttgatgtacttttttaccctccttttgtttttctgaatattagatatgttgatattcaacgtgtgggctggatcggtgggtcttaaaatgtgacactatatacatagtcattatttttatttgtttcattttatttgtgcaaatgattttgggatattggtccaaaatccgacatatttgccaccctattttttgtcgaattcttcttagctagtaccttgtatgataagggttcagttcctcactcccttctcctccaatcccctaaattatgcggactgtctatgtgattgcctgctgaaagattttgtttttcagcaggattttttgaccgtacgatggaacgcgtgttcgccatctagcgcctccaaccaaccatgcgcaagagagtgcatgtgttgtttttgtcattttcttcttccgtacgatacaaaagaaacccactaaaataaaccttgggtttctcaattacataaaaagcaaatgggctttcgggtttgtcacttaagcccagaaaaacaggagaaggaataagtctattttgcatccctcaactcttgctctttgttgaatcacatccttcaaccgtaaaaccggggataactcccctgccccccccccccaaacaaatatttgaaaaccggtgcgaattacctcctctggtggtttaggaggcggtgttgactgacatggcaaccttgatcccgttgactaactgtgtcagcttgtgggcttcacttgtcagagacttcttccatcctattttcatcctcacctttcccctctctctctctctcttctcttcccccgacgaccaatgtgctgccgtggtgactgtgtccatgcctgtgaggtcgtgactcttccaacactttcgatggacggcgccgtggcggctgatccaggggggcccgtgtgcagtagtgcatctgtcggtggtggagaccaccggcacagccggctctcaagccctaccactccatagcgtggcccttgtcgttgctatgctccacgtcactggcattggctcctccccctgcgatagctcttgaccccatatcatcgatattgtcaccgtcagtgtaccactgggtctgggcagagttcgaaattccaaaatgatatttccgaaaattcgggtctattggtggaccttgatagtaagtgactccggtcaaatatttcgggtaaaaaaatttaaaagaaattcactggataaccctatctcctcctcagtcaccacatctcccacccccatctcctcctcagtcaccgctcgacacatccagatccagaaactccgccaccagagtcgctgctcgacgcagccggcagcccaccgccacgctacacgcctgcacctgcatgccacccccagccctcgccttctgcacgccgccagtcgcccccatccaccatcacgttgcatgccaccgcatcagcgagcgggcggtagtgcgcctccttcccacgggcacttctccttccaggcgtcccctatggaacaagtggatggaagtggaattcctgcctctgttgggaggggaagaggaaggggtcatagcaccggagatgctctagtggcctcagcatttgggggtttggggaaggaggagaaggcagcagcatcggcacggggtatggaagaggaaagggagatggaagaggagcaggtggcattgggcgagcaacggcggcaacaaaggtgaacagaggtaaagataacatttgtggcttaatcccctatcctagttctggcattgtgcttgctagatttgctgttaaagttttatcaattttggtattagtaattttgtagttgatgttttctaattattttactgcaacaaggattgatattttgtagttgacatatacctggtaaatatttgtctaggtgagcggtgtgcttaattagacagacaaaggtgtgcttaatttagttagacatttgtctaggtgattattgatatgtgctttgataaattactgatttatattttgtagttgatgccctttaaatatttttctacaagctctatacattaattctctagttgaggtcccatttttttcttgggataataggaaatatcagttcaagccgtatttacgatgtttggagccatgggcaaagggttggggtgaatggttttaaatgtttatattgctcttttactggatctggtggagctgttactcggctcagggagcatttggctggaaaaagagggaatgtgaagccatgcttgactgtacctccacatgttcggaaagcaatgtgggctaactcatactaaggaaactataagggattttaaccaaatgcaaaaacaaagggttgaagcaaatattgttgaatctatatacataccttcagatgaagaggtgcaatttgagatggcatgtagactgtcgttgggggacggtactttcactcgtagtgttggtagtagtaggaagagttgtgcttggagtactcctagaatgcagaatagtagattctatcactcctcaaggaaagatgactttgacatagatttggcatgtagccaatcaccaagataactacgggtggacactataatgaataaggatgcaactataacacttgggaaggcttgggcaaaattttgtcatgccaatgatattcctggtagaaagcttaactgtctttactttaaagttgtgataaagttgactcaagagcatggtaagggggtgcgtccaccttctggcacacaagtagatggtgtttaccttcagtcgaactatgaggagttaattgagataatggatggattcaagactagttggaaggattatggaattacggtaatgtgtgattcatggacaggaccaaccatgatgagcattatcaacttcatgatatactctaatggtcaaatgtatttccataaatctatgaatgaaactggtaaattacaaaattcaaatttcttgtatgattgcattagagaggtggttgtcaatgatattggtgccgagaatgtagtgcagctagtaacagacaatggatccaactacaagaaggcttgcaagacgctgatacaagaacataaacacattgtatggcagccatgtgcaacgcatgccatcaacttaatgttaaaggacactgggagtttgtctccagttgaccaagtggtctctagtgccaaaaagatatccatgtttttctgtaaccataataggtgagcatttacaccaaatctttacagcttgcattcaaatcttgtatagaaagagcatctaaattgacttatagttatttcttcctctttgctacatgttattacttgaaaattgtattttaaatgctggtttggaaatcctagcatgattcacttcacctttttattgttttggcatgaccaatatatgtcaaaaattgagacagaatgtagacttctgattacctacaatacatctgacaatgtatagagcaaaccacagaacaacctaccatttgtagcattcactttatttatgcagaattgtgttggcaatctcccacaatcacatgccaaatgccacaatcacatgccatattgtaccactatgactaatctaatacattttattgtttttataggctccatgctgagatgccacaaggtttggtattgtatttatcttcttttaggacctaatggaacaattcaaaaagtggatgatgtcggaagagtggaccaacagcgaatattctattgcggaaga

SEQ ID NO: 62992 - DNA, 20170 bp, Oryza sativa
tttctttcttttgacagtggcctcctaccggttagaagctcaagaagaatgactccgaagctatacacatcatttctggttgtgagttggtactcaactagatagtccgggtcaatataccctggtgtgcctttgggtacagcctgagttctcttatcaatcgtcgaacatccaaaatcagacacctttgcaaccaagccatttgcgagaaggatgttggctgtcttcacatcaccatggagtattgggtgtggcaaagagtggagatgtgaaagtgcgtctgcggattcagcagcaatccttaggcgggttcccagtgtgacatggaaccgcctactcctctgaagatctagcagctcttgcagtgttttgttctgtacaaactcatacacaagcatcggtgcctcaaattggaggcaacagccaagcaacttgacaatgttgggatggctaacacgacaaagtatgaccagctcttgcacaaactccatcttcctgctctcgtcaatctccttgcacttctttattgcgacggcaactccatctataacagccttataaactgttccctgccctccttccccaatgacatgtgccttgctgaaattatttgtggcagtctctatctcccctctcttgtagagggtgaacccatcatttccatctgctttcatcatttctagcaatatctggcctccatgttgttgaaaaaactcatcagtctgtcttaatagagcctgtcgtttaattttttgtttgtgtcgaatcacttcccatcctaggaatccaaagaggacagccaatacactggcaacaacacctatggaaacagagatacatgattagcaaagtgttttgaaactgatatgtttaaaacagagatcaagcagatcaagatgaggtaacatagagttggaataaatgtgtaccaattgccagtcgtgttttcggtgataagaggtcttttcggcatcctccttgaattgccgcatttccactactacccgcatgacacacacaatcgaaacttccaggtttattgtagcaatctccatagcaagggtaattctctccatgttgacattcattaatatctacaatcaaatgaaaagttttttagaaaaatatagcgttacatgcatctataaaaataggctccttttagtacaaaagctaatcaataatgagctgattagcttttagtccttgttcatttttctcacggtcactcaccatgatccccttgcccaagtacccatatgcaaaaaaaaaaaaaagcaattatctaacaaacttgaatttgtataggtaatttttttaaaaaaagacaataataaaattgaatggattaataatgttgtaaaacaaaaaatgaatccggcaatcttgagaggaggtagggggggacagcggtccgcgggaaaaaaaaagaaatctaaaatggaaaaaaagtgagaatatgaaacaaagactagaaatatttttaaaaaaaaatagccttgcttttgatcagttagctgaaaattccgaaaccatcagtcgactaataacaaagtgttgtcgacgtcggacatcgagtcgtctagcttcttcctactctcgatcgctatcatcaccacgcttctctcccacgcaaaatacagccaaatggtggcggtggtttcagaccagcaatggtgacaacaaatgtatatacgtcttctccggcaatggaccttaaaagcgacggcgacgtttggggtatctgttagtgttaggatcagggattgaaattttgcttcgaaatttcggaataggtatgcaactatctcgcctgaagtttttgaatttttaaagtttaatgaatttggtaagaatttattcaaattcagtcaaatttatttaaagtttgaccgttttgtgctccacataaaaaaataaaacaaacatggccatggtacatatgccttgctaaattctcaacatagaacatataaaaatgaaataaaaagtgagaaatagagtagcagaaagtataactaacatttggcgcaatggatctatcaaaccattcgacttcaaaaccttctcccctatgtttgtgtttataagagagaaaatcgtgctcaaatggcatggcagctcgggctcgactttatataggagaagctattttcgctggcggaccacttaagccatcgccatagaaaataataggagtggtggtggcttaagtgggccgctagcgaaaataggttcatcttcgctggcggcccacatcaccacaccgccagtgaagactttccatcttttttccatcttcgctggtggtcccttaggtccgccgccagtgaaaataggaatatcttcacgggcggcccgctttactcagccgccagcgaagatatgttttcgctggcggcccgtacccacgacccctccttacatatttgtgctggtggtcatagcccatggccgccagcgaaaattatagggcaacgttataaaaaatcggtttttaagtagtgagagggaaactgtttaattatatgcataaccaaattaaaggtctaatgccctcaaatacgaaaagaagttgaacgaaacgtacttaagaaagctgcgtatgcacagctcactgcatgatacaggtatttcatactagttaggaaatactcgatcgagtataatcacaatttcaaaattctggctatatggagtagagggaaaattaccttgacaaccgttgggacctttaaggtaaggattgccttggtatccttcttggcacctacagatgtagcctgttgtatcggaggagttgatacactttgcattgtcgcttttgcaagcataggatgtgagatttcccatagcttcctcacaagtgttggcggtgttgatagcccaatcaagcaccaccggtgcctcgccgccataggtattgttgaactcgaacggtgaagtcaggtaggtggttgaaaaggagaagttggacgcttccatgagcacagcgtagctgcagggggttcgattatagatccccgacgtgttcatgctttgctcaaaccacacctggtagtaatcgaggccctttgggatggcagtctgacaacagcctttcccagaacaggtgccattgatcaggctcgttagttcacctcgccggcagacggagacacagccgctcatgtacttgcccacgtcatcctgatcggcgatgtatgccagtgttcggcacccaataatagtgaacttgttggcggagtccgagaacctgtacggcgtgtccttcaggtccacataccacaggtcatcgaagttcatctctcgggttgagatgttatagcaggaagaagatatacgagtcctcacgcgggcctgactaagctggacatcgatgctgaggagctcgacatatccaaggaatggcttctggacgccattcccggtgttgttgcagtcgacttcaaaggaaggcgacatagcgcagccgcttgaactgaggccgaacgggtagacgatgtctacaccaccgcacttggtggcgttctggcattgcgacgacgctgcctgcgcaccgtcgagtgtctctgcagccagcgccgtgctcagcagtagtaccaatagccaaatactatcataaaacgcagcgcaaatagaagccacagctgctcctcggtggggagacatggataagcgaatatctgtgtgcttttggtggatatatcgagcacactacttttgcaacctcagttttcacaaggaacggaggaatcgtatataaagacgagaggggtgtagcactatcatgtcctacctagctacttgggtgctaattaaccacgaaaattaaaacaaataaacaatgatatgtaaatttatgtacacacccgacgactttgacttggcaagttttcgctaaggactgttcgttccaacgtcgttttacactgttctctttaagagctgaactgttccggagtacacgtagtgttttgaaatagacatatatatttagaggaatatattttagaggaatatatgcatagccaggtctaaaaatcttaactgatatatactgatataaatattaagacttgataggtaaaagtggcattaccatcataaaaacatattattttgaataaccattataattaaatatgtaatttagatgacatgcaaagaggcccggagacgtaattttttttttaaaatggtcaggccattgccgacgttttatattaagaaggtgtccaattttaagaagaaaacgggatcaaaccttacgctgcctagttaattaggaaaaactgagcgaaaaccataactacaagaccacaccatagctaacctaacatatgctaccacgacggagcctaacataaggcatcgaccaaaattgccatagaggcgacacagcaacctacacatgttatcgttgccgagcttgccacccaatcaacacagcagcttcgacttcactgcgatgctacctcaaagctaaaatgaacaaacaaaattgacactgacgaagcacatcagcccaaactaccaaggagccacttcctacacatagctagcatcaacaaccctataaggagattgcagtgtatcatcgttgctgagcttcatcgcacccgtacagtgaagcagctccgactctacccaacagtaaccaaataaggatgatgaacacccgcagcagagcaagaaacgagaccaaggcggcgaaggcctcgtcaaacaccttaggcctatagagctttggaagtgttgcaggagtccaccaatggctaggttgcacacggaaggttcttgctgctagaaggatcgacgccaaaacgacgcctccaagaaagggaatgacgcctaaaggcatagtcgccgtcatgccggcccatggcctggcaaggttttcaccagcgattcccaatcaaagcccatacaaccgttgtgctcaacgaccgtcgctggaccaccacgccatcccttcagcacccaagcctagtcactgtgctgctggcccgagtgaccaagcgtgacccacgctaacacgcagaccacctccagccacagcctcacggcgccgcccatggccacgcgtcgctacggccagaacctcatgacgcggagtggaccacacgccgccgcctcgcatgctgtcaggacgggccaacgacaatgcgtcctagcccgcggcctcgccctcctccttcgcgaccatccagcgagcatgccgctccagccgccgctgggccgtggcacgaggtgaagcaaacaccggcaccgtcgcgggcacaagtggcgcgtgcgcgttggcggcgagcatttccgatagtttagtttaattaactaagtgattagtagataatgacggtaattaagatatgatttttttccgaaagattttttctactaactgattaaaaactttcaagttagatttgaaaacttttgaagtcaaattttaaaaactttcaaaactcaatttgaaaattttcaactcaaatttgaaaactttcaactcgagatttgaaaactttcaagtacggatttgaaaaaatatgaaaactttcgactcagatttaaaaactttcaacttgagatttgaaaactttcgactccgattcaaaaactttcgactcagattcgaaaactttcgactccaatccgaaaactttcgactcagatttgaaaactttcaactcagattcaaaaactttcaactcagattcgaaaattttcaaatcgagatttgaatactttcaaatcagatttaaaattttcaagttaagatttaaactttcaactcaaaacattttgaaaaaaataagtgtgctaaagattaaaaaaggtaatcagaaaaaaccgaaaaaaattgcaaaagaaaaagaaaaaagcaaatcgtgaaaaaaaaaagaaaaaatgggctgatgggccggaggcccgagagcagctggcgcgcgcgccggtcccctaagtttaaggctatttatgacatgacaagtatcagtatggtttccgatgagaaatcaatttgatcaaggaaaaaaaaataaaatagcacccaaagctgctgagctctcggcgccgtgcccgtccaggggttcgctgttcatcaccattcaccaacacggactaagtcataatctctcatgtttgcattgatggagtccagatcgctgcatgcttgcgttcatggttgccttggattattattattttctttttaaaaaaaaaaactagtccagatcgtagtattcgatcgaatggaagacgactgtaggatatctggtgaataaacgcatggtgctgcgtttatgtcacactgaccatgtccaataataagatatttgggcacaaagtgtgtataaggtccgcgaattgtacagtgctgcgtacgttcatcacactcatcattttcaacaagatggtacgttgagcacagctcaaaatggcgccaagcatacaaatcgtttgctggtcaagtcttggttgcatctggcctttcttcgtagcaatgttcaacatatcgtacaggaatcatcaatcaatatccatggaaatccagctacttatctacgatcagcgtgtgtgttccgtccctttccttagttcccagtcccagtcagtcgtgataacgtgcagcctttcctctgctttttagcctctaggtatccacatcaggaatttcgacgccccctgtactgtagtcgtcgcaaatcaggagaggcgaatcgacagcctaaccgatgctgtaaatatagttgctatatggtggtgatgatgcatgactgttggcattcgatattacttccttcgtttcacaatgtgaatcgacagcctaaccgatgctgtaaatatagttgctatatggtggtgatgatgcatgactgttggcattcgatattacttccttcgtttcacaatgtgaatcgacagcctaaccgatgctgtaaatatagtgctatatggtggtgatgatgcatgactgttggcattcgatattacttccttcgtttcacattgtaactcattctagcatttcccacatttatatctagatagatatctatctctatctagattcattaacataaatataaatgtgggaaatgctataatgacttatattgtgaaacggaggaagtataaatcttcctgctgctgattgcattcttagtgaaagtgtcaattaggcctagaggggggctgaataggctaattcaaaaatcaattaaaagcggaagcagtaattttcagatatttccgaaattttcggatatatccgaaaattttcggagtcagcacaaatagcaaagtaaatcctagatctagttgcctacaacaataatatgctagtacaaacagcaactagacctatagcggctcaaacaagcaaagctagtggagagggaggaagtaaagtcaccaaagatgaagctcacgaggttgttcccgaagttcgaatccttgaggggattctactctccgttgaggagctcactaagagccgggtcttagctaaccctttcctcaagaggttgcactaagcactcctccttccactaagggtatctcttccgtttcggaggtgagatccgaccttcacaaacttctcccggccaaccacaagtagatcggtggctcgggagcgacacctagccgcctaggagtcctcaacctccaagaataacaaatgaagcaaagaactcccggagatgatgcaagtgctcacaaatcttcatgaagtcaatgacaagcactcacacaaactcgaatccacaactctcacacacacaccaaatccaaatcgaacacgggtgagagggaaaacaagaaagcaaggctcaaaagtgctagagagagagcaagccaagggcacaaatgattggaatggaaccagcagccctcacaagtgaggggagggggctatttatagccacagcccagattctgcccattatacacaataattgagattttcggatatcccgaaaggttttcggacatgtccgaaaattccagctcagcaccaatagcaaagtcaacgaaagatttttcagacattccgaaaaaaaatttcggataagtccgaaaattttcagcaccaaaacatcattctggatgttttcggaaaagtccaaaaatcactttcaaacaagtccgaaaatacacaaaagcgacttttgcctttactgaagttttttggaaactccgaaaatcaatttcggaaaagtccgaaaatgaacagaaccatatttgccttcacagtcattttcggaaagtccgaaaatgtctttcggatatatccgaaaatttccagaagcgaaatctggttctgtgcattttcggaaagtccgaaaatggctttcgaataactccgaaaatttccagaacaactcaatttgaggagaaacactttttaaaaattgattttgagcactttgatcactcctcatatatcaatgcatcatccctcttaatagtgcggcattcctattgactcaaacaaaaagaaaagttacaatataccatttgtcctatgccgcatcacatctcatcaacgtatttggcgggatatgcattattctaatttattgaggacataataaccttcacatttgcttaaataaaaatgtcagtcctctttaatcgtattgtaattaatcaccaaaatcattaggggcctagatacaattttagttaggttgttccaaaccaagatataatttttttaagcccctggggatcgggacaagaggtactatcatactcccttcgatgtgtctagatgaggtggccggcactggtcaccaattaatacagactttgcgtgggctagcactcctgccacagttagtccgcgctcttgtcacttgtgccaccaccacgtcagacgtaaactatgacagtgtgccacgttatgccacctaggacaaaaccgtcatataaatcatcgatagatttcacttacactggttttaacagtttcgggatgctctatatccggttttgtgattcaggtacggatgaaacttggctcatagttaaggtaccaaaagtgaacttttccataagtgcgtaagaaggtgttttgcatgcggttcagtttttatgcggcccaaggactcccactcgagcctcgtctaaaagcatcatgggctgataagtgaatataaaaggaaaaagtccaatttgactccctcaaatataggtagaaatctaattcgtatccctaaactgtaaaaccgggaacaacgtatcctccaatggttaaaaccgtgcaacatgactcccaggctgtattgacggtggtatctactgatctggcatccgcgtggcagcctagtcatcacaaaaaataacaaaataatgtgggtcccacatgtcatcctcccctccctcaccttccttctcttttccattctctcttccctacacagcagaggggcggcaacaggcggtgctatggctggaggtagaggagagggcagcggcgagaggcagcagggcaccgctcgacaaaggtgcccgtctcgcgcagatggaagtggggatctaggtggcaaggctgggtcaaagcgcgccggcgagagcattctagctaggacatgttgaggatggcctggcgcaagagcgtgcagatggcagtggagagctcgccgtggaggttgatggcgtggggcgtgacgacggccaccctcctgcaacgacatagcaagcaatgcgtggccacccacatgggtcaccgcgactcaccgccgacgctcaccatgtcgtagttcgagagacggtctacagtgaggtgtggttctcttcgctggagaagagcatcaagttgcggagctccacaaggccaccgccaccgtcgtcgtcgcctggggactcagctattgaggtggatggctctagtgaaggtgtaggcgcggtaggtctggctcggcgcggatggtgagggagcgcagagaaggtggaggcagtcgaggagagcatgtggggaggaggcgggagtggccgaggagagcgcgtgggaggaggcggtggtgattcttgaccactccactccctaccagccctgccggccccgtgaacagtgacgatactcttgtcggcggggcggtgccgctcttttcggacacagatcttgctcacgccgctagtgcttgtcgctcgtccggcacgccctgtcgccgcttcccattatcatccgcacgggccattgctgtggagaagaagggaaggaagggctgaagggggaagaggaaggggagagagaggaggaagaagaggcgaggatgacaagtggggcccacatgctaagtcagcctattagactaggtcaacgagccatgtcagcataggatcaacatatttgatattatttattatatatatattgagggatacggattcgattggacttatatttgacggagtcagagtgaacttattaaaaaaaaaaaaagggaccacccgtggattggaccccaatctcgcctcttactcggcccaatcaaacaaggtccctggagctcgagaccggagcattttatcccctccgtacgaaggaattcgccggcggcgagcgcgagcgcagtggtcagtcgagtgatccacccgacatcggaatccaccggcgcttccccacgcttgcgccgcagccacctcgtccactccacacttgcctccgcgccacctctgcctcttcttggttccgcctcaagaaacaaccctaagccgccggcaaatcgccggccgtttcctttgaggtatatacgtcgcctccacatcctcttcttggttgagatgaccgagtaagaaggccgcgtattagttagagagatcctgttgggaatagtcccacattgctaatctagggggagttgaaccaacttaaaagtggggggagcccctcacctcttagagctagcttttggggtgtaacaaggctttctcctggttttgggccaacagatccaagaaaaatcgctcaaccatatgatgggtttactaaggtgcctgtgcatccaaatatgtcattccaacagatcctgttaaagttagttcgctttgtttgtacacttgtttgcaccggcaatttcagattttaattcatatataattgcagacatttgtggaacattggtttatttaaccagcattagaattgagatatgtagattgttacattacttcaaattttctgcctacagagtacagattcaaaagtttgtctatgctaactgatttggaggcaagtaattaaataagttactatgttcattaatgttttgtagatgaataaataaataaataggttattttcttgcttgttcttatttgtttatctcattatctgcgaagataagtaggcaaactggaaacacattcagcaaaaggtttagcatttcattactgtctgtatgcttcgcagacattttgccatgatgtggttcattataatttccttaattttgaccagggatctggatacctgctgaaccttgagattacctaactagcactgctgcgtttctcaatggagcatctctcggaggaactaatcatcgagattctcaagaagattacaaggacaagcgaccttaattctctttccctggtgtcgaagcagctctacactatcgatgcagagcaaagggctgctatacgccttggttgtggacttgcaacagaagatttcttagcactttgttcccggtttcctaatttgctcaaagtagagatcgattactctggttcaacacctggtaatgggaaccatatcgacaaccaaggtctctttgttctttcatcttgttgtactttgcttaatgatattaccttaaccttctgctcaaaaatcaatgatgctggtattgtttgcctatcttactgcaagaagttgatatctctaaagcttaactccctaccagaagtaacttcaagtgggcttctcatgctattttttggttgcaaggccctatcttctctcttcattaatgattgcaagggaattgctggcagcactgagtggctggagtaccttggcactgatggatcattggaagaactcgtcgtcaacaattgccaggaaataagccagtatgactttttatagtttggtcgaggatggatgaagcttaagaaatttgagtttgaaaataaggaaagcttgtggaaacactttggccccagccatgactcctcgcacaatgctaactgtgtgtatagatatgatttgtgctgtcagaatttggaggacttaaggctggctcgagttataacagagccagaaggcccagaaactggactacgttttctgctgaggaagtgcaaggcgttagagagactatgcctggagtatgttaacggtgttattgacaaggacatgattgtgctatcccagagctgcaagaaccttaaaagcatctcactttggatgatacctggactctaccatgaacctgatggcatagttttcagaacggatcttacagatgaaagccttgaggctctaaccaacaactgtcctttgcttcaggatgttgagctcgcgtttacaggtgttgatcactgggagcctccagaaataggcttcatacaggagggacttgtgaagctcatgcattattgtccaatccgtactctcacactaaacggtgccctcttcttcaatgacaaggggatgaagggactctcatctgcaccattcatggagacactcagcctcgtcgattgcaaggagattactgattctggaatgtgcttccttgtgcagtacccatgcctgactgatctcaagctccagcattgtcctggtttgacagatgttggaatagctgagcttgtacatgcgcagaaattacagtctctggttgttgatggctgctgtaatatatctgaaaatgctgtgcagtgtgcagctagatcagtccagtactttgtcaactctgccggatcatgtgctgcccattttaaaagactgcattgattgaagctgttaattcgttgctgaccgcacaccatcggtggatatctcagatggagctgttgcttttgctgttaaaccatatcgtctctgtgatctgatttttcagttttcactgtcatttttgaacttgattttactttgccccttttgttcctgttattctctctaagcataagagcaactgagcaaaccatatgatgatgtactctgcaggcatctcatcactctgtgtccacagctaatgttcagaagagtagtctccagcgatcggaatttttcactttggcgtcaaacttgttggtatcctttgcatttatcgtggttttcaacttgttatagttttagttgcaaatatatctttcatcaaatttgggaatgcctgatcagttcttacacataaacaacatttggctggtactacgtgtaatgtgtaatcttatcctgagttgacccacactcctaagtgagcaaacacttttttacagcgtaacatgtgagcaaacgtgctgctgtaacagttgtgcttcaggttccttcttttttcgacttcttttttctattaaggccctgtttagttcttaaaacaaaaattttcacgctgtcacatcatatgtttggacacatacatggaatactaaatgtaggaaaaaaaatcaattacacaattgcgtgtaaattgcgagacaaatcttttaagcttaattgcgccatgatttgataatgtggtgctacagtaaacatttgctaatgatggattaattaggcttaataaattcgtctcgcagtttaatgacagaatctgtaatttgttttgttattagactatgcttaatacttcaaatgtgtgtccgtatatctaatatgacaaccaaacctaaaatttttccccaaccaaacaaggcctaaatggtagatgcgtacacccctacacacacattatcgctaatatgccacctaacacatgctaaaaaaacaaaaaccagcagcgcattcctgatttgactaaattcatgtgaaaagtccacttacatgtgtgtaatattcatgaattcaaggactttaaactctaatgcgtcgagtcatgaagctacgacttcaccacatctctgtgctttaccaggttcccgtattgcaggtattttgttcttttctttcaatcttatatgttagggggacctataaccccacgggtagttataggtcatgcccatgtactctctgcattccagaataagttgatctaatacggaatatgtcggatcaagatctggtgcagttgttactatgactgcaactttagcagttgcagtgcagccgatggatcaaaaatcaacggctcagatggaaggaaaatactgttcagaaaacactgtagcaaatctgtactatagcgattactgtagcatcgatggtgcaacaggatgacagagcgaatccgggcgttggctcatcgatccaacggctataacatgctccgactgctaaagttgcagtcgttactgctacaacaccatatctcaattcgaatatgtcatattatactctaatctatagtacttggattatgacctatgggacaattttttatgggaaaaaagtccgtgttacacctagaaatattttattagatcacttaaccctaaactattttggctgattttacctcttaaattgctaaacatgatttattttacagcttagtggcatgcccccatatagaagtcatattttaagatgaatttttaagtcataggtgacaacactaccaaagttccaaaattctaaaaatattgagatgtaaactataatgcatctatcaatcctatcaaatttcaatgcaaaaatacgatttacatagaataaaaaggagaaatttctttacagggtaccatgaactattttcaatagtccaagggtgtaaaatgaggcagcaaatagtctgtgggttaagtgatcagttaaaataatttgagaatgttaaatggacttttttttttacaaatttaacttatgtgaataacaggctttcacagattctaaccaaaaaaagaagttttcttgttctttcgaaaaaaaattggcataagtaaattttctacatttcattaaatttcaattttctttccaaaaaaaaaaacgacccaaaggtccaggaggccgaggcccaattacgcgacacaaacaacgcgagttttttttgtttttagatttttttttttttaatatttacagaaatattatagcgccgaaaaaatttgcaaaactagaccctgccgcccttcgcaagggcggcaagccgacgtggcacacggcgccgtgtgcgtcttgacggcgcgcacgggccgcggggagccgagggcttgccgccctctgcaagggcggcagcttcctctctgcacaacggctggaaaggactcctgtttttggaaaacgtaacagcgaagtgtaggaatgcgagtcccgaatataaacaacaacatattcagtttacaaccatatagtacaagaatgtaaagaaaaataaagagatgtctgctctactggccgtgactcgcgccgcgaccccgcttggtcctccgggcctgtgctcgcacgtggtcctgggagtacgtgaagcgatccggtgggacagcacgggtagcgcgagggtctgggagtggggtggagggcgactgctcctgcgtgtgcaccggcggtgcgcctccaagctgtgagggaccgataatgtccgggaagtcgaagtcactaatgtcgaagtgcgtggcggaagcccacccgtgctcggacgaagtcccggtaggaccctgccaagacgtgccgggcggctgtgacgaagtcccggcgtcctgccagaactgcgcagacagcgaggccgacacacctgcctgtgacgatgaccccgcagcctgccaggagtgggcgcccggcgtcgtcccaggctgagcgaagcctacacatcgacgacgcgacacttgtaagcttacacataaattgagtatcaattgattgatgatgtacaaatagaccttgaatatacgtacctccgaagggagggggtgtcggcgtaggaacgtgcgcagctggacgaggagcagtcggtcggggacgcacctgtggtgctgcgtctgcctgagcaacgtcggcagcacgacaggtcagcgcacggagaaccgagcgcatcgagtcccgtatccgcgtgtacgtcgacaggtgctcgtctgcccccacctcaatccccgcgcctaaccgttggatcgccgttgtagcatcaacgacgaccctgttgcactcaacggcctgcacggttaattacaacgtaaatattcgtagcctttgtccaacagaaaggatgatgagacgatggtgcgatgcaaggtactcaccgcacgagcgaagtcctggtcgcggtgcctggcgtagaggtctctggcgctcgcggcgtgggcctgttgctccgtcggagcgtaggtgactctagtacgggtgcgtggctgataccaacgtaggtacgcctcatacccctcctccgtgtgtggctctcccgcgtggtccacgacctcctcggtagcaagcaaccagtcgtcgagaaaaggccccaacttggcaggccagtgaccagctgagtgctgacccttgcgcgagtacctgcaaattaatgtattgtattagggcaaacgacaaacaaagcaaattattatggacagcccgatgttaatgcaacatattaaatcgtagtaaaacggcttaccggtgaacggcagccgtgacgcccgccggaaacgggactggaaaggactgacggaagccgaactgccgcatcacgcggtaaggtgcgtgcggctcgacacagatgtcgaacaccatcggaaccgtagtcatccagtacgcctggtccctcgtgcagagtgtggacaggcctagcggcgcccgactgtgggtaagcaaggcactgtagggctcccacactacgtccgtcggcagaaggcggtcgaactccatcacaaactccgcgtacgaccgcctaacctgcacgtgagcccatcggcgctgcaatacaataaggtcagtgtgacgtaggatgaagttaacaatagtaggacaacattaccaaatactagcgacgtacctgacgccggcaccacagagtacccatcgttgggtagtcgaccgccggtctgttctcgtacagcgacgcgtcgtaagggtggtgctccacaagggggcggccgatcgcaatcctctcagccgcccaaagagaaatgaagagagggcacccaccgaagatcgcgccagggtccgtcctggtacaagcctcgcagaggccacggtactgagccgccagcaacgcggagccccaactccactgaggcacctcaccgaccgcggcgtcggcgatgctcctggcgtagtgcacgagaccccggtcgaccgagtgtccgtgactaccacagaacatcacccacccaaaaagccacaacaagtacgcctccaaacaacggctgaaggagtactcgtcggcctcctccggtagctggtcaacctgcaagcgttggatgaaatgttaggcactttacaagttacgtacataatacacgtcagtttaggtagaaagaacttacagtgaactgaagcagccacctcttcgtaggcccggtgttgcggtgctgctgcaacggctcgagcggtagacctggtaggcgctgcacgggtgcgaaacgtgccgtcagctcgtccttccagtcgacacccatgtcaactggcccgacagcgtctcccgcgagcggtagccccaacaagtaagagacatcctgcagggtaggggctacctcaccgcacggcaggtgaaaagtgtgcgtctccggcctccaccggtcgaccaacgctgctaggagggacctgtccgggtcccaacgtctcgtcacgtcgtcgtcgccggtcgcggcctcaactagccgagccaacggtaagagaccggcctcacgcaacctgcgaaagcgaaataataccagacgttaaaatgaacacattgctaagccccctccaccgtagtaaggtaagcccggtgtcgtgaacacagtaaaaccatacctctcgacgaaggagtcgtgaaccaaaagtcgctcacgtgacgaccgtggacggaacgtcccaagctgagccccctccaccgcagtaaggtacgaccggtggcgctgatctatcgccggatccaacaactcaggatgtgccatctctgcaagtaacgtgttacatgttagggtaaataagaaggtaataatataattgtaaaaacaagttatctgaaacggaagaatacttatagagacatgcaagagtgcagattattgagaacataactttcgttacacaaaggcacgtaacgagaatgaaataacataaaacaaaattacaagccgtaaaacataaagacattacatgcggaagtctaacaagtggttcgcaacacaacacaatgcgaacatatcgataagttcgaacgaaattacaagcaaagccttttgccaacatacaacacacgaactacaccacgtaaccggtcgttccacgtgaacgtctaggacggggtcgccttgaagtagtgccttcacccgtagggcgagctccatctgctgctgatcctgatagacctgcctccgccgcacttggtttttccttgtctttaggacaatacttgtaggtgtggccacgttcatcgcatttgctgcaccgcttcaccctgcctgcctccgactcatccatatcgttgcggatgcgccgagtcttcctccgtcccgccttgtctcggagtttcgttgggtcaggaatatagattatcagatcgttaatctttgtgaactccccagctacaccgaagccaaaaatctcgccactccatgtgtgatatattgcttgcttggagaagtattgtgacacatatactgcatcttggatgccacactcagatgccgcggaaatgacatgggtgcatggcctgtggagcagcgtcggctttctacaggagcagtgacatgtgccgtcgtctttgagaacgcactcctgctttactctcttgcggtagatacccctgcctgccttgtcttggcagagtacctcaaacctgtgttgttgggtaccttgcactagagctcgatgtttcatggcctttgcacgccactccgctagttttttctccatgaaagttccaaataaaatgttgttgttcggcatagagggaaaaactgcttggaaccgctccctgaaatacttgcatgtcccatgtaaaatgaactccactataccaactagtgggagtccacggacaccgcgcatcacccagttgtaaacttccgccaaatttgttgtcattataccatatctagcaccacctgtgtcataagtcttagcccatttctcttttggctcattctcaatccactgagaaaattttcgaatttgctccccagttcttctaaccaatgttacactgtctgttgggagagctccgagtgcttgaggagggtcaggtacagcggccgctggtcttgttgcacgctggtcactacatttgcctgtcaactcatctaatctcttccaaagctcattgaattttttctcctggttctgattgcatagcctcttgaacatgttcatcaactccttgttcttaaattgcttgaagaaattagctcccatatgacgcatgcaccacctgctttgtacatcttcccactggccagggtatcctctttccatagtcccaaactttaactcttctatcgctcgaagcataccggcgtgcctgtcatgtattagacacacattgggcctcataccaacaacttctgtcttaaccagatggaggaaccagtaccagctgtcggtgttctcgctctcgacaaaagcaaatgccaacggcaatacctgattgttcccatctaccccaattgccgttagtatctggccccgatacttcccggtcaaaaatgtgccatcaatacaaagaactggacgacagtgcacgaatgccatcttgcatgcatgtagagctaagaacgctctttgcagcacagtcttgccaggatgttcaattgaggggaatgtcttgagtgcacaagaggtcccagggtttctttgttggataacagatagcagacgtggcaaattgtcatatgaggcttcataagttccaaa

SEQ ID NO: 62993 - DNA, 6975 bp, Oryza sativa
gtttggggataaattgggggctaaatgtgtagttttatgatacaactccttaaatctgtagttttgtgataatttcgtcaaaatacctgtagttttgtgaaatttactcataatttaataatataattaatgctaaaattagatggatcaaaatagaaatttctattacaggtgtacaaacagagtcacaaaatatgctaattttcgcatttgcatgtgcgccggccaacgatgcgggattcgactgagacgtgccgatcgatgcatgcatgatcgccactactccacgttgaaactaaacccaagtcaaagtaaacacgtatatttgaagtgcacatagtttcattattagaaaccctcgatttagtcgaattagcgcttagattgaaatgaaaattacgacatacacccattattttggactctttaaatcatccattttggcatgggtgcagtgagcactaattaccgtgcacgcacgggatctaaaaacagtgcgcaggccgtccccgtcacgtctcactgctacatcctggtctatggctgatggccaattcaaccacatgagcgtactttcccggtctcataaaaaataaacatagtcccgttctaactttataaaggcacatatttttcttttttttcgttagcacgtttttcaaactattttataaaaaagatttctatatagaagttgttttaaaatatcagataaatttattttttaagtttgtaataattaaaacttaattaatcatgcgttaatagctttctcgttttaatcttaaaagacgcgaatattagggaatgtcataatatcaaataattagaaggggtgaggtttcgaacccaggtcgtctagtctaccaccttgtgtagctagtcggaagacccttggacatttctccacgcttttaatcttcatccttaaaagattcaagcgggcgcctgatacaaaatacgacaaatcctaagatatattacatcctatactaggtcttctctttatatgatagagcgagtaggcctgtatataagtgtgatcacgcccactcactgacagactcatagacaagaattccactacaacactctaccgatagtaaaaaaaataatctaaatcatcgtttttatttgatcgaatggttcagatctatttatactatcaccctaattagtgataatagaaacgtgaaaaggtattattgtaaaaaaggtgcgaagggacataattgtcatttagcatttagcagtgattaaatatttttttctcctttttttagctttttgataaaatatgagcgatgcgagcgcaatgaatgagcatggatcgatgtagccataaaaaaccctaatcactgcattagtaaattaatatataatttgcccttaataatgaattatttaaattatttttactggtaatataatactatctatcagtagatagcactagctagcgcattactccacacacaatcatctcaggcccagccaggcaaggcagcagcggccatgcatgatccatcgatcgggttcgcaagctatagcaagcagcagctttcatttcctttcctttccccttttccttatcacgcctttctcgctctttggcttttgagaagggagggagtcccggtagacggtagacgcaggcagctcgataatcgacaacaagccagcagcaatagcagtgtgcagtattactcccttcgtcccaaaataattgtaattttatactattcacatttaacgtttgactgttcatcttatttaaaaaaaatttacgattagtatttttattgctattagatgataaaacatggatagtactttatgtttgactaaatatttttaatatttttattttttttaaataagacggacggtcaaacgttgagcacgaataacaactatatttattttaggacggatgtagtacgtacgaggactcatttattaccgtgttttactgatggatgggataacagtactgatggatgggataacagtgacaccccccccccccccccctctctggtgccagctacctgggcagctgcccggtccatggctatggctcacgcctggactgctctgtattccgatgctgcagtgcacaactgcacatcatcgatcggaataagaggtactcctcctcttactgccactctgccagcttgctgtgcaaagcgaaagcgaaaagaaaagatgttctactagtactgcatcgatctgcagtgcgtattcgtttctccgataagagttgatgaaatctcacgtactcgtggcacgcttttcaaactgttaaatggtacgtttcatgtaaaaataaaagttactctaaaatatcatattaatccattttttaagttcataataattaaaactcaattaatcacatgttattactacattattttacatgaaacacttaacctgtatcttaatcttcatcttcacgagattcaaacaccaccccgtacatcggtacatcagtagtactcctacatggaatcattcctaaacgcgctcgctgtagccctagagatagagagaagagagagagagtactcctactttactgtcgtacttatgtgatacagtagccgttaattgaggtgatagttaggctatggcgagcgctccatgctagagcgtggtctcacccctcccgagcgaatattcgcgccacgcgggtatttgtcataacgacggctctaacaggcaaggaagcgtgttggggagaggcctctccctgtgccgtcaccccgcaccattgaaatcaactcactcccgcgcattgctgccatgaacgaggtcgagaagggcctacccggcggtgcatcggaggattacggcaaggtgctccgccgcgaccgttgttggctatttcgccgccccaaccaccgtttcgggcacctccttcgccgaagtcaccgcacaatcgctcgtatcctcaccgcgccacctcgatctctgcctggatccccaccgttgtccccaccactcagatccttactgcgtcggctctatctctgcctccactgctcgcccccccctcccccgctacggcgatcgagtcaggcaacactgaggggagaggcggcgccacagagggagagaggggagaggcggagaggggtgtggcttttggtggcgaggcgtgcgggcacgtggaggaagaagagcgacctgtgtggcactgtgcgtgaggtaaggaagggattggatgggctgggagagtatgacagtgggccatggactaatacgtaattttttctctacccaaaggactaacatagaaaaatgtttatgggacccacttcaagaatgattgctcaagtcgggtcttagactgcttttgctcacgtgaatggtgggggtggtgcctgcgttgaaattggccttatagggcaggagcaatgcaaagcttcgattccaaaaaaaaaagtgtatatcacatatgatgaaccaatagaaggatactattatcgtaatgcaggcaaccttcaagttgggaatgcaattgcccaacgcaagtgcgtgccgtgcctctgtgccttttgtcctcgctcacaggctaggaacccgtgtacttagcaccgagcggccttgcaggcgatgacagagaaccacgtggatgaaatctttgacgtggcatatgcatctcgaatcgacgagggcatactacaatcatctcttggcgaaaacgtacaagaaaaacgaagcagatcagcgcccagaagagactcccaaaaacgaaagtgacgtgtgctagctactgatggacatgatgatcaaacgagtgagaccgatgccgataataatcttgcggacaaaattttgacccacgccgcgcgcaccggccgccgtcacatacccgtgctatctacaggaccgatgtgctaatcctatctatcatagtgttctagctagttctaccgtctctgccccaccaagaaaatgtatgagtggcgcaggtaggggggtgccaaagtgccaacacccctgtccaaacactaccaccactacacccccatacttttactctatattaagttagctaagatagttatttatctagtttattttgggtagcttgaaagtattatcagtttagttagttagcaagtctaaaaatattagcaagaaacatgattaaaaaattagtttgtgatttctcatctttttcaatgtaaaatagatgatacttatttatgagattatttaatactccctccgttttcaaaatgtttgacactgttgactttttagtatgtgtttgaccattcgtattattcaaaaaattaaagtaattatttattcttttcatatcatttaatttattgttaaatatactttcatatacatatatagttttacatacttcacaaattttttaaataagacgaatggtcaaacatttgctaaaaagtcaacggtgtcaaacattttaaaacggatggagtagtttacattaaaagaacttagcaataaatattagttttaaacttccaatgatattattaaagagctaaaattcaagtttttcttaaaggactagtttacgcattgcttgttattagcggtgactatttgacctactttactattaatattagttattcagtcttatgatttatcttcacccctacatcccgtaatctcaaatcctggattcacccctgctgatgtttgcttgctcagctgcacgcctgcaccacaggacaaaggctgatccatgttgtcctttgacataaatatgcttgcatgcgtacgattcacttcgatcaccattcgtgcctgcaaatctgccatggcaaacagaactaaaaagaaagaaaacgtactccctccgtcctaaaatatactccctccgtctcataatataaggaattttgagtttttcttataacgtttgaccactcgaattattcaaaaatttttgaaattattatttattttatttgtgacttactttattgtctacagtactttaagcacaacttttcgttttttatatttgcaaaaaaaataaataagacgagtggtcaaacgttacaatcaaaaactcaaaatcccttatattgtgggacggagggagtaagtatttttggacttcgatacggtcttcgagatgctactttgatcaacgatatctatataaaaataagatgttttaaataaaaaaaagttgcatattgtgatagtttgtttaatgataaatctagtaacatcaattttacataattgatctttttatatttttgctattaatagccaaagttataaatatttgacttggcactagggttgtcaaaaaagctcgaggctcacgagctacttgagctcgactcgtcctaggcttaattcgagctcggctcgagctccaaacgagccgagcccgagcctgtcccaaagctcgtgagctttgtcgagccgagctcgagcttctaacgagcctagtaatatatgattttttattgctatttaataaattggtagatcaaatatgttatttatatgccttgtattggcataatatatttgttttattttttttcctcttctactaatatgataaaccataaattaattatttttaaaaatttatcatttgaaatatacattgttctaattaaaaatcgagcacggtagtcgagctcgagcttgatcgagctcgaaccgagcctgtatgaaagcttaaatattttataagctcggctcgagcttatatcgagctcgagcctaggcaggtgagctcgctcgagctcggcttgttgacaaccctacttggcactatgctaaaaatgcttatgttttgggacagaggaagtagctagtagatcgatgccgccgttgctcatctgggaatgctacttcctccattctaaaaaaactcatctttatagtgacctagcactacaaatctagacatatctatgtccagatttatactactagattatgtcctagcactataaatctaaacaaatctctgtccagatttatagtactactagaatatgtcaacatctagtaatatattaagtttttgggacaaagggaataatagcttgcggtggccaccaaatcaagatccccacggccatgcacaatactctcttcatctcaaaataaatttatgttcaattaattattagtatatcatgatttataaaaatagaagacaaaatgtatttaacgcagataaagagataaataacgtatattatgattagataagctgaggtattataatctctttgattttatattgctatgtgtgggatatatgaaaatatcatagtactccctccgtattttaatgtatgacgccattaattttttaacaaacgtttgacctttcgtcttattaaaaaattatgtaattataatttattttattgtgaccttgatttatcatcaaatgttctttaagcatgacataagtatttttatatttgcataaaaaatttaaataagacgagtgatcaaacgttggttaaaaaatcaacggcgtcatacattaaaagcgtcatatattaaaataaaatccggaggaagtattataaaattagagggagtatataacaccagatgcgtacattaattcacatctggactacgcagtggccagtggcgagtggcgacgtcgtttgccccggccggctcggggccctagccaagaaaatcaacgcgagacggccgtggcccgtgggagtcgtgatttgatcgacgcgtttatcacaagccttttatcgctttgcgcacccacaggagcagcacacaactgtagaaaatatattgtgcaccggccgtttaatttctttctgcgaagtaatccgaagaaagtggaccagtcaccggacgcgtacatagatgaactagtgcaaaactatatgttatggaaaacggctgtaccgaccgactaatcgccgtatatacgatcacggtagtaaaaccgttccg

SEQ ID NO: 62994 - DNA, 2656 bp, Oryza sativa
tgtttagtagggttctagtgatacgtgacagattaaaatgttatctactattcgatcacagaaccgagaattgataagtctgggatgagatctgtgaaattgatattggcaggttggttgaagatggggattaatctgcaaccatttgtgcacaaactcatttggaatgtcttagttttttggtgtgtttttgcttcaaaaataggattatgttgatgctggcttgatcaaattgaactgggttggttgcagggttggggttaatatgcaaccacttgtgcctgtactgatttggaatatcttatatttgttctatttttgcttcaataatagtttcaataaccagattattcttgctgtgtatttcgccatttgtgactccattctgactcattaccatgaacttgcatggttggtgcgatctagtacaagaacttgtaaagcacttgtttcttgtagaaatgtttttgtacaagtgaatttaggccataagggcacaccatagatatgtttattgaattgacgctgattttgaaaccacgtagtcatgcacatctgagttgaataatgatttacatttacctatgaaaaaatataagtgtacaagttggcacttagacctttgatgtatcatgatatcgggagtatgatttctgtgaaaaatttgaaggctatgtagatgtgccacacgttttcaagtcacaaaattagaaatcattaatattcattgtgtctgggtctattagaaagtccgaagcttcatttgcctgtttatttttggtatgttaaaatatgtgttgcctagtgtcccaatcgtctaatcaacatccaacatagcaatgttatatatttggtgtcattttagcatcagttaacatgcgctacacagtttgcaagtgtattgcacctgcttcacaattatgagttattgtagtaccagcataatttgttctcactataagcgtatttgttctggcaaggtgccaattgtacaatgaataccacttgcataaattgaattgttctcaatgttgtacaacgaatgaattctatactaattgtattgattaattgagttttcattagaccctcgtgatgaatatcaatgatttctatacactggtattgacttgtagtatacaatgattgaatcgttctcaacattgtacaatttttttaaaacaaatgcattgtacaattaattctatactgaaatgacagtgtcgacctgcattattttgactagttttaatcgatgttcttgttattcctttagctctgtctaacggtcaaaatgttcatttttcagctcttcttgtatgggagctttttgactggagatgagaccgttgatcttaagaatggcctcacatgttgcatctacaatgtgatttcaatgctcaccatggagatggccagagtctcggccgtgaacacaaagacaacaagatatttgttggtatttcttatgatcacagataaatctgcaagcgtacagaatataccgatgtagcatttcacccgggagtattctcaggtatcgattttcacagggaatgtgtgtgctaactccggtttaggttcatccaagggcacgaagctatggataaggaaaggatagagaggtttcaccgataagaaatagtgtctatagaaatctcaactttaatcctaatgcggtacttcgagcactggccagctcgctgctcccagatatcattttaccacgcacccggacagggaggatttcactcatattgagggctgtcacccaccttctacacttcaccttcacaccttaccgttgggattgcggagccaaccacccgaaaaatccaactaccctagacccccgcgtcttaagcaatttaatagctacttctagtgttttgtactccacttaaagcaatcactatattataatggactatagtgaacgatgatcccacacgctaattaggaactaaccaagagataattctcaccaagcaaaactaaattacttaaaagatatttctattataatcagagtaattaacaaagcacaaagaaataggaaggggattaccgacaactccagaactcctccgacttcttctcctctactctctccctaatctagtatataataaagtacaatagagcatcttataattcagctcatgcttcaagtgtctgtgaatgagggtgaggagaggggtatttatagtgtggaggtgacttgagagagtggagatgctaaggaatattctccatagaatccaaatagcatcttccttctccctttgccatgtgtcttcctgatgacggtttccactggtattaacgctcataaccgtcataagatgaggagtacaaccatcatgccgaagctggattggattgggccagttgctcgaaccctggctagcccatccagctagccctttctctggtgttctgacatgtgggtcccactatatgttccaatgaaaattggccaagataaatgggctcaacactccataggcttggctatggaagttatattctcatccttcatgtatatttcatctcaactttggtgggttgcattctgcatacaaatatacatcagcactcgtagaaatggttagaaataaatcctaccactatgttggatgttttacttttatgg

SEQ ID NO: 62995 - DNA, 6124 bp, Oryza sativa
gataacgagtttgcttgacacgggtttcatgcgtgcaggtttgtaattttccattttgtttgcatgtatttcaattccaacctatgtgtaaattgttggtgctagctgaaagtttctacttgcaaatttacttagctggtggacttgattccgaggcccactacaaatacaagggttatttaattggcaaaccaagctacatatgcaaaagcagtatcaaaagcatttcagaagatggcgaaaactgaggtatatagagcaattggccagttcatgcagttctgcaacaaaaggggcatgttttcctctagagctgctgagattggatcatctagctagtacaatgcatgtacttcaaatctgaattatgcgtaaattgcatgaattccatactgttggtttgaaatatattaaaatattgtcagtttgtactattgcagctgattggtgggaaacttatggaggggactatctagaattgcagaagcttgccaaaagaattgtgtcccagtgaatgtcctatagtgggtgtgagagaaactggaatacgtttgcattggtccacacaaaagtgtgaaaccggcttggttatgaaaagttacataagttggtatttgtgcactacaatctgaagttgtgtctccaacagtttgagatggaagtgatacaaagggaaaaggaggttgatcctttagggatgatgatggatgtggctctttatgatgaagggaatccaatcatggaatggctttctaatgctagaagtgaatctgctccaatactcgatcaatatagttgttcatgaggtgttaatcgacatgtcaggtaccaggttccttgatgagcctaaccatgcatgtgccaatagaaggagagcaaataagaagaggaagaagaatgcaaaaacaacgtatatagatgaggaggatgttgctagtggtgatgtctgatgacacggacatcgactctgatggtacactaccaaactttgcatctagcctgtaggagcaaaaccgtcaggaaaattggttttaccgtcagaaaaaatattcttgtaggtgcaccgtcagaaattgccgacagaaaaattaccacagaaaaattcaattgttcagtcggtttcccgacagaataataatttctgacggccttttcctgtgggtggaacacaggaaaaaaactgagatgccgggtttgagagaacatagttctgacgagtgcaccgtcagaaaaattggctttccaaggcaaaaaaaaaaagagagagaatgctatgcacatgcacttcagattaatacacaagtaaattgatttggatattgcactcatgattagatccatacataattatttacagcaatcaaatattcatagtacaattgtgcacagatacatcaacttcagtgagatatacatatcaaagtttcaactttgtgtcaatcctgtttacaaacactaagaaaatagccacccagtggtaaaggaactgcaagtctccatctatgttacaatttataaagatacacttataaagattcatattttatctttcaagataaaattatccaccaaacattgtatgaaaattctgattgatcaacacctttcaatcagctgcaagcaaaaaggcaacaggtgttgaatgatgtgcaacaaaaataataacttgcaagatatgcactaagatgtggcacttaatctgtacctaagacttcgttgaaatttggcgttcttctgtagttttggaatggactctgcaagatggacaaattgaatatgcaaatcagctatacaaagaatcagtttaggtcatgcacattggttagttatatttagcaacacattcaggcagatcactttactgtaactgatgaagctttgtctcatgacatttaaatataaaccagggaagtttttttttagtagcaagggactctaatgtgggagtacctgttgtggtgccactgtattaggtcttcacaaaatggcttgagagaggaaaattagatggtcctgatataagttgaaacaagaaacaaattatttagatgtaaaatagacattatacactagactaatccaagaaaattaagtttctattatggactaagttacataatgtagactaatatgggaatcaacttttcttgcttaatatccgggaatcagggctgtctcaagggctctgaaaaaaaagagtaggtgaataaaatatcattctacttatacttttaattgatcaactaattcaaaaaagggcacctaaagtcatcagaacatctatgtgtttcgtaattggcacctaaaggtaaagtaattggcaacaatattagtagacagatggtttgctacccgaagcacaataatatattgcaagtcaattaccggtcttgaagtctaattgtctagactatccagatcaagacaaatatccagatcaactatacggtgatcatttactccaaattaagacaaatatccagatctactcttggtaatcacgtactgcaaatccttgcaaaataatccggagagcagacctaccagctgttggacgaggaggcttgctggggatggactgccgcagatccgctcacctcgaggctagacctggcgccgccggagacgggagcctccggatctggaacacccagcctcgggatggctggatccgtgaccatcgagaatggggcatatggatctgaagaccctgaacttgggttggctggcaccgccggggaagagatggctcatcgatggcacaaggcggcggcgtggtctccattcgtcaaagcaccggcgctggtgctggatctactcgcgagtggcgatggggactgcagaaggaggagaggggtggcggcggtggcttgagggattgggacgcgagggatgaaaaactaggttttcttatgtgggctgctggacttctatacgatggatttaggcccacctgtcagtggtaattttctgtgagtactagcacaaccgacagaactatagcgatgttctgtgggttggctgcgaaacgcacagaaaatatcacagcccacaggatagctctaaagtctggtagtggtagtcgtagtcctgaatatgtagagtcaggggatagcagctctgctagtgagaacatctctgatgatgaagatgataatgtggctgccaagaatagaacctctaacaatgcccaagcaaagaactccaaaggtgtattttatattagttcaacataattatattgtttatgtgtgctaatttagttctatactacgtatagcggtccatcctgctccgcgttcaaataggaggctgaagaatatcaacaccttaatagacaatgacaaaggtaatttcatgctactttctttcaaggaggtataaattccctattacttgcactgacaattccctactagtacatttttattactatggctatgaaatcatgtttcccctatactgtcatgtcaaaattacatattcagtatctctctttctctgtgtgtgtttttgtgttcatggctagctcaagctgcactgagatttcatttttttttacaagtactgttcatgtttgcaggtgaaggcaaagtgtcacactagactagcagcaagtcagaaactgcagcactgcagcttcaagatgctattaacattattaacaaagtatccatatttgtagtacttatgtgcctatattttatagtactggactattgatagaatctattatgctcctatatatattttgtagtactggactgtcgatggactgtatatgaatttctagactttattgtgtgttcaaggatattgtatgaactggtaatggactgttgatggacttatatatttttgggttggactgtattactggactgttgatgaactttatatgcatttctagacttcagtgttcaaggatattgtctgaactggtgatggactgttgatggactggtgatagacttgtatatttttgatctgaactttatatgcattgtatgaacagctattatgataattttggctgcgcgcgccgctcgtatgaactgctattgtgataattttacctaccgtgttcgtatgaactactattacaatgatacaatcttcctattttgtttttttttaatttcagaaatttcggccataattttaaaattagaattcaaaatttatttgaaaatttcgtccaaaatattctcaaaatttctgaaattttgggatttcggtgccccccaccccccaccaccaccacgaaaaaaaaggcaaaccgatagttgaaaccctaggtctgggtgctctcccgcacggggtgcctccacacaggggcgtgcctagtttatactacccggtgtcacaggacaccgagtagattattcaaatcctatataaattacactatattaattattatattagtcaataattagataattagtatgtattagacccccggtaacttttgttctgggttcgccactgcctccatagcatgctcgctggcacgctccgcggctatggtaggtggccgtcgatctacgacagccatgggggagacggtggcagttgggaggcgagaaggcggcaaccaccggcttgggccccagcctcctctccacctcgctaggcacatcgacgggagcttgggaggctgtggcggcacgagatgatgcgggagctcggctaggcagcactgccgccatggagcccaacgcggtttgaggcggatagctcccctcgcgcgcgacggtgtgggcatggcgagccacgcggagatgcgttggggttgccgcgacggatggagccgcatgctaccgaggccacccgcgggcggcaggcttgatggagaggaagcagaagcagccttttttgcctttgcagttgcgctttgaggtttggtattggtaggagcaggagcataagctagcaaccttgttggcttgttggccttgttccctttcctgcactactttttcaccgatcaacccttgaaggcttgcaccaagttatgcaggacttccacacaacaacagcatagtatcaacgatggcagtaagacggcagggactggatgtagggagggaaggatacggattacgaatagcttcatggagacaaagtgcaaagtcacagaacctcccgttgccaaataattggtggagcaaaatgtgaaatatttgttagcatctgcagttcataaatttataaacaatcccatggaagcaaatttaggagcatatgttgatcttaaaattcactgcaaatcctatgaatgaaaatatatagctactccctccgtcccaaaatataacaatttctagccattacaatttgtcccaaaatataacaacttctctaccaacgttctcttttcaaccaatcacaaccttccaccattcaattttcccacctacctccacttctcctacaatcacaacactcccctatttaatcataccatctttcttactagtcatgtggctctaaaaatatttatattctgagacggatggagtaaaatttagtaaatagggacataagtaaccgaatctgcaaaaatatagagcctagaggggcgctatgcataaaaaaagcctggcattccaacaaatcaacatgtcccgcatctgactcgcttgatggatttaggtttaatgcccattttgttttgcagaaaataaaaggccaccaacaccaacttatttgggtacgctttcttgggcttaaaaaaaggaggtttaaaatactggatttacttacaaaggcccaacgcaacacaccaaaaaaacaccatataggtgtgagtgaagcccaaaaacataactagcatgaaaggtacattatgaacagaaggaataagtttatctgaggtcccttaacttgtcaacgagtccgattttcgtgccttcaaccggaaaaccagatacaacgggtcccttaactatcaaaaccagtgcagatgaggtccctcggcggttttgagggtggttttggctgacgtggcgcctacgtggcaaatttgactggtcttcatctgatgtggcattgacgtggcgcatacgtggcaattcgatccggaaaaataataaacttcatgagacccacatgtcagtct

SEQ ID NO: 62996 - DNA, 18631 bp, Oryza sativa
tgttgttgataatcccaaacatgggggcaactagtcagtgcatgaaattttacagataacagcgtcagcatctcatacttcattttgatttacgctgagctgacgtttaatattctatgaccttttgaccttacttttgctccattgtggataaatctcaagtcatcaatacctttctattcaatttggttcatctaaagggatttacactggtctttcgcaatttcatctaaagagatttacacagtgcatcacacttcaatttgatttctgatcaacacaatttaatctgcagaatggttaatgaacgtcaacgtgccctgttagaagaatttgcagtagaggaagccacgaaggaacagagttccttttcagctggaaactggtaagcaaccctcacatcattatgtgaacctatattggaatagaatggtaatcgcaggatcaatcattgaaagatgcatgatttattaatgtccatctattgatcaatttattcacttgaagaaaatgtaacgatcaatgtgtttgctttattctggtctttttagtttgttggacctggcaagcaagcgattcacctgacctaccgaactttcattgctaatatttgttgtttttatttactgcttgcatcgtctggtagtaataaagatgaaatttcaaacaggctttaccagcagctgtctactggttgatacttacaggtgggagctagttgaaaatatgaaggggcaaactttcttgcttgggcttggcttcctcgtactggttcacctgctactgaccaagactgtgaactaggcttcacaaggaacatctggcgacatcacatcgtataaattctctggagatttaaaacctggacatcggtcatcatgattattcagctgcagggatccgtgattttggaggcgcagggcagaagattgctcgttccattggaagagatactcatactagtttgaattttgattcccattacagtcgaatcacaagctgtacggagttttattttgtaatgctccaataatgggagaacaatggggatgctaggtttcaattcctagtttttgctgtgttttttgtttttaccagcatataatttgggtgcttaatagggaggatagctacaaccagcagaaagtgactttttcctacgcccgtgctgcgtggagtgttgtcttgtaaattcatgctgtcatgtaggagtaggtcttcatggaggcctaaaaactcagccaaaaatggcccacatattgaatgttacgttgtacaagtttgatcttgaattttgcatggcagatgagaagagcatgctcttattcaaattccttagtatcaacaaatttcaaattcgagtttctgttgtgtcatcctttcaaaaaaaaattctaagtttgactagtggatttggcaactactccatttctctgttttaaaataaatcaatctagcatatgaagggatatattacttgatggtacaacaaaaaatttgaactaagtaccatgagaatctagacagcaaatttgaacattagtacaatgagaatctagacagatactttatccgtcctaaaaaaacttaacttctagagtatgaattttatctaaaaaatcaacttctatcattctatcttacttttttttaatgattatggacatttcagtcattcttcatctctatttttttaatgattatggacatttcagtcatttttcatctctatttttttgtcttgagatactaggattggctttttttataggacagagggagtatgtctcatttaatattagtttattttgtataaagagagaattcccttcatcccataaaaaaccaacctagtattaagtgtggcatattctagtactaaaaatttagacatatctctgttagattcgttgtattagaatatgtcatatttttagattcgttttttgttttttttgagacggatggtgtattgttttgcagcacgggtaagaagacgttgaccaccgtacgccatggccccgccgcatgacatctgtgccactcgtcgtctgtccaggcgctgcgcctctccagacatcggtgcatcgcaggaccgagggctcctgcctcctggactttttgagagggaaccacccaattgtatagtggggacgaaaacttttttttttaggggaaatcaggatttccattactatgacactgctaaatcatcagcaaccaggtacatgatttgtgccggagtaggagccaaaacaggggcctccgccggatcgcagacactacccatagctgccagttcatgagctactctgttatatagccgaggtacatgactaacactccaggaaatgaaattcaggcgcagtaaggattgaagctctgccaccaggaacgacacgtcgctcagctcgaaatcgtttgtgtagaccgcttggatcacagccgtcgcgtctgtctcaatcatcccccgccctattcccatctccactgctgcctggactccctgtaagcatgcaataagctcaccatggagaggatgcatcagattattcactctcccccggtaagcagccaccacatcaccatccgtatcacggataactttggctgtatatacatgtatagttctttttttttttggagagattcgttcccataaacatccatccgatactgccacattttcaagtgttgataataaaagcattcaaaatggacagctccagtgttttcccatacatcccatcattacaacacgcggaaggccacaacaaaaagaacacatttcgaacacgtatagaagctagtgagtgtatcgtctcaaatggctccgaagcacacagccgcgaaggatctgaaacaggagacactcagaagcgaaggaatcgatcgcggaaatagagatgcccccccaggattgctacacaggatcaggatgactctcgactgaaacttctgctttggtatctacggttgcatctcgcgggcactattcatggcttcttggaggctacacacggctttgtcatacatcagaaaacccatgaaccagaactcgtggccttcaactgaaacaacctgaatatacttttcagcagggtttactttgctcactgaaggattagccgctcttagctggtgcagaggaatgaccacctgtttatccaaaaagaacatatgagataaatatggacgatgcccctacgtttagaagtatttaaacatcaaattggatcaagctcgttttgccctttgatccaaaaaaaaaaaaggatcaagctgctactacaaaagttatgaactactaggtattagtatgtagcaaaaagcatcaccaagctacaggaatgactataagcattatgaacatgccagattcaactggtagctatctaggcaaaaattctgttcttcaggagtagaagtgttcataaatgagtcatgcttgaaaagtaatggaactttgattctctaattttgttccatctttccatggtgcaaaattaagagctgataactgttcttatcatgctaactatccaacagtaaactacagttcacggttcacaaaataaaggaataatcaaacacacaatcatgggacttaggcataaactaagcacgtaaaattaaaagaaaaggtgaagcatggaaataagatgaaggtctcataagcactgcatagagtctacaaggaaatgaacaattcttgccttgtagtaactccattcagttttatttccagctttgtaagagagaggattgtcgctgcagaatgcaattttagctgtagaaatgtacatgactcccatgacaggaccagcagatgttgatagatagcatgcataagatattttcagctgctcctcaggaagaacctcaaaagtttgcctgaatattttttcatagccaccttctgctaagactttagttccttgagcaagccgtcccatagcagcttcagtaaaactaggtcctgtcttgactgattaagaggcaaagagtgtagtcagacatctagtagatattctacatctgtgcaaaaatatagttcatgtaatatcctgcatagcaccgggttgaccatgtacaaaataacgtttgggtctctcagccttttgcataagaaaagtgaattattcgcagactgcccatcatttgaccacaataactattctaaagtaattaaagtgtgaaaattgttcatggggcagatgatcattgctttgaaggataattcacccaaatgtgtgacttctttggatgttcatctatatgcacagttgatatttacaaggtttgctagttcaaggacaagttgacataagaatttatacctggctccctaccccactggctcctaggagccagctatttagccctaaccagttatcatcagtattttgcaaaattattatcattcttcctaagaggttcatcgtatattataattgcaagagaacaacagcatagacatgcatttgctggtttgtatagaaaaactggccggtcaagtctctaattattaatgctgtcatgatcattcaatcagttcaaattcacacggaaaacaaacaatggaattaaccaaacagaagggacacaaaacaagtttcttcatcactaactctccaagatcaattcgtcctactacacaattaccagttcctttggatattcaattatttgagaaagatgaagaacgtcgttagcagaacaaagctttctggggaactgagcacagcactgaagctttaaaaacaacttacaaaacatgcccgtaaaatagagggtataaagcatagaaagctacgccaaatgttttcacaagcttcaaaagatgctgatacttccaaaccaatttctataaccatcatctaactgttgaaggaatctaccttaagttttcactttccaactttatctactcccacattccttccttcgatcattacaaagccaaaagagcctagtgcctacgcgacgcaatccgtggacctcaagaaatgaatcttgcaaacaatggaacaaaaaaaagctaggctccggtaaaattgggagagctgaagtgggctcagagatctcacagtgctgccacgtgtcccggctgaggctctcgaccatcttggtcgtctcccccaccgacttcccccacctggacagcgtctccttcatggcctccaccgcgcctgcgggctcacaaagcaccagagcaaagatcagaaccgaaacaatcccccccttcctgagacagcatcagaacgaaccccagcggcggcgttaagcgttacccttggaggacgaggaggcggggccgcgggagacgtactggctggactcggcggcctcggcggtggcggccgccacataggtgggcgactccgacgtcagcttctcgctccacgtgacggtcttctgcccctgcggctgcgcggggggaggcggatcggcggtggcggcggccacggcgacggggggcggcggcggcggaggggaggaggggtcggaggcggcgggggggtcgtcggatctgggcaccgcgggcgcctcggcggcggcggcggcggccggcggaatctcggcgggcgtctgcatctgggccgccgcctcctctccccgactccgcgcgaggaaaccgaggagaaaatgggtcgcgcgtttcgggtcggagcggagtggaggcgtggcgatgggctggagtggtggtggtggtcggggtcaaaccttttgtctttgttggtgggtaaggaggagtagtgcaggagagggagagggcgggtcgcacgcgattccgcaaccgcaacggccaaagtaggggatttcgggtcgtcggcgcaccgcagcttccaatggaaggatgcgtagacgacgtggcacgtggccacgtgggtagcaaaattgggctgcatggaccaaaatcccggtccgtttcttgggagtaaataagtccatattgcctccctaatgtaggtagaatttgaagctatgcttggggagcttcagattataagaatctattggttggtagccagcttctaataatctggagaagttcgatttttcagcttctgggttctagttcattttctagattctacaactacaaattcttagaatctatgtgacaatttgcactgtttagggagctgaagattttgggagaagctgcagcagctagaagctccccaaacaagccctcaattcacccttagccgctatattgccgccttcaattaaaccagtgttttttaaggtatgtaacgtgtaaggctgagtttccaactcacttttcttgtttttcgtgtgcatgattttcaaactactaaacggtgttttttttaaaaaaaactaacttttacaagaaagttgcttaagaaaatcatatttgtaaaatcaaagtgtttgtattcttattctgtgatgaacaattggcatctgcaattattggttttgatatttgaagattattggcgaagtggtttttgagatgattggatttacaggtgttatacagatactgttgtgatttgggtccggtcagatcgggcagtggttgccggtcagaccagtgtgtatcgcgcggtcagatcggcttagcccgagatctgaccggccgactctgtgtcggtttcgggttgtttgttcggatatccatgattatttcgtgtttctggcttctagacggatactatacgtatgtaatactgttgtttgctaacaataagtcaagttggagatagcttggtctcggaatatggtttctttgtttgattcatgtgtaagtaacttgatgcctcgggagagtattgccggtgatggattgggagtcgacttggggataaggcgatgtccgtgacggttagatatcatgcgggatacttaggctagagttcaatgcacgtggttggtgaagatttcatatggcatacgatggaggtattgtgtgcatatgggatgtggagtcgaatttagaaggagtccaaatttggtatgattagagtttgtaaagtttgtttcttgtacgggaaggtttcctacgtggattaggacttcttgtataagttcggttcgtggctttaggctgcctacctcatgtataaataaagatggagcgtgaggcttcccggtatcgcttttgagagcattgtgttgagagttgagttagggtttcgagtttagtcgagattttcgtgaggagtgctgttgttgcactctgtaaacacagagataagtaataaagttgtcatcaactttgagagttctttaatttgtgtttgttcgggttcgacggtctaaccggtgagatactggcggtcagaccggcgatatcgcggcggtcagaccggcggcatacctacggtcagaccggcggcgactacagcagcatctgctgatcttgacggtccaaccggacgatctactccggtaagaccgacggcttccagacggtcagaccggcaggactacttcggtcagaccacgatccatcgaatttgagggtaacttttatttccgctaaaagttttagtttttaggtacaccaactattcacccccctctagttggcttagttcttgtgtttcgatcctacaatattaattcattttaaaaaacagatacttcctccgttttatattataagactttctagcattgctcatattcatataaatattaatgaatctagacatatatgtgtgcctagattcattaacatctatatgaatgtgggaaatactagaaagtcttataacataaaacggaggtagtacttgattaatcatgagctaataggtcactccactttacgtgtgggagtaattagggtgtgttttgttgctcgaatgccaggagtaattagagtgtgttttgttgctcgaatgccctcagcctggctcgtatgcctcatccaggctgggtttagcctggttagaatgatgcaatgggagttgtttggttgtatacattagatgagcccggctcctaacaccaggcaaagaacaccgcctaaggctgtgtttagttccacgtcaaaattgaaagtttaaagaaattgaaacgatgtgacggaaatattgaatgtttaaagaaaaacgttggaatctaaacaggccttaagtggcattatagtccacgctggtttggtccacctacactgcattctgcaacgcctagttggcctgcatcaaccagcaggaaggaaagcccgactgacttgaggtggtccgcatcctcgtttctcaggttctgaagacccttgatgcagatagagattatatacaactaaaattaaccttgaacgtatctgactgtaatggtgataattcattccacgagtattgagagttcatgtattgcattatttgtgctgctttctagttatatctaacgtacgtcttagtgtttattaaccgccattgagaattgagatatgtagagaacccaaacgagaaaatctgaaggcaatttattaactgataattcacccttggccatatgagaaaattcacaaacaaaacgaaatacaaagaagatgagatcaaagttcttgcttacaaggacagtataccatcttgttggtcactgatgcttccccttcttcatctgagtcaagaactgatcaaggtggaacggatcctcctccatctccggcccgtcaaactcgacgggcctctccctcttgccggcggccacgctcgccggagctccggtgaacgccttgtcgggcacgaacctgcgtgtcttggcaatcttcccgaggtgctcgtcggcgtcgccgtaggcgtcagggtcctcctcgccgtgcttgctcggcttgtagagcgtcgacagcgccggctgcgccgcgaagagcctcccggagtagacgttgtactggtcgtcgccggcgaacccggagcccattcccttctcctggttgaacagccgctggtcgtaggtgacctcgccgccgccgccgccggtgttcgccatgcccagggcgatcctctcgctgacgtcgcggtccctgtcccgggtggccgcgctcttcttgctcgccgcggcggcggcggccctcgcctcgagccgcctctcgcgcctccgctcctcgcgtatcgcgtcgcgctctgctgccgccttcgaccgctcgctcggcgccggaggagcggcgccgagcatctccgcgcgcgccttcgtggcgagctggaggagatgctgctcggccttctccttctccctcatcttcatctcggtgtgtaccttggcgcgcgtctcgacggcctcccgggccttctgctcggcggcgtacagcgcctcggcgagcgcggcgaaggcgtcgctcacctggacgtcgtgcaggccgcggccgtccaacgccgcacgcttgtcgagcgggatggagtagcccttggggttcttccagctcgagatgctgggcggcaccttccagtcgtcgtggtccttctgcgacggtggccgcggcggcgagcgcagcactggcaccggcggcgacccggcgggggcgggcactcgcttgtgcttgaacttgggcggctcgagcgggtcctgctgggtctcccccatccggatgatcctctccgccgcgccggagttgaacgccgatgtctgccgcgcaggcgtgtacttgatgaattccgggtcgtggttgctggccagggtgttcgacggctgcacggcggagaggcgtttctcgacgatcgcacgcagcgcggcgctcgtccgcgccgtggtctcctccacggccgcctgctcgtcatcgtcggcgtcggcggcggcggcgttgatcttgggcaagacgtcgccggggctggagtacacggtcttcccggcgttctccccctgtctcacgacggcgtcgaactcgacgcggccgccgctcccatcgacggtgaggctgagcacgccgccggaagacccccgctgctccccgtcgccgtcgccgccgcggcggcccatgtcgagcgggtactgcgcgacgtggacctcggggaaggcgccgccgtcgccgaagtcctccttcctccgaggcgcgagcgccgatcgcctcccgtagggcggcacgggattcaccgccctcgacgacctcggcgcgtcccctccgccgccgccgccgccgtaccgctccttgaaccactcgtcctcggtgtggtcgtgcggcggcgcgccgccgccgtgcgaggggtcaggcagccggagaaccatcacgaatcacgaggcaaatcaatccactacgaccggagatgcgcgtgtgggtgatggacgtccggggcccgcctcggcctcgacgtcttgtaggcgatcgagacgccgactccgtcaccgactcgagctccgaattcttcgtggcgttggacccgctcgcgcctgtgtcagcggcccatgcaggcccaatcatatgggctgcacgtaagtagtaatctggcctactctaatccgttccggcccaacagcatgggccgcacataagttgcagtctattctggcctagaatattttaagtccctcaataaaatggaaacaattttgatccatcgagggaatgttctcatattttttttttcatgtccctcaaatggtcatgaaaaaatttaaaaacattaaagaagatgtattaacatgtgatatattactccacaaacatgcaagttcaaattcaatctctacatctcacaacgaaaaaaacaaattaaacaaattaaactatagctagttaacgcatattcacagtaattttttttcgttgtgaaatatagaagttgaatttgaacttgcatgtttgtggagtgatatattacatgttaatatatcttcttaattttttttcataactatttaagtgacatgcaaacaacgagggaacatcccctcgagagatcataatccactctccttaatataggtccaatttcctatagttaggtctagagtatgcatactactccctctgtcccaaaatataataacctagtatcggatgagacatgactattataaatctgaatatgaatatgtccagattcgtattctaagatatatcacatccagtattaaattactaatatgtataatgagtagagatcaatttgatttggaagaatgcatgcagcgttagtgcgttaccgacctactggaaacaggataggtcttttgagctgtaatagaacttttgagatgtaatcttgtaactagaaaccactttacagggtgaattggtatccctcgacgtagtctgtatctgccatcgccctggcgcaattggcctggcagctggccagctgccggttgaggaggaaggatagagggaatgacaaggagagacaggatgatatgtgagtaccacgtaatgattctgtcaagtggattaggtcaataaataacatcagcaaatacgtctctaaaattaaattgcaccgattaatacgtctcgaaaattaaattgtaccgattttagtaattagatgtttagatattcgatattgcgatcaaatgatacgcatcagattgtatagtaattaaagtggactttattccttctagcctatccatgatggaccgcgagcgtacgtgtactagatcgctcgattttcccttctttcttcttgcgaataaaatttaaacaccggatgctgtcatgctcgcttccttcttcccgccacagaaacattgggagaaaattccaattcccatggtccctgaacccccaaaacaaaacagatcgtaaactcacatgcaaatctcgccgccgcggcgtcgccgaccggaggagctttgtcgtctgtatcttctccggtggttatgactcatgcgtgcgtacgcacgctacgacggtggggggccctgggccgcggctacgccatggtcgcggcgagctggagatggagaattttttttttttttgcctcccggcctccgaacagcttcagatctgttcttttgctatcattgttcttcgctcgtccggatgcccgacgcttccgaccgaggaatcctcggctccttgcagcggtccacggaaactggtgatgatagacggtaattaattcagcctccagtgtacgagggccagggccaccggtagatcgatcgcaacacgcatcgacacaggtatttctcgtgattttagtacaactaatgactgttttttcaccggtttttcacgtactctgctttcgttgccgcagattgagagaaatgattctacatggttctacatcgattttcagcataatgtttttcacgcacacatttttcgaactactgcaccatactccctccgtcaaaaaataaacaaacttctagatttaaaatttgtcaaaaaaaaaatctaacttctaccttctcatctacaatcggtttgaaaatcgataagttttatctattcaatacccctcatctaccaacccatcgatataactttgctattaattaggagtattttggtcttttgtctctacccttatattcaccttgggaagctatagttgaatattttgtgggacagtgggagtttgctttttcaaagaatctaatctaatataaaaattgttttaaaaaacatattaaaaataatcattttattaattgtatgctaatggttcaccaatctactcctatcaaccacgtatatgttatcactatgttataagtggccaacttatcgtctcattgggttaactaacgatttgcccagcgaattagatggagctcaataaacatttcagtaaaattgaaggtgtcaatgtatgaagaggtgaaacgaaattaaagaaattaagggcatgttcactttgatgtcattttcaaccataccatttttttaaagtaaagttgtcaaaaaaatctatgtttaatttgttaccaaatttggtaaatacataaaaaatcctgttaaaattttggtaatattatcatcttgctaaaattttaacattactaaaatttggtaaggtttattttagccacaatttaaatggtaagatttattttagctacaatctgaagagggctaactcgcggtggttaatcaagtttcacgtactgctgcagcaaaggacaccgctgttgcgtgcataattgcacgcgctgcaagatctaagaggccgttcagctacaggtcaagcgcatatgtcacgtccactaagatccacagggccagacaaaatcctcacctgacagcgacaccgtgaacctgtcctccgccgcccccgtccatcggacggcggccaccaccgccgccgccgcctcgtcgccatcatcgtcgtcgtttccaagaaactgaaatcccagtagcctcaattccattagtgttcttttatggtagcgtgattgaatattagcagtgacggagccagaaacaataaaattcatttgttggtgaagggtgctaataatgctaatcttctaaaatctcaagaagaaaaacagtaaagataatatgtttttttttttgccaaatttgagataggccaggccgaaactgattggtgcaggtaactcaataagccgaacaatggcttcggtatttcgcctttacagagtgccacagaagaattggaatcaactgtgtgagggctggattgtagagggatggagcagctgctgagcattttcctgagggtgctgagcaaattattgccttctgcgagtctttgccatttgtttggagtggcaagcatcagcagaagcagcagcatttgcttgcgtacagactgacagacaaatgctgggctaaaggtgcagacgtggtgaattattattagcatgcatacatctggtcgttggatcggccggtgtgtgatgggatgctactatctgaattctgaaagattgagatagataagctctgaatggcaggcaatgcctctcactgccttgcctggtacagtggtactacatgaactgattacttgatgagtcgccagcaagatcataagctggaggactaacggttttggctgctcgacagcccaatcaggggcatttcagttcttttttttgcatgtttatttacaaagattatcaagtgcagcagcttagtacgtttttattactgtaatatgcatctgaatgatccatgtgcattactactgtgctaggcactgttaaatcttcagaaaaggaaaaggagagagatgtctctgcagactgcaattatgcagccaaattccaatctcgtaaggctccaagaaagaatctgagaattttctcgtctgcctgaaacagagacccttcgagatcagctctgcaaaagattagtgaaactgtcatgccgacagtgcagcgtcagaaaatgttaccgctaactttactacaggccgaagagcatgttattcagttactggcagtggcagatactcctatcagaatgctggatctgaaattacttctgccgcgccaaatcaccagtggtttgacttacccagaagactggcatcaagtggactaatagctaattagcagagtagcaggtgatcactaacccattacccatagcagcatgttcaatttaggtaaaatttgcaatgtctttttttttaataatggagagataaactgtttgaaaacggtagtagggacgaagctctgattataattgagatgtagcagcaaatctgggatctcgagtattatcttcttaactttcgcaagttgttgcttgctgcccagaaggccagaacaatgccatcaagtggccttgcagcacagtagcagaactgtgtggtgccactgtaccatcctagaagatgaccaagagttttacccatagaagaatgcccaatattttttatttttttctaaggacttgttcagttcatttccaaaaaaacaaaaaaaaacttgcaatttgttagtaaagctaaattttggcaagatcaagaaagatatgaaggtgatgtttagttcgacacattaccaaattttagtatagttttatgagcataagtttttatagttaccaaatgttggtaggaattgagaagagttcgacacattaccaaattttagtatagttttatgaacagaagtttttataattaccaaatgttggtaggaattgagaagattacgatggtaaagccttgtttagtttggtattgctaaaatttgatatgattcattttagcaacaaactaaacagggtctaagataagattgcataatagacaaatgggccttgtttggagtacaggaatttcgttgcattcaattgagaagtattctatcaaattcattggttcctaacaagcccttagtaagggatcaatgcctaacagttagattctcacctttagattttcgcttagattttgaggatatgtggttatagaatccgaaaattaactagaagctagaaacaaaacaaactcggtttttctatattatcattagttggctcccaatcacctgtttctctcagaattttccctcaaacaagagccaaagacatgtttcagtgacaagaccacaattaatctctaatgtgataaatgataatgttgttggtcgtacaaagctggcaaagtggggatgaacaaatggtacattggtccagcaacaacgacagtagcagcattcaagatcaaaagagtgaagggccccggaaatctcagagctatccataagtgtcaaaccatcaaggcatcaactaggagcctggactacaaaaactacacaataatagtactagtaattataaatacacttggatatgaaatgtacatgagcatgatggtagttggatcaaggcttttcttatagattgcaatgtttaacattgcaatgttcaactaccgcagtacttaagtacatgtaaaaaaaatacatttttagaatttcacatctggttatatagtattatcccgcctattgaccatttccagactgttgcattcacagagttacttaaatcaggctcctagaatcttcagcaagaacatataactaggaaaaaacataatgttttaggtaaagttatataacaatttgtgtgtccgatttcattttcaatgggatattttattcagcagggcataatggatgcaagttaatcatgctaagccatgtagcatcaaggataataacatattgtgacaaataaactgaaaatggaccagtgaataagtgtgggcaaatccaggactagaaaagaaatcaatagacacattttctttctcagattgtttccttttcctctgtttttatattttctttagaatcatcaaagcatatccattctccaaggttctctcaaaaatgaatatggaagcatgaatgcgaaataacaagagattgctcgtctctacaaaaacctgtcctaatgaccatgttcttgggtccattaaaacaaatgggtgagcaacatacttgaaggctacaaatgtacaacgaaaacaatcatctgcaaattctcctccttttgcttgacgccgagctctcataatttgttgcaggtgatccaacaaaagtgtcctcactttgttggcttatacatgcagctgcatccaatacacctatggggctttttggaatggagaaaacggagccggctgattggcgcataatgtttctcataataatcttatcttgaatcatttcatagcaccgtaataccctctcctacaacattcaagtaacattctattaaaatttgaaaagcacccgatcacagatgaatgcctcttaatgcaagcaagacaaactaacagagttactaagaaattagtgtcatccaacaaaagacagaatcttttgtcagtttaagaacagtgtattgaaagatcaagagattcagtaccttctttaaatttttgtaacaagttgccaccctctcaaacatggaagtttcatgttcctccgatgctcctagagctacactggccgcgatctctgatggtctgaaaaccaagaattcagcaactgcagaccaagattcccagatttaagagttcatcaccataacaatctattatattgatggaggcatggagtggaactacaaacatgtctaccaaaattcacacctttacatgtactcaagatgaggtcaactgagcgtgagagtgcggatgtggacggagtatcatcatcattgaacttgtgaaggtaataatcgataaatgagcaagcagtcacagcttgcatcctccactttagggcattaagcactgcaagctccatcctttttatggtcctagtctcaaacacatattttgcatcacacacctacaaaacagaaaatatcaaactgaaagaaatgagaaaagaaaaactttgatagtatttgtgcacaactgttgcatgtatgataattgatttcacctgcaagtccaaggggtgtggaacaacggtttcctccatttttgcagccaaagacaaggaagctactgctaagagttgtgtcatacaagcctcctcttgctgaaactcagaatgcaattgctccatgacttggcatttatctcagaagcataaaaaaatcgagtttgtatgaaatacagtaacaatgcaatgcagagaaagatctttacaggaagatcgaacacggagaggaaccggtccaggtagttcaccgacaggactgcagtcaaaggcccaaacttataaagctcatgtacctgacaagcaacagtttcagtcaaatcgtatacagggcatgacaggtaaaccagcaagaaccaaatcaagaacaggagaacacaaaacaacgcaacaaaaggggacatttttaccgaaatgtataccatcacatctcatcctgaatagtactagcaaggagtgatgaaaaacaacgaacagaagctcaccttccaaatccagtcaatggcgtcgctcctgacggctaccaaatcgagcccatcaggctgcagcagaagccgctggaggtagccctccatggggatgtgctgctgctcctccctccccaggagggcctcgatgcaatcatcggattgcaaggggaaatccatcgacaagtcccctagagaagcatcaaccccaacaacccaagaaatctcctcgctctcttcgccaagatcaagaatggcggtgttgtcctccgcgcaaaggaggattgatgccgcaaaatcaaagctcggtgccatcctagatcactcttcaaggtgcaaactagtagctaatctctaatccactacttggtagaagaaaggaactaataaactagtagctaatccactattatttggaagaggaaaggactaatcttgttctaccactagtaaatttttcagattctgttggtctgtttcgatttgatgcttctcctcccccttcaagcctccccagactattactgcttctcttcttggtattatataggagtactacttgagagctagaaaatgttcttagctttctcttgttcttcttgaaatgagaggaggggtgaggaagagaaggcgagaaggggtcgagagggtgcctgggtgagaggcactgtatacagacacagtagggagatgagggggagccggagaggcggtctcgtctccattaggtaagcttttttctttttctttggaacggtgtgagctaggtttgcagtaaattttggtccgtgtttagatgaccctcaacttctaactttttcatcatatcacatcatatcaaa

SEQ ID NO: 62997 - DNA, 20128 bp, Oryza sativa
  unsure (1)..(20128): unsure at all n locations
actttaattttcctctgatggagaaattattggtccactttttcattggatgtataatatgttagttagagataagagtcaaatataaattatagagataagatatatcctagagatagaatcctagagataagatagagtcctagagatagaatcctagagataaatctactcttacttgtattgtactctaagtctctatcccctatgtactcctatatataccccatgagatggtcgatgtaatagatcagaaaacatcagaatataacagtttagatttttccacatggtatcagagctgtagacaaacgtcgatcgatcctcggttccagctaggttccatccacgctgccccagggagatgagatcaatttctcactggggcaccgcaccgcatttgctagctagcatctccaatcatttacagattagtttactgcatatcattagatgcgttttccaataattagttttagatctattagctagccacagaaaaccatatgatcgtcaggagcaatgcggcaggtgttacaggagcagacaacgtcaacaagcatcataccatccggcctcgtccatggatcgatctgcatcggctacttcacaagaagcaagggcctgatgctgttcgtcgccaacatgtgcacacgcctgtgctgcacacctgcatcaagacaccggccgatcatctgtgacgtcttcgcggagtccaagtcaagccgccgagctctccaggacgatcgtcttcgccgattctacatcatcagtggtcttcatcaacttgccgctgccgactcgtccacatagatggacacctcgcgtcctctgatagattaatctgcaagacgcttcatcgacgacatcgaccgcatcctctacgacggcaacgaccgcgtcaccaacgacggcatcgatcacgtcatctacgacgacaacaactgcatcaactcggcatcactattatggtgaccactacacggcacaaaaggaacaaccaaaatggtggcctcatcgccaacgacgtcctctgacatatgcaagacgtctctaatggcatcatctgacatctacaaggtgcaagatgctaacaattgcagtttcgtcttcacaccatggtgtaattttttttttcgccttcggctatatgcggctacaccgacaaccacggctactacatgatcggctatatcgacgaatgtctacaacaagaatcatctacagaaactccagtccaagcgtccgtgtcatcgctatcgtccatgacactcccgctatgactgcgggagggaatagaggagagtcaagggacgacacagaaggggacgcaggcaccaggtggaggaccgtccatcagagatgcaatcgatgatagtgagtcgaaaaagatggagaaaaagatgaagaaatagaagattttaaatccagtcgcaatcgttcgcttcgctcccgttacgactgagggggaatgttagaagtataatatgttagttagagataagagtcaaatacaaattatagagataagatatatcctagagatagaatccaagagataagatagagtcctagagatagaatcctagagataaatctactcttacttgtattgtactccaagtctctatcccctatgtactcctatatataccccatgagagggtcgatgtaatagatcagaaaacatcagaatacaacagtttagatttttccacagtactatgttaggtttatttagttttgaccttgattgtttctccgcatatgtttttatgtgaatcatcatcaaagtcagatggtgagtcgaaaaaatgttgtggcgccgcctgtccacatgcatggaaaaagaaaaggaaaaccagcacaacaaatgaatgaatttttgtgtactgtaatgcaattcgtgactgtttatttttcatgattatactgtaacgcaacaaatgtgccccataatacatgcttaaatggaccaagaatacctgtaaatgtctaaccgcaccgaaattctattatattaaagtgcaccgcgagtgcacaagcgctactacagaaacgatttttctagacgagacactcgttgtattgcagacgggaccataaatgcccgcgtctgaaaaaatcgacctccatttccacatacgacaccttaaaaggccctcttgcgaaaatcgacttttgcatgcggaccctgtttttaccctgttccgtcttccatctaaccctgtttttaccctgttagaccctcttccgtctaaccctgtttccactacaccattaagatttggtttaaaagaatgaaataattataattaaatttcataatgccaaaatatccttcaggaaaccatatccatcccaaaccctatccacatatgtatctctctctctcctgctggcgagttgcggcaccggcgcttggtgtcttaagggaggaaggggatggtgccggcaggaagcgcgcggaggggatccgcaccggtgcccgcttgtggacgcaggggtggcggcggcgggaagcgtgtggaggcgatccaggccggcgcacgctagtgaagggaaggaacggcggcggtgagaaacggacggagggttccgtgcctgcgtcagatcacgaaggaagggagcagcagcgccgagcctcttcgacggcggtggcagcgccggcgcgtggtgaagctgcgcgcacagtcgggtgaggcggcgtcggcgtcggagaaggtagggaagggagccgtgctggagggaagaagcggcgccgccggcgcacggaggacggaaggaggcagcatcggcgccggcgcaggcatgtggaaagagggaaaagacggcggtggcgataggcatgcggaaggagggaggaggccgcggcgccagcaggatgaggaggcaccgccggcatgcacgaaggaaggaaggcggcaagcccgccgatggagctgtgacggctagatccggggagggaggggcgaccacagggcggttttccacagctgctggccggtgccggctcaccctctagacgctcgccgcattctccctgcgagtggagctgtggaggagagcagaagagagaaaagagaaaagagtagaagacgagaagagagaattgatgggtgggtcccacatataatagggtcgaatgattaagggaagaagcaacattttgtgcttcagtcaacgtcattagatgcccttaacagaatagggcataccatatcttcggatttgataagaagggccaaataagcaaagttgataaaaaagggtcaaattgatagttagctttcaaaagagggtcaaatgcgcaattgccccttaaaaaaagtcccatggtaaattgctggtgttatattgaagataaggactgaagagtatagcgaaaccatacaattcgcggttaattagggggcaaatcagaatgagaccacaaaatttagaaactaacaccgtagtcagcttaacactactaaacaatagttttttttttctgatgaccaaaatcaatcttggatgacggctagactaaaccacctacgaccaaaggccagagaaaatacactatctgcatatgcgggcttcatctgcgataaaaaatctatttttactggcagcaaggttaagtggaccgtcaaaaaaaattgacttttgcaggcggcaacattaagccaaccaccaacgaaaatgattttctaggaaaaataaataaattcccaaaaataactccaccgaatccaccgctcgcaacccgcactcgacctcctgccaccagtggcctgtttgaccccggcacccacaacccacgctcgagttcccatcgatggtggcccacacaaccccacctcccacaatgtgcactggagatctgccgccggtgccccgcgcaaccccgcgcatctgtggccccatgctcgagatccgctgtcagtaacccactatcgagatccgccaccagaggcctgcgcaacctggccatttgtggttcgtgcttgaaatccgccgccggtggcccgtgcgaccccaccacccgtagtcgctgtccgttcgcgtgacgccgtgagagaaaagatatggttaaggtcacttagtcctgccaggatctgcccgcccggcgctgccctgagttaggaaaggaggaaaggagggaggagggatcgagagggagtgagagaggagagggatgagaggctgaggataagacatatacaattgggaggaggaccatgtcttttatgtaggctgaaatttattttttatgtcggctcattgagaactgcttacgaaaatctatttttactaaggcaaattttactataggacgccgtgacttcatggatttagctgtaggacactatcagggttacgaataagatataccctctatccttggatgtacgttgtatactgatacggtatacccgcgcgtgtacggatagtttccgtatatattaaggaaatctatcacgtgatagggatggtatctacagatgaaaggagttctactcggacaagactgggtcaccatatcgtgaggggtccgatatcttcgagtcctacttggagatcaactgacccgcggtatataagggacccctgggcaggaccgaaggcatcgaatattaccgccaacacacccaccacagcctacggagtcggagcgtgcaggagccaagtcgccgggagatctagtcggaccaacttgactatgatctcgtcgatatcatcgagttctgctattctctttgtaatctgtggtttccatcatataattccataccaattggattatggctattacctaccaaggggcctgaaccagtataatccttatcttctatttgcttgatgtcgtactacgtcgatcctcgtaccaacggatcccaatacctttttatccggtctacgggtatcccccgtcgacagacacccttatcttctgtttgcttgatgtcatactacatcgatcctcgtaccaacggatcccaataccctctttatccggtctacgggtatcccccgtcgacagacacccttatcttctgtttgcttgatgtcatactacgtcgatcctcgtaccaacggatcccaataccctctttatccggtgcacatgtcagatcctcggcccacatgtcagatctccccttcccaatttcgagctcacgcgacaagtccgaccaccgcggcgatggatttctccggcggcgacggcgcaacattgtcggacttgtaccagagcacgcggcggctgctactccgcccgcgatgatgtggcccgcgtcaagcgcctcgcatcggtgcccacctcgtcctcctacttggcgctgatgaggacgtgcagcgggtggtgcccacctcgtcaaactattctaagtttaactaagtttataaataactacacaccaaattatttcattaaatcaataattaaatatatttttataatatatttgtcttgtgttgggaatgttattaattactttttgtacaaactaggttaaacttggagaagtttatctttgaccaaagtcaaagcgacttataatatgaaacggatggtgtagtatatatacattactagcaagactagtgcagtggcattatggaaaaaggttattgcatatttataaagtacaagatggagaaagtactttaaagcccaaacaaattaatgtattgtcgatcaatcatcacttgcattataaatctactcactagtagctttcaagaaagacttagggtaatcgtaattttaaaattctagctatgatgagattagaaggaattttaccttggcaaccatcctgtcgataaggatttccttggtacccgtttgtgcaattgcatatatagcctggtccattggaggaattgaagcactcgctcttgtcacttttacacgcgtataacgtgagatttttttgtgcttcgtcacagttgttcacagttcggatagcccaatccagtagcattggcgcccggccgccgtaggaggtgttaaactccggcgaagtcaagtagcttgttgagaacttgaagtcggacgaatccatgagcacagcgtaactgcatagggtggcgttgtagatcgagtccgacgtgttgaaggcttggtcgaagaagacctggtaataagggaggcccttggggatggttgtctggcagcagcctaccccagagcaggtaccgttggtggcgctcgtcacgtcacctcgccggcaggcggacacgcacccgctcatgagcttgcccacgttgtccttatcggcaatatatgccagtgttcggcacccgatgacggtgaacttgttgccggtgtcggacaacatgaacggagtgtccaagtcactctgaaatgtatttggttccatcaacttagatgcaggattgtagcagaaagaagatatcttattcagcacccggagctgactgagctgaagggagatgttgacgacctcgaaatctccgaggaacggcctggagttcttgcaggctagctcaaatccaggcatggcgcagcggcctgggccgatgctgaatgggtaagggatgtccacgctgccgcacttggtgtccgggcattccgccactgcaccgccggtgatgaggccgagctccaaagaagcgaacgctatggcgagccatagcattgttcgccctctatggcaagcaggcatggttaatttctttctggtggtgtacttttcttttttgcgaggtgattgcctagttgtgtgcacctcatacagttcgacgactgctcgtatatatatgaaggcaagcgtagccgctagcatccatgaatcatcttggatgtgtcgttcaccacaaaagtacaataaaacaaaaagatccaacgattcgtaccaagtcttcgcatgtactatatatttccgcaaaggtcgctataatgggttgacccgaaatctttatgaatgcccccttgctctctttgcccatggaaatattccaataatgttcagaaattggttaattatcgggttagacatggacatatagaacgacatttctgaacaatatggccatgtctaaatgacatgacgttttaacaaagaatcccacgtttagaccaaagcatcttattagagagcaagaaaaactacgggaggcaactcaacaagcatatggattaaaatttaacaagaggttgagtgtgacgtgaattttttatttatttcaacaactggcactactacataaacaattttcctaaaagaggcccacgttaggttgcaaatggatcataattgaccgcgtctgcagaaatcgacctccattttcgcatacggacatgtattgaaaaaaaaatcaattttcgtatatgggcgtcttaacaggcccgcacgcgaaagtaatatattttcgcaggcaggccacttaagagacccatgcctcttaaagacccgcctgcaagtctaatcttcctcctctttccctctcaatctattcaacaaaaagagaaaaatctcttctcccatctctctccattatcttctcctcacttcctcccctccactcattctaacctgctctcatcctcacttcccaacgacattcccggtgacagcgggggcagcgacggcgttggcaacggtcacgtgctcggggagcaacgtccgggagcagcgactgcgggctttggagaggccgggcctggccgggaaatgtgcggtgggctcaggaatggcagcgcgtgacagtaataggctcgggaagaagcggctgcgagcggccagatctgccgcctccagccccgcgacggccgtaatcggccgctgccgggccctcattggccagatccacgggcactagcccctgcgacggccggcaggcggatccgccgccactgggcacgtgatggccggatccgcgggcgctggccccgcaatggctcgatccgccaggattctaaggttttcttacttttaatttttttagaattttattttagtgcggacgacataagcacccacacgtagaaataggatttttacgtgcgggtgcgcagcccgcatgggaaaatgacattttttcagaccttatgttacaagcggatctccgttcacgcaaaaatgtgttttcgaccatatggaaaaacgacttctgtagtagtatgttggagcgcattttatatgattccgtttgatgtaaaaagaatgaagaaaatcttatacaagtgaattaattagggcaacgtaaatcttcgttagaacgagatattgttattttcattgcctttctcgagcgcactcctgactgcaaaattaagttatccatcgatttagcacacagataatttagacgccgctttttacttgcactcaaaatcaatacgtcatccacgaatagatgcacaattactttgatattaaagtcaccggtgaccatttccaggaagatgatccaacaaaattcttcgacggtctaagtcatctttgcatcaatcccacgatttttcaccatgtttatttaccacgcaaaaactttccactctatcacatcaaatgtttgtacatatgcatgaagtattaaatatagaaaaatactaattacacagatttcgtgtaaattgcgagacaaatcttttaagctaaattgctccatgctttgacaatgtggtgctacaataaatatttgcaaatgatgaattaattaagattaataaattcgtctcgcagtttacagacggaatctgtaatttgttttgttattagcctacgtttaatgctttaaatgtgtgtctatatatctgatgtgacatgctaaaacttttcacccctagatctaaacacagctttagtgcaaatcatctctttctgtaaatttacaatcactaaatcctaaaacttaacatacaaagatatcacattgtaatccactaacaatatgccacatcatcatccactaataattattaaatttaaatatcatgtaatccggctatattatttataggtttataatttataaaattttagagcttctaaattgcaaccacgttaaatcatcatcgcacataattcacacaaagaaaagtacaaattatcccctaaactattatggtcgatcgaattatcccccaactattgaaaccggacaaatatccccctgccataatccggagtggttttggttctacatggcaatccagtcagttaattttttattaaaaaaaatcaatgggtccatgtgtcatagtctctctcccctctaacttacttattccccttacacctctctgtatctctctcgggtcggaggctgtgaaggagccccgcgcactagcagaggccgagaatgagccgcgcgccggcggctgcaagcctgcgcagcgggggccggcctgtcaagctcactggtcgtgcctcgtcctcccgtgctcgtggaagcggcagctggcgctggactggcgtgaggaagatggaaagcggcagccccaatcggacttccacgggtagatgggcgatggtcgggggagagaggcgggcggcgctggcttgatcttcttcatcttgagcagcttcttgccgattagcgtcgacgcgaagctagtgcagcagctgctcggatagtggcaggacgaggggacacagcgtggtgatgttcatcttcagcgcgttgccggcgactgctatgaggtccttggacagcgagactcccgacgtgccatcgccatcctcctgctgtcgtcgccgcccttgtgagttctcaccgtgtgcaccagctcgtacttggatctcttcttcttcgatcgcttgttggacagcaggatcgccacgctgcccatccggaagagacagttggcgacttcgatggagagcaggccggcgctgcagcctgcagcccatcctgtcctggttgtagctggtgatgttgccctggatcgaacttgtagtggttcacagctatggcgaacagggacgacgtcgggttgaacacaggctgcagttgacgacgagtacgccaatgtccttggcgctcacgcctgtctggtgcagaagacggcgccgaacatgatggcctcggcctcgatcgagccacacctctgccatgcaagggttcgatggctcgatgagcacggcgatgaagctatgctgaggagggcgcgtctcaacactgcaacaacaagtgaaggtggaccacgggcggcagcactgcagtccgaggtggcaacgaaatggcaacccgaagcttgatggtgtagcgcatgctcgatgacgatcggttacagaagtcattgtagccgagaacttgaacggatgatcaagccaaagttgcgtggggctagacgacaaagaggaaaccggagtcgatgctgaagtcggagacacacagatgtcaacgaggcggtgggagacgcaaacccaatctttgatcgggaaaaaaaaaaggtgatacatgcagaagcagccgcaaacagtatggcagtgcctaacttttttttttttttgagaactcatgcactttattaaaagaaagcgttttagaaacacaaagcatgagttacattaactgctccattaggagtgaaggaaagagctcttttagtaggacaaacatctctggaacaaatgtgagaaatattagagcaatcaaaagctaagcagctgttagtctgagcttgtcttgctgactttgcaaggccatctgcaactttgttgagctctctagagatccaaatgattcgaacttgttgatcctgcagaaaatttttaattcttgaaagaattggtctcagagaccaatgtccggggttttgtatgtagtcctcgttctgcacagcattcactatctcactgttatctgagagaaaaatagggtcttgcagctgaagatgacgagcaatttgcatagctaaaaataatccttcagcttctgctagcaaaggagttcctgcattgagactttgagctttgatgacaatagcattgtgattgctagggttgtggatgaagatccctactcctgttttctcttccgtccaagaggcatccacataaactcttgtccctgcaggaattttaacaacagaatttcttatattattctcttcagcccgattgaagtcttggcaactgtcttcttccatttgatgaacactttcatatgtctttgccattgcctgcgcagcattgcacacttgttgtggctcccaaatctttgttttgaagttgatatcattccttgctttccaaatctgccaaagcataattaaaagattgtatatattgatgccattagctgaaagataggcaataatatcttgaacagagcctagagaagaaagattatcagctttgagattaaagtcagagatgaaccaacataaacgactgaaattacagagaaagaagagatgcaagtcatcctccctttgaccacaggtccgacaattgggactaacggttttgatcctgtggtgcattctttgagcagttgggagagcattactcagcagcctccatccaaaagttttgactctgggaggcatgtacctgtgttttcagattaatttcaaaagattttttgttaaattactgacctgattttgattggggtacatttcattgtaaattgtcttgtaagcactcttagctgaacaaactcctgagggtgtgtacttccagcaaagcctatcttcctcctctccctgcataatctgaacctgcataattgaatgttgagctgcactataaaaaatttgagttattttctgagcatcccaattcttattctcatcccaaagatcagaaaccttatcaggcatgtgaaaaggaagattatcaagattaagatgatcatgaatgttttttcaaatagagcaccagggttggctccaaatagaaatatcacctttagaaagttgccacactgaagcttcctccaagacatcccttacctgaagaatagaagaccagaaagcagattttggcatatctgttctagccttccaaaaggaagtgtttggaaaatattttgattttaggacagaggatagaagatcatttggattagtaagaattctctaggcagattggacaaggatacttttatttacagccatcaaatctcttatgcccaagcctccctcagaaacaggtttgcaaatgtctttccaagacctaagagccattccttttttgccaccatctgcttgaattcctgtccaccaaaatttccttataatagcagttagtttagcaatcaatttttttgagaaaagcatgatggacatgtaataaataggaatggaagcaaagacagatttaatgagggcaagcctacctgcatgagaaagagaattagctttgtaagtagtaagcttgcttttaaacttgtcgacaatgaaactgtaggcagcatttctgtcttttgccctcaccagaagaggatgccctagatgctttgtgctggagttcataagagaaacaggaaaaattgtaagaatattttgtcttacctcttcaggagtacttttgctgaacaggatggaagatttgccccaatttggagtctggcctgatctgagacaaaaggaattgattatttcagaggttttcctgacttcctcttgttgggcctgccccacaatgattagatcatctgcaaacatcagagaatgaatggaaggatcattttgtcctaactttattcctgaaatgtggttcctttgaattgcatctgcaagctggtcagaaagttcattaatcgcaaggacaaaaagataaggcgataaaggacaaccttgacgaatacctcgatgagctgaaaagtacccgtacgattgaccatttataacaacagaaaaattagcggagttgatgcaggaaagaacaagacgaacgaaattagcatgaaaccctttacgacaaagagcgtccgctatgaatctccattcaatcctgtcaaaagctttagacaagtctatttttaaaagaaaagctttttgattaaaagaggtgagattaaaagagtgagcaatttgctgagcaagcacaatattattagagatgcgtctccccttgacaaaagcctgctgagtgtcacaaataaggttaggaagtttattctgaatgtaattagccaaggacttagcaatgattttataagaaacattacaaaggctaatgggtctaaaatcagcaggggacttaggattagaatttttaggaacaagaacaatattagtagcattcatacctgattgaagcttacctgtttcatagaaggagcctaccatggcagtaacatcgtcttttatccaattccaggcagctctataaaatgcaacattgagaccatctggccctggggaggcatctcttcgcatttgctttagaatttccaggatgtcattttcagaagggatttcagggggaggaaaaattacatcattgtcattttgatccatagaaggagtggcatcatctgtattggagctttgaaagagattttcaaagtaagaagtgaagacagttgctatctcctcaggatcattaattattgaattattatggataacactagagattctgttctctctccttctcttctgggttgctttttgaaagaaagaagtgtttctgttacctttctggacccaatgcttcttacttctctgtttgtgataatcggccagcttctgcatggtaatatcatgttgttgcacaatccttttctcctcaaagtacaaatgttctctgtcgggggaactctgaattttcaacagatcttcttccaactgatccaattgctgctgaagaggtttcttctttttgctccaagaggttaaggatcttgctaacaaggttgttcttctctgaaaatgacagtttacagactgcagccaggctgaatgagcatgctgattaaaatctggttcaagcagccaccaattttcaaacatgaaagatcttttaggcctcctgttcttcggattgagaatggcaatgatgggagcatgatcactatacaacatgggcaagtgataaacagtggtatttggataatcaaaacaccattccacatttgcaagacatctgtccaacctttccaaaaccagatccttaccctgttgcttattggaccaagtgtaagctggaccattataacccatatccataagccccagattattgacatgatgcttaaaaatattaatacgattctgattaggaggggccaaaccatacttttcattagcatgcatgatctcattaaggtctcccatacaaaaggtaggtatgtgactactatgtacaacaaaagaggagatttcactccacatggcactagtggccctgtgactaggatcaccataaatacaaagaagattgaaaataggaccagagttcttatagactccataagctaagatataattaacactagactgaactatagtaagatccatgtcttcatcccacatcagccacagaccaccagaagcttgatcagcaggaaccacatgactattagctacatgaaaatgatggatcagatcagaagcagtgactttagagctttttgtttctgaaataaagattaccttagcattagtagagtatattaggcgttggaggtgttgcattttcctactgccgaggtgaccccccatacctcggcagttccagcttaaaagactcatggcgcccttgacgccttatgggctggcgccattgcccatccatcattctttccacttccatctccaccgtttccagcactgggatcaacaagctgaatctctgaaacattgcattccctaggatctgtagccagtatcagcctggagctagctccagcatcacttgcaccacccccttgagtatctccggcagcttgatcaacaaagatatcatgatgcacctccaaagcactccaagtatgcttcctgctatgaaaattgttaatgctttgaggggatcttggagcatctctttgaatgacatcagaatgagcagcagcaagaggtctccaagaagtggaggtcaccattccaccaccataacctcctctctgatcccatcttgtagctctctgcccacctcttctacttggaaccctgattggtgctgaatgatggttagttggagaagcacttcttgattcaatccctccatgttcttcacctcccacaatcgagaaggaagaggcagctgaagtagttggggagcaatggcgtttggtagattcatgggctgcttcatgaaaccctctcttcttacttaaatgttgtgaggctgtctcataaatcttggtagctcttgtgcttcttctgtgttgcacttcgttggtgccaatagcagggttaactaaactgttctgatgggcacttgcactgggtgaaactcggtgaaccaatggaacagactggactggttccatctgatgcaccttaccagcagtattgacattctttgagttgcagctgacatgatcctctatagtacttgaaaccagcttctttttctctgtacttccatgtaccaacatctcttcggtaccaacttctggtatactttgtatatcaggttctttgtcttttttctcacattgtttgcctgctgtggtagtgtgaacagcttgacttgggggcccttgaacagtgctgcagccagctaaagtcaaagctttctcactcgcttttttccaatctagcttgggcattaatgactggctggtcccacttcctctctcttgctgcttctgctgttcttgaatgttcttgaattgaggagaagaaaaatgttgcctgaatttttccacaattgaatttttgttggattcctccatatccaaaaatgcctctgatggcatataatcgatctgagtgatccactttcccagtttatccttaagatcttcctcgaatgcatctggaaattgaatgataattctttgtctttgaggacagacctgaacattatggaagaggagaccacaaaaagtacatattctgggagttctttcataatgcagaaaagctttaagttcagatttatcaggaagctccaagataacatgatcaggaactggtttttccacatcaatcctgattctaacacaaacaaatttctgattcctcagcaaactatctggatctattggttcagcttttgagatttgacctatgttttcagcagccaacttgacattcttaacatttctaagacttgggggaatgccatagatacgcacattaaccataagatgcttgaaagtgtaagctgacataggtttaattttctcatccaaagaaacccattcaagcagaaaaacatcactgccaaaagaccacggttgcttttgccaaacccaggacagatcttcataattacgaaaatgagccataaagagattgctttctacctgagagatgtcaagataaactctttgccaagcttttgccattgatttcttcaaagcctccaaagggatctgcctctgctggcctccagaatgtccaaccttcatgaggaggttgtgagtggtttgaactgttgccgtttcaggagactgttgcaacctcactctgatctcctttgttggtgtgattgtcatcgcttccagagaggtggcaatctctggaagttgagagtggactacttcatgctcatcctccaggggtggatccccatccagatccatgaccccctacgaacgccaaagcagaacaaaacaggaaggggaagaagaaggtaaggaagagggattgaacgagggaatgtggaatagaatgtggatgaggaggactaggttagcattgaagaggaaagagggaaattgaagaagatgggaatagggcagcaaagggctgactacagtatacactgacttaggtggtgtttagatccagggacttaactttagtccttgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgtaaattagtccaagattatggatgggttttattaatagtctacgtttaatatttataattaattttcaaatatccgatgtgatagggacttaaaagttttagtcccatctaaacagggccttacggcatagagccgaccctcgttagcgcagtgcctaacttcaatggtgcaaagaccaagtagccgagcaggttttcaatttcgaaattggtttttttctggggtggaccaaaatttcagaaattttttggctgaaattatttaaatgttttactgattttgaatgaatttaaataaaatttgaccaaattcataaaaatttaaaaaacccgaaattttcggatgagatatgagcttgccggtcatggacgaaattaccgaaatttcggaaatctcgaaacaaaatttcaaaaccctggagccgaggcggttggtccatggtggccatccccacgctgcggcggagtccagatggcgcctgccgcttcccgagagggggaatggaggaggtggtggctagggcgaaacgactagcacgcccccacctatgtctcgctgttccgggccgtcgcgctccacgcccggaacggccattgctattccctatcgcttccgcgtctattgattgcgtcgccgacgcgcggcgggtcatcctgttcgacgagttcagcttcaggcctggcggcgtctcggccgtgtccgtccacgggtgtcatggcggatggccgaggcccgagaggccgaagctccaggccgccgaccctggcctaatggggttcatcctcatctcaaactccctcttctttcagatcaacaaacgagtccgactacgctgaggccaccggcggcgccttctgcccgctcaccatcgacgatcggcatggcgctgccggaggccaacattgcgcagttcagctcatgcttcgccggtggactgaagcagctgtgacgaacagcttgttgcatttcctgcttcttactgctacgaattgttgcagagttcagaatttgttcagtttaggtgcttctgtaatgctagcggttggattgcaatcgttgatcaatcacataagcgattgcaaatttgcaattgtcaatcaatgaaaaagtcagataagctgtaaacttttctacatttttttcagagatggggcagaataaggcctgcttcgatcagcttctgttataaaaagaaaacactgaatattcggttgtatactgcatttcttcttagtaaatgcacttttctaaagaatcttgctcgcgcctcttgcagaagacggaaggggagaggaagagaaagaaagagagaaaggatagagggggagaaaaagaaagacagagaggatgatatgtaggccccatattttttttttgcgaatgataaatgggtcctatatatatgtttttaattctactaccacctaaacgtcacagacaagtcaatactgtcatgtagatgtcacgtcagcgaaaccgtcctctggagggttgagatatccagtattgcggtttaaggattcgaaatagatttggtcacaagttaagggagtcattgtaaacatatttcaaagaataaagacaccataggtcccgggcccaacagaggcccaggacgcgagggttttatcactctccgttgccggagtccggtgagaaaaggaaagaactcgccgtcgccgaccgcgggcgaggtggccggcgtcccctcgagcggcgctctcctccacctccgcggcacatccatctttttccacgaccgcctccgccgcgccctcctattctccccggcgatggcgccgcctcttcttggttcttcagccaccctcaaccccggccactggttcctcggaggtatatacgcatatatgtctcgtctctgctcctctaccctgatctttcagttcttgtttaggaactcgagaatcgagatgaccgaggaagaagccagtgcattctgaaacaaaaaaaaacccctctaatctttggttcagttgcatatggtggctttacttgggcgccttcggttccanatatgttagtccattaaattcttgttgcaatttattggatgcttctgttatatctagtttacttgtttctaaaaccttggattactcaattccctaatcaattagtacagtttattttcccaaatataccagtttcaggttttagtttgtataaaatgtaggtgcattttattaattgatttgtggaatacttacctgttcttttgaacaagcaaatccaagattttaattcgtttatagctgcaaatcctttcgttttcaattggtactgtaaatcatacatagtttgttcgactaattcggttctaggtttgaaaagttgctctatgttaactgattttcagagtttctaccttaattaatcatttcgtggatgaatagataggttacttctttaaatcgaatcgtgaagcacaaacacgtacagcaaaatgcaaaaagttttaaatttcatcagtataaatatggcacattaattttccatcctgtattcatgtgattcattacgatttcatcaattttaatccagggctctggacacctgctaccctttgaaattacataactagcattgctgcatttctcaatggatcatctctcggaggaactgatcataaatattctcaagaggattgcaaggacaaacaatctgaattctctttcccttgtgtcgaagcagctctacaacattgatgcggagcaaagggccactaatttgtgttggtagtggacttgcaattgaagctttaccagcacttttttcccaattccccaatttacacaaagtagagatcaattactctggttgggcacctggcaatgggagtcagatcgacaaccaaggtctccgtgtgctttcattctcactgcccttgctcaatgatctcaccttaagcttctgctctgaaatcaatgactctggtcttgcttgcctgactaattgcaagatgttgatgtccctaaaactgaactccacaccagaaataacttcaagggggcttctctctttagctgtt

SEQ ID NO: 62998 - DNA, 4732 bp, Oryza sativa
agttgacatgtgggcccacgtgggccccaccattcttttattgatttatgtgtgagactgacatgtgggtcccacgaagtttattatttttccggatcaaattgtcacgtatgtgccacgtcagccaaaaccaccctcaaaaccgccgagggacctcatctgcattggttttgatagttgagggacccattgtatctgattttctggttgaaggacaaaaatcggattcgttgataagttaagggacatcagatgaacttatattcctgaacagaacataaacaaaagtagcagacataaatttctcacattggtgcatttaaaattggggtaggtgggggcgagattgctcgtgcgagacgcccccgaatttaccgttttcggcccaggtgatgccggcctgcgagatcaattcagcctgttactcaatttgatccactcgttttcagactttccttttttaaaatttgcaatgggcttcattatttatcacaccgaatcgagcatttttcttactcatgtgtatgaagtttgtaaaaagtctctcctaaaccaaagtttgtatacgtatatatgttttatacatcaaaaatatatgcgtatatataaaatttatatatacggtatatatatacgtatgtatatactttctatacatgtgtataaactttatatatatgtatataaagtttatatgtatgtatacatacgtatatacgtaacagatgaaactaaaggggggagttggtcgcgcgcggatcagcgtcctccagctggtgggggtgtggtgaatcggggtaacagccatgcttagccgttgcaggacaattttgacatcggagtttttaagtagacgagttttgtgctataaattgtttctgcataatacaaagaatgtttcaagggaagggtatggaaaaagagttgaagtttagcattctagtttttcttttttgtgttttctgctcaattatgagttatgggcaaggtggtcaaatatatcgattttttcatacgattttaagattttactaattaacatgtctaattctatagaagcaatcctacttagagcttccaattccaagtcagcatcgcgattttatttaactaccttggtatgcactatcagaaacttacttatgacgggataaaacaaaaacacgtcaggaaaattgtttgtaacgtgtcaacgtcaggaaaatcctcgtcaagaaaattctatttttctgacgttagtacaggctcgtcaggaaaattagatttttcacgataggagccattatacatgtcagtaaaataattagacgtcaggcctagtccggtttctggtagtgatggagtatccatctatctatctatttatctatgaccattaaactttctataaacgctctcaagtcaccacgtggcattcctgcaaacgcttctaagccaccacatggcacggtctaatctcacagttgattttcacttaaattggtggattcatcattttacaccatcaaattgaatctattattaaaaaataataacttcctgtatacggtacaaaacgatctaccgttgtacgtaattcgtgtcgttaatttgggtgttaatgaatcaagttgcatatatacaacgttttgtacggtaaccaaatcaagcatattactcaaacttttttcttgcgaacaaaaaaatgagttcactggtacatgttttttctcgaagtgcaccggtacatgtttgggctgaattacagagttttctatcttctatctaatttatttatttattgtatactaaaagtccattaaactttctagaatcgctcttaaaccggcatgtggcgttcctacaaatactactagaccgccacatggcactgtttaatctcaccatcgattttcacttaaattagtggtcccaatactttttatctttagattagatgaattattttaaaaaagtaataattttcttatgtatattgtgggccggaaaaaataaaccaaacataagtacttcgtgtacgtacttacgtaactggaaaagaatcaacgaaacatacctactgtcacggaagaaaagaaaacctgcatacgtacttgcaataaaaccaataaaaccgataaagtaaaaaaacatacataacatatgtacgtagtgccatttaaaaaaaatcgatgatgattttctactatttaaaaataaaataaaatactctaaaaacttacgcaaatatacatagttaataaactaaatcttctacaataaaaaaataagttgtcctatctttgatatattttaaaattatatatctaatttgtgatccagtcacatgaggtcaacatataataaataatattatgataatattttaaagaaaaaaaatgatgaattataccttgaactattatgctcgattgaattatctccataaacccaaaagtcaaacatctttcatcttcaactattattaatattagacaaattacccgctgactcaacccaagttggttttggtcctacgtgacagtccagttaacattttcttcgaaaacaaattggtgagacccacctatcatatatgtccctcacccctcaccccactctctttcttctccctccacgtctgtcaatcggcaaggctaggggcggtgatcggcggggcaaaggagctcgagtggcaagtggcagaggtggctcctcctcggcatctaccggcgcgtgcctccttgatggccgtgtggcttcccctctacctccatcggcgcgtgaaaaggacaatagcggtggggcgaaggagctcgagaggcagaggtggctgagggcgttgagtggcgaaggcttctcctcctcggctctctcggccaccacatgctcacttcgacggaggccattatctccatcccttccaacacatctcatcatcgtgtgacggccgctggaggcgaggacctgtgctggtcctccatggccaggttcggctatcaccctgccatcgagaactcccccaacaaatgcagtcatggctccatctacaacaacatgccatcccaccacggttcttaatcgatccccaccaccaatgcctctctcctgacgagacagaaagcaccaatcaagaacaacgaggtggatcaatcaagagagcaagagcaatggacagacgaaggagaaggagaacagcagcggggcggcggcgcgcctgcccggccgccccctgcagcaaggggagggataagagagagaggctagggaatgggattaaggaaatgagggagagagaggggagaggggagagagatagagagggtagagagtgtgactggtaggtcccacgtattttattttctaaaaaatgcttactggactgttatgtaggaacataaccacgctccgggttgagttagggggtaattcttttggtactaatagttaagggtgaaagatgtctggtttttgggtttacaggggtaattcgtactttttctgattttaacaaaatttacatcatatttcagatgtcaaatatcacttgacgactatacaatgctaatttaaatctacatatgtaaaataaatgaaaacaatacaatttagttgtgtattttttaagtggatctgatttgattttaatttgttagagattaagattctcaattttttttaatctttagaattatttcattagtatctgataagtgggcaacttaaatgttacatccatgtaaaaaaattatgaaaaaaaaatccaagccaattattcttgctataatacaaccacttaaaccatcatgagatttatggtcatatgtatgtttttctctgtgtgaaatagttttgataacaaataaacaaacaagtaacatatgcaataaactatttatgatatattttcttatacttgaagagttccaacttatcaggcataatttgatggacgtatgccatacaccctattgatgtgactataaagtatacttcaataaattagttattcaataaattagttattgtaaataagtttggaaaaatagattcattctccaaattaattagtaaaggtgtctcatctgattatgaataataggcattggaaaaaaactcaaaattatagatatttgtcaaaatataaccaataatatggtgctttggaaattacggtggtagtatttaaaaaaacctttatccgggttaaaaaatcatatatagtagacatagatatgaaacaactccagcattccataatcatgacacatgttttcataaattcaaggttgtacggtttgaagtaatatgtccaaattagatattaacgaaaacatgtttaaaatagagtcaagatctattttataaatatcatatacacgtaaacattcgtaacaaaaattcaagcaacattaaataagtgtccgcgcatacgcgcaagctattttcctagttggagtataataagtgtttcttttcacaacctttccttgtgtatagccatatttgcacatttatatagataccagattttaattcattattataaaagaaaaagattgatcgattaatctgggtgtacgtggagcacacacctaattaatactctgcactaatattttgaaatggtcaaaccactcaagtcacttaagtgcttactgcacttgataagaaagcatttatacctaaattaacaaatcatcaatatacatcattgtcaaaaaaattatcatcaaatgtcatgtgaataaat

SEQ ID NO: 62999 - DNA, 731 bp, Oryza sativa
cagggtggtatgtacgtagtcgaaggcgaggtgacataaatataggaaacggcgttgaggtacggtagaaggagggaggagagccagagtgtgtgggcccaccatctatggtttgcccatgcatgcatactttgctgcctgctgggcacgattgattcgatcgatccgtcaaataaggagcctttcctcatctaaaccttgccgcaaatacagaaatcgtcaacaataccagttgaaaaggcatatcagtgccggtttcctaaccgacactacagctaattaggcactgatgaaggggttgtcggtacccattttaaaaccgacattgatgtgttccctcgaataaataaaaacatagaggatggcttgaatcaagtcgatgcttcaagcggctctctaaaattcacagcccagcacatcgatgccctcctattccgcatccacaatacaaatcaacaacaagaacacaagagcatccgtgtatattccattatctaaaaaaaaaaagagcaaccgcacacatgcatcaaggcatcattgcaatattcagactggaatatatgaggaaaccccccgttgatgatgttcgccatatcatagaagaagtggaagaagtgctcaaacagttagaaagcaatgtacacacatggagactatggtgcagcaacaatcatcgtggaggcagtggcatcctgtgaccggtggatttggcattgtttgttcggtgtagc

SEQ ID NO: 63000 - DNA, 6892 bp, Oryza sativa
tcagaatcttaaaattcatattggaaaataaaatgtaacatcatatgtttaactatgtatggccttataactagagtggattacgagccaactcagctcaactcgttaatgagaaagactagctcagctcgtgtcgtgagttggctcgttaacaagttatatctcttttatatcatattattaagaaaaaattataaaactaaccttaactttaatcgtatgttcacctaccaccttaaactttgaaaccggatatccaaccccctcgaactgtacagtaacattcatattgcaccctaaggtggttttgaaactgagataatccatgaaataccattgacaagcgtctaagtcccagaaatatcatcgacatgtgtgagttccaagaaatgttattgtacaaacaattttatcccaaaaatgccattcccgttagggttccgtccattctgcgccattaagttctatagtatgaacagtgtatttaacggcgtggaatggatagaaccctaacgacgatggtatttttgggacaaaatcgtttgtatgatccatttcttggaattcacacttgtcaatgacatttctgggacttagatgcttgtcaatgacatttcatagattatctctttgaaaattggtttcatctaatttgcatatatgtttgttagatttgactatgtgacatctgcattggatatatatgttaaactctccaaaagaggttctcaaaaagattgattactatagatcacgtttcttttggtaagacgatgatcataagaagaagtatagactcacaagatgggatatgatttgtcaacccaaagatcagggtggtcttggagttcataatttagaaattcaaaatcaatgtcttttgagtgagtggctatttaagttaataaatgagcaaggtgtttggcaagattcgttgaaaaggaaatattttaataatcaatctttaacccaagttgagaggaaatatggagattcccatttttggtcggatcttatgaaagttaagtattcgttcctaactatgggttcctggattgtgaataatggtgaacaagtcagattttaggaggataaatgggttggtaaccattcctttaaatataggtatccatctttatatgctatagtttgagggagaaactcctcggttgcaaatgctatgcattctgttcctttaaatgtttcttttaggagagttttagtagggcagaacttgactaattggcataacttttgtgcttcaattgtgcaaatccatttgacagaaaacaatgatttttttagatggaatcttcatcaaaatggtcaattctcggttcgttctatgtacttagctttaattaataatggctacattgagaggaataagtttaattggaaacttaaaatgcctcttaagattaagatttttatgtggtacctgcttaaaggtgttgtcttaacaaatgataacttggttagaaggaattggcatggtaatttgaaatgttgcttctgtatgaaaaacgagactatccaacatttatttatggaatgtcattatgcaaaatttgtttggagagcattacaattttttttctggtttaaatattccacatagtatatctcatatttttttagaattggttcgtagggattgataaaaaaaccagtaaacttattctggtaggagcttccgctatatgttgggttctatggttgagtagaaataatatggtttttgataaatcaccatctatatcttatatgcaggttcttttcagggcaacacactggctccggtcctgggcacaactacaaaagtgtgaataagatatcaagttaataaaagctgcatgtcgtaatcttaagtcaacggttatgcagttttttgccaacttcggatgaaaatttacaaatagaattcaataatgttatgatcttttcttgcattggtttttagtacttagtgtatgttcctatccttttaggcatgtgtttttatgactttttttgtcatgcgtttttatttgtatgaattggtgtaataattggttgtagctcattgagcaaagactgggattctattcaattatctaaaaaaatatatgttaaactctccacctaattctttcgttattaccccttctttttgctctcgcttacataagaatgttgatatagtaccagtatgatattactacatagtataaatttgtggtcaatgattaacgatatgtgaacaagccatattagttattcaaaaccgttgattcaagttcccagatacacaaaaacactatccaaaaccgttgataaaatggtattgcaaagtttagatgattggttatccagttttaaagtttagggtgctagagggattttgaccgataggttaagggggtatggacttgttcctattaataatttcaaatttactattttatcacaaattaacataataataaacactgactaataaagaactcactaaatatgaatagttttgtcgtaattaaaagactaagcactagttaagaagcactatcttgtagtaacgagctaaacaatcaactcgcgggctagctcggctcgacttattaaaactatgaatccgaaccgatccgagttgagcttgatacaagcctatctgagccacgagcttcgatttcttgtccacccttacatagagcgtcatcctccatacaaacaaatcacataagtatagtcacactacatagctatataatgaattgagaaagcgacgcgtgaaaaggaaacaacgtaacgcagtgacttgaggaggcggccaagggtctcacaggcggatagtcggagagatggagagagacaacgacgagcacagcgcccccaaccccaaccaggttaggatcatgagcatagtaaagatacagggtgaactgatggttgaatcgaaaaaaagaaatccaaaccagccacctttgcggctggttctatgaaaatcatgcactattaagtaaggccatatttgtttcagcataagattattgtgatctagattactgtaaactggattgtaataagccgacataaaataagtttgttgtttgtttatctggattattagttgtttgctagttgttagttacccaataatcttaaaaaacacctttagagtggattaccaattatagggggtgtttgagagagggactttagtccaaagacttattttttggagagagggactaaagtttagtccctcactcccaaacacccctatagtaatatgacttatagattgtaataatctatcataataaactatcagtttgtttaatttcaggttactcgtaataatctagattataataattctaagttggataaaaagggcctaagttgaaatccctaaataacatgcatagaaattttgtagagcttctacagaaattagttgaattccgacaaaaatcatgtattaatccaagcaaagcctctgttttcgctgttttacttccagtcgtccgtacaattcatttactgtagcttctgtacggagtaggtagaaacacatagcgtggtacagagttcagagtttcagcggtgatcgttcagacaattgatgccagtgctacacacaatttgacctgcaggacctgcagactgcagctcatcgcccagtgcctgaggactcaggtcatggagatgcatgcaaaagccgagacttgcttgcaacaagttggggtactgtttgtggcatactcatactaagatctctagacttgattagattagccttaaatttcgtatggttgtgtgagtgaacttgcgatctctagtattgccctgttgtgaacttgcgattatatgggtcgagaaggtgaggccagtgaagtgaagatggtcttcacttctcggtgaagataggaatggctaaatggaaaacgagtccgatcacaaaatctaaacattgggtcgttctggtgcccgaccgactatttggtacctcttgaagccaatgcctttgccaaatcaatacgaattatactatcttactaaaatattgacgaataaattaatagaaagggaaactataatagcccgtactattgatggtgtgtgggcggcagccttcaaacaaaagttacctcatgaagagagtatatctcaactggttattgtaagtttgtaactgaattactggcatatatggcggggaacacggtctatgcacgtaagttttttcgtgtatatcacaaacaattctagaaaaattttattacttttagtggcattacatctatatgtaaaattttattttcaaattcattatatatatgaaaaaaaaaacaaaattctaacatatttatattattaaaactataatattttttacggctaatataataaatttgagctaagactttacataaagtgtaattttattcgacgcggatataaaatatatatttttagattttttttatgaaaatttgttagctgacatggtgtgtacgtattcgtacatatgatatatccctgcatagtgtgtgtcttagactctttgttccactagtattcgtttaaaaaagtaaaggaaaaaagtataccgaagatccctctacttgtcatcgagttataaattcatcctccaaccgtataaaactagatattcggtgtcccttaacttatcaaaaccggtcagaataggtccttcggtggttttagcctcgcttttagcctatgtggcggctgattcagcgtgggacccacatagaccccacatgtcaggatgctaggtcaatctctctccctttctcctctctctctctcacactttccttctcctcatccgatgccacgaggagggcagcgccgcgacgacggccgacgacggcacggtggcggagaagctcatactcttagtgatgccgctgccgccgaggaggaggaggtgaggcgagagcccaggggtggtgggcacgtcgtccatgccgaactgggtgctctcgtcatcgaagtggtggtgctttgcgaggggatgtgccagcggtggtggtggaggaggcgaagtgatgtactccagcatgtgaagcggcggcgtcggcgggctcatggtggcggagtagcggcgtcagtgggtgagcacgactgcggagaggcggcgtaagcaggtgagagcggcggcgacggcgggcgagtgcggcggcggcgagcgagtgcggctgcggatggggagaggcggacgccgacgactccgcagcgctcggctttgtcgtcggcggcggctccgggcacgggcggagcaaggcggggaacgcggagcagaagggcgggtgagcggcggctccgagcggcaaccatctccgagagacgggctcctcccctgtcggctgctggccgccggcgcccatcgctgcggcgcccggccccgcctccacctccgtgcccacctcatgtcgcgcgtcatggagacagacacctcgtcagcgtggttcctaggctcgtcgctccgtgtcgacgcactcgtccaggagggcttctcggcgccgtcgacatagcaacctgataagagtgagagagagagggtgctgacatggcatcctgacatgtgggtcccatgctgactcagccgccacgtagaataaaaccggtgtcaaaaccaccaaaggatctagattgaacggtttttaagttgggagatgtcatatgtctgtttttgtggttgggggacgattttgtaactcaatgacaagttaagggatcttgggtgtactttctcaaaaaaaaaaaagagcccaaatatgcctctctcagaccaggccgtcgtatatacgagcccacccccacagagtccatttcaaacccccaacgtccaaacctaacggaacggatcggcgaatcccatcaagataactctcccacatcctcggcgcgagacgtgaacgaaacgtcccaagcctaccgccgccgcgaggatctctcgaatcgcgcaactcacagcagagggagaggaagaagccgagcgccatggacgccctcgtctgcaccaacgccttcgccaccgccatcgccgccggcaggtttcccctcccgcgaggccgctcgcccccgtacgccgcggcagccgtccccgccctccgctcccgccgctgcctcccgactcgaggtccgggttctcgaaggcaaaatcgatcgggtttatcggaggtttttttttttttgcgtgaatcctgacgggcattttgtgtcgtctttcatcggtgtgtttgtccagggctgctacgcctgcgctgcgccaggggggtggattggactgatccgtcgttcgtggcagtcgcggagaagcccgacgcgggggcggaggcatggaaggcgctcgcatccgcgggcggcggtggcatcgaggaggaggaggatggcccgtttgaggcgatcaacggtgatggaggatactcggtggaggagtctgtggtcttgccgccattcgagcagagcttggtggcggcggtggcggacagtgtcgaggacgatgcgctcagtcaggcgctcagctctaaggtagctttactgttttgcacgtaacccgtttgttctattgcgtctaattacttaatttattagtatgtgattctgtttatgtgggatggtggatttgaggtagaattggatgtagctagactaaatcaaaacactaagtttgatgtttatgtcgaagtgaattaatgtgattgggaataagtagaaatagaaaggtaaattgttatgctggcctgacatggtaagatatgaacaatttaaccttttctaagatccttatgagaacagctctctggtctctgcacatgtattactttttacaggctctattaatactttggcgtggccttttttttttgcgagtttg

SEQ ID NO: 63001 - DNA, 618 bp, Oryza sativa
  unsure (1)..(618): unsure at all n locations
taatttacaaactttgctcaatacaactatggatatatggcaaacttttttcactggattataaatacaaagttaaattagctacaaccactaaatatataattaccatgccaaataaattctatggacgtagttgcatttcaatgttaaaactctaatggatatatgcaagaccacctactttttttttgtatttttctcattttctctcttttttccctatgatatgtgtaagggcaaattgggcatttcatcatatatttgcatcgaaagatgacatggcatgcccacatggtaattttcgatgagccaaggactgtatatgtccacatgataaaatctaagggcttgcttggacaatttgaaaggtcagggactaaaatgatctcatagcgaaacttcagcgaccgtaatggatattctcccatactaaaaacctatacatgctgcactcctataaactttttgcaaaattgatttattttgtgctttagtggaattgtaaggaagacaacccaagcactcatgccattaatagcacacataggtccatccccctaattgggcaatggcaggagcaaaacctttacgtgactttntggcccactctgtataatg

SEQ ID NO: 63002 - DNA, 13170 bp, Oryza sativa
ttttgctgatgcacgtgtaatacacgtgctacatcacaggtctcatttccgatggcccaatccacaagcagcggcgctcgcccacggtaatgatcattgaacgatgaagaagtagggtagttcttagagaagttgaagctggatgcctccatgagtgccgcatagctgcaacggctcatgttgttgatctccgtcgtgttgaagcccgagtcaaacatgaccccatagtactgtagccccttggggatggctgtctggcagcaacctatcccggagcagacaccgtctgggagcctcaagaggtcgtctgccttgcatgtggccacacacccggttgttaacacatcgtctgctaagaggtaagcgagcgttcgacacccgatggccgtgaacttgttgccgaagtcggataatctaaatggtgtgcccgttaagtttagcgaccagcccgtaccgttcatcccgccagaagtactattgtagcaatagttagctatgtgcatcctcattcgtacctgaccttctgtcagcgagatgttaagcagctccacgtctttgtaatacggcttgccatctcctttgatgttgcaggtgaggttgaagccgggcagggcgcaggcaggatccaggccgaacgggtaagggatctctaccccgccgcagcttctcacgcaggtggctgcagaggcggccgagcaatatgccgcgatccctccgcagagccatagtagtgaagctagcatgtggaatggcatggatgatttgtgaatcttctattcttccacgctgttgttctgggtaagtttcttcggaacctatagctagctaaatatatatgagtcggcgattctaaataattcataagtccaattagctagagcttagctcgatctttcataaagacgcgcgtaggaaacgagagatcaagctacgtacaaccgtgtgatgctttgacttggacctgttctacttctaggcttctaggtaggtctatgcatgccctcgcgtaattctacaggtctatgcagagaagtatttcttactagataactgattactaattcaaagtttctaacttggcaatttcctattaattagctagtggagtactcaacaaataatttttcaaaggcacgtgtcaataatttttatgataaatatgcatagtctatcattttgcaaggatttctgatttcttccataaataaatactatgaaataacatgtctcacatcaaacaattattcattgtgcattttacaaatgtgctaaagcaatgtaaaaaagagggggggggggattttatgtttctctataattatgacatcgatggaataaagaaagagatatctgtattgttcgatctcgatggctccagacaaagaacggttgagatttatttgttgtggagaaactataaaaatattcataagaaaattcaaataagtccaaacaatctaatttcaaactttgatagagtgtccaatctatcaacaagacaaatctaaaacctcagaatattccctcttatggatgttaatcggatcgagaaaataagtaaggtatacaccgtttgatatattgcgattggttcaaagctccatttgcatatttaattagattcaaagtataatgtcttgtggaatcaatcaaactccatgtggaaccggtaaatcaaaagggccctcataaaaaaggtaaacaaagaatgctacatttttatttatttttaatttaaacatgggaggagccgcttcctgttggctgatctctgttaattaggcgcccggccgctgctcaccgtggcaaagtaatatacgtgatcaggtctactcgttttctaaattcctctgtctctctacatacttgcctccgtcctaaaataagtgcagtcgtcgaaatccgtgtccaacgtttgaccgtccgtcttatttgaaaaatttataaattttttttaaaaaattagtcacacataaagtactattcatgttttatcatctaataacaataaaaataataatcataaaaaattttcaaataagacgaacggtcaaacgttgaaaatgaatagtgtaaaactgcacttattttcggacggagatagtattatatatgattctcagtgacaagagacacgatactatttcgtttctctgccaaccaaatatacatcgtcgccgtaactcgaaaatgttaaagaagacccgcggagcttgctttggagtttggatacaccacccttaattttcatcgatctgtgcatgcgcatggttaattccctgcgagctgagcctgtattcatctagagtttgttgctgttgcttcagaataattacaaaaatggccttttgaacttgtctcatcattgctgcttctaaaaaactgtccgtgtttttttggttgctaccggatcatgagaaaaaccggaagtacagccggccgaagcatgtaccagaccacccaagttaacgcgaaattaatggctgtgtccctgtgtcctcaaactcgcactatctctcacgttccctcgtctcgttctcacctgtcaaacgccgactctctctcagcgattgatgaaccagaacaaaaattactcaaaatcctctaatttttaattaataagaactaaaacaacttaaaaatagataagttaccaggtatccgtagacaccgggaaggtacacataggaatgccactccgacagctgttccgaatgtccgccgtgtgacgctggtgatgccccctatcgagcgacgccatgtcgtcctggtatcaaataccggctccgtttcatattataaataatcgtttaactttttttaggtaaaatttcttaaagtttgatcaaatttatagaaaaatataatagcatttttaatacaaaacaaacatatctctactagtataaaaattgaagctgtttctgcagtccgtcatctgtgtttgagtcggttagaaaaattgaagatgtttctgcggttcgtcattcgtctttgagttggttttaattttatattttggttttaatctatatctcttctttatttctactattataaaaattgaagttatttttgccggtgttttggtacaccactgtgtatgaggcggtttttaaattcgttcacttttggaaatatatatccgtatttgagttgtttattaagttcgtttgcttctcgaaatacatatctggatttgagtcgtttattaagttcgtttgcttttggaaatatagaagagtcgtacaggaaatctctttaaaaaaaactcacatgctaacttgacgatcggacactaattacagctcatgattttaagcgaactccccgaataaaattcaccttaattaaactatataacaataataatactaaaatagccttcacccgtcgcaacgcacggacattttttctagtctctaatgttgtaaaaattgaagatgtttttaccggtatttcagtacatcatccgtgtatgagtcagttattacgtccatttgcttttggaaatacatattagtatttgagtcattttttgaatatttgagtcatttttaagatcgttcacttttggtaacacagaagaaatcatataaaaaatctgtttaaaaaaactcacatgctaacttgagacgatcgaactcctaactgcagctcatgattttttaaaaatatatatccaagcgaactcttacagtaaatttcatcttaactaaaccatataacaataataagattaaaattaacttcacccgttgcaacgcacgtgcattttttctagtattataaaaactaaagatgtttttgccggtattttggtacgtcatccgtgtatgagttggtttttaagttcgatttcttttagaaatacatattcatatttgagtcggtttttaagaccattcacttttggtaatatagaaggaatcatataggaaatctgtttaaaaacactcgcatgctaacttcagacgatcggactcctaactgcagctcataattttctaaatttatatatatccaagcgaactcccacagtgaatttcattttaacttaaccatataacaataataagattaaaatagacttcacccattgcaacgcacgggcattttttctagttatgaaaatatactaggttagattcagtggtggatctaggaatacttttgagcctgggcaagtctaacaacgaaaaacaagtatacataaatcaatacaaatatgtataccttttatcatatacgtatgtaaaattgacggtcatcgagttctaatttaggataggaaatctagtgtacgagaatatatcaaagagacgatggatatataggttagactatggagtttgtactatcttattgaaagaaaaaagactgataccagaaagttatataattttgcctttagatctcagttgtgatggtgtgaaattgaattaattatcttgaaagtaataggcatttagttaagcatggtaatcaaccactttatacctactattgtatgcagattagctggtgactaaacagcgtaactaagtgcggataaactgctgcatagtggtagagcccgggcacttgcccgcgctggccgggccctagctccgccactgacttagatttaatgacactaatttcatattttagatgttgttcaattttactataaacttgatcaaatttaacaagattcgactatgaaaaaattcaaacgtaagcgtacacactaccagaggttcctgcaacctgatcgaggtggtgcatttttttcaccggctctggctcggtttgggcttgcaaattcccttcttggagctaatcgctatccgatgcatcgtcaggcccaacaaggccattcaacgttgagtgcaaagtgggcctcaatcacgcctgttcaccgtcctaataagtctcaatctaagtgggtagtggggtaactgacactttcaatatgagaaaaggcattgtgagtgtaagatgttagacaaaactaaccgtgtaaacagatgtgtgacattgcgtgattaacactaagactactacagaacatcacataggtgccggttcatagttatcgattcatttaaaaccgacacttgttaaacgtttcccactttcacgggacaaataaaaagaaaccggtacctttgaggaaatataggtgctagagtattatatgtgtcaattctttaaaaactggcacctataaaacaaactgagccgatcgagctaagcccatccttttgacacaccttcaccgagtcacagtccacatccggccttatcctatctcgttgcactcgctcacatcgccatctcccacgccttcttcttccacatcaactccgccctcaactcggccgccccgagcacctgtgccaccccaagcacatcctcgcccttctcctcttctccatcctctctatcatcgccattgtcgtctttgttgctgcccccatcccctcctgcttgccccaactactcccagatggtggcacggatgaaaccatagtgttttcactccaactaactactcctagctagcggtgttccacagttgcggcggtggcgtccccaccccggtagctatgacgttcccacccgagcggcggtagcgcggtgtggatcaaggtgctcgatggcatccccacccaggctgtggtggcatggcacggatcgaggcacttagcagcagcacggtgcggattgaggcacacggtgatggcgcctggcagatgcttggtgcggagggacttctctatgacagtgggtgcatattttactctatggcgtgcaaatggactccattttgtttctgatatatttatcttgttctttccctttgatgcatgcaaataatatgtgtaatggattttaattgcagtgatgcaaaattcttcatttgtaccaaaatttgcgatattgaattttaattggagtgatggatggatggtgatatgtggatatgggatgggaagttactcgatgcattcgaaactcctaaatggcgatcgctcgctaggggcgatcgggtcgccctcctctcctccacctagttttctttttagcaccgcagtactttcctattttagtaaatttatacacctaaagtttgtacacctcaagtttacacatctaaagtttagagacccaaagtttataaatcaaaagtttatatatccgattcaaatttgaatttgaattcaaatattttttatatatagtatttctatacatttaaagtttatacacctaatgtttatagacccaaagtttataagtcaaaagtttagatacccgattcaaatttgaatttgaattatattcgattcaaatttgaatttgaattcaaatatattttatatatagtatttctatacacctatataagtcaaaagtttacatacctgattcaaatttgaatttgaattcaaatatttatatatatatatatgtagtatttctatacatttaaagtttatacacctaaagtttatagacccgaagtttataagtcaaaagattacatacccgattcaaatttgcatttgaattcaaatattaatttatagacccaaagtttataagtcaaaagtttacataaccatttcaaatttaaatttgaatttaaatatttttttatatatagtatttctatacattaatttttctaactttattttttattttttttaaaatttatggtgtagtaggaagagaagaaagggaggatcggagagaagtgtataggggggcatggggatcaatcactccaagcgatcgatcgcccattagccacgccccgatgcattggcttgatttgagccaatggatgcatcgagcctaaatcggtacctttgattcctcttcatcagtatcgcctgtagggtgctggctgggaaatccaacacacatgaagattttccaaccggcagccatctctgtttatgtatagtaggaacaaaatgtaagttctacaaaaacgacacctgtaggtcgacacacgacactcaatggcacaaccgctccaaacatggaagttgtcgacttatttagagggggaaaatggtaacatattgtcgatgagaagttcctctcatgtctgatgcaattctccaaggcagcagatggatgcgaatagagattatttggataaacgagaggatcaatgcgccagtcttaaagaaaacaagatatatttacgattacttcatattaactaggcacaccttgtgatacaacaaagttttcagagggacatactactacgtaacaaacataatctatagctactatataaatggagatacagtaagacaaatgttattggcatataaatagaagcactcgcaatggaacaacaaaacatgtagtaattgtgcggtcatctagcaaattctatgttcattgaggccaccctctcaaggtcgtaataatctgtggatcgttcacctgtgaaatactccgatgtgtttgcaccggaacttgctatcagggccaatgaagaactaatacctgtaagtaccccttggtcttgttgtacttgtcccgccattcgccggcgcaattcatctgcaaccgtgctcattgttggtctgctctcgctagtcattattaagcactggcttgctagagttgccagatcacttatcaatcccatgttatcttcgtgcaatatttctgcgtctatgagctcaaggaagtggccttctctcatggcctcttgaaatattaacgcgaggctgaccttatccacggataatggcattcgccgggttaagagctcaagaagaactataccaaagctgtaaacatcactcttatcggtgagctggaagttccgaagatactcaggatctagatatcccattgtccccttcaccacatcatagttctcatccgcggtcctaattttagagcacccaaaatcggaaacctttgcgataaaatttttgttgagtagtatgttggtggacttgacatccccatgtaagatgatagggtggtcgactgatgagtgtagatatgcaagtgcttcagcagactcagcagcaacttttaggcggatctccagtgttctgatggatggatcattttggatgtggattagattgtacaaagtcttattttggacaaattcgtagacaagaattggaacatcaaactgaagacagcaaccaagaagcttgacgatgttttcatggttgactcgagaaagtatgagcagctcatctgtaaattctgcccaactatcctcatcaaatcccttgcacttcttgattgcaacagggttgtctggatgaagattaatacatcccctataaacagtcccctgacctccttgaccgattactaacatgttgtcgaacccatttgtcgccgactcaatttgatctcggtcatacaacataaatggaatgttgttatctctgctcatcatatttcttaacaattggcctccacgtagatgaaaatactcttccctctgtctcatgagttcttccctctgtctcatgaggtcttttcttatgattcgttgtttatatctgaaccattctatcccaagtaaaatagttagagtaaccaaaagggacgcacaaattcctgtcaagataggtaaacattttaaacgcaaataaatcgacgaggaattaggcgataagtagtgacaacaaaagataaacatatggatccatgttagtataaatgcaagaacttcataatttattcaaacatatatatctaaacaatgcgagattaattgaaaaagtttttgtgtaccgatagctagccctccgtcgcatggtccggtgtgtgcattgcctcgtgtaccgaaggggcaagtacagtcggagcctccatctttatttctgcattttccatagcaaatatacttatttggttccttgcactcatcaatatctgcaaaacaaaatacgcgtgatgttgtggaatggaattcagtggtgctaatttctgtcgaaacccttgcaatttatcgtactacacagactaatttcacaccatgcgtttaatattagtattccctttgttattgacatggatgtaaccgtcagattataatagtagacaaaattgactacatgtatcccacacgcatgccatatatatactttgtgtaaactttatgtagaaattccatctgtagttagaaagtttagtgcgtaaattttactagaaataataaaatgttgacagattttttttaaatgaacaatttactaggaaaatttctatgtatacactttctatatagagagaaactttatatatgtaaattttgtatatctaaatttacaaagaattatatctataatttgaaaatttagtgcataaattttactaaagattaaaaaaaatactccaagatggatttgccggctctgtcttcgaagttgctcataggggtagggtttgcatgagtacgtttataggggtgagtgtgcatgtgttgtgtgtctgtattatactgtgtaattcttaaaaaaaatactgatatcactgaaactttttcaaaaaaataataatacaattagaacaaatatctgatcagaaaaaacaataaaaatgaaacgtcgatcttttcccatggcgtggaaggaaaagaagaaaacagaaaatgcgttttttttctgtggcgcgccttttcgtcgttttctgttcgcttttctgttcgctgtccgcggccagcccatcttaccaccaccgtgagtgtttccacctaatattgacaaatccaaaactctttttctttaaattaatgaccaatcttacatcctactccctctacctcaaattataatacctataatttttttacacagtattcaataatatactttgactagtattttatttctttctatgatcccaataaatatgaaattagcatcgcataaaagtattttaaatatgaatttagagatataacatgcataatatgcatacttattatagatatagttagtacgattattagttaaaactatcgagtttgatttttttttaaaaaggggtgactataatttgagacgaatggagtattaataacagaacacagatggaaatgatcctaataacttctttatacggtagagaacagatgcggacgcaaagctgataggaaacgcggcgcatgagatcgactaattcgccagcaacgcactggccgctccagtcagtacatcctgatttattggcgacgaatcggcccactccaatcgaccaggctccgatcgctcttcatctttaatcagcgcggcgattgaaacccatcgacgttactttcattagccatcatcgatatcaactacaggtctacagtttatttaccaagtaggaaggtagcccgcgtatatgcgcagacacttttacttagtggtgtttgaaattttgttatgatgtttatgtataggttctttttgaaaaatacatctttttttacttttaaatatctgcatttatcaataatttgttagggattgttttgaaagttggtttcgttcattggacatacggacgtgcgctaagaggccaagaggggggcatggttttagacatttgtctacatgcatgcgtacctatgcaggtaagttggaccgacgaggacgttgggacatttgacggttgtctgtgacatcctacttctcttagaatgtggcctttgttttttttttaaaaaaatgtgacctatgttgctcataaacattgtgtgtgcttgagtacaaccaacttgtaagtcattgtcccttcaactatatcattttcgggctaactattttacacaaagtgagaacaaaagtgtaagtggggtgatatttgaaagtgggcgtactagttggatgagctgggctgtgttgttatagaggataggttgttacaaattgtaaactaaaattacttgaatcatgtcgtaatatgtcgcaagaatggagctggttcatatgaaactataatttatattacatgtgtttagatttttttaaaaaaatatcatattaattaaaaccataatatattttttatactaaagatgttttttagatattaggatatattagtttaagaaattttttattaaaaatgtggtaatatgatatctttatctaatttattaaattaagacatacccacttactcttgtttgcttctcctacctccatccataaatcgaaggatttaaattttatggtagattatcagggattataaatactactcgtaccatccaaccatctctcatttaatttttacccaatattactttaaccaccttataattctccaactacccctatttaatgaaacttatttaatgagggcaaaataccccctgttgggcttcttagtatttttttcattcctccttatttcctataaaattatatgatccattttaggtagaagatagtaattaaaaagagcttaattcgtagacggatttatttgtacctttgtggattgatttagctttacctatttgacctcatatacacgatgagagaaataattaagttggtagaaagtcgtcacatgtttagtggtacatagtaatgtgtccaccaattgtattttttaaaaaaggtggttattttgtcagcggtaatttttaggattttcttttattcagtggttaacttaattgccgtatggagaaaaagaggcgacaacctatgggctcgtctcgtccgtgaggaggaaagtggatacatgctcgtccatgaggagggaagtggatacgtgcattgtacatatgaaatctgacggtcttatcaatcaataatctttttaagatatagatctaatagtttaaaataaggtacacaggtttgggtaatacgattttttttctcagaatctcttatatttactttagtttattagagcatcatgtggtggcttaggaacattcatagaaagccatgtggtatcttgagagagtttataggacatttaatgaaattttagtatataataatagataatttatgtcatattaattaatatattaatcaataattaaataatttgtatgtgtagtgccaacataattttttatgggttcgccactgaacaattaagttggtacaaattaatgagtccaccaattttatttttaaaaataaggtggttattttttcagcggtattttttaagattttcttttttcctatgatttacttaattgccgtacggggcaaaaaaaaaagaggcgacagcttctgaggagggaagtaaatacgtgcgttgtatatagagactttggcagtcttattgatcgataggttttttttattaagatatagatataatagtttaaaatatggtacatcggtttgggtaagacaatatttttctcaaaatctcttatatttactttattttataagagcatcacgtggtggcttaggaaagtttatagaaagccacgtggcagcttgggagcattagtaggacgtttaatggactttcagtaataataataaataattcatgtcatgttaattaatatatcaatatataattaaataatttgtaggtgtagtgcccaaatatattttttatgggctcgccactcaaaaggaagggtatatatatccaattgatgtcccaataatttttttctgagttcccactgaagattaaggatatatagatctaagtgacgtattataattttttatatagaagcatatatactaagagaatatttagctatctaattaaaattttatagtatgtattggttgttagctagaaaataggaaataggagagatggaaagggacggagggagtacgtacatacatgtgcaaacatattttttttctttttgaaacgtattaggtgaacgtgtgaacggagaggaaacatacatatttttttcttcaatataagatttagtggtgaaaattaataatttaataggttaaaatattgggtccaccggtttaaatgaaagtgccacgtggcggtatatgagcgtttgtaggagtgctacatgtcaacgtaggagcgtttgtagggagtttaatggacttttagtatataaagatagatagatagatagatagatagatagatagatagatagatagatagatagatagatagatagatagatagatagatatgtatatatac

SEQ ID NO: 63003 - DNA, 705 bp, Oryza sativa
ctttctttcagatgctagattaatcagttacaagtaaactaactaactttacttggccttgtttatgcagagggaggccacctgttgctttccaatttttctgctgggtcacgcatgaatagccaagacaataatcttaaaaatttctttcagacaaatgggcatgtggtttttcaaagagtggagaacaactgtagcctaagatattttacggaaaatgagatacggcaaatcacccgtggttatagcattttactgggaaaaaggttcattcggtaaagtctacaaaggaatgctggatggtcgatgccctgttgctgtgaagcgatacatacatggaacccggaaagaggagtttgccaaggaggtgatagtacattctcaaataaatcacaagaatgttgttcgacttttgggctgctgcacggaggaaaatgctctaatgatcgttatggagtttatctgtaatgggaacctgaatgatatccttcattgcagcaacacaaatggacgtgttcctttctctttgggcaaacgtttagacattgccattgaggttgctgaagtgctctggtgcatgcattcaatgtataatcccgttctccatggtgacatcaaacctgctaatatacttgtggatgaaaatctttcaccaaagctatctgattttggaatagcaagattgctttgtgctaatggggctca

SEQ ID NO: 63004 - DNA, 622 bp, Oryza sativa
cgccactggacgccggcgaggacgcgtctccggtgatttccccgcgaaacggaggcgaagccgggaaagaggaggcggctgcgacgccgggagaggtggcggcgcggccggagggtgcacgggcgaggcgggaggtgcggctggaggtggccggcaaggaggaatgagaagggcgacggcgggagtgcgcctccgatggtcaccgcgcgaaacggagggcaggccggggtggaggaggtggcggcgacgctggaggaggcgacggcgcggccggccggcgcacggtcgaggcggcacaggcggctggaggcggccggcaacgtgggagagagagggcgacggtggggaggtggctagagaccacgggagagcttgggaagagaccaaaacggtagaacgcaaagagggggttctattttataggagaggagagggaaccggccacgggggaggtcggaacggcggcgagaaccacggccggcggcaatggagggcggccgaggaagacgcgggcgttcccggcgattgggggcggcattcaagggggaaaacgggggaaatcgaagaggaatcaatggggattaattgcccccaatcaatttggaaagaggggctgcaggaa

SEQ ID NO: 63005 - DNA, 2720 bp, Oryza sativa
gcaccccgaccgcatggtcgatttcagaaggatgcaaaatggacttcaacggagaaaggaaacaagctagatacatacaatagacacaagggagggaatataaactttctatactcagcccaaacctgaaagggagtattttgattatttttgtaattaaataattgttaaatgagtttgtattattaaaattagcaatcatgttctgaaaattccaataaaattccaaagagcgtaactaatcatgaagaatttaataaaaatagatttaacctgttattttatttctcacttgctttaacgcatacacgcaaaccctacccctttgagcctcttcgaagaccgggccagcaaataagattgacgaagtcaccacaggtgtctcgctgtcgacgggtacgtcgtctaccactgaaatcacaaagctgttaaatcttagaaaattagctctcatggggagtcggactcaggaccaaaggagctactgaggctcttgtatccattagactacaagcccttttgctacttgtaaattgatttaattatacacatacctacttaaaaataccaaatatttcatcaaattgttctcaattttctggtctgtacacttcccgttacaacgcacgggcacttttgctagtagagatagagatatggatagatgaaaataaggtcgccatgtcatctgaaggatggaactgaaggatgacgtgggacatggaccgatctggtcttaggacgatgtgggacatgggccgatatggtcttgggcctgcatgcaataaatcctggaacgcgtgggaaggaaatcacacggaaaaaaaatcgatcccataaaagaaatcgaacgacgatacgtaggatcgcacaagaccacataaacctaccagaggggggtaaattgtaggaaaaaccaaaaggaaaaagtatgaattaccctccccccctgaactatcacggtcgaccgaattaccccctgaaccacaaaaccgggcattcttcacccccaactatgcaaaccggacaaatcaatagagtgagagagagaagagacaggaagagaggatgaggagtatgacaggtgggtcccacattttttataaaaagagtgctgactggactgccacgcgtacgccatgtagaccaaaaccaccacggatttagtcgatgggagtaatttgtccggtttgcatagttggggtgaagaatacccggttttgtggttcagggggtaattcggtcgaccacaatagattggggggaggggtaattcgtactttttccaaaccaaaaacctaaaaatttttagcggaaataaaagttaccttcaaattgatggaggtcttgacgtagtcctgtggccgccggtcgaaccgctcacaagcctccagtcggactgccaaaccttcgccggtcagaccgcccgaacactgccggtcagaccatgcgcacacctgcagttagaccgtcgggacccagaaacaccggtagatgacaaactcgaagatgtagattgaaactttttgactttattgcatcaactagtgtttataaagtgcaacaacagcactcctcaccaaaatctcgaactaaactcgaaaccctaattttctctcaactcaagcctctctaaaaccgataccgggagacctcaccctccctctctatttctatatgaggtaggctgtgcaaagcccatggatctaatacaacttaggactcctaacccacgtaggaaaccctctctctctttccttatctcaatcaatcttaccgaatttagactcctttccgaattcgactcctcttttcatacatacataatccttcttgtataccatatgaatttcttcatcaccacgtgcattgttctctagcctttagtatcccgcaggatctcttgatccctggacatcaacttctcccaagtttactccgatcattcaccggcaacactctctgatccctcaagcaacacctgcacatgcaacaaccaagaaaccatattccgagcacaagttcgtcccaacttgacttacattagtataacaatagtatccgtacgcatagaaaccatctagaagccaaaaccccaaaggaaacatccaaatctaacaagacaacccgaaaacaataacaatcaggatcatgccggtcagaccatcaggtaagctggtttgaccgccgcaacacctgtgctctgactggcggcacatgaccgatctgaccgccagggtcaaccgaaaacacccacttcacaaattcaaccatctattaaatctccaaaataacaatagcaaaccaccaatattttcatcacaaaatctaaatcaactccttgattttacacgatatacacttacgcgggtttaaaaaaaggacgaaaaataattgtgcatggatagagtcgaacaacgtacgaaaaacttagcgagccctccaagggcataaccattatcagatcgttagatcaatatacatccggcgtatgcaatgttcaaataggagtaggtacctctcatcgagagggcttaaacctatctaaatcctcatctctggatctttttaagtctcgttcgctacctctatcgacgtttgatgtcgcgatttcggtatttgcatagtatggggatcgttggtattaggatatacgcgagagtaaggtaaaagagatggagacagggatttttatacaggttcgggcccctgaattgtca

SEQ ID NO: 63006 - DNA, 519 bp, Oryza sativa
tacgcaactggaaaatcatgcataataggcagaagcagaattcaaaagtgatcataattgataaacgcgcttctcttgaagaaaaatgataatagtgctgggctgggctttgatgcacctccattctcttccggaaaaagtacaccgaaggtccctaaacttgtcatcgagttataaaaagttaaaaacatcctcaaactgcaaaaccagatatccgacgtcccttaattaattaaaaccgatcacaataggtcctttgatggttttgatcccggttttgtcctacgtagcggctgagtcagcgtgggacccacgtggccccatatgtcagggtccacgtcatctctctctctctctctcttctccttgctcactcgctgcaggagggtggctggcagacgcacacggcggcggcctactgctgctgctggccaacgccgccggcgacgttattcctgggtcgcttcctccggggcgcggaggcggaggagttgtcgttctcgggcgaggaggaggagc

SEQ ID NO: 63007 - DNA, 1353 bp, Oryza sativa
atagccaatcgtacctttcaccacgtcatcgtgtccatcagctgccctaattttggagcacccaaaatcagaaatctttgcaataaaattgttactaagcagtatgttcatcgacttgacatccccatgtaagatagggtggtccagtgagtgtagatatgaaaatgcttcagcagattcggcagcaacttttaggcggatctccagtgttctgatggatggatcattttggctgtggattagatagtgcaaagtcttattggggacaaattcgtacacaagaactggaacttcaaattgcagacaacaaccaagaagcttgacgatgttttcatggttgactcgagaaagtatgagcagctcctgtgtaaattctgtcctactattctcatcaaatcccttgcactttttgatcgcaacagggttgttcacttgatcaagattataccctttaaaaacagtaccctgacctccttcaccaatgattgatgtcttgtcaaagcctttggtggccaactcaatgtcatctcggtcatacagcttaaatgaaatgttgttctctatgttcatcatatctgttaacaattggcctccgtgtagatgaaaatactcgcccctcttcctcatgatgtcttgccttttgattcgttgtttgtacttgatccattctatcccaagtaaagtcgttagagcaaccacaagagaggcacaaattcctagcgaggagaaggtaaaaatgcttaagccaaatatatatgtacagggaattgttcaaatgaatcaatgcaaaacatgaaattcataatttattcgaatatagcaatcaggcaaggttgaaaattttgtgtataccgatagctagccctttgtcgcatggtccattgtaggcattgcctcgtgtaccaaacggacaagtacaatcataacctccaactttatttctgcattttccatggcaggggtacttatatggttccttgcactcatcaatatctgcaacagaataccagcggtattaagaaacggaatttagcgttgctttgttagaaaacagagcaattcaaatcatgagtatatagtgtgtacatgtgaatgtgtatccaaatggacttcctaaaaaatgtttttttaaagattacaaaatctatgatttagaaatcaaaatattttctaggaaaatattcttatactgcaccttataagttaaaggcacatggcagatgcaatggaaataatttaaggtatgactctaagcaatacaaaagcaagactttcgcaacatctaaaaattatctctaaactttagcgctatacattattattcatcattcaactttctaataaacaatttaa

SEQ ID NO: 63008 - DNA, 1041 bp, Oryza sativa
taggtatgtggtatccataaccctgacaatctctttcattatgaccgatttccagaatcgacaagattgtccctttatatggaaagcaacgaatataaagacaaatgatataaaactttttaatgttactggccagtagatccacgcgtttgtgcgacaatgacctccctcgctactaaatcatctcattcgccgaaaaacctaactcagcctcgccaaagaacgatgacaaccaagaaacggaatcatcgtcttcctcatcctgcaattgagaaaaacaagaacctaacgaagttcgagcaacgtgtgcagcatggatgtgagtcttcagtcgggaagcagaggctgccaccacctccaccaatcatgacatcctttctcacatgcttgggcatgacaagcttctcgtgatcgatcatcatcccactctagcaaaggagtacgttgttggtagtacaggcgagccctacgccccccacgccttagccggtgccagtgttagccagcgatgcacgcctgatcccttgtaacagccttcccaccagaaccgcgtagccagcccatccgacgggcgggcccatttacacataccacattaccactccacatagtgtgaaagctttcatgtgtaaataaagaagagtggctagctgtgatgtcctacgatccttttgttccaaccaaattatatctcctgtgcatagaacttctcttttatccaacacaggttcgtaactgcatcactgtcggttttcgaaccaatgggatggaaatggctgtaacgacactaattttgctcaaattaatttggtttagagtagccgagaagtgaagaacttctgcagtctgctagatcaggctctaattttgtcttcatcacgtcggattggaggctatagctacaacatggttttagtggcacaaaaatctaaattttgtgagcttaccctatactcgaaacaaattgtcccggtcagtaagtttgtggatttgttgaatagagagcatcagatttgataaagagtgctatgccggttcgag

SEQ ID NO: 63009 - DNA, 654 bp, Oryza sativa
  unsure (1)..(654): unsure at all n locations
agcgaattcaatatcatgtcaggaatgaatattatgtttcgatgttaggtaattttatagaaggtattaagaagtaccaaattttgaaatataaaatttgatatcttcagatactccaaaaaacttagtgtaaagtttagatatctcgagttacttttgaagaccgtatatttgaggaagggctggtgtgtgtaccaagaggctgaagccggtgacgccggcgaaggaggtggcgatggaggcgctggagagctcgagctcgccgaggtggccgacgaacatgacggagatcatctgcaccacgttctgcagcagccacccggcgatgagcggcccggcgaggtacagctgcttcctcacctcggccaccaccgctagcctcgagctcccttctttcttctcctcgccattgccggcttcaagaagaggctcctccatgcttggtggcgccgncatggccacgcccccccaagcttagcttcttgctctgttctaacttcaaacagaaagatgagtgtgtttacaattacagatgaggtgaactacttacctgagggtgtgaagcacagcaaatcagtcaataatctgacaaagccttaatagggctttgcgataaattggagggaactgcgaggaaacgatgcacactaactt

SEQ ID NO: 63010 - DNA, 665 bp, Oryza sativa
tgaacgagaacgagaacgatcgatcgaacgagagcgataacgagaacgatcgacggaagacaagtgagaacgagggaacgaacgtgaacgagctagggaacgtgaacgagcgaacgaacgaggacgaacgttaacgtgaaatgcaatatatatatatatatatatatgtatatatatatatatgtatatatatatatatgtatatatatatatatatatatgtatatgttacttcgcatttgactatatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattgctttatttgtaattagacttagtatgtaattattgactacggaagtggtgcgacaagtagcaattgactattgtagtcttaattagacttagcatatacgcacgaaacacttagcatacatgacattttagtcttagcatgtaatattatttgaatatatatataagattactttatttgtaattagacttag

SEQ ID NO: 63011 - DNA, 1138 bp, Oryza sativa
gtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacggccctgcag

SEQ ID NO: 63012 - DNA, 6780 bp, Oryza sativa
tgagtagcatctatatttatcactgatgctaggtagttgtgatactatacagaactttgcttgttcgaattctgaaaatgctccaacacaaatatttccattctaaggaagaaatgaatgagcgtatggttggattggaaactgtaacctgaactctacatatatacaacacagctaattttgtagtactcaaaaaagctagcaatatgctaaagtgggtgagaatacttgttgtttctatactggctttacctcaatgcaaaatagaatgtagtggtcggagaagctttctgggatggttcagcatggtagagaagtgtcacttttatcctgccatcactccttggtggactattgaaagtcacctatgccaaggaggaagaaatttggtgtggggtcccaaaactaatgattcggaaaccgacatgtttagactgtatcaagccctggatcagtagattgatacatgttcaacgatctggatcttcattgcatacatttgatcaaggtttcaaaggagataatattacaaaatataagggtatttacaagcttgtggctaactattacagcagaagctatatgatgactcaactctagtgttttgctatagacttaaaccatctatctaatctatacttgagaactaagttaaaatgagattaacttatatgattgaactcccggcttcagtaagaacatcaaacggactgaaaaaaatgtggggttgaagcaagggtgagtacaacgtactcagcaagctattatattaatcaacaatgaatgcatgaaataataatattcgagtagggttagatttacttgcagaaagcagagaatatagaaggaaagtctataatgttttaaatgcaacagtatttaataaagtttgaaattatgtttctaaccaagatgacattgtgagtcccaatgcccgataaccgcaagcatggctattcaaatagttttaataatattcatactgcagtagatatacgctttacccgcaatccatgacgtgccaaacacattagccttgtcatggcaaagcttttcggtcactaacatcaatggtacctgttccatgaactctagtccccacacgctctgaacgtaacgttatcagcagcgagaggagttctggtgttcccggggtttttagagagaactggttgagagaccctcgtcatctcaatcaggttttcataattcacacacacagctcacgagataattaagatatttacctgcgcctcggtaaatatcacaatcgccctgctcggcgtaagtttgcctcctgtgcgaggacttaagaagaaccactatacagaggtaccgcctttgctagataacttaatcagctaggtctatgcccatacgagaattgcggtcgtactcgtatgttcttcacatgtacttggtagtcttatgtcggttggaacagtactagccacccggaaatcaaccatttctaccgtactgtcccaatctaagtttattatattttatgcataatctaactaggcatggctaagcaaaatctagcatatatctggtttgctatatattcaggttatgcatttaaaatcatgtatggctaatgcagaagatactggagatatagaatataggattattatgctcaaaggagagaaataataacttgccttgctccaacgcaaataaatccgaaataggcaacctgattatttgatgcttgaaataccataggttgctatccatataaaatagactctactgaagaagaggaagatccaaattcaataaaagccataaaatagcaagaaagagataaacagttaggaggactagggtttaggttatctcttttatgcaggtatatggattactgggctgatattttatgtgcaggttctaaagggttgggggctaaggtggataggagattaagcaacaattgtcgcttatatttcttgtgtgggttttggtttcttggagagtaggagatataccgaataatctaactggttaagtggatatgtggctagtattggtcgaggttgggctttggtagaagaatggctaggatttagttgttctcgagtcgatgctgaaataggatagcatatcggctcgtaattcatgcataggctatgggtagtaggcaggtaaatggttgtgattatagctggtggggagtctagaaaataagttgactaaggtttcagttgtctaagccgatatcgaggtaagataaatatcgactagggtttgggtgttcgctagtcgtcgctaaagcatgacgactaggtttggtatcttctctagccggtgtcgatagacaatataacggctagagggatgggaggtttgtgcaggtttagcgaggcggaagtgttactccaacaaccatgagtggcgggggagcggctaggatcacacagagctcaagagctaactgtgcgaggtcgagggaatagtgaagctccgaccgttgtacgcatcaaggcgtggggtgccaggagcagcacttcgaccttgggtttggttttgccgggctttacaaccaacggttcgacgtcggggccaatagaccgcaaacgtccccatggaaggcgtaaagttccaaccggcggctttttagtggctaaagggtatttggggtaaaagaaaatatttgaaaaaggcaaatataaattcaattgatatttgaataaattcaaataaaattataaaataacaaattaggcatcaaaatgaagcatttgaatttagatgaatttaggtctaggtttcactgagatcggatctacggtttaggatatataggcttctaaagattggaatttgaattaaatagagtaaattgcgaaagtatactgttcatgggcccacctgtcagggattcctttttctttttctttttctcctcttcttcttcttcttcttcttcttcccgtctctttcttctttttctcctcggtcgaacagagaggaggaggagagggggcgccgggctccggtggcgaggaggcggtgacgccggcggccagtggtgttcccgactgcaacgcacctagggatggcagtggccggcaaagggagtaagggaaatagccggaacggcggatggaaggtcgtgaaccgggaggagagagagagctccggtgaggtttgattcagaggtggaggaagaggggaaaggggaaaaatggattcctctcatcgaggcaagctcgatggcgcgagggattggccggtattgctccggtgagggagatcggccgacgacagtgatagccggccatggcaaggagagagaaaagagaggagggcttcaagctcggtttgtgggggataaacagagggggttcatcctcttatataggcgatgagaggcggttcgaagaggagtaagacaagggagaatcggcgacggcgatggcgtggaaagaaggatgacggcgccgacttgattccttagcggcgacggttgcggcggcgtgcgccgtgcacggcacgcgcactgggaggagggaggcggctgggttgtgggccgaactgggccggctcggcttagctgggccggcagcccaagaggaaagaggaaaatagaaagaaaaaggattgggccaaaaggaagaaagaacggagtttcggctcgatgacaaaaagaaagaagtctaatttgtatacttgatttggataacgttgttttgcgaagaatttgaattaggagagaattcagaaaaggagattttctaatttatttgagtgcaatatttagaggtggagtttgagggaatttatttggaagcactcaaataggaaagtaaattaatagtattcctcaaaatatttttgggaatgtggtaggaaaataggtggaggcaaaaggataggatttgaatcctaaaatatatggcatgggtttcaaggaattgtttgaggctaaaaggaaatttaggtgacaaggatataatttattttcttagcacaacagcaattattcacaatatttgtaataatatttttcttgtgccgagaaggaaatcaagccacaggaattaaattagcggctagatcaaaaggaagaatttagatatttggcgataaataagaataggtttggaatcaaaggataggtttaaaatcaaaggatgggtcgacaattaaatccaattggaattgtttggtttaggttctaggacaatagtggagaatttcttggaccataattcataaaaatagaaaggggttttcaaactaaatttgaataaaagaaattttaatcaaaagaaggttttaaaccaaatcaagaaatacctcaatttaaccaaatatatatttttaaatgaaaaacacaaaagagattaaataacagagaggttttgtgcgagttagttctaggaggtccctctaattatattatcctaggtttaggaagttattaagatcataataatcggcatgatgcaggattagaaaatgacgcattttcaggatgttacatttgggggggggggggggggaattgcatatgtaccattgcaaaagaatgacttcgctagaatgtcattcttaaaacaggcttcggtaaaataccacgttcaacgaagacggcttcgccgaaatgccatcctggacgatattacccttggctccacttcttcctcctccatgagccggaggagctcaccggcgacgactatgtgccatggccaacactagctgtagcattggagaggagatgcagccacgacgtaaaccacgatggtcagcagccaattcattgaggacaagcagagccaattcgtccttctcaaccagcaagcaaacaagcagaacaagcagcctcaaacagtcacaggtcaaccacgacgccatcgacggctccgccgcctcgtcgtccatcacggcaatttttcgctgtcttccgcagtggctccaagtctgggtccccgcatcaccagctactaccgctcgccgccgtctcattgtcctccatcgtcaattgcagcgctgcccttccgtcgtggtcctcacccgccgctcatcctcacccgccagcaccagatctggtagcatgcctcgacggtgatggcagcggtggtcgttgtcatcgcgcgcgcccgcggctggcgagagcacgtggtgggcgtgcatgcacaacgcgactgcgcacggcctcgtctcctccgcttcccgagtccgaccttgccccgagccggagtcgcctcctcctcgcgcgcagcgcacggccggtgccaagcaggttttggaccgagggcggacggacgcgggcacggaacttgctccctccactagcatatgtacctgctgctgcaataggcgggtgccatggccgccggtgagctacaggaagatggaagaggtgccgaagggtggaagaagatgcccaagggcaaattagtccagtagggcattcgggcgaagccatcttcgttgaacgtggtattttaccgaagcctgttttaaggatggtattctagtgaatccattcttttgcaatggtacatatacaattttctcttgggggggggagggtgatgtacagctgacctggagacgggaaggccgggcagcaaatcatcaggtaacgatggcggctgcgatgaacctgtgccagtgacctacaacagtctaaatgcatatcatagacaaaaaggggcgcaagctagtgtatattatagccgaaccatcacctgatactggatatttgcaacataaacatttatttaatgaaagattaaaaaaccaattcaaggtaaaaccataaacatttattcaataaagattgaaagaaaacaattctttcaaggtaaacctgtgagaaaaaaaatgatttaacagggtcaagtctgattcattctaccctagcacaatatagttaaaatctagagacatctgtagacacttaagactcttttaatttgcattcagtgagacattatcaatggatcgtaggccctcctagctagtatgtcttactatacctctagctaagaggaagaaccaaattaaggtacacaagaatttaatatgcacctcatgcaaggtggtgtaaaaaaaaaaagtcccatggctttaacataggccaatgatagctaaaatttcagttctaaataggtcatgatgactttataattttatatgttgttttaaaaagtaattgattcttatggaggaaaaacagaactcacatatacatgtcacacttcatatgcaggggagggataccataagcttaaaaagcagtaataaaaaacagtagggcatttatattatgatcctaaaggctttgagatggatccacactatttatgtttctaagtgtacatcttatgcaggcaaaaaagaagcacaaatattaatctcaaagcagtctaaaaaggaaatttaccttggcaagcaaagagaatcattgcatacatttgaaaggtatcctaggcttgattaaatgcaggaaagccccaactgcaagcagggaaccacatgggggcgtccttgttggcactgcaaaagaagggttgccgattggaaggaaatctttggcaaaagagatgaggtaagggccagagaagaaattggaggtaccaggaagcgacgccgtgagcacggccttgccagcgtcgacctcattgtccaaacatccaaatagaagctacaatagttggcaacatagtattaaacatttacaataaaagagcatcgaaacctccaaatagaagatacaataattggcaagtgcaactacaaggcgatgcttttatattt

SEQ ID NO: 63013 - DNA, 9468 bp, Oryza sativa
ctctctctctctctaccttatctctaccttatctcttccttatctcagccacacaccttcccccactcctccccacttgtcacgcccggaatttctatccaaaattccaaacgcttacatgtgtgtgaaccctcgtccagaaatcagccgaggcacacaataacaaattgataatagagtacaattattactctaattaataagcgaataaaatgtcattacagaggtagatagttcctctcaatcaataaagatctaagcagcggaaagataagataaacggcgcagacgactccactccacaggcagcttgaccagggctacacctaatcctccacaccatcagcttcactatagaactcttcctctgatgaatgattgcaaggtgagtatatgacatactcagcaagtcacgcagcaaatatgcaagtgcacaggataacaaaggatggcatagtagggtttcatttgcataaacagcatttaataaacatttcagaattttataaaacagttaagtaataattaaacaatattaatccaacgctatacaacataccctgttgtataggcccaaccattctgaacaaccatcctggctgcacagttctatctccaaaccaggaatataccattccaaaccaggagctaatcaaattattaccagttatagcatcttttattatgatgagaagtgtgagactaatcacgaaagacattgttagacccgcccataaccgcgggtacggctatttgaatagttttactctggccagaggtgtaccactgtacccacaagacacagcctcacaacatgtcaccatgtgcctcaataccaccacggtacctcggaaaggagctgtgacaatacccctcgcacaacacaatccaccacagggcacctttcctggatgataatcacccccttataaacaaggcatggactccccagcgacccccgtgggcttatctccgccacttctcagtctggtgctccgcaatgaaccatgctatataaaaggtaaagccgttacccatgctggcttgtggttggcacggttaatgtttcacaaccgaaactcgtgaacacgactctcaaaaccatgtgctcacaacccaccattatcaagttttagttggccagtaattaattaacctaatcacgattgaccatcgtgaacgatcattaagccatcattaaataatagtgagtcataagttatcccaatagtgcgctaatgtttctaagcatggctaagcaatcatatctaatatctagctgaaccaatatatatagcccaactagtcaagttataataacccaaggtatcaaggaataaagtaatcaagatcaaaaagggctataacaaacaataggttaattccacccaatgacattcgaaaataaatgcaatatttgaatagaaacaatagctttaaacgggatcaacatgctcaaagggttgtttgggatctgtgtgacttgccttgctggccttggaactcttcaaattcttctcctgcaaaaacggactctccggaaacgtcggaatctaaacagaaaagagcaaaatcaccaaaacagcacataaacaagcatgaacagtacatgtggatatttttaacaggtagatcttaattttagaaaaatttagagacttgaactaactaaatccgagctaagatgaattagtaatgaatttttaaagattaaatcggattaaaacacttatatggattttaattgaattatgacgcaataatgaattatttttgaaaaggaaaaggggtttattgcgtcagcggctagggtttgcggtggaccgggcgcacggcagcggttcacgggaacgaacggccgagatcgatccatccaaaacggacggccgagatcgatcgggtctacggcggctcacggcagacggaccctgatgacgtcagtggtgacgtcatctccggcggcggctcgggcgcgcaaactcgccggcgaacgacggcgcgaggacgcgaacggagggcaccatcacgtagagagcgacgcggcgaactcaccgatgaccaaaacggcggcggaagatgaacggacggcagcggcgtcgaggaaaaggcggcggagaagatcgggccgacggcggcgacggtgctccggcggttgacagcgacggcgaaggggcagacgaggacggcggcgacttggtgaccatgatggcgatcttcccgagcgacgacgacgaccggaacggcggcggcgcacggctggagcggcggcgacgatggcggcgctaggtcacacgacgctagggctcttccgacggcgagagacgaaggcgagggtggcgacgggtagcggtgggcttggggatccttttataggggttggagggcgacggcgaaggcccacggcgaccggcgacgcgaaggaaacattggggttcggaggaaagagaccgatccgattcgacctcgaatccacgaatttccaaagcgatttagatgatgattccaaaagagaaaaggtagaggagatcccgaagatcatttcccctctattgatttcaccggatcgggaaaggagcggccggatttggaaggagacgacggcggcgcccgtcgtcgtcgtcaaggcggcggacatcgtcgaggcagcggacatcgtcgtcgtctccgcggcgaacgtccccgccgccagctgcctcctcaccgccatccaccaccacccgctccacccctcgccgctacccctcgccacgttgctcctgggccacctcctcttgtgccgccgcgcttgtgaggccacctccatcgtccgttggctctgccgcccggactcgccctggcggcccaacagtgccaccttcaccttcaccatcacggcgggcgggcttgacggcgacgatggtgaccggcgaggcggcggtgagcgggcccacccagatccgacgagttgtagtggtcagttgcgtgtgggccagcgatttttgttttttttttatttttggtttttttggtataacttgaccacataggataatcgattatcccgtgcggtccacttaagtgaaccacaagggaaaatgattatcccgtgcggttaggccgcccgcacgcgaaaatcgtgtagtagtgcgatgtctataatatactgcacctaaaaaccgagacaacagagcgtaagtcgccattttagccggtcgcctcccctcccaacccacagtcgatatccttatccacactccatatccttctcctttcccatccctctctccttcctcttccacatccttcgcctcctttcatgtcctcccattgaggagaccctccaaacccctttcctataggtgcgggccaagggtgtggcattgccttccccttctcctcgctgtcatggttgctgtgcctgcactacgtggttcagcactatgtgtggggctgacacggggaggcctccctgtcgcatgcctctctggatctagcggcttagtgtcctccgccagatccatgcatcttcaacagcatcaacgacataaagagcatggccgacagcgagtcatgttggtgtcaatcgaactcggagggcttgacgcatcagcttgattcaattgtatgcaattgagatcttggcggtgaccttattcttggatgttagtgtcagtcgaatttttttggggggcgggggcggggggggggggcctcgatggttcaactcgattcaagcctatatttttattcgtggaacattaaatgtgtcagtttagaacttttctttttttttattcgtgaaacataaaaaaaaaactctaaactgacacctttgactcttctcatcaagtaccgtcaatggggtgacagttgagaaattcggtaatacctataagaaatttccaaccaataccaaggtcctttcctgtatagcagtgtctggaagcgctcccctacaatacatatgaaaatccaataaaatggttaattctttgacaagatcatgcgcgcgcacctataatcgaagtagttgttgtctttaaagatcctcacaacccagttgaaatcacgcatttgacagcttaatttactctgttgtttcccatagtcaaaagtttagccaaactttatcagccaatatgcagattagcaagttaacgacaaaatggagataacatgcatccttaaatatatactccctccgttttacaatgactaacggtaggcactattcacgtttaaatttcaactactcatgttttttattaaatatttacagaccctaaatgatgctgtgttagtaaagtaggatatgtcctaaaataaaaacataacacttttgttcactttgatctaacaatttaagcatgattatgatcaaagcttaaatgagaggtagcatttttttctatcataccacaacaagatattatttgccccgagaagcaggtgcaatagaaatttccagaaagttactcaatggtgagagctagttaatatggttaccccaccataaattgcctggccaaggtggagaatccacaggctaaataaccactgcgcactgacaaatggaaattcgtttatggacaaaaaataaataaatagacaaataattaattggtttacacatctttatcgaaccatgtacatgatctgtgcctataaataacatatatatcatcagcacctctcaagtcttaacccaaaacaagagaaccattagtcaaaccaaattaccaacaaagtacacctctcccttgctagggtttgttccctctcccaatctccaaagtgtcatttcacattgacttcattcttcttcccagatcccccaatttctccctttcaccatgaagcttctccctcttctcatcctcgcaatggtcatggccaacgccttcggcgccgtcacttctcgcacggcgccgggggaggaggcgctgctggcgcacggcgtggtgaagacgacgacggcggaggggacgtccatcgacaaccaccacgcgataccgcggccggagtacgacagctggagcagcccggggaacatgccggggagtggccatgacattgggagcgaacaagctcagccatgatcgagctagatgcagcttacccagctctacccatgtcctgtacgtatatacatagcaagcttgcaagccatgggttatacacttattacgtacgcttgattgcatgtagctagtatccatatatgtacggttgtggctctagttgtggttgcatgataattcgaagatgctttgtagtttctacagtgattgtatatttgtattgctcatgtaaaagtgtttaactgtatttaacctcatcacgtgtactaatgttaattaattaaatactgaataaaatttatacgtccctacatgaagggagagttcttgttttctcatttggggagttcttcgtggtgatcgatcgatttagttatgttagtagagccatactgttgctacttgtgaacttgaatgatctaattataaataattaaatacaaataaagcatgcaattattagacagttgatggatcaattagttatattgctgcttcacgccatagcatctactgatttgcgcccttctacattacaatattataccgtacacagataaaaattatgatgaccaatttgtagttccatgcctcttttttttttgcatcaattccaaatatgcttggataaatatttacatttcacattaaggacaaattatttttatcgaggaaagaacagctgagggaagtgctccccctccggtagtggactaaattttcatcgtttcatgatctaaggggatgtttagatccaggggtgtaaagttttggcgtaccacatcgggtattatacagggtgtcgtatgtggtgttcgggcactaataaaaaaataattacagaatccgtcagtaaaccacgagacgaatttattaagtctaattaatccattattagcaaatatttactgtagcaccacattgtcaaattatggagcaatttggattaaaagattcgtctcgtaaattagtcacaatctgtacaattagttatatttttagcctatatttaatacttcatgcaagtgttcaaacgttcgatgtgacaaagtgaaaaattttagggtgggatctaaacaggacctaaatctcgatcttattgctgcttctgtgataagaaagttcatatagtgccagcagaccattgggaagggatggggccttctaatgcgatgccccctccgtacacaaatatagcaagagatagtattggattatatacatattaatactacgaatctacatgagtagcaaatattcaagagttgtgactctgttcattttgactatcaagcatacacatggtatatttgtaataatcaacaggtggtgtaaaaattaatatataaattgttgcattttaatataacattaagcaaacgcataacattataatagcaatgctgtgaaattttctgaattaattactaatattgtagttcggtatgcatatatttacagttgtctatctacctaaaaaccatgaattatacaagatagacatttactaacgatgaatatatgtacatgaagcacaaatgtggagtataaaacagccataattctcaaaaaaaaaaaagccattcttaccttagtgaataaacaaattaatgattcgcttgcaattaatggatccgcaattcgcagtttgattatggcatgatatatatgcatattctttcggtcatttattcaaaaaaacttgttcgcaaaatcatcagtagttttgtttttccagtagtgtccaaataaaaaaaatgatagaaattagtttgtccagagacaacgccacttacctaactgaaaggaccccacttgcgataagttgaattattatatggtgagatatatattagccaataagtgatgtgtcattttaggggtacagtaaaccttatatctctaatctataatattaattaattagataactttgtaattaaccacgtatatatattttttactggttaagtgtttagtggatgcttaacatttctgcatttacctctatatgcttagatgttagatcaactgaccatgacacattcagtggccgattgaaacggtcgggttaaagtttaggcactgatattccccaccagtaaataaaatattaagttattgctaagcaaagcataaaccactaacttagtgggaaatactatcgctagtgtaggatgatttctgcataatttattatttcaacgacaaagattgggccacgtagtcaaacgaaatctttaaaattacgatattatgacttattttattttaacttgccacagtaaaaagatgaaaatttgggtgtcattttgcactaactagattctactggtccaacagaacaaaaggagaacctttaattttacatcccacatgaatgtttttctatactagtgtagcattcacgagccatttttttgtaagcttttctcactatataaagtgtagctgaccgaacccgtagccttcactacacagttgaatccgaacgaattcttcctctcctacagtagtagagatttttccaggtttgactcgatcctgttcttgttaattagttcttgcttgcttgattacgatcaagtttcaaatgtctaattaaacattttttatccctgtaatttctctctctctctctcaggcagctataggtttgatcaccatgaaggagaaactgaaggcgaggtttcagatcatcgccgtcttgctcgccttcgccatggtagctcaagctatggcgattcgcggcacgggtacgacggcggagcaggataacaccggagggagcacgagtgcgaaacataccctgcctcaggctgttggaagtggcacctctgtggacaaccaccatgccatccctcgtgatcagtacagcaaccatgggggtgatgatggaggtggcagtactggtactggtgatacaaacaactagtgagttgatgatcatggatgtgtggagattaatttctgagcttgatgtgaggggagatttaaatatatatgttgtgttaattaaggtactaagtactggttgtgatgttgttttgatatcagtagccctaatcctgagaataagctgcttctcttcatggggatagaggagagcttctaaatatcaatgtatgcaatatttctgttgtgtgccataagctgtttactcttatgacaaattaattaaatctattgtccagaaaacgaccagcttagttcatatgtgcttccaaattagtatttcgtcgtgttgtcttgatgtatttccaaattagttcatatatatgtgcttccaaattagtatttcccaattagtatcatcacctaacaagtaactacaaacaaaggcttgtaaacttatagtcgacactaagaaaatacatcatttccacaacataatttcctgataccctagaccatcaatgtaccctttcccttactttcacttaatcttgtatcagaaaaaattcaccctatcgacgaaactcttgtacttattgcatgctctggtattactttctgcattgggatctccattgaaatttgcctttgttatctattggaagcaatctggcaaaggatgtgggtgtagggatcgagagggggatgacaagccatgatgatgggaagattggttgctcgtcgactcaactgttgtgttgttgagagctgcagagctccatgtggccgtgagactgaggagggaggaagaaataagttagtgcaattgagtggtggtaactggcaaggcattataaatggaagggagaagtgatgggaggggtaatgtcatgggaaactattttgatccctcgtgaggatgtccccttattgtttgcatgttattccaatggttataaaaatatttgagaagatgtaataacatgtgatatatcactccacaaatatgcaaggttaaattcaacttctatatatcagaacgaaaaaaacaaattaaactatagcgagttaacgcatatttacagtcaaatttgtttttttcgttgcaaaagatagaagttgaatttgaacttgcatgtttgtagagtgatatatcacatattaatatatcttctcaattgttttcaacttttttcgtaactatttgagtgacatgcaaacaacgaggggatatcccctcgagggatcaaaatccactcctgtgatgtcattagagaaacaaggggaggtgagagtggaactatatttgaagaagttagcttgtacttatttccctagttttgttgattggtttaattcaaaacagagcgtacattttttaaaaaagaatgaagtttgatgttcttccctatgtatttataaatcttacttcgcatttggacaaggacgttttatttaatcagcgcatttggatatggagtttttaatttctcagacacatagaaggcaatat

SEQ ID NO: 63014 - DNA, 1513 bp, Oryza sativa
agggtttgtaccggttcgcgaaatccaggccgtccgtccacaatccgacgatcacacgggcgtggaaggcccggcacagcgggacacgtggacggccagatcgaccctacggcgagatcggacggtggacagcagcggggaccagtccataattaaccgaaaggggaagggtttttttgcaaaaatcgctgacgtggcgcccctaatcttccggcgttcccacgatgtttaagtaaacctatatttgatgccgctgatgccaattgtagccatagaaaggtctgtccgtctgtgtttggtacaatggaaaagtgttttaaatttctgcggggatgtcccattatttttttcaagagaaaaaaaacaccatataaatagttaccaaaaattctcaaacaaaacaacattcataccatatacataaaataaactattttaaacaatcaagtcaaaacttaactcacacattgagaaataaaaaaaaacagcatatgaatggtattggtactattcactcctggatgtcttctttgtttctcaatatatagataaaatttgaatataatttttgatgaagaggtagatgctaccatactatattgccaaattgttttagaatttttcataatcacctctattgaatttgagagaaaaagttaggcgagaggatagaggtattagaatcctctcccagattaccaaacgcagcagtgaaatggtttactcagggcaagtactataatgcttcatatgttgcccctacaagtgccacattagattgagtgatgaggtggaggagaaaagtgaagagagagatgatgagccacccctaaatcaagaggcaacctccacacaaatttcaaaaaggatgtgagagtattagatatattggtatttgtgaactcgaggtgatatattgtatgggttgcctcttgcttcataagtgaataaaatagataaatttggaggtagtagtcacatctaccatagcactttccctcgtacaacagttgcatcagcaaaaaagttgtatttgatacaaaccccaagggcaatcatgcgacggtaggattatttgatacaggaactgcccggggctaaaataaggacataactaatggattaatctagaagaaacagtgtgaagaacaaatctcaaaccgttgactaatccataactacaaagtattatacaacatctccattaaaataggagcagcctccttggcaaacttgaagaccctgtccaccaacctcaactttaaagcagcgaaaactatgcgactccagctctgcaatgactttctccagaactaagttggatagcactgatattcatgttaaggaaacatcatgcatcactaaaagataggcataaatcccaacagaagaggagtcacatagcttagtgtcagtatgtggactctgtgacgaagctagaagtacaataaagatctaataagcattcttaaaccagaacaagggcattgaacgtagtaaaaatgcatatcta

SEQ ID NO: 63015 - DNA, 602 bp, Oryza sativa
tgattacctcatgggctcaaattcagcttaaaccaagtcaggccgatccacttggaattttgagctggtgttaattaaaccattaattcctctttgcagaacaactgcgcctcacctaagcccaagaaaataagaacggcatctgctgctcggatgactgttggctgcttcgatacaggagtactttttttatctgcacaagttagaagtagaactgtcagatattgcaagacttgaaatttgaagccatgttctgtcacttatcgttttctttccttaagctgaacaaatcgacgggttcaccgagcagcgacctagatttttcttgaaactattgctgagacaacagaaattttccagctgcaaatgaattttcattcgcacatttccttttaccaacagttcttgaaggaagattttcttgggaatacagtttttttttcacctgtaaaatattttcacttttattcttgggaacaccgaggattcatacagtcaaaaattttcaggccgtttgggtatttggtaagggtaagacatctatctggctagtcattgcaacaaaaacgaactctgaaacagaacgaacatggcgaagggga

SEQ ID NO: 63016 - DNA, 1065 bp, Oryza sativa
ccctgttccaataaatatttttaaagaaacaaaaagtcaaagttgtattttggagaccgtgtcgctgtccaaaacgacttctttcatgagtacggagagagtatagagtaaattatatgtactgtactgcacttaagggtgcaaataggatgggtcgtggctatccgcgctgcgtgtcggttccaccggtcatttttggatttgtcctaagtcaaacgcacgttgctcttttaaatttgatcaagttcgtaaaaaaaaacataatgtctatgacacaaaattagttttattaaatggaccattaacatatttccgtagtatactaatttgttttggtatacaccggttttaaatgcgtcggtcaagcacaaggaaatttgacttggaacaaacccaaggtgatagcacattagttgttgctcgccagaccacactcctgcccgcgtatatatcaaataatattggggtttgggtaaacccatgaacctgcccaacaatttctgtactatctcttgagctttaagcctccaccacatagcataaactaaagctatatatgaatgtgagaaattaacttttagattaactattcataaagagagaaatcagaagatgaacagccatgccattcctgattcggatttcatcagatgacagccagaggggtcaaggaactgcagctttgtaaggttgttaagttgaggaagcaccgtgcctgccaacgaatattttgtgataataaattttaaagtaaagaataagagggtattgatgctaatagcacaaaaagtttcttataaacaccaggtgcttcaattgcatccagtttgaagaatttggctgaacataagtacgtgctagccagatctctcacgagtcacaacagtgatatgcaaagtcaaattgatgtgtatacagtggctagtagcttcagtttcgcagcagtgacatgaaccgagtttaaaactataatatactcttagtcataacaacagcattggataattctgccatgttatgagccggctgatagtgaggcatgaaacatataattggtaccaggct

SEQ ID NO: 63017 - DNA, 1311 bp, Oryza sativa
gctgctcgacagcatcttgatgtggtaggcccgcggcggcctttccccttctcccctctagcgctggcgcgacgtccctctccgccacagctcagggagacggccgacgagctcggcggtgcggagaggaggagaacgacgagttcgccagctagggtttgagcaggggcgtcgacgagactctctctggcacggcggcagctgtctccggcgacgatcgccgccgcctcacacagggtgtggggtgtgggcatcgcacagagccacgaagcgcgaagccacgacccccacagtgcaccgcgccgttctccccacgccgcgcagcaacttttctgacgaagaacgcacgcccagttttggctacacgaacctcgttaggtcacgctctaatcccagctggtagagaatctcctacgtggcgtgggttggccaaatgccacgtgtgtgcactgtgaatgccctaacgaagatagtaagtgtcgacgggtgatacccgtagaccggatatagagggtattggggtacgttggtacaaggatctacgtagtacgacatcaagcaaacaaaagacaagaattatactggttcaggccccttgataggtaatagccctaatccagttgatgtgggattatatggtagaaaacacaggttataaagagaataagggaacttgtcggatccggcgagattgtagtcgagttgattcaactagctctcgatgacttggctcctcgtaagctccggcttcgtaggctgtggaggttatgttggctctgagattcgatgtctaaaccccccggggggggcccttttatatcgcagatgaggaggtctcctcatagaactcggaggtatcagaccttatacgatatgccaacgacccagttctgcccgagtaggattcttcccatctatagattccgtgaaaggtttccttagaatatacaggaaatatccgcctgtgcgtgggtatgccatatcgatatgtaacgtatatcgaagggcaaatggtatgcctaacccgtaaccctgacagtagcccccgacttctgcttaaattgaactcgtgcaaccatttgcgacttcgggtgtcgagactgttgtcattcccggtgcgagaaccgcggagatagaccgtagtcgagcacgccatttgaagcccaacggtcacaagcgaattttaaactgaagtccaaaaaaccggcgcgcgtaacgggaccagaaatttccggcgggcatctctctctgttccctggaatttgcaccgtcggtagtgcgcctatttaaaggaattttgggagtccatct

SEQ ID NO: 63018 - DNA, 7543 bp, Oryza sativa
ccctcgtacaacagttgcatcagcaaaaaagttgcatttgatacaaacccttgggcaatcatgccaccgtaggattatttgatacaggaactgcccggggctaaaataaggacataactaatggattaatctagaagaaacagtgtgaagaacaaatctcaaaccgttgactaatccataactacaaagtattatacaacatctccattaaaataggagcagcctccttggcaaacttgaagaccctgtccaccaacctcaactttaaagcagcgaaaactatgcgactccagctctgcaatgactttctccagaactaagttggatagcactgatattcatgttaaggaaacatcatgcatcactaaaagataggcataaatcccaacagaagaggagtcacatagcttagtgtcagtatgtggactctgtgacgaagctagaagtacaataaagatctaataagcattcttaaaccagaacaagggcattgaacgtagtaaaaatgcatatctaacaggactaaacatcaatgagtgaatatatatcagaagccagatatgaagaaattgagtatttaaattgtaaagaaatatgagaatctttagattgcaatatgtcatttatgttccgcttctctacactatgacatttcataacaatgtatactgatttgatccatagcaatttcagaatcattcttttgtagtcattattgtagttctgaaatttagcttgctaaattcagaaccactaaatgtccaaaaagaacaaaagttgttgaaagttgagttattagatataaaatcatatataggtggcgtggtattttcacaatagagaagtcatgaatgaaagtctgtaaaatgttaggcataaaaaggatactagttggtatcagggtcaaaacacaaccaccacctccagctcctgttaacttggagaccaagttgaatttcaatgttgtccgcagtacagtttctattgaagaatggctaacacccatgcactgaagcaaaccttggttcatctccatgagttccgccagcttttcctcctttgaggtgatagctatctcatcattagctgctaactcaacaatgcttgacacctcttcactaatggagttcactgcgttgaatacagaagccatagcatctgaatgcctggaggctctttcagagacaccagcaaccagagcctttgtgttcctaccaactcttgtatccgtaataagcattttcactgggttgctagatttaaggtttgtcaattcccctttcttgaatttgatcatgcttcctaacaatcaggaacagatttaattagtatatgcaaaaccaaggaaaacaaataacaagtaaagggaggtttagattcctggaaataactggaactagcacaacatgcatggctggtacctaaacttaacacggtaatgataatgaatctaaaataggatatgtcactttatttgatgactgtaacaatattatctgtatttgcatcatctcattcattcaactaagtgtcacttggatgtccaacagagccggcatctaaaagtactaaatcgaaagactttccatgaaaaagaggagagcataccgaaagtgctgacagcattgtcgatgccagaaggcttcccatggataatcttctccccctggaaagcccaccggttaactagctcaagatcatccttcccgaccaactcccaccccatgccctcgccgctgatgccgccgactgcagtaaccacgccggcagctgtcagcaacacccccgacatcgacacgcagaaggcggccgatgacccaagccccgaccccatgggcaggtccgagctcaccgtcaccttcccgggtctacacctacaatgtggcccaaagtcctccatacccattaggaggtttcatgattacgtcaaggattgctttcaggatagaggcagagcaagcgaaccaaccccaatatggaggtgtagaggaagaggaaggcagagagaccggcggagagccagatcttggcctcagggatctcgtgctcctccaagagcctggcaatggaggccagccggtccggggagcatggcctcgcctcccgtgcccccgccgcctcatctgtcagcagcacctcgcggaggcgcccgcacggccacgagaaggtgaggccaggatccttgaggtccagctccaacgtggcggccgcctcgtcgtcagcgaggggcatgaggcagagggagcagcgcgtgtagaggtcgatggcggcggcgacggcggctgagccatggacgacggcgtgctcgccggcaaggataatcttgcctggggcgcgggcggcgcaaacctccattagtgatctgacgaacccttcctgctctcatgtcgaatcgaattgatcaatgctaatgtatgctataagcttattaaattggaattcgatattaccgaagtttggtactccaagcaacaacccaaaggccgctgcttttaatcccctggatacagttcttctgactcactttgaaccctcgggttttatggcctgcacaatgcaaactacacggatgattatcgctatatatgctattggcaagtatcagccacaccacccataatgaaggctacactttcgtgtttttgtgcttcagcttttgaatatctgtgtcagtacttaaaagattgagatcacattatacatcagttgaatctatttatgaaatttaaacccctctacagagccagaaactgaaatatccaggggcctatatcatgaaacacaattaacagctgttccttcagtcaccagcctatccaagggcctatatcatcaaggatcaccccttcttctgtgatataataaaatgcatgttcttgaatatatatagtaccttcttatcacccttgattagtaaaaaaaaccattattgtgtttctgtttagtatatgcaccagaaagcatccataatacatagtggacagaagaagaatgtcaatttaatttctaggcagaaataagggataccaaaaaggaactcagagaaataaaactttgaggaaataatgcaaatgtgaagaatagcagtatataaatgataacatcaatttttaaccttttcgaaaagttcaaacactattcacagagtttttccaacatctcaattctcataattgcttgtggagtaggtaagggttttcaaaaagcaagcctggactcctggggcccctggactggttggttggttgcctacaatctgttacatcaaacagttcacactgcgataatctgaaaacgattatattctgggattgacatgtagggaaaaacattttgcgctaaataaactctgtgtgatgaacagaatgcaaatcctgaattacaatcttttggtgacagatagttaaggtttcttttttatgtggagaaaattgttgatggtgactatctgtatggtctatggggcaaataattgatgttgaaaaattctgaatgaatatgcatctatagcatggtttattgtttcaaactataattagtagtataagattgaaacaaataatatgcaaatagctgaagcgaacaaatcattcattctttatggatatgaaagagccaatcaatatatatgctatttcagctgcacaagtgtctagatttacaaagtttcatgttaaatgtccatcaaatgctgcattattatgtaaaaaaagactcttatgcatatgtttgcttccaagcaatttactttcagaataaatacaagctgtaaaaagttacccacgctggaagaaaaagaaccgagttcggtgtaataaatattgatatgaattcacgcgtcagggtcaggccactatatgtggtcgaattgtggcctctataccatcaccaaataaaatgcacatagctgaagcgacctaaaaatcacctgatagtgacgacaacgttggtgtggagactaactctgaaatgtgtgtgatctgcagcatattataggaaaagaaaaactacattaaagatcagtgggatctatttcttgaagctgaacccctctgcacaaacaaacaaatgtaaaacagaatgccgaaggtcaaacttgcgaaactcagagactgaaagccaattgaggacagcatacgattgctgaagttcagaaccagataaaaaatttgctcgcattcatttattcatatcagtgagtttgtggttgtcggttaggtgattgaggtagtcaacacacaatacagaccatggtgctgcttaaactgacagtattcaacattgcagtagttgataactctttcagcaagctagaatatatgccactgcaatttagttcaatttctgcacattgacagctccattttaaaacagatttgatcaggttgagttagcagcagattgtgaagcaagttctccacaaaataaaataacatatcatttcaccccacaaaaaaaaaaagcagaattcatatgaattcattagcgcagccaaatttaatagtgaagcttagggcattggtcccaagtccatattggagattaaagaaatgaagttgccgcgattgacatcgggcgagaggtatttgctgtcctctccaaccttcaatccaagattcatcaaatcagtcgaacttatcattgaaaaaagaaaaaaatccaatcacctgtcggcacggtcgcgatccactagtggcggcgacggggttaggcggaggccaccagtggagaaggcgagttgctttcgaggggaaggtggaggcgcgacggcggagcgcgcgcagctatgatggatcgaggcagcaggatgatggatcggcgcagcggcggtggaggtggggaagtgagggggccgcgacggcggggataggcggaagacggcgaggggcgggagggaggcggaggcggagggcggcgaggcgaggcgagaccgcaggatcggcggcagcggcggttgaggtgggggcagtgcgggagacggcggccggatcggcggaagtgggcgtcgattgtgcgagcgggaggggattggagtggccgttttgttttgtttgttttttttttactgtcgatgtgtcagttgagtgaaatttttgtgactgcacttcaattttttatcagcttctttttttttttatgcttacaatagattgttactagaacggaggagtactaataaacaaaaatctaaaacttttaaccttaaatttaagttgattttaaagttttttcatcgtagtttatttttcagatcgttaatagcacatatataaaagttttatttataaattattttttatttgtaaatatgcaatttggaataatccaagcgatggactccacagtcctctccacgccgctgcgcgtgaacacgtgcatctgcccctgcctccctggccttactgggttgaatcaatttctgcagtcagttttgtacagttctaaaaaaaaaaagggggcagttttgtagtattctcagatcagatcacgtgaagctgaacagagagggcttagccaggtcacaaaaataagaggaagcaatgttgaaattataagcacataataatttaatttattccataaataaatcatgacattgcagatgtaaactagattgaacgcatcattagatctacacatgtaaactaagcagtaaaacatgaacagatcaaatatgcgcaacatgtcgaacacgtaccgagatggcggaaagaccggttgctcgctaggaactactcgcggttgcgagcgtcgacgaaggcgcgaagcacgcgagcggagaggaagccgagccgtcacgaacgaacagggagcagtcgagcgaagcgcttcccaaaaaccttattgccgccttctcccggtgcaggacgtcgaaggcagaggttccggagacctgctctcccgatcgccggtgcatgccggcgagcgggatggagtagtctacgagcgacgcgcggtacagagtaggaggcaaaccctagattgatttcgcgtgtgatgtgtgaaggcggcggctcggtttatatagagataggtcgcctgatcagggcgcccgcgtaaaccgaaccggataagtcgcgcgtaacctatccggactccacgccgtttttcacgcaccggatttttcgaaatgtttccaaaacaaaacaaattcaaatttcccgcagcaaaacaaaactgcaaaaggaagctgcatctgcgcaagggtgaggagccaattttgcggaccattcgatgcgtacgtcgtgcacgtgcaccgcctgccctgccaggcgaggcgaggcgagcgagcgcgcgcgtgtgtttcccctcttttctccaccacacatgcttcaagtgactaggatggcatcctcccttttaaggaggtccccctctcgtaaaataagtaaggtgatactaaactccacatgcatgtcatcccatgaggtgggcttttgtgattttccaaagaattaatcttcgaatgggccttagcccatctattaattccaacaatcccccaccaaatctcaaaatcccactgagatttgccttttccaatgtactgtttatataccagcggttcgatggagaccgattaaggttgaacatccacctagatctccaagctacacttactcacaacttgaacaatggactacgccttgaattgtaagtcttgtgtaagcaagtttcactcagagtcttatctggtattagaccgtctatagactacccctcgggtggagcgtataagtcatactcctaggtcattagtaagcttcctagaagattcacccaaaatctccatagactgcgaccaacagtcaagcttacaaaagtgagttctttcaagaatgctctgcaggacaacatcttcgctaattaaagccaacagaactcattaaggcatagccaatctgccttgcagctcacgagagtacatgcatcttcacttagagagggtatagataagtactctcctctagtttactaatggtttgttcttcccaggttctaattcacgggatctccgatcacatagactgggttaccaccatagtataactcacatgggtctcaaacccatctccttcgatgcattatctatcatatttcgtgatagttccttcgtgaagggatctgccaggtttctagctgtttgcatgtaatccaacgttataactctggagtttctcaatttcctgacagacttcaatcatcttttcacatgtctagacaatttcatattatccttagaactattcactttgacaattaccgtttgattgtcacatttcataaggatagccggcaccggtttttcaacaataggcagatccattaatagatcacgcagccattctgcctcaacagtagcagtatttagtgccgtcagttttgcttccatggttgacctcgtcaaaatggtctgtttgcaagaccttcacgaaacagcaccaccacccagtgtgaagacatatccactagtggctttgatctcatccacatcagagatccagttagaatcactataaccctccaataccgcaggatacca

SEQ ID NO: 63019 - DNA, 1921 bp, Oryza sativa
gaaataacattaattattagaaatcaacaattataactttgcaaatgtagactgcatcatcgtaaacgtctataatgtttgaagaaagtttactgcattatattctttacacatctatctatatattatatactgaaaatccattaacatctgctatatactaaaagttcattgaactccctacaaacgctctcaaactgtcacatggcgttttacaaatgttcttaagacgccatgacgatctaataaattagaaaaaaaatcctaaaagttttgataaaaaaagaaaaaaaaccattgatattcctttaaataggtggacccaataatttaaccattagatctttaaaaaaatccagtacccccaaccccgccatatgtgggcacatatgtaagtacgtagtccttcaaccctctaactctcctcggagatcccactctcctgtcctattttcgagcccaacttttcctattttctaacaaacacataatgtataaataataataatcggatagttaatgatcatgactctcaaagttacatgcatttttctcaatttatttgcattttgttgtgttatttacaattaaatacataattcaagatccatttacccatatttactatataaaattttgataacgtagctgttctgactacaaatatttgagtctaaattccagattcaatcaccaccaaagagcttggaaccatgatacatactctgggcctaaactcaacggaggcggagttgcaagatattattaggttgtgttcattagatgggtttgggagctaatctctcccacacacgtaaaacgaagcagctcattacattagaatattattaattaaatattaattatttattttataaaatggatttatatgttttttaaagtaatttttctatagaaaacttttagaaaaaagcacggcttagttgtttggaaagcgtgcgcacgaaaaacaagggagctaagttgggaaaggagtgggaagaacacaaccttagtgaggtggacaccgatcgaagcactagcatcgactttccatgactttcttagcctaatagcacgctacatgattatgtgaagcacaaaggactgagatgagggccggagggagacgttccgcatctccgacaagtactagaaaacagtgtcatttctatcgctgaggagttcaaaattaaattcagaaaaatagcaatttgattaaaattctcattcaaaaatttagaaaacccaataaaactataaaaaatgtataacaagattccatgtagaatatgaaatatcaacagtccatataaaaatataagttataaatatctgaaatttggaataataaaataactattaaaaaatgagtccaaatacaacacgatacgaaattaagtataaattaaaatccttaaaaagaaaaatctagaataaaacaataatttgatttgaaacaaattcgaaattagaatcactcaatcactaaattcaaaatataacaaatatttttttaaagaagttatcattattgattcacatgcataatgaattgcatatatatatgaatcaattaaaaagagaattgacagggttgtaaaaaaacatttattgccaataaaagtttatcgagatttcttaaaaaaagatatacaatgaacaccgagttaaaaatagaaaacaccttactttaatttcatttcagtttattttgttataactgctttcagacaaatacacatctcgcgcgggctatcatcctagttatattgaaaaggtttgactcggcattgaagctgactggtgagttgaatatatggattgaaatggacaactccaagtggcatattatcttatgtttcttttatatatatatatatatacctctgttgattactatggtcatcaagcttgctgg

SEQ ID NO: 63020 - DNA, 1534 bp, Oryza sativa
atcgttcactaaaaaccggcacatatgtaataggtgcaagttcttaattagaaccagcacctattatctttgtgacgtgtccgggtcgagacaataggtgccggttcatagtaataggtgccggttctcattacgaaccggccctattacattttaacatggctcgggttatcggtgccgacttttcatgtaactgtgcggtacgagcgtgtatcactgccctctctacaaaatctgtagagctcgatgagatctacaactttgtagttggtaaccttttgatttaaggtcgtttgagtgtccgaaaatgtgttataatgtgtcgaatctatttgcgtaagtgaatatttaaaatttgtaaacagtctcggatcgagacaaagcatatataaaagttgtagatctagatgagatcttcaattttttagttgatgaaaatttcatttgtgctcatctatggtgttaaatatggattataagttaggacaacaatgtctcaaaagattagcatttgtttccaagacaacaaattttcgtaggtgagatggtaaggaggctttagatggagttcgaaattttgagtttgaaacttgcttgaggcataattatgaatatgggttgaaaaaatcatgggatttctgggaagtgaagtgtgaccgtatagatgctaaataaattgcaaatatttttttcgggttttaatttgtagcacctacataaatttcaaatgggtgcacccctataatttgtcggttataaatttagaatcggcacctatagtatcacataggtttgtaattagaaccgatacctatagtcaccaataaccgaggttattggtgccgaccaatatgtgtcggacctaaaaccggcaccaattggaccatggttgtatgtagtagtgattataggcaagattcagtaattaattacatatatatatatataatagtagtgattatatatagcctaattgttttctggaccactgttcttgtctatcttgaaccactgatcacctaaatctttagaacttctagtgtttccataagactaccttaaatttaaaaattaaattaaacctcaaataaattgtttgacatatagatattttgcccacggcaccgagatggcatagaaggtaacattgcaacatgaatgctcactgttggctgtgtagaaacagtattttgccacgctacgacggttggcgtggtgaaatctttgccacatatactatggttttcaaccagcaacaattttatatatatttccaataccattgaggtatgctgtgacctaaattttgtgtagaacttttagagcatttcatacacggcgatgttatacttcagttaatgctagccagcctgattttactgtggaaatgacagcaaaccaggcgctgcttttttactgcctctggtagttcatgtcactgtatgatatttaagtttatttattatatgtgatagattgtagggacaatcatcatatatagccaacttgttgcaacaaaacattagttatgcaa

SEQ ID NO: 63021 - DNA, 1953 bp, Oryza sativa
gtgatcttaagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcagttttttttactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaacttgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctactgttcgtaaccatcaacgattggcctgcacttagcaacctatccggacagtccaacaaggggtacaaggcttgca

SEQ ID NO: 63022 - DNA, 2936 bp, Oryza sativa
ttcctgcagcccataaaatgattcctagtctaatgaatctggacagattcctgctcagattctttggactagaaaacatcccatccaataataggttggtttttttgggacggagggagtataatttgcatgattttgtatttacttttacatttttaatatatagtttacagtacaatttcatttgacattttaggtcagagtagggctgcagcgttagctgccgtactgctatatccgcctctcaatgcaccaacgaagatacagtaggacttttattactaccggagcatgaccttttctaattaaggaggctgaattatcgagcgcgtccactctcctaattatccgtgtgatttgtaaaaaatattgatttattcatcctaattttctaaaaaaggaatatcaacttaccaacttctaattaatatttaatttatttttatccatatcatgcaccagaattttcaaacggatcctgatgggagtgcaacaacaaaaagttcatatataaatgaaaataacaaacgaaaaataatcaaaattaacataaccacataaaaacaatatgtcaatgctaatcctattaattaatagtactattaagaaaacagttgtagaatgtcttttataggtgaaaagttttcaaatataataatactataaattgtagttaatgtaattgcagtttaacttgaatgcaatcataatgtaaataggatatagttacgttgtgacttgaaaggatatgccatggcataatggtggaggcacatgcctgggatgcccacatatcgtggtttgaaattagaccacgtagggtttattaggtttatgtttcgctgcacacaaatctcaaagctaatcctgtgccaaaatatccaaagttttctcccttgtatagcaaatcccttaattgaataggctagatcagtcgatctaatgcaaatatttccaagataaccgtctcaaatgggcagcttgccatccatgatcgatgttatttcctcgttttgtctttgtgctgtagtagagtgacaaataacgaaaccaatacattcccttcaaaatttaaatgacgtccatagaaataatatgcgtccggccgaggcaaacgttcgtgttttatctctcgacttaacaaattataacttgattactatacgatgacggaaccaaaaattatcaaagtctaaggctgtgttcgataccaggagttctcaactccccctctcgttttccgcgcgcaggcttttcaaattactaaacggtatgcttttaaaaatatatatatgaaaattacttaaaaaatcatattaatctatttttataaaaaaattagataatacttaattaatcacgtactatggaccgctccgttttccgtgctcactttggaactggctagaacgaatgcagccttaggcagccctaggcttgcctccggcgctagacgtatatgcaactcttgcttagtcatatattaaagcataattatgtctattataactgggtatacattgttactattttgcagtttactaaattaagatggttatggctatcgtgttacatataaaatattaatacaatctttatatggaaactataccgttatctgcaacgtaacagtccgtaaggtatgtggggttaattatatatttatcacatcctgctggtgtcttattaatatatctcacgaaagtactcacctttctgcaatccatgcatctttttccgacaaacagtttaaaaagatgagcggacaaatcaagccagcaatctattggtcgtttcagattagacaaatggtgataatatatcagtaagtggaagatctacttttcatcatcagtaatataatatatcatcattaacagcaatatattagataacaccgcacttgacttctattgactttggtggatttcagctagatctccaacaaaatcctcttttggaaaacattcagctgtccctctagatgtatacatgcctatttttactagtttattgtactgtttgcatttcctagaacatttgaaagtgccacagttttcattattacaaggacgagattataaagtcaatatagtacgtgtggaattatctatttattttaacttgataatatatggccagtttacttaatgtcagttttaaattttataccaaagttgctacaaataaaattactgaggttgctcaaaacgtatttagtccaactcaaacaacttttatacctgggagaaatatcatggaaggacttgttatattacatacatgaaatgcatcgaaaaaagaagagtggtgtgatttttaagattgattttgagaaagcgtatgataaaataaaatggtcatttgtacaacaaacattgaggatgaaaggtttttcacataaatggtatgaatggatagcttcttttatctaaggtggacatgttgcgataaaagtaaatgaccaagtgggctctaatttttaaacatataagggtctaaagcaaggagatccaatgtccccagtcctttttaatatagttgttgatatgctagctatattaattagtggggtcgttccacatttggtggacgatggtctatccattttacaatatgcaaacgatactcttatttttcttgagcatgacttagagaaggcgaagaatatgaagttgttattatcagcttttgaaaagctccctggcctaaagattaatttttacaaaagtgaattattttgctttgatcaagcacaagaatgccaggaactattctaacatttttggttgccaatagggaattttccatcagaaaacttggaattcctatgctttttagaaaacttagtaacaatgattagaaaacagttgagcaaagaattgaaaaaaaaaaacttagtagttggaaacgtaaacatatgtttgtacggggaa

SEQ ID NO: 63023 - DNA, 1175 bp, Oryza sativa
tatccgaatcttccctctccatttcatcaacaattataccgactctcttcccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccttaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctctttcgttttttttggatttttagtgaatataatgaaatttcacagaggagggactgggctttatagggggagaggcaaaaatcgccctcccccagggcggcaagggggccccctgcaaaattccatgccccctcgccgcccatttgcaggccgccccccccacagtacaaaatcgccctagcggagggcggcaaggggggccgcctgcaaaatttcatgccccccctcgccgcccatttgcaggcggccccccgcacaatataaaatcgcccttaccgatgg

SEQ ID NO: 63024 - DNA, 6221 bp, Oryza sativa
tgacaaacagttttctttaatgtcaattttagcaaagtacttttttatactaatatgtaaaggtgtggatgtagagaaccaaccttccatagtaaggaatcttggcctttgtagcattctgttttaactgatcaaaggcaccagctctgaatgtatcagcacaaaccaatgaaggtttaaagcccttcagctgatgatagtgagcatatttggtacaggtagtggttttcccagaacctacagcaacataacattatgaagtgagcagcgaacattaaatttatattgcaacccaagaaagaggcagacaatagattattctaaggagcaggtgcaatagaaggcaaaacaaaactagcaggaacttaaaggaggaaatggcactaatccttaagacaatgggtctagcatctacaaccagcagggtaccacaaatttccctgagatgtgacctctatctgacaatgtaatactagaatctgaagtttgttgacttcaagaattaattaattcacaagaaggggaaaaaagattgagaatcgtccgttgtcgtctggctatggatacttttccaacatggagaaaagtaatcatcatcagaaagaaaaaataactttacatagttttactcaccaaaggcctaataaattcagcagaattcaattagaggagttacaaacaaacctatcagcagatagctactagtttataacactaaaacctagcaggtgctaggtaaaattaaaacgggaggccctgttctaatcttcaactccaaacaacaaacaactttctcgttttccgttagcatatttcctaaactgctaaatggtgttttttgaaaaaaaaaatatacgtagaagtttctttaaaaataaatcatttttccaagtttagctaatacttaatcaatcatatggtaatgagttttattatttcacgtgcgccgaaaatcccaacagacgaacgggcctaccttgcaagccgacgaacatgaccacactgggcttccccttggtgggggtgaaggacggcttccccggatcaagcatgttgcagagctccgcgaagacggcctacatacaagacgatatatatcagcaaaattcgttcaattgccagctgattttgacgagggagcctagcttatagctagctcatcgatggatcgatggatggatctctgcatatctgactgacctgctgtatgatgcggcgcttgttggtgccggcggggagggcgtcaaggttgacggccctccggatgttggcgcgcatgtcggagaccatcctgatctgcacgtcggactgcaggagcgcgcgcgcgatctcgtggaggcagtcggcgaacgccttgtcgtcgatcaccgtcgcgttgctcatctgcgccagcgcgcgggagatgctcccgcccagctgcgcgagcaccatctccaccgatcgatcggcgctccggcgtgcggcgatcttcggcggcgggatggataacgtgtcgtgtcgtgctcgtgctcgtggcgcggcggctgcccagatttgtggagtgtttatctccgtgatcgttattagtatagcttatatatatatggacagggtttggtgtaaatcggaatccggatatgaatcgaagaggtgttacaaaaactgggctgaaaattgaaacttaggcggaatccatctatcgatctatccgtctgtctctttctgggggcgatttttcgtcttcgtccgacttccgcgctcgcgtagatcgctcacgtttccaagtttccgtcgtggcgtttgtcccgtccggttcgatcctttgccacacgcccacgcacacccacacgtgccaaggcttgacaggtaaggggcccgtgttgatgtcttctgtacacttgtgtgcgtccctcggaccttttggtcctgtttggggagcttgtcccagctgcagctttttctaaaagctgtttctgctagaagctgccccaaacagtccacagcttctgagaatctgtagttacagattctaaaaaaatgaactaagaagccagaagctggagaagctgggtttcagagcttttccagattctcagaagctggttaccaaacagttacttctcagaatctaaagctcccccaactaggccctttgtttggtccttgtccatcctactaaatgggccttcatcgtatatatatggtccaggctagggaaataagtttagtttagttccctcatcttgacaccaagtttaaaattcgtcaccgcatcgcaatatcaggtatagcccgtcttcaaactcataaaaccgtgtcaactttcgtccaactcctaaagcagtatgtctctcggtttcatctaacatagagctttgactcccgtcagctgtgttgagtcggtgtgggacccatgcggaccccacatgttagcaacaactctttcttcatccactctcccctatctcccctctcttctcatcatcagcaggtcaggaggtaggccgcaaacagtgtggatagaggtagcgatcgagaaggtgaagggtggcccgacacgacgagagagctctgtgtgggtctcacctagtcagtgttagccatgagatccaccaacttcgtgtggccaatggggagaggggcaggcgtcggcgagtagaacggcggcctgacacgacaagagagctttgtgtcggcctcgcccaattgacgtcagtcgcaagctcctccaactctgtgcaattaatggggagaagggcagccgctggtgggcctcctcgcctcccaacggcgatagccggccaaccaccaaatctaagcgttaggcggcaacgccaatgtgaagaagtcgaccaaaggtgacccgactgctcgcgaggctatgatggcacgtcgtgaccttcggcggtgacagcctcggcgggatccccatcccccctcctcctcctcctccactgatgctggcgccctccatccgcgcctgcacgatcatcccgttcaactacacctcccacccactctgtctcatccctagccactgagacaaggggcaaagaaagggtaaagagaaagagagagagagagagagagagagaatgagaggatgtgtcactaatatgtgggatccaccaatttttattttatattttgtactgaattgttctgacatatggattctatgcagattaagctgccacgtcagccgaaactgggcactataatgtcctatgatcttaggtacatcgagtttacaagtccggaacatgctatactatgtttttttacgctgatacggagtactttgtaagtttgtattgttgtttagggatgaatttcaatctccgagtcaagatgagagacctaaagcggacttattgcccagcgttgggtgctcatcgagacgcctgtgcaaactggtcaggaataagttcacttcatgaccctcaaaagtgatcggattctaattcatgaccccaaaccgcaaaaccagatatcttgacccctaaactttgaaatcccgggcaacccgactcccatggcagttttgcgagcggttttcactgacgtggcagttggaccctgtcaacatcgctgacgtgtcgtttgaagatgggtcaacaaagtcgagtcaccgtatgcgttacacttccatgtgggcccggttttcgctgagttggatctggtaggtatatccccgcccagtgtaaatcccgggtgtattgacgagcgaaaccctagagcgcgctgtgagtcgtgaggagaaggcgaagaagggcgacgcggggggtggcgcaacggtggagggcgacgcagcgggcagagcggcggtggtggccagctcggtcgtcgtttctggcgggcaaagctggatctgtgctcgagctgaggttagttaatcctcattgaaccgtcgtcttcccgggtggattagggttagttgtgtcgatttgggtgctgatttgaaaatgcggtgcatgtatactattgttgttggatttggaggaggcttagcatattttaataagggaatcagtagatcaggtggatttgggcatactatattgggtggttgctttagatcaggtggatttgggcatattatattgggtggttgctttggatctgcggaatggtgatttgaatagcatggttgacactatttttatgttgcaaattgcatgtagggtttgtgaggagtatttggcatcatggacccattagacactcttccagtgagatttcattacaatggggagtttgttttgcataggagggataagtcctattgcggtggtagtgaagcaatgtcctacttagagagagacaaggtgtcacttccagaaattattgggcatttgcgggatcataccaaggttatggaaaggacaatgctgcattggttgttcccaggcaaagatctcaattctggcttgagagttcttgtggatgacagagtgtgcagctatatgtcagattgcatagttgaaggtggggtggctgaagtgtatgtggtggaaccaattgtagttgatttgtcagaagatgaagaggatagtgactatgaggttgagatggatgagggtgctgaaacagattctgaaggagaggatgatagtggggatgatgttgaagttttcaaggataaatatgtgcaggagcaagctgggaagggcaaaataaaggaagggggtgatgcatcttgttaggacagtgctgggaggtgctgatgcagctgagagggcagtggtggaaggtggtgatgcagctgaaagggtagtggttgaaggtggtgaacaagctgataagagaatggtgttgtacaccagagacacttagccaatttgttatatgcaggaggaggaataccacactgaaactgatagtgactacatgccaggagatgaatcaccatcagatgatgaggaagaggctgcaaacatacataaggagtacaagaaggtgaagaagaagatcaagactggtttcattttagggattgatggtgctggtttagaggggtcacagagcaacccaaatgtacatgctgatcaaggaaaaagtggcaatgaaacaccatatgaagagagtgactcaaaaaggtcaatagatgagcttgaaagtgatggggaggtgactactagaagtagcaagtttccaaggtacaagaagaagcaaggtgtgcctgtgtttgaacttggaatgaaatttagctctaagaagttgttcaggaaggcagtgactgcttatgccctaagtgagaggaaggtaatcaacttcatcaagagtgatcctagaagggttagggctaaatgtgactggccaagctgcccatgggtgtgtcttttgtccaagaccacaaggtctgatagctggtagattgctaccttagacaatttgcatgcatgtccccctagaagagataataagctggtgacctcaagaagaatagctgagaagtatgagaagttcatactgtccaacccttcctggaacttggcccatatgaaagcaacagttcaggaggaaatgtttgctgatgcttcattttccaagttgaagagagccaagaaacttgtgatgctgaaggctatggatgccagaaaagggcaatatcaaaaattgtacaactatcagcaagagttgcttagaagcaatcctgggagtactgttgtgataacaacttggtcctttcaaacactccacagagttttgtgcagagcaaaaaaaaggaagaggttagctggtgctaccactagtgctgtcagcctaacaaacaccacaagtgctactaagcagaaggttagctcattttcattacaacttaatttcatttgcatatccatttcctaacttaagcatttccactttattttgctgtgttgtttcaggggcaacaatccaatattgtcagcatgaatgctaaggcaaagttggcaacacaggcaggtggttcggccacagtcaacctccaagcaattgtgccatactccaagggttctgcatcagcttcaattcaggttacatctgggaaggcttgtgtgtcagtctcagctcaagaaccagcaaagaagacaaaaattggtggtcctcctccacccaagaaggccaagacacctggatctattctcattcaaccaccatgggaatctgacaagctttgaagcaagctttgtgtactgctatgcactgccatgccttggctaattattcagatgtaatgccagactcataggcttactatt

SEQ ID NO: 63025 - DNA, 7474 bp, Oryza sativa
ttcctgcagccccctaaagcaaaagataaagatactctacatgagcttaaccatgttcttcaaattgaacttaatctaaactataatgtaactcgtgtattgtaaaatactatctcaaaagaacgaatgcaagattactgtcattactattcgtctccccttgagttgaacatcaaattcaaatacaccaaattcctttccttccacaaattttgagttcttcatgaacatattaatagtacaagtcatatatgtgcgtgcaaatgcacatgttgacagtaatacaacttcttgtgtatcaattctaacaactaaacatgttgcatctaggccaaaattgcttcaaatacaaatgaccaatttactcaaaataatttgcatacatccataaaaacaatacttcatttgtaaattcatttatacatagaagatggacataacattatcaatcaaattaactatagacactgcataggtacatagtattttgatagataattttggtgcagggcatattggcatatagacttcttgtctatatattcgcaaattcgatgacattgtatctacttggacacaattaatataaattagttgtagcttatcttctctgatagtcatgcactaataaatatctctaagtcaataatatactctcttcatgatgagtgtatacatttattctatacggagaatatataattgtgcgttctgcaaatgtggcgtcaattagacaaagagaagatatatgaataattttattactcatttgcccaataaatgtatttgctacatgcaactacttacatgatgtccttttatgcaactttctaccggtttacttcttgtaaataaagtgcacaaaacgagtacaaaatagtaaagaatggttttctatacacaccttttattacaatcctagcaattaacatgattttctaatattcaaaggtatgtgtaatttacagaactactaacccacagaacaatcaattatcccaaacaaacaattgccaggaaataaaccataaaatattatgcttccaaaaggggtgctaaaacaaaggtttcacaagttcatggaagctcttttgcctaaaaacaatgtttctaggattaattatggttattcaagaaactaactaaatagttaaagcaaatacatagaaatacgggactaaggaataaatccttaattcttctctatttggcgtaaacccaattcatgaaggttcaaagtataaatggcgaatgtatatttcccttagtttctaatgtctcataggacttttccgcataatttccgagttccgcataatgccttggaaaccaaggacttttgaaataaaataccattttcggaccaaaatcacggttcgtgcccgactccttttaataggccaatttctacttggcccacctccttatactggctagctttaaaacctggccagcccatctcatatgtcgcctaatgggctattacgaccttcccccacaagaagtgggtgaggtatgatccaattgccattcttcaatggagacaatggatggaaccaatggcaaacgtgctagtgagccctcggtagagatggacgtctatggaaagttgccatggtcagaggcgaagcggcgatgcaacatctagtagcaccgacactggcattcgttggcatcaggccgtgtccggcgtccgacaatcatagctccatgttacgtgtcgatgaaactcagctcggcatataggccggcatggcggacggctatcgacggcgggtgctcacggcggcttcgaccctcgtcccggccgcgtgcggtagcgtgggaggcaagccgtgcgtactggcggcgaggggaggcgggcgtgctccttggcgtcactacgggcggcgaccgtcaattgcgttgtggatggcctcgaaaggccgtcgagtcggcatttcagatggcggatcgacgagggaaagtctctggattgattcggcaaccgttgacaaaggggaagacgtcatgcggtggcgtccgggtgtcgctacgtgcaggcagcggcggtggcgcctgcaggtgccgatgactcggatttgttaccatctacttcatacagatagcaatatgatggattattaacatacaagtcacaaccgacagagtatcccaagcgcgctgatccataagatcagcgatgacgagtgtgttaatatattcatagattaatgactatgttagccagaaagacgacaacttctaggtggtgtcgtgtgttactgagtgttaggtgtcgtcgttcgggacaacactccgtcgttcaattcaacggattatgtatgtgcaccttcctgtgtgcatggtaagcgcattcgggcgcgtggtgccaaacttcgtggtcggcgatataacaagggaagagtcggcgcaaatgccggataaatacatctattcatgcgagaaaataaaacgactagaggcatgatctagcatattactctcgctactgcaaagtattagaatagataaaaccgatactgtcgaaacatgatttcggcaataataaaagggggtagcgcacgagacctaaaagtggatggatgcggagacaaaggatttagacaggttcaggccctctcaatgagaggtaataccctactcctgtttggggatttgaatccgccgggtgtagtatagatctgacgatcaggttgtctcatcatgcccctagaggggctccctgccctccttatataggttggggggcagggttacaagatagaaaccttaaccaatacggtatcggtttcctaaatctactttacaatcttatcaaaccaggactttaggctgttccataatatacagggaaacgtaatacccaagtcatgatctgttacatatttcatatatataagttatcccctataactagtcggataaccatgccgtgtgggtatggggtacccataatctccacagtagcccctgagaccttcacagtcggaaagataatcttctctcgaactagattactccaaagccgagtgcttcaatcatcttcgccatgatctcccgagtactttttccaagtcagaagactgtggagggctgaaaaaataaagtcagatgcatcgactagatgcacctaataggtgtaacccccgactatgtggttaattgaacaaaccaaacatatagtcaaggaataagtcatccaattaaccgagtggtttttgataattatagtcaaccaagtgacttgataccaatatatagcatatgcggtgtgaatccccgaataatatgatccaagtgatataccgactgcttggcaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaacatatgccttcgacaccctttaaaggatgacgcatataacatgctcccgagtaataaatcttccgggtaatatagaccaagcgtagctcatatgaatagcttctgatctgagtggttatcccttatgggatactccaaaatagatgtaacaattgaatcccgactggcgcaagtattcggttgataacctttacggggaataataattggtccagtctttgagcatagaagatagactcatgactatgaatccatgtggaatgtatccggaacaagtccaaattggagatataatcctcacgcttgagttgatgagcccctgagcatatagcttgtccttctgtcatagtcaaaattgtctattggcaatagcatggaggcgaagaaacagtcggtgatgacaaaagcaaaccgacgatgaagacgtagacgcacatcaacagtgatggcgaaatccaccaatcatgaagatgaagaaaatagttgacgacgacaaacgcaaccgacatgatgaagatgacgatgtcggtgatccagccaatagcagtgtagcaaccaatgataatgacaaagacgctcatcagcatttgcatagtaggtcaaccgtcaaggtgaaataataagtcggcgaaaacataatcatccattagcaacagcagagatgtcagggtcgatgaagcagaggtgctggtgatgatgtcagtgacaataatccatcaaattaatgttatagctgttgtagatgcttcacttgaggagagttgatgttgttgcccaactcatctaaaccgaaatatttgaagttgttgaagtagaatgtctgctccgaagcaaagatgaagataatgactcctggagttgactcggggttgatgaattgattttgtcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgtccaagtagaaatcctgaatattggagagcctcttgttgtagtaaaataacatggcatcgcatgccgagatgtcgagattcacaacaacgtcatggttggtgatgtagcaaaacttgtgaagtagcagcaatagagtttgctggtaccgaagataataaagatgaagtcgctccaccatgatgacaaagttgtgttgccgtgatgaagtgaacacgagtcggcggcaacagaagcaaaccggtagtgaagacgcgcagttgtgaagataaaagcaccagtcggcggcggcataacacgagtcggcggcggaagacgatgatgtccatcagtagtggtagctgtataaaccagatgtagaggcgagggcactagttagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcagatgcggcggccggtcggtgaagacgtagacgcccaacaacggcagcatagtaggccagccgtgcaggcggaaacaccagtcggcggcggtcaaagcggccggtcggtgaagacatagacgcccaacaacggcagcataatatgccagccgtgcaggcggaaacaccagtcggcggcggcgaaggcaagccagtcggtgaagacgtagacgcccaacaacagcggcataataggccagccgtgcaggcggaaacaccagtcggcggcggcgaaggcaagccggtcggtgaagacgtggacgcccaacaacagcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataataggccagccgtgcaggcggaaacaccagtcggcggcgacgaaggcaagccggtggtgatgttctgactgatccattcctggagcgtaagagataagcttaaagccatgaatcccttttatgcatatctggatctagatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcatcattaatggaacaaagtttcacggattagaatttactactcgggtacttttgcaattattaagagcagaaaataaatttatctcatctctatgcttttgatttattccgaataatacttagcaccttgcgttactcggtccatccaacgagcccccgagtgctaggaatcggcccaaaggcaaccatccattggcaaaccaaacggaaagcataggaagatagaactccataactcgataggtacttttgtactcaaattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcagcggcgacgaaggcggtcgacggtgaaagcgaagatgcccactaatggcggcataataggtcagccgtgtaggcggaggcaccactcggcggcgacggaggcaggccagcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccaatcggcggcgatggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcataatagaccagccgtgtaggcggaggcaccactcggcggcgacggaggcaggccggcggtgaagtcgtagacgcccaacagcggcggcataatagaccagccgtgtaggcggaggcaccactcggcggcgacggaggcaggccggcggtgaag

SEQ ID NO: 63026 - DNA, 11825 bp, Oryza sativa
aaggcggtaccccctggtactagacccagtggtttgcaacatcaagctccgaagatccctgatcgatggtggcactgcactcaatatccttttcgccaagactctggacgacatgcaaatccctcgcacggaattgaagccaagtaatgcgcccttccacggagtcatccccgggctgtcttctactccactcggctagattactctgtcggttactttcggcactcgagagaactttcgcacagagaatatttgcttcgaagttgctgattttgagacagcgtaccatgccatactcggacgcccggcgttagccaagttcatggctgtcccgcactacacctacatgatgatgaaaatgccaggtccccgaggagtcatatccctgcggagtgacatcaagcaagctgtcacttgcgacaaggaaagctgcgagatagcccagacccgcgagattgcgctcgctcgagaagaaatccgactggctgcgtccactgcaaccgaaggagaagtgtctgcaaccaagatgtcaaaaggcggagaaggcgacgccaagaccgagaagattcctctagatccctctgaccctactaagactgctgtaataggcgctaagttagattataaataggaaagcgtgctcatcacctttcttcaaaataataaagatatctttgcgtggaaaccatctgatatgcctggtattcctagagaggtgattgagcactctttacatgttaaggaagatgctaaacctatcgagcaacgactccgccatttcgcacaggataggaaggatgcgatcaaggaggaattgaccaagctgttagcagcaggcttcatcaaggaagtcctacatcctgactggctggccaatccagtcctggttcggaagaagacggggcaatggcgcatgtgtgttgattacaccgacctcaataaatcttgtcccaaagatccctttgggttacctcgcattgaccaggtagttgattcaacggctggctgcgagttactcagttttttggattgctactcaggatatcatcagatccgactaaaggagtccgactgcttgaagacttcgttcatcacgcccttcggggcctactgctacatcgccatgccttttggattaaagaatgcaggagcaacttatcaacgcatgatacagagatgcttttcaactcagattggtcgcaacgttgaagcttatgttgatgatgtagttgtcaagaccaagcagaaggatgatttgattacggatctagaagagacctttgcgagcatccgcgctttcaggatgaaattaaaccctgaaaagtgcatcttcggagtacagttagggaagctacttggctttatggtgtcccatagaggcatacgagccaacccggagaaaatcaacgccatcatcaacatgaaaccatcgagttcccagaaagatgttcaaacgttaactggatgtatggcggcgttcactcgatttgtctcacgactcggcgagcgggggatgccctttttcaagttgttaaagaaaaccgacaacttccagtggggacctgaagcacaaaaagcctttgaaaacttcaagaaacttctcactactccaccagtcttagcttcaccacatccgcaagagccgttgttgttatacgtgtcggcgacttccaaggttgtgagcacggtcctggttgtcgagtgtgaggaagaaggccatcttcaaaaagtccaacgaccaatctatttcgtcaacgaggttttggccgactccaagacaagatatcctcaggttcaaaagttgttatatggtgttttgattaccgttaggaaattatctcactattttcaagatcactcgttacggtggttacatcgtttccactcggggatatacttcaaaaccacgaagcatatgggcggatcacaaagtgggccttagagttgatgtctttggatctatccttcaagccgtgaacttcgatcaagtcccaagctttagcagacttcgttgccgagtggaccaagtgccaagaagacacgcctgcagagaagatcgagtattggactatgcatttttatgggtcaaagaggctttcaggcaccagagcgggggttgttctaatctccccgactggagagaggttgagctacatattgtggatacatttttctgcgtcccataacgtggcggaatatgaggcgctacttcacggattaaggattgcgatctccttgggaattcggcgtctgatagtttgtggagattctcagttggttgttaatcaagtcatgaaagagtggtcctgccttgatgataatatgaccgcctatcggcaggaggtacgcaagttagaagataaatttgatggccttgagctgacccatgttcttcgacataataatgaggcagccgacagactggctaattttggttcaaaacgagaagcagctccttccgacgtgttgttgaacatttttatgaaccaactgtaccgaggaaagaaatagtcgaggccacggacactcaagaagtaagcatgattgaagccgactggagagagcccctcattaaatttttaaccaagcaagaactccctccagataaaaacgaagccgagcgaatctccaggcgcagcaaactttatggcatacacaaggccgaattgtacaagaaaagtccatcggggattctgcaacgctatgtgtctttggaggaaggaaggcaattgctaagagatatacattcaggcatctatggcaatcacgctgccacacgaaccattgttagcaaggcctatcggcagggttttttctggcccaccgctgtatctgatgctgacataattgtgcgaacatgtgagggttatcaatttttcacccgacagactcatctaccggctcaggagttgcaaaccatcccgttatcttggtcgttcgcggtttgggggctcgacatggttggcccattcaaaaaagctatcggtggttatactcatctctttgtagctgttgataaattctccaagtggatcgaagccaaaccagtcgtcacaatcacggcagacaaggctatagatttttttcatcaacattgtgcactggtttggggtacctaatcggatcatcactaataacggcactcaattcaccggcggagtatttaaagattcctttgaagacttcggcatcaaaatttgttatgcctccgtagcgcatcccatgagcaatggacaagtcgaacgcgccaatggtatggtactttaaggaataaaagtacgagttttcgaccaatggtatggacaagtctttgcgatttcgtaacttcaaggaggagcgctacggagaagaccgagtggatgatctcaaccgactggaagaagcccgtgaagcagccttaatccagtcggctcggtatttacaagggatacgacgttatcacaatcgcaacgttctttcacgagctttcttagtcggagacctggttttgaggaaaattcaaactacacgagatcggcataagctatctcccttatgggaaggaccattcataatttctgaagttactcggccagattcttatcgactcatgtgtgaagacggtactcatgttgacaactcttggaatattgagcatcttcgtcgtttttatgcttaggcattacttttgtatcttcctctttgactactaacatcaagttgttccttgagttaccagtcgggggctactataataataatggagtgtgatttttatcaattcaatttgcttacttgatttatcattgtcttgtttgattttttagcttagccaatgaggactgaaagtttttaacaacttttgcgggttctaggctcaataaggtttgataaaaacttttaagaaatctagagctgagtttaaatcatcaagcacagcataaattcatcagtattgtacaaattgtgcctccatcatcatcatcattatcatcagaatacacaatcaatcagattcagttttttaatcattagagttatcagacccagtcggcttaagatcgttgtcctgtaacctctcaactacatcagcggctatcttgtcggcagctttttgcgcatcactgatgaggtcaagggcggcttcctcacttgtcccgtctgcgaagccgtcaacaacatcaatatcaatcttcgggtacaaggacttggtcatcgccaactctagacttgcccccatacttccagcttctttgatgttcttaaaatatgtatccggagcagttctaagcttgtcgaagatttcgacagcatcaattgaactcggaccattgttattgaaaaacatggcctggacgagtggcgtagcggcattggcgacttcatctctagctccttcaagcttcttgattttgttaaccaagatgtcgaattgagcctgggatttgattttgcgatctgtacaaataaattcacatcaatgactgggcatgaagatgagagtggtttttgaagtttcagctacaagtaccttcgacatctttcagagccgagtccctctgttttgccagttcgaccttgtctttctccagagcctggattcgcctttctagcttggatatcttggcagctttcactatattgctttccactggttaatcgcacatgaatagcagcatgaaacaaatcagataaggatgagagttaccttttgatgaaccacttagctcaaagttggagtcttggagctcggcgatccggtctctaaggtcatgctcagtcttcctagcaagctccttggcttcacgcagttgatctctggttgcttccagggttccaaggtggggaaccaatttctcgaggattgcagtttttgcctcatttctaagatggattctctgcattacaagtgcgtctttattcagtaaagtggccgacaggatgattgaagctgtatgtaaagagacttacatttacaagacgggtagcttgtccaagtgtctttttcagcagacacacttcctcgtcttccttctgtttatttatcacgattccctgtggatgcatttcatcgtctcaccacttgactaatatgggtgggcgagaatcttcagccgatcgtatccggaggacctcttctttgtcaccaatcattgggccttatatattcatgaataatggtgagacaattgaagaaagtttgttggatcaaaacggatttggaggacttgtttacctgttatgatttccggtcggggatgagcaggtccttttatcctaacaggagagttggatcccgggtcaacaccagcgtccttcctgggagggctgttagcttgagtttctacttctgggatgtccttattttgttctgtacccgactggtctctagtcgggggctcctgttcaacattggcttcagcttcggccaactggtttccagtcgggggctcgttgctggcctctacattatcggttgctggttgattatcactcgggcgaccttcggcggtcggcctggtttctgttgaaggactagtctccgcgccattcggctcagggtcttttccggaaggatctatatcagatggcttcctgcaagtttgagatatgctatcagtactacttcaatagtgagtgactggcgatacaaaggaaattgctaaacgacttgtacctagatgatttcctgatttttggtatgggacgactggatgtcttcttctttggattggcttgccttggctgtttttcggtcacccctttgttgccggcatcatcaccttcatcatcgctcaagaccaatttcctcttacgggagtctgactggttagtcgatttcgaggtgtttggttgagtatcggaccgaattttttgtactccactcgcctgactagtctgccgacggggcgagcgatgttgagcaattggaggatccgacttcatcaaggcaaattcctgggcatgatattccaagctttcaattaactttgcagaagataaaagcatgcttttgagaagggctgagatgtttgatacatacccgcggaggagggttgaaggcgttgtatggcaccactggcaacaagtgcgaataactgaccacgatagcattcgagaagattttgtacattctctccttcatgactttaaactcaagagaatctagatcttcacggttagggtcatgcttgccgtcaaactcaaaggttgtgcgggatctctctttaattggcgctagtcggcttttaataaaatgccgggtgatctgctctccttgcagaccttgctctttgagcttcagcatgcgatcgatcagggcaagtgcttgggccacctcatctcccatgggaagcgagttccaggtgtcttgatatactggaggtagacaagaatactcgggaagcgctggctcgggattttgcacatagaaccaatttgcatgccaacccttattcgaagttttgaagggcatggaaaagtatttttggctcaaggttccccttagttggaaaccggctcccccgacaacacatggtttgctcttgtttggctgaggcttgaggaagaagatgcgacggaacagggaaaaatgcggtcttatacccaggaaagcctcgcaagcatggataaaattggcaatgtggactatggaattggggtttaggtgatgcaaactaatcccataaaattccaaaatcccccggaagaatcttgaggttggaagagaaaatcttccatagaagaaatgagaaaataccacgacctcatgtgtgtcaggggttggaaatgcttcgccgcacgccggacgccacccaatgatctcctttgccggaagaacgccgtgcgccaccatctccttcaagttttcctctgtcacatcagagggcacccactgactttcaaagctttctctctcctctgccatggatgcaaattggatgatgcgatttggtttgaaatatggccgggaatggataggagatcgatgcggtggttgcgcggaagatttttgtggaactttggaggatggattggaggggatttgtgaaccctagcttcaccgaagtgatttcgcactatagcagtgagtagggaaagtggcaagagtttcggcggggaagacaaaacgacgctatgccttcggtgttatctcattagggtatcgggagtactaatgggcctgggcctaaacagtacttcagcccagttttgctatcagcgtggttaagttgtgatccttaggggcttaggcatttgtttttgctttggcaacacttgctcacgacaatatagcccaatgctgttaaaatcctttttgacgcagttagataattctgtggaattactacaatgcaaataaaaaggtgcctgacagaaaagtgttatactgattttgtaggcctttttaggctgcaaaaactatttgggttttgttgaggtgactggtttttgaatagtcattctctcggcatgttatatgcttattttgattatgacgtgagtcatggcctaggttatttagactcatcgatttatatcacatttgatggatctttttgagagtttttactcggattcttgtcatatgtgttggattatggaccttatagtattttttactcgggtttctttatatttccatttttggtatatcaaagctaaagcagtcggctggatattttatcaaacgtctcatatgcttagttgtatgatactttggatgattcggttgtaaaaccactcggttggatgttatttacaccttgactatatgtttagtttttttaactaatcacttagtcgggggctacacctaattaggtgcatctagtcgatgcacctgattttttctattttcagccattcacagtctttgattttgatactcgggagaccaaggcagaagaagttggagtgctcggattatcgtttgggattacgagagaaaactattttgttgactgtaaaggtctcaggggctactgtggagattatggataccccatacctacacggcatgtataatccgactaggtatggggtgccatgtatagatagaatatctttaaagggacttgggttaaattccaaacttgtatgttaaggaaatactcgggatcttagtcggttacgattgaatcttatctgtaactacctattccgttagggatatggactgtattttgtaatacggaccccttcccctatataaggaggggtccgggtgcctcttggggcacgatctgctcccagatcatacgatcaataatacactcggtggatcaatccccggacaggagtagggtattacttcttgttaagaaggcctgaacctgtataaaattctttgtttctcaaccccatccacttttccagcttgatagccacccccttttagtattgccgaaatcttgtttcgacaaatttcaatcaaattttcaattttgatgtgaactaaacacacccatagtaggatgcatgagatcgtgagatgagtaaactcaaacttgcttaaggttgggaatcgctgattggtaactacattaattggccctcataattttatccatccaaattccccattggaccattacttacacttttgtagggtgattactggagggacgacacagggcacaattctctactgcttgtacatgcttcagagctgcaaaaaaaatgacaatttgaccctttcagaaaacttatttcgcaaataaaccgcgcacaaaacttatttcaaaaataaaccagaggttcagcgccaaatgcttcggcactgagcttagccacctcagtgccaggtcaaccggcactgaatgtcgtgccaccgtggatggcacgccgactcagtgtgccgacgtgtcaaagttcagcgccacccgactcggcgctgaggtggctaagctcagcgccattgtatttggcactgaaggggggaacttagtagctgtgccgagcattatggtatggctggctgctctgctagatctcagcgccaaataggttggcactgagtatggctggttccgtgccgggtggtttggcgctgagatatatttgacaggcttaaaactatgtttacttctgacacatttggagttaagtgaacacagcaaaaaatatgcagtcattcggttgataaccagtgcgcaaccaaagcaatgttgcgaagtgaaagtcacaactaagcaaaccatttaacatatatagaagcagtacttaactagagaacaagtcttagccatacataagaaggtccatagaaccccgcaaaaaaaaaaggtccatagaagtgcctaacagccataggtgcaaaagtgatgctaattctgacagccttacatgacgaggtccatacaaaagtcatattcagcataagttgtgcacatcaacttggaggataccaggacaatacttacaataactgaaccattaccatcgcttatatacaaacctgccgagatttgcggctcctggagatttttgagctggcgtggccacctgcgcgtgccgacgcgtcagcgaggcgctggatggcgggtggttttcgtgagctctcgcacgtccgtgtcgtcgttggtgattttgcaaaaacacccttcatttacttgataatttgttatagatccctggtccttagttctaacgttgtgcactcttacttagaggacctcttaagaaaacaatattctatatgaagaagcgaaaaaacggaaaattgaaccgcgctctgaaaactagaagtttaggggttgtttttgcaaccctcacccctttccccaaaccctagccgccaccattcctctgcctcctctcctctcgctccgctctctctcctgcccaagcgacggccgccgccgcgtgccgtcccctcatcctcttcttcccgcagttggcgacctcccccgcgcactccctactgcgagctgttgctgtcgccgcgccgtcgtcctgccatcgccatcctctcgctcccgcgccgcatccgccaacgaggaggccgggactgtcggatccggtgactccggcctcctcgccggcagatccggccgccctgaagtgaggggaagccaggagccgccttctactcttctacctctatgcccggcactgcccctctctccctctccctctccctctccatcttgttcatttccggatcagcggatgcctgcgattaggcggccacgaacgtgcgtgtgggacgtcgaggagacggggaatcactggatccaggaggtcggtgaaccgatttggagagggagctgcatgatctgtggcattggtgtaccgtttcggacagcggcggtctccagtacggcgggtgctgctggatctgccgcatggagggctcctcgtcagctccgtcctacctcttcttctgcctttttggaaggaggtgaggagaggaaagtttcctctggaatttcatactgcatgttatatctttgccaagttggtggtcttagtgtgatactgtgattaatttggaccgatgaagatatgtgtattgaatttttctttgcaagtttaaatcagtgtaacactatgaatgtgagcgtgtgaatgcagcttgtagtgaagctttgttgagcttacgcaaagcagagaagggcatcggcgcggggctcctagaggatgctgccacctccatccccttgcgtcacggccgtgctgccctactggtcctctggcacagcatctaaggtcatctgccaccacaaccaggttgcatctccaccgaatgtgaccccactttgatggcggcgagctttgctttggtagtgttgctgtcaatttggctgtgcatttctttaaggggttcatctacgatccattgtagcatgctgatgactttaaattacaaatgagttaatgcataagattctttgtttccaagtataagaaattgatatatcttttgttgaagtatgagtatgctgatttgttccagcaaaatatagcaatgtacaatattttttgtggataataatttgataatgctccatccaaatgtagtcatgcatcttcatcaaaatagactgtggctttgcatttttagtttgttcattactaattatgccccttgaaggtagtgacttctataaaattaatttataacgagcatgtttgtaacttgacattagatgaccttttacatgcagaatctgagactaaacatatacactaatcacactaatcactactactgctgctatatattactgttgtaccaaaaatatacaagtgcatttgataaaggttatacaggtctggatcagaactgtatattactgttgcaccaaaaataaattaatgaactgtaattttctctgtattatttttggatgtgattactaaagctcgctatgtgtctgctctttttgcactatagatgttatgtggggcattcagtatcagcgccggaaccgacgccaacagccagagcaggcgccgtgatgttggatcaagttgttaggattagtttcagtgattaagtttgttaggaagattaagttgttagttcctggttagtagctgtttggttttccattgtaagcctatataggccattcggtttaagtgattaatcaagaaagaagttaatcccagttcctgttagtttccaccacggctccgggaaggtaaggcgtgcgtcctcgccctcccgttcgagcacagctacgcgctatgccacttagggccggcgcctaacaatagaaaatcaatttatctcaatttgttgcacaatccatctatagcttcaattctattctaagctatctaatcttcccaacgccaatcagctgctgcattacaatggaatacatttttgcttt

SEQ ID NO: 63027 - DNA, 9941 bp, Oryza sativa
cggaatcctgaaagtttccgtaccgttttcaccccaggaagcaatagggtgcaaagggaacacatgtgacattaacgttgaaagaggtgtgctggcagttctacacaaatcgtcttccttacactaaaaactggtttttactagcagccaattaacaaggttgcttgcgaaaaccgatttcaacatacaaccatgttaagccgcctaactgcgatgatttttttttctctaaaaaatcagaaccctaaccgatttcaatatacaaccatgttaagccgccacagcaagatctaattaacctcctcaccgttggagaagctgacaccattgcagtcctcaagaagggatgatccgtcgtatccgtggcagcaggcggtggatctgccactatcgttgccaggatgaaaatgggattttgaatcaggcggtacgatgaaaatgcctattatgtacattgaaaatgagattgtgccgtataaaatagtaggtagtacgtatagtttcatctattggatgcatcgtcgattttatataacaccttttataccataattttcagcttttacaataacaacagaaattttgattatatattgtatacttacacgaagtcaccaacttgtacaatcaatacaagttttgtccttagtctttgcgatctttctatattgagagctcaattttcacacaaatcaaaattgaagggaatccaaacaaagaacgaaccaacacctcctatctccacactatgcatgcgtttgattagtggatgaaacaagatgggttgggttgatcctattttttaagttgtttggttggagaaaggtgtggaatgaaatggtccttgatgggaatattatgcttagattcggataacggaatgaagggagtatattggacatggtcgcgtggtcgcattttctatgtaattaataaaaattgaatttatatttcgtagagaacgatgagaacgtttcttctaataaaacctagtggatgtatacatacaaatatatcgtacaaatgataaaattgatgatttgctactctttaggttgctaccatgtgacaatgtcgagtgggactctcatgattcaatgacgtgtgggtggcgtggcgataaaaaaaatacatcaattctcgagtggaaaaataatcgaatataaatctccggacaaatagaagaaatgatatacatcaaatctatttcaaaatcacctcaacatgaggcttcgaccaagttctaccatgcttaatctgcgcactgaccgagatccaatcgtccagcctccacggccgatcgccattgctcaccgtgttccacccccagagcccgtcttcctcgacgcgcccgtcccggacgagcaccacgcgctccaatgtcgcgcacacccgcaccaggtacctcaggaaccgcgtatgccgcggcgcgctcgccgcgaaccccaccatgcgcacctccctcagccgccggtgccggaacttgcgccgcggctgccagtagatcggccgccccaggtgttcgtccggcgagggggcgggcgcggagacgtggatgtgcagcgactcgagcgccggcgccgcctcgaggaggaggcgcggccacgagacgtcccaggtgggcggcacgtcggcgacgaggagctccctcaggccgagcagcgcggcgccgagcgggcgcgggaggatccaccgcttcggcccggtgaagcggacggcgagcctcgacatcgacgccggcggcgcgcccccgaggagggagtcgaggacgcggtggtggggcggcgtcgccggggacgtgggggcggcgaacgtgaggttgacgtgcgtgaggcgcgggacggcgccgaagctgagctccaccaccggcacggtgccgtcgccgaggcacgcgaggcggcggagctcggggaggccgcgcagctcgacagcccggaacgagcagctgtccacgacgagctcctccacgccggagcgcggcgcgtcgattaccagggcgtcgcccgcgccgcggcagcacaggaggtgcaccacccgcaggcggcggcacccaccgaacacggcgtcgtacgcggacatcggggtggacgccgccgtgtcctgcaggacgagccgctccagcgcggcgtaccggtgcagtggcggcagcgcgcagtggcccagcgtcaggctgcggaggcgcgagcggtggcgctcgtcgtcgaggaggtggtccgggaaggcgtacaccggcagcggggggtcgcgcggcgcggacctgaggacgacgacgtcgaggtgctcgacgccccactccccgacggcggtgtcgatcatccggtcgatggtgccggcgccgtcgtaggtgcggaagaactcgaggtagagcgacctggcgcgccggcggcgagcgccgggcgcgtccaggaccccggcgaggccgtcgaggaacgcgcgcgtggcgcgccggtccaggcgtttgatgtacggcagcagcctgccctcgacgtcctcggcgtcggcggcgccgcgcgccctggctcggcggaggcggtcggtggagtggaagtagcgcggcgagagcacgtcggcgacggagaacctgagcgccgggaggcggcgcgggaggcgcgcccggcggcggggcgccttaatcctaggcgtggcagaaagatttttagtttggatgacggtgggaagcagctacgtacacaggtcgcagagataatataggcggctcggcgagtcaccatcgcattccgattccgactccgatccctatcctaacacgcttgctgctcttgttgacgtgctgtaaggtgaggtaccgaaaacagagcgatagtttagcgtatcattagctaaataaactttaaaaatagattaatatgatttttatatgaacttttttattaaaaaagttgtgtaaaatatagtttaagaaacatacgcgcaaaatataaaaaaatagaagttgagaaaagggagaaaaaaacacagcccaaacgatggttactgttgagcagagctgcttgattccgctgatatgatagttgatgaatagataatgtctatgaactggttttttttttttgaaactttcaatttttaattttaaaaataaactcttctaaaacttatttttaaaacctagatcttttgacctgccaaacatggcaaaacaatactaacacatcatctgtagtgggcgtgatagttttattatgccacaacagcaaaaccgacgtggccaagaaagatttatttttacaattaaaaatttaaaaatgttttagaaaaatcaaaaaatcgcaaacttgttggttgttaacaacaaaatttgataagatgtacgaagaaaacaatggattcgatgcggatttggaggagataattcggtttctaaaaacagcgcaatgcatcgactagaaggctgtaccttcgacaccccactctccaacggtgatctcaatcatctggtcaatgatatcagcgttgttgtagatgcggaagaactcaaggtagagtgccttggtgtgccgatgatgagcaccgctagtactgggcgcatctaagatcccagcgatgccatcgaggaacgcgcacatggcacgttggtcggagtgtttgatgtacaacaatagcttgccgtcgaaacaactaaaactctcattcctacaggcataagatgttatgttgatgtttcttggttggataataaaaaatgaagtatctttattcatgatccaacttctcatgctgccatttggataaaggctattagtgcaaattctctttcacctttgcatgcagagctttcagtgttctgggtggcttataaaacttgcaggtgtttaagcttgatgaatgtcatcttcctcactgatagtgcaacaattgcgactatattccatcaaaataatttacaggagaacccaggacattggagtttaaggccattactatcaaaatttcagaattttccttgcaggagcaacaattgcatgtcaagtggatccctcggaaggcaaatgaagttgcggatagacttgcaagtaaagctagaagacacaattctagggctagaaactataattattgtctacaataattctcatacttgttatcactctacatgtccaaccacaagtgccctagtaaacctctgtcttgaagagacgatcataactcatgtactttgtttctaatttctagtgtaataaaagtcattagttctaaaaaaaaagggaggtgcctagaggtggccgagaaagctggtttgttcggtgtttgctaccccttcatttttttaaataacccacacaagacagcgcacaatttcgtactaatatagtagaaaacaaaacaagtctatagccctggaagactatagctagaaaaaaaataaccacaccacgcgtctacaaccggatccccgctagtaaagagtaaacatgaacacaacacccctaatggaatgggtcttcaaatgacaccaccagcgaagaaacggtgtcgagaaacaccaccgtcacctattctgagaacatgacatggttttcacctaaagaaaaccatcaaggagagaagagattctacaacaatgccccaagggaaaagtggcgcccatgagtgtcgctattgttggcccaaaggctaggctttcacccgtaatcttcatgccctcccatgccacgtgcacctgtccgtatcagcggccaccaccaactgagcaccttcaatgcatagccaccacaccagcgccttgccgtcgaccatccattaagcaggattgcaggatccagctcactcaacctccatccacacgattgggttgaggaggaagaggatgagagagaagagtggatctcctcttcctcgtactaggccgccagcgtggccatcttgtgacggcaaggcgtcaccacgagaggactagcgtatggatcagagtccgttgcatgccctgcaaacacccacctcacggcatcgctgacgcctccacctcgggcagactgcccaccttgctatcgcctcgccccgaagccatcattcgtcatcggatctcccatgtggtagcgcctcaacggtgccatcattcctgcctccatccatcgacatgttgccactggacaccggccacgccgcgatcgcctcccgttgggctccagctgtcgtcaccaatcagcatgggttcttgctacccgcgtgcgccactgccagagcacgacagccctcgctgccgcgcttgcctccaccagccttctcttgcgcctcatcggtctcctgctgtctcgtgcgctgctagtcggctcctccggccagatccattgcaggggcgacagatctagccgtgggtggaccagatcctatcgtggcggcatcggatccgtcgcctagcgctgcgcagcgtcgccgcctcgtcttccccacacatcgcatgtcaagccgccttccccgcgccgaggtggagcgccgccgagggtttgaccccacattcccctacaattttgattttcatgaacactgagttctcgatgtgtttacacggttcgtgtaagccataaactaaatatgtcggagaaaacgttgatgccatcaacttttagccaatcttctatttcttcctatagtccaaagtagaattccaccttcatatgtgctcgctactttctaatggacactcaactgactaaaattcgttttgtcattgtattttagctttggtttacacgtaaccgataagtttatacacattcaattatatcctcctaacaaattcgtgtatcacaataatttaactctactcctgattaattcagcagagagagaacgtgtttaggccggagatgcagatctcggtttgatctaggccgttgagtcccgatctgacgccttgtagagcccaacacaccggcggctctgcatctcgaagcccaccggccgaagcccccccccccccccacacacacacacacacaccggcgccgccgcccctactccgatggctactccggccagcgagcccgccggcgcagggacgccggagccagcagcgccgttctccgccgactggaaggagcggatcttgctgcccgccgcggtcgccggtgagccgcccccaacccaccccccgaagaaaaactcgccgcgggcgattccaaagggggagggggattcgctgacttttgggatgctctgtaggtgtggtcggagctggattcgggctgctgtcgcggcaccgggctcgccttggcgccgcccgcgccaccgccacctacgccgccaacctcgccatcgtcgccgggtgctacggtggtgagctcctcttgttacgccggggcgtctgatttgtttagctttttgttgcaaagtctgtagctcttgggttgaattgaatctctaagtgaggtgcggttagataccccgatttggattattggagtagtatttcttcactgaacttgtgacttcgataatctactgttgtggtaggagagaagtagacttgctatacttcacttctcaccatttcttagttatgacttgaatgttggttgagattattaaatttaagctactagactatcattacaaaaaaaccgtgagtaactggatcggacttaaactcattttggaggcgggttgcctgggaacatggcgcagatgatgatataatgataggcatatacaaaacgatttcacatttctagtagtgtctcagtttgggatactgaattactattcttgttaaccattgaacaaggtagcctttctctgcgtaaattagcatagccatttttgctggggaatttgatgtggtgccttgagaattgcgatattgtgactttgtgagtgattatcttctaacatgcctccagtccctccatagtaaggtttctgattatccattatcctctaagcatgctgttaatcgtgctatcaacatccatgaagctatttcacaacatccatgaagcaattgtgaataaaagaatgattgtcttagtttgttgttaccattgtctcactttgatttggcaaagattcaatgcctaagtaaatctctctttgatctattgtctatgatatgatcttaggaaaattaagctcatcagatatgagtaagtagaattgtggcaggctggcagctatgatcttttaaatgcaatgccctcaacataacctttttagtgcccacaactccttttttttcctttttcctagcacttgatcagttgaaataattcggggttttattgctcaagattacaaaaaaactggagaaatttctggtcagccaaggaacataggttgtagctattgtgctacatgggttctggaaatgtttgacatatttgaaaccctacttgacatgtttgaacttgttttgagctattattgcttacatttgtacacagtatgaagtatgaacatttgttgtccttttcacatcagaatctggcattggttttaattctgcttggtactacaactgtacaagttctatcttgtggcttttaatctactatttagaatacataacttttttagtgggatttagaatacatacttttgcactgttcgttttggactatgattttcattttagggaacatattaaacatgtttgtaaaaggtggaatagcgtcttctcatttattgcagcacttatattttctgtaagctcatgttaataagggacatggagcctctggatgaatatattatatatcaacatgtttatgtaatgcatgtgcttgtttccattcaggagcacgtgaacttgcaagagatgctcgggcttcaacacctgatgatcccatgaactccgttgttggtgggctagcaagcggagctgttcttggtcgattacaaggttgatcattatattgcacaatcatatttggacttttgttctttccatatttgaaagtatctaatttaatcttttcagtaacttcgtattttaggggttatcaggcaggtttcatgtatggtactaaaatcaacaacttagatcagaaagcaattatattatatatttccacatgctatctttacaaaatacatatagcagccataaaatactaagctagtaagctagagttcaccaacagacttgatagccatcagggtttgtgctttaatctgttcaggcaacattttggaagctagaagttatgcctacttcggataacatctgaacaaaagttctagtgcacctgtaacgtggggcccttttattttctcaaaattggcatagtgttgtacatggaagaaatgtgtgctggtcccggacaccatcatgggtaaaatcataaaaaggttaatttattgtaaattgtgatgtgctcatttgttttcactggttttccagaattttgtgggatgtgggtactggtaaggctactattactgaacttgagtgtctttcagttcctgtcttctgttagatgcgggattgcctattgtatgtctctttcttatacatctccagaatctttgtaacatcttctactcttgtttccaaagaaagctctacataaaagctttcaatttgcatccttcaacatcactatagttaattgcacttattgatatcactctacagtgaattttagagttaatttactatgatgcatagtgtagcctttctgatgtattagcagtcttagtttagttccattcaagagcttaagatatttcaattttgttctcatgggttatctaaggtgggtggtcttgctgagctccaatctaatcataataagatcttcagttccatttaaatgaaaggcatcattgttgtctttggtagcccttttttttttttaaaaaaaaaactattatgcaaaccttggattgcttcattctaccatttaatccatctttcttccaagcttgtgaacaaattatgaaatatatgctttcaacctgctattactagattctccagttatgcatatgcttgcatgtccacttgactattctgttcaattaaatttccacttgactattgctttagattaccttgaagtttcatagatagtccaatgtgatttgccttactcaaattatcaacaagtctgatcattttataaaaatcaacccttctttgtgatgaataccttttggccttcagaattcaaacttgtctgaatttgtttgctgtgatgcaagcattttctaacttgtctgaatggcattatttgttttctaccaggcagcttggtggaaacttttgggatatatatattgtctgaaaactcgcataaaattatatcgcaatgttcatgtttgtgccctggatctcatgatttgcatttgctcactgtcgctgcaggcggacactttggggcagttaagtatgcagttacctttgcagctgctggtaccgcattggactatgctgcactgaagctgagtcctcaaattaatggcaaatggcatgccctgaaagaacatttttctggagacaaagactggtttacgctccccgaatggtcgcctattcaggtgttggatgaggaggccttggcgaagaaacgagctcgagaagagaagttgttcgctcagcgagctctcagtaaacttagcaaggaggaaccatagttacagtgctacagtactgctatagacttgatagttttgtcaaggcgctatgcgtcacgtaaaccattatagttctagactgttagaacattcaaattttggagttttttttatcttttcgttatcctttgtaagcttttcacggaaagggagaaaccatgttggtcattgttgtactggaaagggttttagcttccaaaacatttgcttgtctgctgtggtgtttgtaatactgctggtaatctggcaccttttggaagtaaaactcttttgaattcacataaaatacaacccagaatgtgaaatttaaatgcgttatttttcctgtaaaataccattgactatta

SEQ ID NO: 63028 - DNA, 6048 bp, Oryza sativa
ggaggccggcaagggggccgcctgcaaaattccatgccccccctcgccgcccatttgcaggcggccccccgcacagtataaaatcgccctagcgaagggcggcaagggggccgcctgcaaatttcgttgacggccgtcgcccgagagcgaacggccgtctgccaggtcattttcgccgccctctgaaagggcgattgggcggtaggcgactacttccgtcaattttcaaaatggaaaattatttttgtaaaacttttaataaaaaaaattataaataaaaaaaattccaaaggagaccatatgacccacaaaagaatttgggcttcaaatcaaacaaaaccaaatggcctgaaagcccagttcccaaaaacagcagcttaacaagcccaaatttgaaccaatggcatgtgggccaagctagtagatgccccacaaatcagtaatatggatccacccagtccatatcccctgatataccacgctgagctttatcatgcatgccggagcagatcactgttctgctcaacaaattacctgcacatgatctaaaggactgattgttccaggataggagcatccgacagtaatttcgttttgaagttatatatatataactgagattttgaggaattttatcagtgattttttgggattactagatttgtaacacagtttgcattgcgttgaatgttatgatactatttcattaggcaggtgggaaagtgcttttattcatcgacatccacttgttttctacatgttacctaaatatttattaatgttttttaaaaaaatgacaaaatagattaatatgaaatatatatctcttcacaagcatgtaattttaaatttaacttctacaagctgtaacaaaaattaaaaaaaaatacaactctgaatgtttgtgtactagttttagtttaatttattgttctgttacaacttctagaaatcaaatatgacctacacgtttgtggagtatatctcttattaatgaggaaaatttcttgtgtgcctccttaaatttcaaccaatcccttctatgtttacgagttttgctcactcctttttatactcctgaattttgatttggattctctccacaccatttccatctgccgactgtttaattcctataaaattatccatttttcctttagtcatggaagaaagtgatcatagagaatatcgttggagtctagtataacaaacttatgaatattatagtcacacaacaaagattttgacaaacttcttcattccttgcgtgcccaaggtaaatttgattttttatataaccactaaaggtcatgtaacgaaaattgtatagaagagatcaaaagcaaaattttggggtatacaaggaattgagaaaaactcaagtacgtagaagagattgacttaaactaaaatcttgttaatgctttttaacttttttatgactatttagatgatatgtaagaaatggtgagatgtctactcgagggataaaaatccatctccacacacagatcacatgttgttccaaaccaaattttgacaaattagttgaaacaggtaaataaaacgctgcagtgtcgtccttatggtaatatggtgcggcatttttctcgaagaagaatacagtacgcaaatttgaactctttgatatggatattcccgatgagtgtgacatgcgaaacgtaaatagcggattatttcctgcctatctttatttaaagattttcctgcctatctcgaaaaactctgtgttcggccctcctcccagcacgcaaaataaagctagtattattgcatgattaattaagtattaactatttttttgaaaaatgaatcaatatgattttttaaaataacatttatatagaaagtttttgcataaatcacaccgtttagcagtttgaaaagcatgcgcgcgaaaaacgagagaggtgggttgggaaaataggggaaagaacacagccttaatagtctttagtctatctacaaataaaattattttgtagcaattccatcacattaaatccaaagttccacttgttctaggcttctagcagcctttcaagctcacttttcatcatgcagttactacaagtttgctagaccaggatatgtgtccactacaagcttttttttgaaacctatgtccactacaagctgacaaaaacaagggttggcaagatgtcaacactatgtaacatgatgtcaacactgtgacacttcaaggtccaaaaagagagtacatggatgatctttttccttctcctagatcatgtttatgccctatatataaattctctccaaccatcttcttgtgttcatgactcttctcaatctaaccatatgcatcaacaatactagcctaatggagaagctggcagtaaccactgacattatctgaagaaattacttgccggttacagcaatgaagagaagctgaacccagaggagtggtactgagaacacaggtgccaatacaatgtatggtgagctactgtataatggagtaattctgtaactgtgttctcaggtcacccctttgggtttcttctcatgattctttgtccaatttgagatagtggtatacttgaatgattagattggtttatcttgattcatgagcaaggatatgtctatatactagggttagacatttcggaccgaaattcccctccgatacgatattattccggctgaatttctttaatttttcaaaattttcataaatttgggtaatatttattcaaattcaactaaattttgctcaaaatttcgaaatttcggaccgaaatttccaaaatttcgggatttcggtgacccccgatataaaagcacaaaccgataaagcaaaccctgctatatactatggaaacgtctagaggaagttccttttttttttcctcatgtattttctcttttgttccaagaattttttttttctgttcttcattccggtaagtgttgccgcaccaacattttatttacatgttttttcttgcagcaaatctgttttgtatggatattgctgtaattggaagaacaaataactgaaggtagtctgtagatgtttgtttggaaaagcgtttccctactcgatgggtgtatatcatctaagtagttagaaacaataacaatatagattgatttgtatcactccataaacattgcacattcaaattcgattgctataagttgaacaaagtatttgtatacaagttttaatttaattttttgtttttttataactggtttttacaacttatacaagtcgaatttcagcatgcatacttatggattgatatatctcatactaatctattttttgttacttttttatttatttataactatttaagttacaagcgatctatgagtaactgtgtcatccacgggctgttttcataattccagcatcatttgactgttcgttgtgaaatttatgtcaaaatctagtgaattttctatatgcttaacaaactaattccacggcaataacatacaacaaggttgttagaacagaaagatttacactctaataagtaataacatggccactgttcttccattcgtaagcagctttcatcagtttgaagccagctgctgccgttgcatcctcttcatcaccaaaaatgtaatcgaagaactcctcgcatcctcctcctccgccattgccgtcggcgaggagactcctcttcctcttcacccttctcggcgtcttcttctcgaccggctccacctctccgaggtcgccgaacgcggcctccttcgccagccattgttggagaagcatcgcccttgcctccttcatggcgggatcatcagcgcatcccctgaagtgttcgtccgctcttcggcatacggcgcggcacctccggacccgctcggccttctccgccgcgttcccggcgatggcggcgccgccggagcacgccgtggcctcgaactcggcgtagctcacccacacgttgaggtgttgtgttttgccgagaagcctctcgtagagctgcctcgctctgtcgagctcgccggcgtcgatctcgaactggatgtagtccgtccacactagctccggggcgtccagcgccggctgagagacggcgaggtcgtatacggatcgggcgcggtcggtctcgcccagcttcttctccaacgcggcgtagcttctccatacgtggctgctgctcggagcgtgctcgatgaacttctgggacagaatccggcaccggccgacgttgccgagctggagctcgatctcgatgtacctcctggatagcttcggccggggcgcgacgccgatcgcgttgccgaggagccgccgcgccgcggcgaggttcttgtcacggatctcgagctccgccgccatgacgcagatattggagaaggagaacttcttgtgtgggatcgtcctgaggcactcccggtacacgccgcgggcgcgcgccacgtcctccgcgtcgagctcctcgaagagggcgtagttgatccagaggtagatgtaccgccgccaatgccgcttctccgccgccgccgccgccggtggaacgttggcgacggcgcgcctgtagaggtccctgatccggttcgcgtcgccggtgttggcgctctcctccagcctgatgaggtcgaaccacgcgtcgtagcacagcgggttcgtggtcaccgcgcgctcgtactgggacctccgcttggtgacgatgctgtcctcgacgccatggcggtcgccgaaccgcttctcgagagagaggagcttctcgcgcagctcctcggcgcggggctcgggcggctcgccacggagcgcgtgctggtatattgcacgcgctcggtccggctccccgcaccgctcctcgaagtcggcgaacgcggcgagcagcacggcggtgtcgtcgttgtcgccggcggcggcgagcaggctcccggcgtgctcgtacacgcggggcgcgcggtccaggttcttcagtttcgtctcgaactcggcgaaaaggatgaacgcgtcggcgcacgggagagcagcaacatgccgctcgtgcacggctctggcacggtccagctcgccgtggcggagctcgaacgcggcgtacgcggcccaggcatcggcgccggggcgccaagacgtccacctatcgaacactacgcgggcgttgtctgtggcgccgaggagatcctccatgcggaggtactccgaccagatgcggtcagcgcgcgggaggatcgccacggcgcggtcaagtacgttgcgcgcgtgcccgacgcggccgccacgagcctcgaactgcgcatactttatccacacaccatggtcgcggtacgccggcgcgccgccggccagcgcgcgctcgtacacggatcgcgcgcgggcggggtcgccgccgccgccgccggggaactcctcccaccgcgcgtacctcatccactccgacgacgcgtcgccgcatcctccgcgaccgctgccggctcggcggacgatggcctcgaaccgtgcgcgtcgctcgagccggtgctcggcgagctcgtcggcatcgacgatcctcctcttcttggactccgccggcaggcagacggtcaccgatccatcgccgtgcagttcgcgggcctcacggatgagatgctcggccgtgagctgcacgggcgccggtgctttgttcttgacgcggcggggggtcggcagcatcgccaataactggaactggatacaggtggagaagtgccgatgagttgtggtgtcctattattataggccgccgaggaaggccaggccggtacacaatggaaatacgaatcgggcccggtcctttgttcctttggatttttttcgtttttagatttttttttaatatttacagaaataatctatcgaccaaaaatattgcagaaatagcccctgccgctctaatggtgggcggcaagctgacgtggcagacggcgggtcgaccgcgccgtctgccgccgtcgaccaaaattgcgattaggcccttgccgcctatacagagggcggcaaggggctaattgtaattttggccgcccataaagagcttgcggccgtactttttc

SEQ ID NO: 63029 - DNA, 8538 bp, Oryza sativa
caatcttaagttatgcatagacaatcttgaaagctcttctacggcgtggattcaaagtgagccaaaatgcgtcacaaaaataagaacaagggttaaaacattaaaaaaataatcctgctatatgcaatgatttagagaggcaatgcacaatgatttagttctccttcaggctttagtcactttatacaaaaacacaaaaaagaccaaaaaggaaaaaagaaaaccaaaactattttatatataaaaggcccactacaagtaattacccactaggcccataaaggaccactacaagtcattacccattaggcccatcaaggcccatctaaaatttctagggtttcctcatcctcgatggggtttatccttcgagcacatatataatccgcacgccgccgcctccctctctgcttcgcactccattttccctctccccgctcgccgccgccgccgccgccagccaagctcgccgctcgccatgggtaagcctccccctcctctccctctctccggttcatctcgattagttttagctctcaatcccttccggatctgaccgtttcttggacaaatgtcagcccggatcaaggtgcacgagctccgggggaagaacaaggcggagctgcaggcccagctcaaggacctcaaggcggagctctccctcctccgcgtcgccaaggtcaccggcggcgcccccaacaagctctccaagatgtgcgcctccttcctccttctctctcgctcgtttgttggtgtggctggatctcgctcacgggttcttggggtggtgaattttttttcgcagcaaggtggtgcgcacctcgatcgcgcgcgtgctgacggtgatctcgcagaagcagaaggcggcgctgagggaggcgtacaagaagaagagcctgctcccgctcgacctccgccccaagaagacccgcgccatccgcaggcgcctcaccaagcaccaggtatagaaacaactcgtgtctcttctctttctttgtcccattcgaatgcatctaccttatactaattggatgtgaattacctcagttattgtttagggctagatgtgctgtgttacataggcatttttcggtcaaattgctctagttgatgttgaaacagttaccaattcttcagtgcaagctgtgttttttttatgttagattggattagtagaacacatgtattgggaatcaagagagctctttaggaagaacgatttttgcacggatttttatgagattttattgtgtggcttgcctagttgttgctggtgatttgcgtatttcggttactactctgttagctgtttgtagtttaattgtgataagctgttcgcaaattgtcatatgattgctgtaaagctgttggtctcaccttgtaagagtatatagtgctgagtttggttattttgtgtatgcatgtgacatactgcggaatgataattactgcttgtcttaggtgatacatactcccatccattaaatcatttagtcaggctcacaggcttgtttaatacccttttggttcaatattcgcttcttgttttgttatttttgctgtttgttattggttattttcacactaggctttaatcatatggcatgcatgtcatagtgtgtcctctcctgtgtgccttgtttttgttgtaacaaattacagggaccatgcaattccctatttgaatcacttttgagacctgagcctcacctcctttaggaattctggtcatagcaggatttacatcgagtttaaagctgtctctttaggtcttcagctgcatttgtattatgcatctggtgtagtttagaatttggagattttatttatggtgcatgtaacttaggtcgttttatgtttatggtcttgtcttgtgaaatcctctagtttgatctgatcctgttaaaatatttagctaaatggtttgggcttttggtactgaatgatttgctttactattgtgcagctctctttgaagaccgagagggagaagaagcgtgagaagtatttccccatgaggaagtatgctgttaaagcttaggttattaggaacataaatgttttaccggtcaagttttgcccagttgcctaaatttgatgttttgtgtggacatccattgtcaccttagtacaatgtatttggtctactgcatgaagtgcgtactattttgccttttaacgttgttatttggttatagctgcctgtcacctgtctgttgaaaatgtgatggttaccttaatgtttaagagattccacttgaactatgtccctacgtagttcaaccgtggatgggcattcaaattcaatctataccaaaggtagtgtgtgctagtgctgaactgaggagcacattcttcatctctggtagttttgctgaaacctgatgtgcaaattatagtagttactaccaggtttcacttttttttgattgaggtggattcactccagggctgcggtgctttttgtgaaactttgatcaaaatatggcttggaattggaattggtagatatatttgttggttcgatgaagagtaagcaaattgatgggagaattgcaaatataacactactcttgcaatctaattcgaaatagcccctaaaaaacacaaaactgcaaaattttgccactgaaattggtgtgcacacatctatttgccattgacaaataagaagacaaaaataattcataaaaccaatataagaaatacagcaagagttcataaaaccaatataaaaaagacacatataagaccgttttagccccttcttaaccctctcccactcaggaaccctacattcccatatcttttcatctcttcatgcaaatcaacttgcactacaacagaaaccccgacgcctctcaaatcctttcatctcttcttgcaaatcaactgaaattgatttgtcatctagtttatctcaagtaatcaactgaaaattgattcatctagctttagtttatatcaagtaatcaactgaaaattgattcatctagctttatctcaagtcgggtaggaattaatgacggacgaaattagcaacttcgatcatcatttatttcggttggcatgttcttttagaaagtaaaaatgattcttatggattattgtatggcatgttccttttagaaagtaaaaatgattcttatggattattgtaacggtatccgtgatagtatgtacgagtatgtgtggataatgacttgaaatcatgctaggaatcatgtcgtgtaatacgaatagaatcggatgttttaggcaacgatgtacatgatatatccacacggattttgcgcgtttcattcgcttggtatttacatcacacggacctctttcacatttcgctcatgaattgtgacttcgcaatgaatgttacgcgtgacaggaatcggatatacacgtaccatagttttgacaaaaacatcttcaatttttaaatcgcaggcgaggacgacgtagtcccaaatcccaattggacattcgggaagagcaaatcgtgcacgcgagggcgtcgcaggcccaatcgggcatgcggaaattcacacgccttagtccgtttaattgtcttaaagttaattgtactatcgctaataacatatatataaaaggtttattcataaataatttttatttgctagtaataaacgatttggataagcatataaataagcgtgacaataagatagtacctctccgtcctataaacaaacgaatctagaatcggatatgacatatcctagtactatgaatctagataaatatatatccagattcgtaatactaggatatattacatcgggtattaggctagttttttatgggatagagtaactgagtaagtgagttcacgggacctacttgcaccgctgattgcgaggggaaaagtacacgaaggtccctcaacttgccatcgagttacaaaatcgtcccccaacagcaaatccagatatccggcgtcccttaactaatcaaaaccggccacaataggtcctttggtggttttaacctcggttttatcctacgtggcggctgagtcagcgtgagacccatgtgtcagcgtggccatgctagcctcctctctctctctcccttctctatgagggcagcagtgtgaggtgggagagcaggagggcgtcggttgctggtgacgggcggcgtgacggcggtggggggaggagcggcgggcgggcggtgggggacgggcagcgcgcgggctcccccgtcggccgcgcccacaaggcagaggaatggtggccaggggagaggagcggcggccggcggagtggagttgggcagccccttcgttcctctcctttcctcctcactctctcactcttctctctggactgggcaggctggccggcagtgggaaggaggttgaggatgatgttgtacgacacggcgttgaggtggacgcctcgcttcggggcgagcgggagcatgtccttggtggcatccgcgcgaccattggaaacgagggcgttgaggaacaaatggaatgtggcggcagagtgggagtagaaggctgggacggcgcggaagacgacgactgcagcgtcggggcgagaagcggcgccgaggtggttgatgacaggggcaaacacggtgggccggagtgggccgccgtgggagtgcaatgcggcgaggagcgggggcacgagtgggaagaggcgcgcgcgggcgaggcggtacaacacgcaggcggtgaaggggtggtcgtggaggtgcctaggcgccgtcgcctctccgccaccgcgctcgcccgccgacaccgcctcgccctgccgccaccctcctcttctctcgtgtctccgccaccgcatcgtcggccgcctgtcggacctcctcgctctgacgaccttctccccaccgctggctggcctgcccagtccagagagaagggtgtgtgtgtttgtgagagagagaggaggaaaggagaggaagggagaggccggcctgctgacgtggcatcatgacacatggggcccacgctgactcagccgccacgtcggacaaaaccggtgtcaaaatcaccgagggacctagtttgcactggttttgtaagttggatgatgcgtcatatctagttttacggttgggggacgattttgtatctcgatgacaagttgagggaccttcggtgtacttttccattgcgaggactgggggagagatggcatgggctttaacatgggcctggcccactaacgctagacgcaccggcgcacactatgctcctcctcccccctccttcccctacacgactctactcgattcgaccgttccgccgcttccgcagcctcccccaattcaaaaagaggaaagaaacgctcctcctctcctccccccacccccccgctcctctcaaatctcctcccatcccccagatcgatctccacaaccccaaaaacaaaagaaaaaacaaaattctgggaatggagcagcagcagaagcaggaacccggcggcggcggcggcggcgtcagagtcgtcgcgaggatctgcccctgcgcaccaccgccaccaccacccgacgccgccctcaacttccaggtcgccgccctcaatgaccccgccctaatctccttcatcccccgtcgcccaaccgcatccgccgccaccgccgcggcctctgggtaagataagaacaaacgccttactgtttggattttgggggatttttgttttattttatcgctgatgaaatttaaccacacgcggttgcggcaccagccgaggagatggccccaaggataagcagcagcagcagcagcagaagtacagggtcgatggctgctacctcagagacgatcccaaccaccgcgtcttccacaacgaggtcaagccgctcattgatggcagaggtggaggaggaggaggacgcggcggcgccaaagcctgcgtcgtcgcctgtggtgatgcggctgccaaacgtcacctcttcatggtattattaatttattattatgggttactagctggatgaacttgagttgcaacggaattaaaagaagagagaaaaaaataatcgtatctttaccatttcaaatattaatccaagaattcatgttgcagttggagtttgatatcttccccccttaaatactttgtatagaaattctctttattgtttgttgttttcagatcacagtttgatagttcaatatgtcttgagatagtggttgcaggtttaggcagattcaccaccacttgagtcttttaaaagagtacagatgctaatttttcttgcattacataaatactgtatttacatgctaccccagctgaggctgagcctgcctttcgtcagaacctaacaccatcttgcattcctcagttgcaattgtcactgttaggctactcactctcctcatctgcaggggtctcctgatcaacctggcttgttcaccatggcaatggcgcaactcctcgactcctccaaagccattggtgccgctgtcactgtctcatcctatcaggtgctccaagatactcacatcctcgacctcttggagcccaagaaccatgaggttctcatactagaggatgccgacggacagactcacctcaagggcctctccagggtacagcactactcatctttcctgaattgtttgtatgcctattaaatcatagcaaaattcatttagtattaactggatccgtcatattttacaggttggtgtcaactcaatcgaggagttttcgcagctttgttgttgcgctaccaaccagcagaggcaccatcccgctaaagattccacccagttacaggattggggacaccaagggctgattatctacgtctctagctttgatcagcaaggcaaagaatgtgctctagctaagataaacttcctcaacctggcaggtctgctcttctcttttctgcacccaaccttctagctcctcattggtatagtgtgttgcataaatattgtactgcatatttcgatcatcaggctatgtggatcccaagcagaagaagaatgaaggtcttgctctactaaccggtaacaagtctatgcatgccttgatgaatgttgtccaagcactgaacagcaaccagagatttgtaccatatagacaaagcaaagtaactcgtattctgcaagattctttatgcaagagcaagacgagcggtagcgtcctgatagcctgtttggtaagctactaacagctaacactttccttttgtatagggctgcaccaaagaaaatagttatcaaactagtttgactcttacccatgtaagttctacaagtatatttacctgtgaaatgcaagttttagcatttggtcacggtacctgtcggtgattaggattcgatcaatatatgtgcgtgctatatgtacatgttgctgataaagtagtttagcataaaacagaaccttcatgcctgatagtattgttcttcactaagtcaccaaactagtactaccttttagtccaaggatatgtcggtgtgataattcgatccagtcctcatttgccatatgctacaaattgttatacagaatatgtactaaagcatcgctccatctacagttagctttgactggttgttacatatttgcatatgtaccatagctttcctgtttgaactgatacacaataggtgttactctcccaatctaaatatatgtttccttgttcttgcttgttgtaggctgaagattgctgccaagattcagtttctactcttgccttggcttctcgctcgagccaagtggtcaatgaacaatactacagcttatccttgagtgctaaaaaatcatcaaagtcaaatatgaacttacctaccgatgccaaaaccttgtcaaggacgtttattcacaaaacaatgtcgatgcaagagaagaatgcccgacctggattcaataatagtggtgtaaaaggcggacaaactcctactgctaatagaaggtcttaggaatttaatatgtgaagtaaaagattttgagcttggtatttcattacaaagtgtagctaattgaggttttatttcacgcaggactcagccaatcattagttcaacgaaaaaatctggaagctcaatctgtacttcaattaagatgaaggaaaattatgctaaacctaaaataagtggaaggtactcttgtgaaaatagatctatcattcttttttttctaaaccagcttaaattgtttttttttgttgtcaggaaattattttgtccaagcaacaattcattgaaggtacaaaactgactatcttaattgttatactctgttgcggtttatcagacaagtaacacatgggcatgaaattgcttttatcgtctaattgactaatcaatttcaacttttgaactatttaggaggagaatgctacggatgttgcttctacagtggtaacagaaactaagtcagcaacagtgagaatacaagctgatgttagtataataagcaccctactatgcatttttggtgattatcagttgagttattttatcttggacctccttacattattgtacaggaagtacaaccattagtaggcatggaaattcgagct

SEQ ID NO: 63030 - DNA, 2810 bp, Oryza sativa
ggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcagcgacggaggcaggccggcggtgaagtcgtagacgcccaacagcggcggcataataggccagccgtgtaggcggaggcaccaatcggcaaaagtagtgccgcggcgttacatgcaaacagcagaaaataccaagagagattaatctgacatttagagatcaatctaataaacaacaataagttgaaaaggaaaaaacccggcgaagtcggagattaaaaggaaaaaactcgccgagattgatctcttcgactgactccgagacggagcggaggaggcggaggtcgcagtcgcgggcggcgttggtgtccatcagcacgacgcaggacggcaggaaggcatcggcgtggctgcagccgtctcttatgcatccgattagatcggttttggcatgcttcgtgtttgtagatccatcttgcaacaccatggcatcctcgttgggtagattggaccagtaggcgtggtggtggacgaggacgaccatcaaatccgtcgaactgtcgttgccccgtcgttgccgtcgtgctgatgcaaacaagatcaggcagagaatagcagcgacgattcgtcttgttgaagtcgtcggcggcgaggaatcaaggagctcccaaagcgaagacgaagccggcgactcataaagttgattccatcgcactcgttgtcaggaaactcggcgtttacccctacctggcgcgccaactgtcgaaacatgatttcggcaataataaaagggggtagcgcacgagacctaaaagtggatggatgcggagacaaaggatttagacaggttcaggccctctcaatgagaggtaataccctactcctgtttggggatttgaatccgccgggtgtagtatagatctgacgatcaggttgtctcatcatgcccctagaggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatctccacagatactcatctcgtttatctcgtttatccgatgtaaaggtatagctggtccggatatgcagctgccgctccgttttacacaagggaactcccgggggagtcgatgtggaccatagccgaggcgctcggctccggtgcaatgcgcgtggctagagtccagaaacaatcttcaacagcccacggcatgcagctccggccgtacatgcaagacaattaatcacgaaaataaatctggttagtgtcagtactataaggatatatgcatatatcagttgtatgcatgcaacatgcatgcgtgtagatgcatgttaatctaatcctccttgcatgcatcagattggtatacgaaaaccaatctgcacagtgcaccacatcggtactgcctcctgcatgcacagtgacccgcacggcgacagcgcaccggcgtgccgcgtgcctccatgtgcttgtaatccatccagccagccgaggcagatggttcaagtcgcgtcgttcctgacgtccatttgtccaggtggcttgcacggatggtgagcaaccacaccgtaccatcccggcgatttgcatcacgaggctcgccatcatccggacatgaaaacagaaaatactagcgcattaatctgtaaattagaaatcaatctaacaacaagaacagattggaacgacaaaccggacagacggtcgtgttggccggcgacgagcagtacacagataacagatcaatctccggattagcgtacgagcaatctcatgctgataacgtgttaaataactagtggcctattcgctgatccggagtagaagacaacgatttcattcacacaatcatatagtagatgaacacggatatagagagaggcatcacagctttattgctttctcatatgtggatacatcaaccaacctctcaaaccctctatctcagtatatatacccataataggaagagtcctattaggatacgtttccatatatttggtatgagctcatatttatctctggtaggagataatagtttcataacatatacatgaacatggacgatatttacaaggtggcaagccacacagtagagatttactcgtgttgatgaactgcagtacatcttattgatttctactgtagaaggaagcaacgacataattataacatttggagctttgacatactaattttatattactgttacacgtactatacatacgtgctcgatccaagtctcgtctacattgcaagaaaatacaaataatagtcctctcatacatatgttcatgcatcacctgtgtagtaaatttgatcaatttcctccacatcttgctctgttcgttgattgctctgagaaactccttggcagttagggtaggttccaa

SEQ ID NO: 63031 - DNA, 2590 bp, Oryza sativa
aagctgagattttttaccgtccatcatagtttttggtacctcccgatactataatcggagccatccatccagtgagatcaaacggttgacaatcactggtactgcgaggtacgggagtcccgtgtgggatacctcccacttcattcgcatgcgtggaactagaggtggccaaacgggcggcccggcccggcacggcacgggcacgggtccggcacggcccgtttcggcacggcccgttaggcacggctcatgaaacgggccgtgccgtcccgacccacgtgccgagccgccggcccaagcacggcccgtggatggccgggccgtgcccgtgccggcacggcatgcgtgtggcccgccgtgtcagtacgggcccgtgaatgaaaaatgggccgtggacggggcacggttggcccaggaaccgaaatggcgcggagggatgcgatgcggacttgcggaggtggctggcgggctgggccatcagctaggaggggtgctcaacggacttgcggaggcggctagcgggctgggccgtcagttgggagggatgagatacggacttgcggaaggatgagatgcggacttactacagtagccgtgccgtgccgtgccggcccgcgggctcggccggcggcccaagcacggcacggctactcgtgccgtgccggcacggcccgttactgtagtaggccgtgccgggccgtgccggctacaggttccgccgtgcctcgggccgcccgttttggcccggcccgtttggccacctctacgtggaacaagttgaagggcagaattggactttcgcataatagacagttttcgcagagacggtttgaatccccgacaccggcaatctcactcctcccgatccccttccttcctcgacggcggcggcgcagccaagctcgctggcctccgcctccctcgctacaaccagcaatcaccaccctgcccaatcccaacttgcccctcctgctcccggtccaaatccggccgcgccgactgcagggagccgatatagctcagggcgtcgacgacctcaatgcaccaacgaagagatgtccacagcgacgagctcagtgcccgcctgaacacaagcaaagacgagctcggtaccaatctgaagcaacatgaatcgtggactggaggacgaacaggatgctgctgtccatggcatgaccagtacatcatatcgatccttcactagtaggcaagcatcttcatctttccttcaccatcatctctcgcgtcagcctcgcagcttatgcttctccccgctggcgtcgtttgacctcctggccgctcaatccacggagcggtggaacatggaggtgtcaccacgccgatgcaccacgtcgcgaggcaggcgccgaggcgtcgggagcccagacccagctggccctggttgattgccacccgtccccttcgccctgttcgtgtcggtggccagcctatgcgcgtcgctgagtttctcttcgttcactacccatcgtacccctctagagatcaacggttggattgtaatcggtacctcacgttacatgtacctcgaggtacagaacgctggaccggagaagcctctaagaagttttagggttggacacggttattaaaaaagtaggtagaagtaactggtggaggattgtgattggatgagtagtggagataggcggaaaacatgaatggtggaaagttataattggttgggaagagaatgttggtggagaagttgctatattttagcaaatcctgatggctaaaagttgttatattttaggatggagggagtaccaattatgagatttggtcgagtctacaagtactccctccgtttcaaaatgtttgacactgttgactttttaagtacgtgtttgaccattcgtcttattcaaaaaatttaagtaattatttattcttttcatatcatttgattcattgttaaatatactttcatgtacacatatagttttacatattttataaatttttttaataagacaaacagtcaaatatgtgctaaaaagtcaacggcgtcaaatattttgaaacggagggagtacaacacaatttatgataaggaaggagagcacttctagcacggcaatttgctgtgagcttaataataagtcgtacaaaaaaatatcaaaaagttaatgagattactctatgatagatggagataaccagttttaacagaaaaaaaagagctatcaagtgtggttccgtagcacgtaccagtcgtgatatcttttgaaaggctgtattatctccatcagcttggggcaatcatttatataacctgactttatttcagagacagatatagcaccaacaatagagatgaggtctggacagctattaagtcgaaggatgagtcccttgagtgtcatagaactccccagatggctgttgtctatgcactctatgcttggacagtcgactaagcagagcttccgaagagaggatggtaatgtcattctcctctgcatattcaacttgggacagccctcaatacatagctcctccaagtgggaaaagctatggaggtcatcaaccggcagtaatgccatttttttgcaatattttacctaaa

SEQ ID NO: 63032 - DNA, 1406 bp, Oryza sativa
gagccatcggaagttttggaaagccagagacaagctgagactgtagaatatatacattctttcaaaaataattaataataactgagttagaaaatatcgcaaaaagtaggaaagatttatatatatataaaccaagagcacattgttagttttctcattttgtttttcattgccaagaaaacattgggctggagcataaatgctttatgctaatgtctgaatcaatggcaaaaaccaatttaagtgaaactaacatagcccaattgcaaaaattcacccactttcagttgtttgttatctttagttggtggacgatcaatgttttcaggtcaaagaagttatttaataatggaaatccacagtaccgtttttatctcctataaatatagcatgtcatctgactacatttttctgcaaacaaagccagggaaggtgaaagaatattttatagcagtatcttttaccatgtttacattgagagtcattaatctcaaaatattaacctttcttttgcagggcctgcaggaattaatgaagatgaaggccgctcttttgatgatactagtggtggccgtttctttcaatttgtgcacttgcaatattccagggaacatggaagaagaacatggtatgtacaaggatgtgcatgctgggaaggacatgcgcaagctgatcgatattgatggaaggactgcccctacaggccatgactatgaccatgtctgtccacgtggtatctatccttgctgaataataatgtcctagttctcaataggaccagaagctattggagccaactagtaattaatagcatcatctggaataattgtagaacaaatatttggatgtaagatttgtgtatgtttgaatccccacggggctattggtgtgagtgcaatatatctagtttatatggtttgtaacgtgtaattcttaaaatagtatatatatgctataaaaatactttagtgttccattgcattatagttgcctgcgtttatttctaacagagattatgaattatgataaatctggcatttcacctatgtaggaaatagaaatggtatctacgtgtttttttagaatatccatgtatatagatcaccgcatgcatacatttaacatttgtaatttcaaattcatactgccaactaatatgatcaattttatatttggatcaagttgttagatttgcaatatatgatcacatattgtaaacattattggcaatgacaaatgaatattgcagacattgttgccaaatttgatctcctaaaaagtataggtcacaggataattgttcttgtagttccaaaaaaacgtatggattaatgcagcttacaaaatgcatctctagaaagttctggctggaattgagataaaatctacaattgccactaacctat

SEQ ID NO: 63033 - DNA, 2052 bp, Oryza sativa
ccgatgtgggattcggaggggccaccgatgaccagcgacatcacctcggatgtcaccacgagcaccctggcaccggggttgctcttggcgatgtccttggccacacgcagcgccgtggtgcctccgaagcaaccagcctggtagagcatgacacgcttggtcgacagcgggaggccgaggagcttgatgagcacgacgtcggcgctgggcaagcagccggtgctggtggtggcgaagacgatgtgggtgatgctcgacgccggcttcccccagtcgtcaatggccttgcgcgccgcctccgcaccgagccgagggatgccctcctcggcgacctgctgccgtacgttgagcgaggtggacatgtacgccgtcaccgacgggttggccctcagccactcatcagagatgtacatgtgccgcttctccgtcgatgtcttctcgcctagatttgcaataatgcaataaccattgctatataattgcttgggcaccatgaaaatcgtctccatcgtttcgtttattgatggaataagcgaaacggtatatttgtaaacggaaaataatttgtaaataaaacttttatatgcatgttcttagcgatctaacggcaaaggctgaagaataaattatgatgaaaaatctcaaaattaactccaaatataagattggaaattcaaattttggcttataagaataagtataagccaaaagatgaggctgctagcttctacctatatatttatggttgttaattaagttcatcgatcgggaaaagatacaaaatggtagtaatttcgcatgcacttacagatgtttgcaaacttggcttttaggtcgaccaagtgattgctatcggtaatctcaaagtaataatcagggaatgacttctgctcataaacatgaaccggcacggccgtgccgattcccaggattgttgctctcccgccggcacaaggattgctgctcatttcatgtgtcaactctggtgcccctgacgatcccatcaggcagtacgtatttggagtatggacggcaactatactctaagaggaaatgaaatagccgctatagctttgagatctctgcagctaccaaagctcggcctgatatatataggcattgtcgatgatgacggccgggctactttttttttttgttacaactagatgttagcattaatcgagaagaggtggaagagggagtggccggcagttcaagtggaggggagaaattgaagaggaatggctggcggtggaagggaagagaatttgtcatgggaggtcttcaggagggtaatttggtcattttgacaaaattaacgacgtctaacagaataaaagtgatggcaaagacatttccaagataaaatagtttatacgattatatttcttagaagttgggtttgttgatggcctttattgaacgaaagtctatatgcttgtcaattgcatctagctaatccaatcatcggtgccatatgagaagagtgtgcactagcttgaagatcacaccaaaaaccatgagattagtagatgccatttccattttccaccattaattggcctcttgttccgctccttgcgtgtcgcatgtacactgtgatcacccttttttttgtcaattccatttgagtagtaattctgtaattgttgtctttttcatagtactttttttcaacttcatttgattgtagttcttcaaaacgtaaatgtaacaatctagcggattaaaagtagattagatgggatagttacataaacattttcttgaagttcgtgattacacatgcatgcaccctatatcaatacccgaagaaaataattatgtttcatatatacggatcatatttagatgtttagagtgagtcataatattataatgtttttatgtaaacaatacaggtggttagctacatagtgcagaggtaaaacatgaagctacatgaagtaagttcagcgtgaaatctaaaagtaattcaaataaattgtagaagtaactaaatacgataacaaaagtaactctttgttctagtattagaagaagtagctttat

SEQ ID NO: 63034 - DNA, 2136 bp, Oryza sativa
  unsure (1)..(2136): unsure at all n locations
aaaaaaattccacccagtcttatcgaatatttagcagnatatatcagtatttaaatatagaaaanaactaattacttgtaaattacgatatgaatcttttaaatctgattgctccatgatttgataatgtggtgttacagtaaacatttaccaatgacgaattaattaggcttaataaattcgtctcgcagtttccaagctgaatctgtaatttgttttattattagtctatgtttaatactcgtgtgtccgtatatctaacgtgacacgctaaaaaatttcgttttgcttatcaaaatacatatatgtgtttgagtccgtttttaagctcgttcgctctttaaaatataaaaggagtcgtataagaaattattttaaaggaactcacattctaacttggggcgcttttagaaacacaacagttatcgtataagaaatcattttaaaaaactcgcatgctaatatgagataagagtcggactcctaattacaactcatgattttctaaaaatagtatccaaacaaattctcacaatgattttcactttagctaaattgtataattaataataataataataataataataataataataataataataataataaaataatattcacccattacaacgaacgtgtatttttcatagggtagtatcaagatttcagccgatcttacctgatttagccttatattttatgtgcttaattgatatgctagatccgccttttatattgagatcttcttgctttcaggtatattaagcttctcgtttgatatatattacttgctttaatatctttacatagagtggtatcggagtattagccgatacatgctaaatctatctaatcggctatgctatgagcgcttataatttcattgttaatatatatttcgatctaagtgatttatactgtctcgacatggcgatcaatctatcccaatcacttgacttaaatatatatcgacttaaggattatgtaccgttaatatctacagccgattgaatagatttagttctttcttgttattcatgactgccaatcgatgcaaagatgacatcggctcaaggataaatgatatgtcatcggcgactggccgatcggctatcggttatgaatttaactgctattttcctgtctttggttattggtgattgcaggatcaaatcaattggcacgctcatgaacctcaaaggcaagatttttggacctgcactggagttaagcagatctcccaggcctcatgtttttcgcatcaacacgcttttggcaagcccagtgggaccaagttacgacaattttctctcatggctgaaaaaccaccacagtcaccatcatcagcaacaaagactgtggtccctcctcagaccaagattccaaagcctacgggaaccaatgaggctgaggttaatactgggaatattattccagtcactggtggcaagctatcaccagagcaaaaaaggaatttgaactaatgatgcagaacgcacaacaacaattcatgaattcattcacagagactcggcaagggagagttgttcaaaaatacaagttgaagctagttgctgatgtccctggaacaggtccttctaaagatggtgaggtgcaaaaaactcaagtcagcacagatgattcaggcagcaaaggtactacagatggattgggcgacaaaggtgatgggctccaagatggcttggttgaagatcttggtgaaaataagcacaaaagaccaattgcagttcaaccactttccaagattgaatagactacaccgtgccacatgctttgatcaaccaatcgggagtgctgtttaataccctaccaacatggtgaaagttttggtcgatggaacattaacttaccatcaagcacaggcccagttatcttcaaggaggtgtttcccaaattacagatatttgataactggtaacaaccagcctggctccaaacataaccaccagttcaaaccgaccggcaccaggttttgggttcctgaaccaagccggacccggtgtaaggcaccataggcaaacaacccaatccttgattggtggacccaaagaccaagccacaggatgtgtggacaaaaatattcattcgggttggcaccaagggagcagg

SEQ ID NO: 63035 - DNA, 607 bp, Oryza sativa
ttattaccttaatacataaggaatcacgtaacttgggcctttatccgtataatatctatacatgaactacccctacttgtaatcagacaatccatgccatgtaggtatgtggtatccataatctcctgtttccattttcagagggcctctgaaaatcaaatattttaagtgttttcttaagaaaaccactctttagaatcacccaaatttataggcggtgtttgacagcagtcttagccatcttcataggcggttaaaaatttaaaccgcctataaaatgaaaggactgcacaaattattttttaatgttttgcacgggattttcttcgtgtgattgtgcactaatttcatgctgccttaattggttattttgggttcgtcgagatgaacaaatatatctgaaactctgaattggtctgtccggacctagaaaagtgagatggtacaatcattggttaacgatgcaaaacttatttcaaaaaataaaaaggatccgatgggggcgatcgatccaaaacttgttatctaaaagaaaaacagatccaaggagatgtaagcttttgaggtgtattaaagagactaactaaaaggtttgtgagatgctttg

SEQ ID NO: 63036 - DNA, 4708 bp, Oryza sativa
tttttagctgtattccaccattcgcaaatttgtccatcaccgccaagaccatcttcaacattcggtaagtacatgataatgtcatatcacttaattgatctcttcttatttgcaaaagttatgccatgcattcaaattaatgctccgttattgttcaaattgtagggatcgcaagagaaaatgaaaataattgcgttcctctttgttggtatgatttttgtctgttcatgcactaattgtgtgttatggaatatagaatcaggtagaccaccggaggatttgcaccagaataaaatgaggaatttattggccagcactgatagaaaggttgctcctggcgatagaattgatcatcggtgccaacgtatcaattatccaaattgcaagtgaatgagctattggtaaagcaaatgaggtaccttaaagatactgaatgtcagtgtaggaaataagatgtaattagctaggctggtttgtatttgtaatataaaattttatgcataactattcaatttagtatatattgttcaatcatattgagaattatacacttgtgatgttttgttggaaataatatgtctcatggtgttagacatcgtagtgcatgtggcattggtaggtagtactttgaatcaggttggttaacttttttgaatttggcaacaattcttcatcccacaatgaaaatatttttggctgtatttttattgttttatatttagatggtaagattcttattattaaataataagagagattacaaacctgttgtttaaagaaatataaataaaaaatatataaaaactaattatatgtaatatctttgaatgccacagaatataaagctgaccaactcttgcaaatgcaaaaacttatgaacaaaaatcaactaccttcattattcttccaacagaacaacaaaccgttgtcaccgaacaaattgatgacccatatgccatagatggcaccgctgatttgattattgacaaccgttcaggcgtgcaatccttgtatttatcgatgacctcgctagctggagagtcaccaacaaagagttaaaaatccttacatcgtaattatcatggaagatgaacaccatgaacctaattatctaatccttcaaagacttcattgagaaaaccctaaaaacatacaaaagacagatgaaacactggagtagcaggagatgtggcaagacacaagggatgggtttatgatgtttcccattcatttattgatttcctagaagtcatgattataaaaaaatattgttcctataggagattgcaagtattatttaatttcttaataccatggatgaggtctatattcatttattgatttcctagaagtcatgattataacaaaatattgtcctataggagattgaaagtattatttaatttcttaataccatgcaggacgtctatgctttgtgtatgcaatacccaagtatccaaatacacgcaattagctggaaaattaccaaactacacacactatatcagaatttgtgataaatatcaacaaagtctaccaagtatttgtatagaaatacatattatgtacacactctgtcccaaaattatatagtttgcttggttaaggtcaaattttgaaagagggggtgattttgattggttgagatgagaagcatatatgaaaattaaagaaaagataggtatcataggttgagatgtaagagtaggtggaggaaagatgtttatgcttagttttattgagggactaggtcgaatagttatattcgtgacaaaattttaatgaaagaaataagaaaattttgtagtagttaataagagtactactagtagtaaataatattcataaacaatatgtaaaggcaattggttgtggcctgcgagtcttcccttcatccttatgatgtcgctaagttttaagatatcctataagttcatccctagagttttccgtctatccctatttggtttgttaatatcattaatttattatgtaatgttttaaaaatgactatattgccttttacttggacataggttcaagattaattaaaagaataattctcaaaagttgaaatcaattttagctcttaaaaacagaagggatataattatttgtccccatatttgataacggaattttaaattttgaaatgcttttcagtttaatttgttgtctcttcaggggtacatttcacttctacctctatatggaaattttcttcgaatttggttgggattgatttaaggaaatacaaatttttttttggtataaggaaatgtagaaatgggtgatttgtgcaatttccacttttgaaatttcatcaaacttgatttatattcatttaaaaaaatgtttctcttttaatcccttctatatccattttgtttgtcatccttaagttgacagtaagattctcattgttacaaatccagtgccaccttggtataaaaatgattttactagtgagaacatcaattataagacattaaatggttcaaagttgtttcacccaaatttccgaaacaaatgtaggggataagctaaaactcatagaacaaaaatacagaaaaactttggggcccgcaaggaattttcacaaaacaatgtaagccctgtttagttccaagtgtgaaaagttttggcgtgtcacatcggatatacggacacaaatttgaagtattaaacgtatagtaataacaaaacaaattacagataccgcctgtaaactgcgagacgaatttattaagtctaattaatctatcattagcaaatgtttactatagcactatattgttagatcatagagtaattagtcttaaaagatttgtctcgcaatttacacgcaatctatgtagttagttttttttgtctatatttaatacccatgtacgtgtccaaacattcgatataacagggcgaaaagtttttgcatgggaactaaacagggcctaagacaactaacaccaagaaaatcacacgagcaagcatgaaatacatcaactgtatttacaattacaaggtttgatatactgattatataaaacaaataagtatagttaattggatatactaatatactacactgaaatgaaaattaagggcgaaatcttgcagaatcacacctttccaatatcatcctttgcgatttatgattacatcgacgaactctagctaagggactaacaccacttgctggtggtattcacttctaatgttctattgtattgatatttgcaaaactgtggtccatataatcgaagatctctcaaagtagattgaaagttattacttttattcgtgtttacaaagtgcaacaacactactcctctcaaatagatcgactaaactcgaaaccctaacttttctctaaactcaattctcacaaaatttataccggaaggaggcatcaactcccctctctatttatacctgaggtaggtagcctaaagccacaaactcaacttgtacaagaagtcctaatctccaaggaaacattcccgcaaaggaaacaaactttacaaactctaatcaaccaaactggacctttccaaattctactcttcatctcatacgcacacaatatctccaccgtatgccatgtggaatcttcacaaaccacgtacattgatccttagcctaagcatctcggatgctatcctgatcatctggacgtcatattctcgtaagttgactcccgatccatcagcggcaacactctctcgaatcacacctacacatgagtcaaccaagaaaccatatccgagcacaagtactctctaacttgactcaacatttgcacacaatagtattgcttacgcattgtatccatctagaagtcataaacatgaattaatcacgaaaatccaaagaaacatcctgaaactgaaactaacacagagccgacaggttagaccatcgggctggccggtttaaccatgcaacacacactggtctgaccggccgagtccacccgatttgaccggacccaaattgacaatcacaatcctatttacatcttccaaaactacttcgctaaatatctccaatatctacaccaattatccccaatacccattgctcatcatgaaataatgatcaaaacacactttgattttatagcatgatctcatgtttatatctacaaaactactatgaaaataatacagtaaactggccatatttttttttagataatggaattacttccggcatttgctcaacgagctacaaccatttattacaccaaatcgctcaaaagcattcacaatctaatgaaaccacaaagcacaccaatttaacgtaaagcaacacaagctaataagcaccaacacaagattaaagacccacaattattgaatcctcttcgtggacctccatctgtagttggcgaaaatctgcatgaccattgacacaagtttacgacatgcatcatttattagcttgatgtcttcatcacacctttgtagttgagcccaacactgaagccagtatgttgccctgaaaagtacatgtatataagatttttatggtgctttataataaccatatcatttctactaagccaagcctaacatattgcagatgctcctacaaggataagtttcttggttttttatcaataccccaagccaatccctaaaaatatgatatatactatgtggatggtataacccaaaagcaatatgtactgctctccaaataaatc

SEQ ID NO: 63037 - DNA, 3981 bp, Oryza sativa
ctgtccttgtggggtttgtttcttggtttttggtgttttcttggaaaaagctccttggtttcagtttgcttttttaaaaaaaataagctttggatttcagtgtgcctctttttttttaatctttggatgtgccatgtgtcatggtaggggtttgatttgggaggttttgaaatttttgtggatttgtgatgttttggtgggggtacgttttgatatttttgaaggggttttaaggatgtgttttgttgtgagaataagtaggatatacgattttagggtgataaacaatagagcgggtgcgaagaatagaaaatagaatttttccttgttttgagaattgtctttagaataaaatattttaattatattgctaaaaaggggaggctattcccctttccaggttagttgagatatattttaaggttttttgcatttttaggtggtgttttttttatatatatatatatatatatatatatatatatatatatatatatatatatatatatatatatatatatatatatatatatatataatttgtttctaaagagaggctattcaactattgctaggatatgtatagtctccctttataatattgttccatttgactaaagacgttcttatcccatatctcacccttttggcttgaggacatttcatatactactaattagcgtgttgaactttgtaccgtcaatttgcctttaatacatggcaggactaccaattcaaattggcacaatttgctacatcggtagtacttactgtgcgagatattttttgatgtatgacttgtcttcctttaccgtttataacatacaactttcctcaagttttatagtattttaaaattataaaacaagtctcacaactaaaaagaagaaactagctgaaaagtgcttgctcatcggacaagtgtttcttgtactgcagtaagaagaaagtagcgtgtgtgtcatcacgttacttcgtttttttagaagaaaaagggtatcataaagtatggcgcgttactccttttctttaaaagctttttaaccgagcatgaaacgtagcttataatgcacggcaatctcaaattcgccacctcataaaactctttgttttgatatctaaacgaagaaaaccgcactagttgaaagcttttttgcacttaacgcatagcccatcagagaagcgtttcaaaagaaaaaagatacggcaacaactcaactaaacagtggtgaacaccaccactaacgtctctacctacaattgagctataaaaaattacagtttgaactaaggatcccttaatttgtatggaaaacacagaaaatttagaagattacaaccttacaaagaaagatttctagaagggcctttttttagaattgaatcatttcctttcctataaaaatcttattaaaaatacatggtggtgtttgaatctcctaaagatgaagatgaagatgaagataaagattaagtatttcacacaaaacgaggtgataataacgtgtggctaatttggttttaattattacaaacttgaaaaatagattaatatgatattttagaccaacttttatatataaagttttcgcacgagacacaccgtttagcagtttgaaaagcgtgccacgagtatccaaaaattccattgcagtctatcactctcattttactcttagtcctactaagattttaggagaaacgtccaagggtcttccggctagcttcacaaagtagtgggctagacgacctgggttcaaatactcaccccttctaactatttgatattatgtcattccctaatatttgtgtttttttactgagattttagaggaaagttaacaaaagcttcaacctcttgaaaaattccattgcagtctatcactctcattttactcttagatgattgttctactaagattttagataaaagttaacaaaagcttcaacctcttgaaagttacattgcagtctatcactctcattttactcttaaatgattgttctcattttactcttagatgattgttcgtgtatttttcctgtattttacaattctttgttttgaatttgcattctttcctgtattttgcaatatttttgggcttgcattcatgttaaaatcctatatttttttggtatttctttgatttattttaatcattcctgtgaaattgaactctttgacttcagcctcaaatagtctatttcaatacaaatggaggaatccgcatcaatacttatttcgcgaacgcaaatgcgcatcaataccaatcgatgacctttgtcagtttaagagaaacattgtgcccaatacttcctccattcagcatgaaggaaaaaaaatactttaaatgccccttacgagggtacgctaactattgattgactgaattgacataaatttcagcaaaattaatattactacttcctccattcagcatgaagaaaaaaaatactttaaatgccgatatcccactgaaaaccaggccctcaatgttagccgagtgtttgcatcaagcccatcatatatatttgcaaatatcaattaacatcagcacatgctcccaaaacatttcgttcatgtctttaagcccatttgcttcatgacgctctgcaacggattaacaccaccgatctgattcaacaattgcttagggatgagattgttaatggtgttcagcgtgtccttgttgttcataacattcctgtccatattcttgggcaacttcttcttcaacttgctacacaccttggcgattctcttgtactcttccagcatgtcggtcacatctttcatggtcctgccagatcctcgagcgacccgtttaattcgtgattcactcatcagctttgggtttgtgctatcaagctctgaaaattaaggagctaaataagtttcaagaaagcaatctccattcaaagaagaacaaaaatgcctataatagctcacctgcatttgtcatagaatccataatagtcatgtaccgcttaatctttgcttggctttccttgtcatgtccttttggcatcagttcagacctaaatccaggtatcatagataaaacctgcaagaaagaattacacaatgcatgattaaattcgtaaaaaaagatttccttatgttgcattggctttcagtgttgatatctcgatgaaatactccaataaaaacaagattaaatactgaaaataaatctaacctgtccaataggacccatgttaagaagattctggaacagctcgtagaatactctgagagtaaaggttccttctatcagtctctgcataagctcaggttgttgatcagcaggcatagcatctttgatcttgttcactaagccagacaagtctcccattcctgacagttagagaagttatgtaagctcgatagaatagcaaaaggttacagattatacccaatatgtttttactaacctaacagacgactaacaaatggtttcacatcgaaaacctcaaaatcctgcatgtgttctccagttccaataaatacaacagggctctttgtagctgcaaccctggaaaagaaaaaaaaatgtcaaaacaggctccttataaaattttcactgatttactcaaggatatccgcctttttgctataattaagaaatcctaagagtaataatttaataattaataaacataaaatagcaggaggtggtttatgtaggaaatactaacgcgctaagtgcaccgcctcctttggcatgaccatccaatttcgtaacaatcacagcaccaacagaagcactctgtttaaatgcttgcgcctgatcaaacgctgcctgaccaatgctaccatccatcacgaatatcacaaggtcaggtttctgcacacagaaacacaagttaaattctcagtaacaacagtggaatgtgccttgatcaaaagatctttgccaatggttgtgccaatgtaaataccgttgcttctgcaacttgacgcatttcttcgaagag

SEQ ID NO: 63038 - DNA, 577 bp, Oryza sativa
aaactccatatcagtatacaatttagaactaactaaactttggaattaaaaaaagaaaatataagtagaagtttgagtctatattgaaatacaatttataaccttaatttataaaaataaaaaataaaaaatattgaaataagagtttacaatctatataaaaatacaatttagaaaaaaaaatgaaaatttggaatagaaataaggaatattggtagctagccgcgcagtttgcgcgggccaccatactagttgttattgaatacaaatccagaataagcctgtattcacttcgattgactgaatgaatgttctttgtttctcaaacaattgaaatatactgattgtcttgcaaatgtagcaccaagagtatgcgtgaagatggaggatttgaggtgatcaagaaggcaatcctaaacctatcacttcgccatgacttgcatataagtgcatatggtgaaggaaatgaaaggaggttgacaggtttacacgagacagctagcattgacaatttctcatgggtatgggttcagcgcccttttatatctttatggtttaaattctatttttaagctat

SEQ ID NO: 63039 - DNA, 1119 bp, Oryza sativa
cttctttctttatgcatgtatacgtgcatatatgatgaaaaagagagcaaaaaaaaaaaaagaaggatcgatcaccggtggggcccacaagtcagcattggtgtggaccccaccagtgacacgtggcaggaggaggggagtatgttagtactgaccgtcggatgaaggaggcgatgaaggcgtcggggttgccggacttgaaggcgcggaggaacgcccacatgctgcccaccatcggccaccccatctcccccggcggaaaccttgacctcctctccgcccccagcgccgccacgcgaacccagtcgtgcgccctccgcaccaccgcgtcgaccagcaccacgccgggcaccaccgccgccgccagcacccacaggtcccccgccgcccacgccgccgccatgcccatgccctccatcaccatcgagaacgatctatcgatgaaccaacgcaacgcaacgaaggaacgaaacgcacgcagagacgagtgtcgccaaatgctaagctcctccctctcaatatataccctggcgactgcccaattccctcctttatttatttatttctctaattttaatttacgcggaaaaaaatgcgtgcttagcttttttttttttcgagaggacaaaaagggctttacataattaatcaagatgttctcgatttaaaaaaagaaaccgataactaggttgatgatgtttgtgatgcattatttggcgattaattaatttgttctcgaaccctcaacacttaattactagtagtgagttttgtatgtatagtagctcgatcgatgggattattcatcgtgagcatgtccagagatcctttgtactttcttctttggactcttgtggtttggtttcgatccatctaatttatcgccggcttttcttgtaccctagcttaataacaacacagtccatcaattccagtgatcgaaatgcaaaactgattaaccatggttttgctctccatatgtatctagctcaattaatttgtatgtagcaacgactccatttacatggccacacatggatatattacgtatctcttctagctagtagttgcacggtctatttcatccaactcgtatcacgttgagtttaataaagcttg

SEQ ID NO: 63040 - DNA, 3631 bp, Oryza sativa
ctgattgcacagcctcttgaacatgttcatgagctctttgttcttgaattgcttgaagaaattagctcccatatgacgcatgcacacctactctgtacatcttcccaaacaccggggtatcctcgttccatactcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgctaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacaagtaatgttcctgtggtatttctgaacaccaggtagaaaacatgtatgcttggtaacaactgacactgtccaataatccttccatttccccttatacacgtgcactctccagggacaaccatctttttccttaacacaccgaacttcatattgcgaccggttcgacttggcaacccaaaactctctatgaagtgacactgcaaaatgttttacctactccttcatatcttctgctctactataaatcgctccctgaataacctcattttctttgtactcccatctcacactatcctcttcagagatgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgccaactggagctactacgcccccgtcctctcgtgcgttgacctcctccacagaagtctcgtttacttcagcacttgatccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaccctcagttgcccgacttactataacattgattgttatgtcacttgtctgtggatcaactctcaagcccttcattaaccatccttttatagaaggtacactcctctcagccggtctatcaattcccctttctgatacaataaaatctgacagatctacctcagttggcccgtaacggacatttcctggtccatggtaaacttggaatatttgtttgttcgacatatctgtcaatgaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaaccctaaaaatataatgcatttattcaaacaaatttttaaagaatacacactatttaactcaatagttatatataggatctatgaatattacctgaaattggcgtctgaatccggcagggcttcgccccttcttctcttctcctctcctctcttctttttttttttcactggaattgaggagagaagaatgagggctgggggctgggcaggaggccttttataggcagcgaggcctgccgcccggccagagggcggcaagggttttccagcaaaaaaccctccctccgtcaccgcccgttcctcccctgtttgccacgtcagcttgccgccccataggtgggcggcagggtctattttttgtaatttttttggccgatagattatttctgtaaatattttttaaaaaaaatctaaaaccgaaaaaaattcttgttcctttcctattctgatttctgatgcaagcggatcggacgcacggaaggaaaaaaagaaatcaagcgcccataggccatagctaactccccgcagacatgcatgtttccacctgatgtcggtgtggctaattggcgcgcgccagctggcgccgcctcccccgcctgatttttttttcttttctttatctttccttttggcgcttttttcgattatttttttaatctttagcacacatatttttaaatgttttgagttgaaaatttttaaattttgatttgtacattttcgaatcttagcttaaaaattttcaaatctggactcgaaagtttttaaatctcgagttgtaagttttcaaatctgagttaaaagtttttaatttttaaatcttaatttaaaaattttcaaatctggacttgaaagttttcaaattggagttgaaagtttttaaattttcttgcaaatttaaatttcgagtagaaaattttcaaagtgagaaagttttcaaaatttgtcttcaaagtttaaatcttaagttgaaagttttaaaatctaacttgaaagatttcaatttgttagtaaaaaaatctcccaaaaaaagaaaattgttccctaattactgtcattatccttaactaaccgtcagtgagttagttacgtgaacacgcgcaaaacacacgctagcggcacacgcgccagctagcttttccgcctgatgtctgcaccgtgctacatgcaacccctcatctctcctatctcatgtataagtactaagtgctacaccaataacaactatacgaaatatttagtcccaacgagtgaaacatcaaagaaataatatgaaatgtacaatattttgcaaatacatgatattgtgaaatatttttatatctcacatgaaacatagcatgtaaaatatcataaaatgtttgctaaaacataaaaaacacactgtgcaacatttacaaataaactagtgaaacattaggaaatacttgttgaaacatacaaataatatgatgtatcaacattttaaaaagatcgatcacaacataagaaaaaaaattagaatcaatataatcatgtgagatcttattttaaaagattagattatgaagaatacaacaatgcgatcgaattattgattggataagtgatttaaaagaaaaaatcattcaaaatttgctaaaaaaatattcacacctacaaaaatggagagagaggagtaaagaaaaagaagttggggcacctcgcctgcatgcatgtaatgaatatttgtgattccatgtgtatggaggaggccgatatttgtgggatttgttggtcgaccaattggaagtaattcccaaaaaactagagaaaaaaaggagagaagatggtgg

SEQ ID NO: 63041 - DNA, 32243 bp, Oryza sativa
cgccgcagcagccaccaccgcctcgctggccgccccgcgccacagctgccaccgccgacagcgccgcccaacgtcgccgccgccgaagctctccagatccaatggcggcggggccggatctgccgccgcctagccatgatacctcgccgtcaccactcccgctgccggcgaacgccacctcccctgcgcctgagagggggcgccaccgcagttcataattgttcaattgtacctttatccatgcaagagtatttgcacccttagcaacaacgggagactgcaaacaaatcaagaagttagtacacctggtcccttcacagatgaaacaggatgtgaaaaaaaaatcgctttaaaccatgtgtttttttttaaaattcagtcatatattcagatccaacttatatattgccaaaactgatagctatgttggatcgaacttagaaaatgcagctattgacattccaatctttctaaactaatttgttagtacagaacagcatatcaaaacaatgtacaaatcaccacaattatttgtcctgtgacgttttataaaaaaactagaaagaaagcctgtgcattcgtgcaggcatctttattatttttctaggacgatctattaaagtagtccataaattttgattactaattatctcattattgtagaaaacatgaaagtaatatatatgctgtcaaatgtataggtcacgaagattgaacttggatctatcaaatatcaaataataagaatgcatatgatattcacttataaatcacggttgttgctcctacttgtatgcaaacattgcaccaccaagctactcacatacacaacaatcaaggccctcacattggctcacctcattttttttccaataccttgaagtcaaggctccaacatatataaacataacagcttcaccatcaccaggcttctcactttaccatttacatgcccacttaggcttaccatatataaacaattaaagggctctcgcattcgctcgtctcagtgagaatcaccgttaaagcaccttgttggtatttcttaacaatattactagaaatataattatcatcaatgacgcaaaaatactcctgctatattatgattacaaagtccatccgcaagcacacggatataccattgtagcatttcaccagagagtattccaagggtatcgtatttatttaatcccgtgagaagattataattgtcacagcctgaatttcgtttcagaatttataaattatttaataaattattcttagattttttattaaaagttcattaatttacaagtgaagttaaatgtggaaaatcaaaatttctaaatataaagcatggttggatttaatttgtattaaattctccatgattaattatactctctgaaattttctcagatttttcagagctcaattcctaattttaataatacaaagaacattccagtaattattcacattttaaattaatcattaaatgagctggtttcaattttattaaatacttagagtgtccaactatgttcaacaattttattggaattatttgagcattggaattatttttaaaaattgaaagatcatttcagtgattaatttaattgggaaaagtaattaaatttccttttccttttcgggccgaaacaggaaaagttcaatttcatgccatccttccttcctctctctggtcggccttttctttccaaagtctagcttgtgtccctcctttaatcgggccaaggaatagaagcccagccgaaagtctgctttgcatcccttccgctacagtgcatcttcaacctctagacagatccgagccagccgggtgcacggctgccgccgcctcctccttccaaatccgatctccccgttgtcctctttccatattagttgcgggaatggaatcctctcaatctgctctacaatttccccaagaaatccccaaaattttctatggaaatccattccaatttcgcgaatcaatctttccttacaccggcgaagatcctaaacttttccggagcttttcccgtcgatgtgggctcgatcccggactcccatggctatatatagagccccctacctctcctttttgggccgccacctcttccctctctccgccgtcggcggaaaccttctccccgcgagcgcctactctctccgtcgccggtagccgctccagccgccatgcgctgccgcctcggtcgtcgccgctttgcgccgccacctccctcggctccgcaaagtcgagttctaccccggccgctggttattttgcgccaaaatccaccggagctccatcgtcgccgtcaacccgaagttcaccgtcgcgttttgatctccggcgaggccctgctgctcctcccgtcatcgccaagcttcaccgccacctttgttggattcgcagctgcgaggagaagcccgtccgtcatctgtcatccaccgaagatcgccggaaagtcgtcgccttcgttgaccagaacctcgccgcccttcggagctcatcgccggtcatctccttcgctgtccgtcgtcgcataagtgttggtaagaatcgccgtcaccttctctacctcccggtgccctccatttgcgttattgtgccgtggttcgccggtaaccgctcccatgccgttcaccggtgaggtttttccctaggaacttaatccaatctaaccaatccgttgtctatctagcattgtcgtcgtctccgtgtgttgccgccgggtcgccgtcgtcatctctccctctccgatcgctttggtttggtgagatttctatctgtgttccctcggtttaggttttaatctcttgtttgtgtcgtcgagtagccgcgttgtcgctaccacgccgccgtgccacgcttagctgctgccctagcgtcgccgctgcgctagccctctagccgccgccgtgccgctccctgccacagccgtgctgctgtgctgtgcgttgccgcttgccgctagctgccgtttggccgctgctcgtgcgtgccaagtcgctgtgtcccgctactgcagctaccaagccacttgctgttgtgccgtgtcgtcgctgctgtgccgtgttgtagccgtgtgacgcttaaacctagccgccgctttagcccgttgctcggtagtcgagttatctagctataggtgcaaccctaggttcctaccggcctatcgtttgccgtaccagggctttaccgttaatcgtgtctagctcactagtttagccgcagctgttgttgagtcgttcgcttgtttgttcgaacgaggtgttccccgtgcttcgttcgttcgtccgtgtggagtcgtcctttagtttagagccgttcagagccgtcgttccgttcgccggtttcggttgatcgtttgggtgatcccgtgtcacgtagaatttactccttgagtcggtatcttgcgtggctcgcttgccagatcaatccaagccatctgatcttggtcgactcggtcaaaattaatctcagccgtccaaaatcaatataaatcctgttatcccttttcaatggcatattagttctttttactataagtcgtctactaaattcgttccaataatttccagaggatgatttagtcttatatctcagttataaattatttgtaaattgtttaattaatttcgaatattcttttctttaataggctttaattggaattaatcttataaaattcataataattcatatgaagtcggaattaagtggttcaagtctctaaattcatctaaattcatgatctacatgtttgtttactttatatgtactttttatttggtgtttattagtctttttcctcgttttgcgtgttagcttgtcgtttccgtcatttcgaagattcgcaagtgcgtcggaagtgttccagaagattaattgaagaccgattattgcaaagcaagtcacacagatcccaaacacaattcctttgagcatgttgatcttatatttaaattctctatttatttcaactatgcatttattttcgaatgtcaccgggtggtgtgaacctattcctttgttatggccaatttgcattgatcaccctatttcttgattaccttgggttaaaatttgactagttggatttatgtattggttcaactagatgtattagatataattgcttagccatgcttagaaacattagcatatgattgggataactaatgtttcactattacctaatggtggatatctaatggtagctcacgatggtcaatcgtgattggttaattaattaattgccaattaaaacttgataatggtgggttgtgagaacatggttttgatggtcgtgctcatgacaattaaggaccggttcacgagttttggttgtgaaacattaaccgtgccaaccacaagccagcatgagcaacagctttaccttttgtatagcatggtttattgcggggcaccagactgagaagtggcggagataaccccacgggggtcaccgaggagtccatgccttattttataaggaggtgattatgatccaggaatggtgcgctgtggtggattgtgttatgcgaggggtactgtcacagctcctttccgaggtactgtggtggtatcgcggcgcatggtgacatgtcgtggggccgtgtcttgtgggtacagacatctctggccagagtaaaattattcgaatagccgtgcccgcggtcatgggcgggtctaacaatgtctttcgtgattagtctcacacctctcacaataattattgatgctataattggtaataatttgcttagctcctggtttggaatggtacattcctaatttggagatagagctgtacaatcgggtatggttgttcaggtttggttgggcctgtgcagcatgtgtgtcatgttcagtgttgattaatagtgatgattaattactttactgttttacaattcttaaatgtttattaaatgctgcttttgcaaatgagcctatattataccatcctttggtatccttgtgcacttgtatatttgctatgtggcttgcggagtattccatgtactcaccttgtaataatcaatcaaacctcagttgaagaaaagttgcgaagaagaagacgtttggcttataccccagttgagctgcctgtgggagtggagccggagcttcgctagaccgtaattccaatgttgtttacttttcttttgtaagtatgtaatgttattattttgatgaatctgtatattaaattgtcagtttgtgtatcttggctgattcctggacgaggattttatcaaacaagttagttcagaaattactagtgaattcctgggcgtggcaataatagagagatccatactaataatttaaatattacttgtaataaccaaagtctaggcatggattaatataattcgagggtagagtgacactaagcagaagtatttatactcattcataattatctaagctaagtggatagaaaatagaaagatcctattcctatacttgtagtatacatacatattatacatacatcctagtcatatgattacttagctaatatataccctctttccgatgcccttttggtgcttcgagaaaccacccctgattgcggagttccttacgataatccgtcatgaccatccaactggggctaaatacggaggagtaccctcaccaggaaattaacttacgactatatacacgcgcggaggaatacccgtactgagctgtcaccatcagtggcccatcttgcttccacagcatataaccccaaataatgatatccagtaatctaaataccacgcttaaattaccaaatactactctaatatcatcgtcatgacatagagtcatagtaaatacaatcattatacccacaccattgcatctcccagataagctagcatcataataaatataacttggatatataataaagttggtattcatatactcggaaagtaatacaataccaaagtagtataaagaagaatattctaaagaaagtacaagtcttaaaagagatagaaaagctactagagccatacccgaattcttccgaagactccgaggactgaagattctattctaattctattccactatactctagagactatactaaacttgagagatgtatgaagcttcttgcttgagctgtgtgggaaaagtgaggaggtgaaggctttttatagctctccaatgacggttatgacgattggaatggccagaattgccctccaaccgtcattggggagtgatccaagccgtccagaagaagccctgcatccaacggcggcacggcgggttcagccgaaccatgggctgggaccagcctggcccaaattcggcaggtggcatcctcttttgctcctctccgcagacttatgaattttggcccaattggttgtgtcatttttgagttctttgcccattcattgataagtctaattcttgacatcgcccgattgattgatcgcctgttttgatgtcgattctcctccattttatattcattctctgcaagaggttaataatcctagtgctagtggaatatttattatttaaacataaatatgtattgcaagcatacctagttctcctctatttaggtaatattgacgggcgaaactaattgctaacgactatcaacacacctatccttctcaatttgtttttaattttataaagattagatctaattgttggaaataacgggtcgaccgatttaagtaacaatcaagagccagatgttcttatttttccttataatttctataatctattagtgctacatggtggttcagaagcatttgtagtcccacgtgatggcttgagagcgtttgtagcaagtttaatggaattttagtatataatagatccgtgaatatttaaatttgggtgatttttacttggctttttaatcatattttaaacttatgatccttctctcaaaaatctatttgggattgttttgaaaattggttatgattttgttcatgacgatccttaaaacacataaattctaaatttataatcgattaaaattgaggattcttgaatttacgacaaaattatttttcaacagtagagttggttcctatgcaattctttgttagtacagaatagatcgagttgatgttttggcaatttcattgccctgatttcctagcttgcacaacccctgccatgctcggacttttctctaatttgttagtcttatgtcattctttgttagtacaaaatagagttgatgtttaggcaatttcattatcgggattccttggcttgcacaattccgtgcattctcactatggcccattgtgatcagacttgttctctaatttgttagggcctcgaaagaaatcttaggagagctaaggatattactgttgtcgatagtattgaccatattagataaagttatgttataataacatagtgcaaagcaatgttgagataagcatttgagttaaagtttaaatcatctagatgatcatcattagcccacctttacatgttatttctcatgcaaggtcgtcttttcatggtatgatattagacacgctctctctactagataacaattcttttcatatgaattttttattaattgttgtttccatcgccgacaacgtgtagccttggaaatatcctaatggaacattctagtagtctcattggttcatgtagaatagttttcataccacataagttaaaaatctaatgcttggcacctgagttaattaattattgaggattgccctacctcatgttttcgttagtatgcttatacactccaacgatatctttattcatttactatatttttataattttataatataaagatggtgccttgtaaatccatgtgaggaggaggggtagtgggatgatactctgtttttttttagttttttaaagattgatctagtgggtgaaataatagttttaatgaggtcggatgcttcattcttttagaatttatatgatttttattaatttttaagatgtgatatgtagtggcttatgaatgtagaatgatagatctaatgactgaaaataatgggtctaccgatttgagtgcaaaatgatgatggttagatattttttttatagaatttaaacaacatttcttaatttttaagatgtgatgggtgatggcttgcgcctagaagatatttaatgtacaaatttatatatgtagaatgatttaagatgacataactgttgtcaaaatttttctatgttcaatattttattttttacctagcaaaataaatgtaatacggattttaaagtatttatttaattacaaataaaaacagtatagataactgaaaactgtatataaattgagaatcatgatgatttagctaattttaaattattttatattgagctgttagaaaatagctacgagaaaagggaagagcaaaaaaagaaaaagaaatacgtgagcacatatgcacggtgtgcacgtacggcaggggaagagaagagaaaacgaattcattgagattgatctaataggccgacaggttggtttaagttatctattcccaaaaattgatctaatggttaaaaataatgaggccactgatttaagtgaaaaccaatggtgagatgtttttctttttttcaaaatttctatgattttttctattttattagggcgccacgtggcatcgtaggagcgtttttagagcaccacatggcggcatgagagcgtttataggaagattaatgaacttttagtatataataatagatagatagatagattttgaacatgagcaggtctgccaatgccaggttttcgtcctctttgttttgttttgttttgttttcgtccactgatatgtttgttaaaatcttcttttgtttcttactgtgactggaagaacattagtagagctttcagattggtctcctgaaaggatctaaatatattttgaggaagcacgtgaagctggatcaattggagtgaattgaaccttgggtgattatttgggagactttcggtaaataatcttgtattgctgttgatgttataatgtttgcttaatgttcactagctgcatggctttcaatgtgacacttctacctgcatggcttgtgccaagtttttacaagatgttattttgttgcacataatgtgtaattcaatggatagatatcctcatcgtcttcaagtaatcagtgcgtttcagctgtctcttttacttgtgagcatgatgaagccctttaactacattacccttttactattcagaagaaataatacaatatggtctagcccctatctttcttctttgtatcaaggacatgcagtacgtacatttacatgttcttgaagaacaagtgtaaaacacatcaattctgtaatttcagggaaacctccgtacattgaattttggtcagtttgcaaacaacgataaatggtcaatctctggtttacaacaggaactcttgcattatactattagattttgtttctaatagctgaacaattattgtcctaaatatcagcacctgtatctaaagctttagtagttaagaaggctcaactaattattctgttgtatgtgacgtggaatatatcttttttccgtgcggctatttatttgtaaccgtatttattgggaaagagtttcagcttgcatggattgctttatcgatctgcttcaatcaaagatccatctacccaagttgcatatgaaccaaagatttcatttgtgatttgcattgtctgtaactgaaataaaccataggttgctgatccacaccaaaaggcactaatgtgatgaaatatagaattttctcggagatagattctaattaatcactcgagtggatgtccacccgtatagtgatgtcaactaaatgatcttgaaaaaatttcaaaaaaaattacaagatagattgatatataatatattactccacaaacatgcaagttaaaattcaatttttataagtcgtaacaaaaatcagatttaactgtaaatatacgtatactatttagagtttgatttgctatttttgttacatcttgtaaaagtcaaatttgaacttacatgtttgtggggtgatacatctatcttgtcaaattttttgaatttttttcatacccatttagttgacgtgcaataaatgggtggatgtccacataggtgattaaaagtgtttcccaattttctcaactattttcagcactgtatatctgtcaccaactgagatattgcccatgcatgatttcgtgggcatcaaagacagaatctgctttccatggtgagttgataaagtgtaaaatgaattattcatttcgggaaggattgattgctgtttgggtaaactaatgcatttctcttatctggtgtgttttaccctttacctgttgccggatggtccctttggaatgttcttaatcattgtttttatgtgaatcatatatccatctcattgtatgtttaattgttaaaacataaattgtattttaactgtttaatttgtatcatcaccaaatatggccatagcaatagcacgcgcatgttactaggtaggattggtactaaaatcttgtaagagcccggtaggtgctttgaacaaagagtgataaggagtgcatgtattcacaatgcatgtcaacacatttggactccagtgtgctctccctctttttttttcatgacgcgctccgatatgcatttttcatgactataagtttggtgaaatgctcacgaaaagaaaagaaaaaaatactatggcaccaaaataattccacgacaaatctagtggtactacggatcgactagtctgaacatccatcaggctcgtcagaactactattgctgcatactgtccgggaaatacatatggtcaccacagagcaactcgtcatcgacactgaattcgcacgtatccaaatcaaacgacgagaacgtgtcccatccgtcgtccaccaccatcgacgacgacggtgttggcggcgccgacgaccgcatctgcctgagtccatcaacgacggcgcggaacatcgacagccgccgtgccggcggcgcagaacggatggccgccggcggctgctcccgctcgtcgtcgctcatcgtcattgacagctgcgcctgggcccccgccgccatcgtagccgccgcaggctgccactgctgacgatgcactgcattattggccgtgtggccgccggcagtggagctgaacctgaacaacaccgcgtggtgtacttccgctttggccggcggtggctcggtgaagacatgggccggcgtcggggccggcggcgatgggttgcaggtgtgcgggtgaatgtaggtgaccctgtagagtggcgggtcggcgtcgttctcctgctgcaccaccttggtcgccatgcaattcctgtcgtcccggtaagagcatcggtagtatagcctgtagatcgcgacagttttacaccaacgtctgaaagattggtttattcgtgacagattaattaatacacacgtcaggtaaattaattttctgccctgggggctattcgagtttttggtagtagactagtaggtacgagtaccaaacatactaaatacaggtacataatctagattgatgaaatgtgcaattagtacgtgcaccaaagattagaaaatattattttttctttaaaaacattgtgatataggtgtgatagtgtcatgcctcatgatactcgcggtccatccacaccaaaattaacccaaattgaaatcccggactacacaattatggctgtgtgcattcttagtgtagagatcaaaagatatactaattaataaagatgtggttcatacctgggtgatgacaaagattggtacagaatgaaacttatgtatatttagtgaaaacaaatacttatatatatttggtgaatggtgatacataaaagtaagaaatttcattccggagattataatatcctactcaattctttttgtatatattacttcaatgccacttttctcatacgggcggcctctcaattgtttagggtttagttttaactcggataacacaatgggcattatgattatacgtgagttaggattgtaatataggggatgttgaaaatttccaaaacgtaccttgggaacgatgagttcttgattttcttctctccatacttcctccagagatggccatctgtatgtggtataggcgtaaggttgacacatgttggatgcccttcctgcatcctgtaatagtattacggaaatatgaaaacattatctaaaactagaaaggtagcccgcacgttgcgcgggcatatattatagattatgtttgaagaaaacttaaaatgagtgttgctttagataaatttttcaatctatttgttagcttttaaaatatataatatttaatacattcctataaacaattttgtaccatctcttcattatctataaaggagtttgatttaatttgtttggtgacatgtggtgttttgtcttgtttaatagaatgtttaggagctttcttttttttagcaaatcctaaataactattattgttaatgaatatgttttatgtgtaccaagctagtcctcctagttggttcatattgacgcaattttttacatatttacatataaatttcaaaagttattttgtagacctccatccctgatatatgcgtgatctatagtatcttttttttaaaaaaatgttatggcaatggaacatgtaatggttgttccaattttaatgaaaagtaggaaacaatgttcctattaatattttctatttattgttttattttatactacccttattttaagtttcaaacataggcgttatgaatagagcaatttatattagaaataaaatgtgtggcttaaaaattatttctccttttagtttgatagctataaaaatatcgatgaggggcagaggggaaagtgcgaaccgaggagtgaggagacgggtagtgttgtgtttgtgcgcatgtgaggagaggatgtttttggggagggggttctctcctttttttttaataaatgatttaagtgaaaaccaatgatttattttgttcataaaatttcaaattattattttgctaattattaagatgtaacacatagcgacttaaaatttttccttcaattcttccttctaatttttaagatgtaatacctaattagaaaaataattacccctcttttgagatgagttaggccgggaatattacttcttttgttctttgctttaacttcccaacttattcctctttttttttttctagggcacacttttcaaattgctaaacggtatgtttttttttaaaaaattctatacgaaagttgctttataaaaatcatattaatcattttttttaaaaaatagctaatattaaattaattatgcgctaatgagtcgcttcttctggtgctctagagattaggtcgtaacccatggaatgaacacagcctagttatgttcattttactcttagaaatgtagatctaaattaattatcgtgaagttatgtaggatgataaatatttattattattgttttttatatttcttctaatagtttgaaatgcatgcaaaagttaaaaaatatagcccaaaagtaacatatttattttcatattttagtaatagtgtaatttggtctttaaccgtgaatttggtcataaagacatcgatggataaaaaaactattatatgatttagatatcttagatagttaatattttaacaaataaagcatgaagatggagaaagaattaatggaaaagagaaaaagggagaaggcgtacgtacgtatgtacttaactacctaatgctgggtgggccgagttcaggagatgatatttttttaaaaaaaaaatccaatggttgtaaataatgggtccaccaaatttaatagaaatcaacggttatttgttaaagtgctatgtggcagtttaggagcgtttataggataccacatggcggcttaggagtgtttatagaaagtttaatggacttttagtatataatagaagataatagattttcatatgctagcacaacttttggaatttgtactaagatatgtatacggtacaagtacgtactgtcgtttatattgtagaactgtacacgtttatatgatacttgttcaatatttgttcaccatccaaacaaggaataagtaatgtcaatgaaatcatggaaaaaaaaaagaaatcttggtgatatgtatgcatgtacacctcctatgaagtgattattcatatatagataagggtacattttatttgacaaataatggacccacgttatataattttactctaaagtaattaactacttcaaaagaaattcataaattgtaaattaggctcagaggatggtaaatttgaaaaggttgtggaatataatgggcctactctcgtttatatatagttatgtgagggcatgcacaataataatataatgcacacctttcgtgtcaaaataataataataataataatgcacaccactctaaatatatcctcaaatatgtcatatcaaacaatttgccatataaaaacgggctgaaacaaaagggttttataggaaaactagaacacatatagaagacaagccagatatatactaaccaagttgctagaaggccagtgaggtaagagcaaggacttaatcttaaagacgaaacaatgcgtataacacgatagtagatgtttattcaatgtgtgttgaataaattcatcgcaaatagttttaagcaaggatttcatgtatataattaaatatgttgataaggttttaggcccagcgtcctccaccttcctcttttgttatatttttctatcttaacatcttttacgatggtctcactagctagtatatatatatatatttagataatggaatataaagctagtatatatatatatatatatatatatatatatatatatatatagtagaaatgatctacatatttcatcatttcctatcttattatagtaatcccccactaactccttaagcttaacatgcaaagatgtcacatcatcatccactaatccactaattaacaagatgccacatcatcatccactaacaatcatcacatttaaacatcatgcaaacatgctatgtctttatagtttttataatttaagagcttttcaaatacaaacatgttaaattatcatccaatataattcacataatgtttcaatatacatcttattatgttttatgataccctatatacttatatagttcatcctcacttagttagtgattaaatgattaatctatggtccagattatctttctccttttttcctctaattaagtcatatcccatcaattgtttttatcctttagatgattaatctacagtccacacacccaaactatctccctatttttcttcttctataaagtcataccaccttactttttacgtttgaatcaccattctacatactatttaaatttaaattatcataaaccacattaatttacttaatatggtgttatctagctatcatagctatcttacacgttattttttttattgttatcatactaaattcccgcagcaatgtgcgggatttcacctagttttctttatctcaaaaaaacccacgtgaatcaatagctctggttaatgtttctactaccatttctcctgcctactccctccgtccccaaaaaaaaaaacaaaccttgatttccatgcccaacgtttgaccgtccgtcttatttgaaaaaattatgaaaaaaattaaaaaaacaagtcacgtataaaatattaatcatgttttatcatctaataacaatgaaaatatgaattataaaaaaatttcatataagacggacagtcaaagttggacaaggaaatctaggtttgccttttttggacggagggagcagtacgtagatctactttataaatttgttgaccactctattgtcgcacactaattaatggtggtgtatatagaccgtcatatttctccagtagtccagctgcacagcgatcatcacatctgttccattagcagtccagcttttgatatcatcatctgttccattagcagcttagcaacgtatcctaattaagcagtttctctatgtaggcaaacttatcaaaatctcgattatgtcatacgattttacagcttgacagtacgtctaagtgcctaattttatggttcagtacacataggtagaaaaatcgacgatttacaatttttatttgctcctacttagaacttcctatttcgatgtagtatcacgattttaacaacataccccctctgtcacgtaaagaatcaaatcttgggaacagattcatccccagaatttaattctttatgggatagagagagtagatgtacagaaggcaaaaccatcacatatactagttatccggccccttcacaacagcttgtggtcctccctcttaattacgttctacatgtagttagagcaaggataatagtagagttcactttctattattagcctatcttaaagccaacatatataggttggctacaattttcttctcctctctccatttctcacttatacatttaatatatttgttttggagcttgtgataagctagctcttgcatgatattttatattatatctcttctccacgtaagcttacagtagagttatatctcagtattatacttgctcttattagccagcacatatacttagatctgtgtgtatatatatttcaaaatactctaattttatgtagattgctgctattagtagtggagaattaaatatttaattactttgaatactgtgccatataatatgatttggaagatctaagccaacagtataatcacatcatttatgcaacgtgcaacacgtactgtcctgagaggttatatgtctccatatatatactgtgggataccagctcctcatgcacaccaagagccaaagtactcatatataactgaaaattacactgtctgtatagataattgccacttgcctctccatatataccacttggggtgagttgagtttgaattagaatgatatatatatatatcatatgtgggggcctaattatttagtgctaaaattatccggagcacgctgtagatgcaatgtatcggacataatttgttttctgtactcattaaaaaaaaggactatagtagtttgtaaaattgtaaggtcaaggcacacagacttcactctttcagcatattcaacttggacaaactattgaattataatcgctgctgtccagcaactaatatgccctacgtcacagattaaatattgtgcccctaataactccagcgggagagggagaacctgatttatttccctgagagatgttaggtgtgtttagttcacgccaaaattggaagtttggttgaaattggaatgatgtgatgaaaaagttgaaaatttatatgtgtagaaaagttttgatatgatggaaaagttggaagtttgaaaaaaaagtttggaactaaacaaggccttagttgaataatattatagtgcctcctcattgttgaatattttggagcttcagcgttgcgggactcttcagcttgaagattctgttaataaggtcctcgcatcgagaacacactttgcagtggtaatttatgtagtgttagatctgcagcgcattgaggttatgggtgtgcatgacttcatccatgcatcaagattcaagattatgtactcaccggctatatgtttcactaggaaattttaacgtccatagattttctatcatggtctctatatctagtgagttagtgtaagtaaatatgtgtattcatggataagtgttttagaacatatatgggagtttttattaaactcggctaattaattatacgtatagtattaagatgatacaatcgcattgatcaaagatcagtcttaacacagctgcatagctaagatatgcacaaaaccaatatgcatatgtatatgttttctcgtataattaggacgacgaaaagaaatagggaaggaaacgaacggcattgctgctcgatatgcatgcagaagacagctgatcatcagagaaaatcctcaaattattaccttggcttccgcgaggagaacggcgacgacatgggcgtcggcggcggctggccatggacgccgccgccgaccggacgtgggctgcgagatgccgggtccgtgaactgcatcgtctgcagctggtgacgcgaggccattgtcctcgcgtgcagactgcagagactattttcaggtaaatccctgcacctaagacgatggagagcaacggcaggtctatatgtaggtgaagaacaggagttgctttgatcgatgcacatgaggaagagtgatggaggtgtcaccagccatatattaatgttgcaaacggaggatataatattatcagtcctctaacctgattcttgttcacatattgcattagctagcatatgaggtgtatgcttacatggtaaaaaaaaatagaatagtacaggaagatggtatctgctcccatgattgtgtgttaaatttatgacatatgcacatctgaaaataagaagtctctatccatatattgcattatcttgttaaaacaaacaacttgattggggtgcgtatttaggactatatatgcatgtcatcatgtcgtgaattattattgctacaggatctacaacatggccaacaagtctgctctcctcttcttgatcttctttatttaaaaaaaatacaataaaaaaccgttaacatttggttgttcttcctcttggagtgtgggatttcaaggagagagagcgagaatggcaatttattgttgggtcagaccactccatggtacacatggctaaagccatgatggcaaagtttatgagaatgagatcgaagagcctgggaaaaaggaaaaaaataaagtctatgagaggacagaaaacgtagttgagcagtcatgtcgattgatcgaactaagcaatgctccgagtggatttagacattatctcgaatttcctatgtttgttgttgatctgatctagctagatgctactatatattgaggtagtcttaaataagacattattaattaattaacatatatcttaattaatctaggcacacaaggattgggaagaggcaagcaaaactatggataagggttagtgataccatggagattatatatggtggagatggaggtcctacttcatagaagttcatcaaagccctggtggaaagggagaaagtgtagtataattttttttaaaaaaaacactggaggggaggcctccgctgttaaattaaactttcttgagaaagaaaagaaaaacaaactagtctaaatatacaaaattacattaaccgaatccaagtcttgactacatcctaagcaacaaaagagagaagtctcccctaaagaagctgcctccaagaaagtaaagagggtgacttgttattaagaaaaataaaaccatttctttgcttacatatgttccaagcccctacaagaattttttccataaagcatcgaccttgatagttgtttctggcctccatcatcatattgtccatgttcaaagaggtatcccaaaatataccgactctgattgatagcatagaacactgtgaagtgtatttcaatcctccccaaataaaaatccatttatcactttctagtgactgatcaacctcacttatcatatctgataacgactgaagttcatcatatgcttgcggggagggagagagagagagagggggggggatagatgaaagttattctcaaattgaattgacaaagaacactggactgaaacattcctattaaacaagaacctagataattaaaaggcaattaaagaaccaaagccaaaaacacttgccaacatttgagccttatcctcactgacatttattagaatcaaacaagatttatggtaattaaccttgagcccggtcccttgtgcaaaagtctgaagtccggtcccttgagcaaaagtttgaagtaaagcttttagagtgaataactcctttccacagactttagaggtggaattgtgagacaatatttatttatgttttcacaatggaaggcctgcaatatatataaaaagttatgttgttttcgttgcccattgctttcggttgagggtttcaatatagtctaactataattttataaggcagtggttgacacatggccttggagatatagtactagcaacaggtgtcattatatattttgtattcattagagtgtgcacctagttgaaaggaaaattaatatacatatatccaatggacaatagttaaatacaagaaaacaaaacatatttatccatgttatgatgtttgtgatatatttttcaactttttgtattgcgcatttattttgtatataagcctttagttgcaaattagacgatgctctgtcatatgtgtttagcggcgatattgtatagaaataattaaaataaatactaaaaataggtaattgagatccctagagaaagaaacaagatatagaatgtttttttactctcgactatgcattaaacatatgtgtgaggagaggatggaagaaagacagcgacacatcgttaaatgcacatgacatccaaatgagctcaaggccatcagattcagtcgattagaccttaaggctgccacacttgtccactataaggagagatggaagcaagacgttgtcaaatgcacatgacatccaaacgagctcaaggccatcatatccgatcgattaggccttaaggctgccacacccgaccactataaccatgaggccaatgcattcaaactgctctctgtgtgttttagatgaatgtggagatggcggggcagatttgatggcacattcggaagtgatcataaatgataccggcttatacttgaagattttttttagagagaaggcaattttcattacccagctttggggagaaagccaaaagttacataggtctgaaaaaactagaaggaaaaacaggactaggagacccaaccggaacttccaatttccaaaggtgcaataaaacaggaggatcaggccccaaccccacacatttcagagtgcttcccatagcacaaagctacaactattacaacctgaaaagaaaaagagctaaatggtattccctctttccctaaatgattgacgccattgactttttaaaatatgtttgaccgttcgtcttattcaaaaacttttgtgaaatatataaaactatatgtatacataaaagtatatttaacaataaattaaatggtagggaaagaattaataattgcttaaatttttttgaataagacgaacggtcaaatatgtttaaaaaagtcaacggcgtcaaacaattagagatgaagggagtatcatccagtaggctatagaagctcgtagctgcgacaccttcatcatccgcctagcttgctccattcgtactagaagatatttttgtgcaggtttacctatactttatttcacgcgtgcaaacgagactattttatgattttttaggtcatctactaatttgaaaaatgaactacagtttcactataggaccatattgtgatttcgatgccacatcacctaaaaacacaatgaatatagactaagtttgaaatgtgaacaggtgtttatagtggaaaaggttgagtaataacgtcgtctggtttggaagttctagttgctttacatttttttgaaagaaatagttgctttattacatagtagtttccctgctacatagcactatatacgacggttcacctagacccagtttatctcaggtgtttcttcccacctatccaatacgtttgttcctttctctcatttttcatacacacgcttcccaaattgctaaacaatattttttttcaaaattttactatataaaacttatttaaaaaatcatattaatttatttttttcaaaaattatctaagacttaattaatcacacgctaatgagtcatttcattttttttagggtttagctcccaaaactaattgagaagagactaaaacgtgttttagggattagctcccaaaaataaactaattgagaagagaccgaagataagaaataaagtgccggtattaaacaaaggcacataatagttgagaagagaccgaagataagaaataaagtacgtgctttgttgctatataaggcaaattttaatttttgagctactgaagacgagtccgttgggaaaaaagagcgaaagtcactaaaatattagcatgcaaaatggctaaaaccctcaatagtttagctagctaaagggttgctcgatcggaatctaaggccctatttagttcccagaactagcattttcacgctgtcacactgaatgtttagacacatgtgtggaatataacatgtagacaaaaggaaaaaccaattacatatattgcgtgtaaattacgagacgaatcttttaagcctaattgcgccatgatttaacaatatggtgctacagtaaatatttgctaatgacggattaattaggcttaataaattcgtctcgcagtttcctggcggaaactgtaatttgttttcttattggaatacatttaatacttcaaatgtgtgtttgtatatccgatgtgacaaccaaacctaaaaattttccccaactaaacaaggcctaacaacggtgatatatatatatatatatatatatatatatatatagcgccatagtccttgtcacttcacatgcccttgtcattaattgtggtcattggtatatatattgcctctttcttttatgattgtcaccttgtgtggtggttcacatcatcatgagatgaggatattgtcacttgcaccatatatatactccctccgtcccataaagctttatttttgaatttctatatccaacatttgaccatatgtcttatttaaaaatttataaaaaaaatataaaaaaattaatcatgcataaagtatcatatatattttatcattaaaaacaataaaaaaatactaatcatataaaatttttaaataagacgaagatttaaatattatataaaaactgaaaaataccatcttcgtgggacggaaggattagttgttagtgcttacccttccggtggatatatactactcccgccgtttcatattgcaagactttatagcattgcacatattcttatagaagttaataaatctagacacatatatatgtctagattcattagcatttatatgaatataaataatgctagaaagtcttacgttgtgaaacactcatgaatgcttgctcggtgaggtgagtcattaattgctgtcgtgtttgcttcctatgcaacacgtagcatatatttaccaaaattattgcggttctatatcacactcttctatttcctccatgttgaaatatatatgattttgtataatttcactattttaattaattagtccaagggcattgctacgagaaagtgagttgagaagagaccgcatcctatatagtaatgatccactaaaaaattctaaaactcaaaatacaaaaaatgtcacatcattatttactaacaattattatatttaaacatcaggcaaacatgtcatattatctataattttataatttactaaattttatagctttaaaatgcaaacatgttaaatcatcttcccacataattcacataatattttcatatatccctccatcatttcttgtagtatcctatatatatatatatatctatatagttcattcttatttagttgatgttatttctcttttctctcattaagccatatcacacaattgtttttagtctgtagatgatctatggtccaaattatctccctcattttaatttcttccatatcatctcaattctttttaacccttagatgattaatcttgacccaaattatctcccaaattttcttctcacataaaaccacaccactttacttttacatttgaatcaacattctatatattattgaaatttaaattatcataaaccacttcaacttatgtaagctttttacttattgttatcgcactaaacttccatcgcaacgcgcgaggtttcacctactataagaaagagtttctggcaagggggtttccatctaaaatctaatcttaaataatgtggggtgcacaaatatgtgcgcactcaaaagtgtatacataatgcttacttcgatgcatgcacaatcataaatatttctgtaatgcttaccaagcacgtaatattatttctttacatttaactatggtcttctatgccctccatgatataattactgagataaaattgatgtgtttttgcactcaatccttgcatattgggttttgcttcaacccttatgtgccccacctaattaggttctcattttttgtggcctatatgcacattacactggttgaacataagttaatcatgctattttctttgaaaatatccatattgcccttgtagagcacaatgctaaatgctaaccatattgcccttgaatataactagtgagtaaggtccccatatagagcacgatgctaaatttttgaatcaccagaagtcacattatttttaagctggctttgaaaataaaatttgaaatttaccaaatcacaaaagattttgacttttaccatttatttgaacacaaagattttatttttcaatgaatttgaacaaaatttggttaaattccattggaaggtttagaatttggttaaaatttgttgaaaattcattaatttggcttggcctaatttaacaaaagttcacatctctaatattataaaaattcaaggtgtttttatcaaaaatatttcgtacgtcgtcggcttttgcttgtctctcgatccgattatgtttctatttgcttgttccgttcattaccgagaaggaaaaaaaaagatattacaggtagcggatagactggcataacggatagaagcgggatgacatcctcaaggcctgtatgggccacgacccaggtaatgtgtgtatatatatattttcgcgaggaaggtaacgtgtaaagaccggccataatcttccaaatgtgataggtcatagagtaagttttattaggtaataaatagttatagttattactaaatctatttatacctatatcttaactacttaaaaaatttgtaactttccattcgtcacatcaaatttccgtccgtaacaataattttccgtccataaatccaatcgaaatccaatcagacaatccaaacaaagagaaaaagaacgggaaaattaataaaaagtgcacaaatcttatctcaatctcgcgggaagccatcgacacagccgaatccgcccgtgggaagtcgccgttgctgccggatccgcttgcgggaagtcgctgatgtcatcagatccacccgcgggaagccacacgacgccaccagatccacccgtggaagccagtggaggatgccatcgctcgtggtggggggagggggctgccgctgcccatgctaagggagggcgccgccgccgccgccactcgcagtggggaacgacgtcgccaccgttgctcgcggtatgggagggagccgccaccgccactcgcgtgtcgccgccgttgctcgcagtatgggagggcactgccacggctgctcgcacaccaccgccgtggctcgcggtgggggaggctcacgctcgtcgccgggagagaggatcgggagagagaaggataaagtgtgagggttagggttagggttttctcccgtccgcatcttcagcggcgcagaggcgatccaagccgtgcatcaaatcgcctttgcatcgggctgcctccatcgctgggccacatcactgttgggccacgcacgtttgatgggccaagggcaagccggtgggtccaacacaacgcagcgaggaggagttgggggagacaaattagacttgagttgcggactgagaaagtaaatgtgctgaaaatggcccagagagaaattgggatttttatttaaataaatgctaaaatgatgtttttattgtaaaatttgcaattaagcttcaaaaattccaacaaaatttcaaagactgttattaatcatggttaatttaataaaaattaaatccatccatatcatattattttgccaccgccgtcgctcacgatgggagagaactagggttagatatagatttaattcattgtttatgtccagaagtatctcatataactcctatggaactataaataactataatcattattataatattattttttttcctgttgcaatgcacgggtattttttctagtgtaaccaaaagtttttcctgacgaaatatatatcaatccggagagaaaatctaagagttgctaacagaatctatataaaggctattaaaattaaaattcaaagtcatataagatgaagcaaccactgctgcacaaaccctctttaaccccggtttacaaccccctttagtcctgggtagcaaactatggctacaaatcctggactaaagatagcgatctttagtcgcagttaaaataaccgggtctaaaaacgttactaaaaatcagccatctttagtcccggttggcagactaaagattttttttcctttttttcattgtttttttgctatttgcatattaatttcaaatcaaactcaacaacaaacatccacattcacaaaaacatcacaaaatcttccacaaatttacagatcgaatgaacatactcagattaacatcacaaatttaccattcacatcacaaaattacagatctaaacatcacaaatcaacaaaacatcacagataaaaatccccgcgtggccacctgccctcccgctctgccacctgcgccagagtcggcaccgccgcgcccctcgctggtgccagccgccgccgcgcgcgggccaccgaagccgccgccgcccccacctttgctttctcccactgctgctacatgcctacgaaagagaggaaactttaaagaaaaggacaagagatcagagaggaaaaaggagaggataagaaaggaaagagagaggaaagggaggagaaggaagttaaaatgagaaggagaggatacgtgtgagggattatatactacgtgttgatttttagtcctggttggtagtaggggaccagacgctattttaatcgggactaaagatcatataatggcgttgggcttttcaaccggggttaaagagtcctggtttttagtaaaaccaggactaatgtaatttttgggcaacccggcaaagatgatttctccagtagtaaacgtttacgtgcatatactgattcaacgaaaactctagaaatatgtagtattctcaataatccaagcaaagttgagcaagtactaatataaacagacgctctataatggattgcagatatatatggtgattgtggtcatcactcatctgtttcatttgtttcaatgtttttatcctcttaggacccctttgaatcttagggttgaaaaaatgttttctaagagatggaactcttgctaaatttactctaaaattcacatgcaatgtgtcattccatagaaatttcatgagatttgaaaagcttcaatcatttaaatcaaaggaccaaataggtaaattttctatagaatttaaatcttatgaaattcctacgtaaatcctttgattcaaagagacccttgtttctttgacgcaccaaatttatatgtggaatttttgaaatactactacatgacaacctgacggtcaactacacaacttcggtacggtgggacagcactgtgcgttgggtgcatgcacctgctgcagtgtaggtttttttttttaactgtttgcttagcaaaattaattgcaatgtctgattgaaaaatattcatagtccacctgtccaggaatccacttggcagttaatgaattattttttcctgtctttgaattaactagccattgatatatcaagtttatcaattgatatggagcatatgtggataacaaattataaataagtaatattgtcggatggtggaagaaggacctggaacgagatctaaggtgtatcacgtgtactttcccaatacgggtggcatcgctcgtcaattcctagctggccaagttgctgtgtcagtgtggatactattttggttttctaggaggaagtcggcaaagtcatctagccagccattaattagttggctaataagtacgtgtggttgccaattaattaagttgattccaaggtctggtgatgtagtactatcctaaattacatataatacctgattattctcgttgtttggttctgcgtgcatgcatggatggggattggatcggagataacatgacttcagaagttcagattaaattaaattgcaaatggttatttgtagttctctacgggcaagtgtttgttttctaagctcaattggctgacttttttccgtcgcaatttggcaattgtttgagttctctatgacttaccgaatacatctgatgcataggctagacagattttattactgagaaaatgtaactatagtttttccaatccagcaatctagatttgtaactagttaagagttcttgaatgcctctggtcctctagtacattaaagatataagatgttaacgtccgtgaaccttcttattcgatattggctttgtgatggaatatgctatggatcacctttctagggattacgcttacacaaagaagagttttggaaagcgtcccgtagaaaaaagatattggacatggctaattagaacatccatttgattttctagatatgatgtttatgtctgttggaggtaggttgtgaggctttccgccaagcagccgaagcaatcaagattgtgcggtgaagcatgatgaaacaaccagagccacttaggtaagcaccacagcggaaaaaggatgaagtagatgaagccacatgagtaaggaagcatgatgagatgttgaagagtcgctgaagtggcaaaagcaacaggacgacaaaaggataacaagtgtggtggagccacaaacacatgagtgtactcactggggcagtcaagtagtaggcctcctccagcgtaaacacccaattaagacctaaggtcagcccatgaagaccacctaaaacagacatgccaagaaatatgacaagaatgcccctcagatgtccctatcactgttaagggatagttgcgtaaaaaaaaattaatatcactaagagttttattttatgatgactcgaaatatgcacatacataaaccactaatttggtaattagtgacatggaaaacttttgtttaacacttccagaaagaccacctatctatttgttcgtttagcaggttcaccacgtccttaatatttatacaaaaaaaacaaacgttatcggtggtaagtttcttgttaaatttatatcgaaagcacacttaagtgaacgttaatttctgggcttgcgattttatctctattgaatgaattttccgttcacaggttagtttgctatacagggacttgccgcaccactagactcggtctagctaaactgcaaatagatgaccgcgtttgttatactctagatagcacaaactcgtcaatattaaattttctcaagcatcattgatagtcaattttcgcattcagatcgttggcatcagggcttcctctcggtggcggttctcccctcttatctaattaagtactttcgttttgtaatatatgatgccatcgacttttaagatacgtttaactattcatcttgtaatatatgacgctgttgacttttgagatacatttaaccattcatcttatttaaaaaaaattatataattattatttattttatcgtgactttatttaccgtcaaatgttctttaagcatgacttaaattttttatatttaaaaataattttgaatatgaagaatggtcaaacgtttgttaaaaaatcgacaacgtcatatattgaaaaaatgaaggtagtatcattatatcatacttcgtcagtatacgaaaggcaccaatcatatagacacatagcttcttgcgttggtctatccatgaagaaaagtggaaggcaaccaaaaacagctaagaggctttattaaggcaatcctcgtaaagtagaatacaagttgtgttgaaggaagagccaagttacggtgtgcccataaattactattgaagcaaacaacacacttatggcttgtttagtaactcgatgtaaggggattgtgagtttacgtaagagaaatgatgataggattaaaatgagaatttgatttttaattctaatatcttgtttggtagaggtgatggaaattgataggaagtttagttggagattatgtcattaataaaaacggatggcttaaaattgtttagaaaaagtaaaggaggaattccctcctaattacctgccactacctaggtattgaaaagaagggagtttcttcctcaattctccatccccatcccaccaaaattcccatgtctcccaatcaaacaaaacacttaatagcctcatccctttaaactcccaatctcttctaaaatctccctccaaccaaatgggccgcaacaaggctagaatatgggaatgggagtatataatgtagacctcttgtcagttctgctagctaaattacatataagaataataatttagttttcttgctagttggctgcctataggttttcatctagatgtattctgagtaggtaaagctagctatatacttcctctgtttcacaatgtaagtcattctagtatttcccatatttatattgatgatgtctagattcattaacatcaatatgaatatgagaaatgctagaatgacttatattgtgaaacggagggagtatatttagctgtttgcaaaaagtattggtgctggcttcgataattttgaatggtataaatccatattattgaccttcacagcctttatctaaaaagcactcaattcatatgatcccccataaaaaataaaaatcctcactcaattcgccttggttttttttaaaaaaaacacatcacactttattaaacgacaacatttaggggaattgaattccccaatacatcgcccaggataaacctaagagttggaccatctttaacaagagagaggtcaactgaaaaaagaaagcaaacttcctaatgaaactaagcagcaatgaaggagccaatcaacagggtactgcggcaatgccgcgacgattgcatccaagggcctctattgatgtgtactccgcttgacgaaccggtaaaccccttcggctgcctccccgggaatgacacatatgagaggtttggtgcgaagccgtagattttggtgtgagcatcaccggaatccgcaaaagatttccacggagttcatcgttgaatctgaggagcacggactgtaaacctgcaaaccaaggttgcaaatccaatctgggctcaacccgaacgataaaccctgcatggttattactgccaagagacagagaggaagaatttctccaaatccagccaaccaaagactcaatccgaagatggtggcgaagaacttgctgtcttggtaactcgatggagaaggttgaagaagaggagatcatccgagccgcatccacgccgccattgcaagacacatccacaccaccgacaccgtcacggcctgcatcggcgcagccgtcgccgtcgcgggtagcaacggcgcggccgtcgccgccgcgggccacatccacacggccgccgccgcgggcagcatcgccgcggccgctgtcgccgcgggcagcatcggcgcggccgccaccgccgcgggtcgcatctgcgcgtctgccccggccacgggtcgcatccgtgaggccgccaccgcagctgaccatatccgagtcgccattgccaccacaaactgcatcggagccgctgtagctgccgcatgtcgcatccgagccgccgccaccaccgcggaacagatccacgccgctgccgtcgtctcaggtcgattccgcgtcgccttcgccatcacaagctgcatccgcgtcgaatccaccaccatctccaacttccataccacaccaacgaggagaaaacgggaagaacccgacctaacgagactagcccggctacttagctatactaggggaggggggacgacccctctccctcccgccgccggcgatgaggccgccggaatcgaggaggaagaggggtcgagagagggtgatttactgtagcaagggaggtttcaagagagagcaggaaggtttgatgaact

SEQ ID NO: 63042 - DNA, 1665 bp, Oryza sativa
aagactgacgaggattacgatcagttggatgggcaaccccctttcacgatgacgattgacccttagcatctctcttatcaaatgaagacaccccttactcacgcagcgatcacaaggagggaacaatagtgaggagaaagtacgtgcggtcaactgtcaccgccgatgtaatgccgtaattattgtgtacacgatgtaaactattttggatgtattgattatccatataaatcaattgatgtatggcatatgttaattacgcacgattattagaggtttcaacaagttcaaatcatgtatatgctagttatatgtgatacttacaatttttaaaagttttaaatcacacaggtggcaatttcatatgtacgttaattagagtttttaacatttaatttactagcattcatatgctaattataattgactagaggatttttaaaagttttaaatcacgcaagtggcaattttatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatatattggaatttttattaattataagtcatatatttgcttattacgatttatccacttaatttattacagacaaaaataatttttcgaagtaattgtcattaatctttagtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgaagatatctttagtcccggttgttctcaacaaccgggagtaaatatcttttctttactcccggttgttctcaacaaccgggagtaaagatatctttagtcccggttgttctcaacaaccgggagtaaagatccgggggtatatatattcccggtgcgccctcgtcttcttcaccaacacttagacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgccgccagatctccctttatctctcgatctctccgatctcagctcgatctctctccgtctctctccgtcgccgccgccacgccacgccgccgccgtcacggccccagaacgcaacgccgccgccgccgtcgtcgtcacgccaccgtcggcacgccgtgaccacgccgccgccgtcgacacgccgccgt

SEQ ID NO: 63043 - DNA, 2811 bp, Oryza sativa
accgccattactacccctgttggctccgtcgatccagagaagggaagaggtgagggaagggaccagtagcatggtgtagatgaatagtacggcgccggccagcgtcctattacttcggtcggccggatccgacggcgagaaggccggggtcgctggatccggtggccttggcctcctcacgggccacgacgacggctaagaaagggcaaaaaggtggcggcggcgcgtgaagagcagcggcggaggcggaggtgcaagagcagagagctgcggaaaccccgttgccggcgagcgaggtgagggagaacaagagctccgacgcacgtggcgctcacggccggctccgccgacggggacgggggcagggccgtgttccccgtgccggtgaacaccgcaccatggccgtcaccgttgagggacactagctccttcgcgccgaaaccacccgctatggtcgacgctctcgagttccgcaagtgttaacaaccaaatttagtaagatatgaaccaggttcaacattggaatcgaagcggattcgacaaagagttagattcgaagaacagagtatgcatcggctgtggtggcatcggttggagtctgcatcggctgagatgaatcggacagaggacagctgatacagccgatggagttggtatagccgattctgatgaaaatggcttcggggctgtttctagaatcgattgacgtgcttcacaaggattgccacgataaagataaagctctaaataagacaactgtatctattaattaggatattatgtaatttccttagagatatgtttgggcaaaagtccgccgcaaagacttagggtatattagagtttgttagagataagagtcgtgtccggcaaggacatattttgtatctcgggtataaatatgacccgaatccatgtaatcaattaacatcatttcaatatactctttgcgcatcgccaccctttttactttcgttctatttcgacgagttcttgctttcgtgttgagctacatcgattcgatcttcaactagaggtaaacttgtcatggcggcttgcgatctcgggattagtgcttccatctttatgacactctaatcctgtttatgtaatttgacaagttatcatatacacattgcaatctttgttagttgtgttatataacttgttatgggctggttcttactgttaggaagtgatcgatagtgttatgtttcgttattaagttagattatattgtgtatctttcatctcttagaggttttcatcatctttcctagatcttatacttgtttttatgcttaatgtttaatcggttgagttcgatctattaagtaatatctataattatgatatctagcttgttttatgatcatcaagggagatagcatcggggtttcagcccatcttatctggtttagctactttatatgttatatgctcgattgatatgctaaatatgtcctttatattaagatcttattacatcagagtatattaggcttcccgtttgatatattctgcttgttttgatatcttaatatagagtggtatcggagtattagccggtacatgctagatatatttgatcagctatgctataaacatctatataatcagtactttactatatatttcgacttaagtgatttatacgagacatggtgaccgatctatcccaatcacttagtttaaatatgtattgaagtagggattatatgttgttaatatctatagctgatcaagtagatttagtcttatctcattcattaatgactgttgatcgattcagatatgacatcggctcgaagataaatgatatgtcattgactcatcggcgactggccgatcggctatcgtttatggatttaaccgcggttttttcttgtctttattcttgttgattgcaggatcaaatcaactggacgctcacgaacctaaaagcaagattttagacctgcactgaagttaagcagatcttccaggccagtgtgtgttttttgcatcaacacgcttttggcacgcccagtgggacaacttttctcatggcagaaaaacaatcaccggcatcgacaggcaagcctccaaaccctccgggggccaagcatccaaaacctccggggaccaatcaatcatcatctgaggttgagactgggaacatcgtcccagtcaccatagacaagttatcaccagaacagaaggagtttaagcaagtgatgaagagtgctcagcagcaattcatgaactcgttcaaggaaacctgctagggaacattcattcagaagtaaaaggtgaaggtggttgctgccgatgaacctgaaacaagttcatcctaaggggactaaaggtgttgcgaatggctcggatgataaaggtgagggtcctcaagatggtacggtcgaggagcctttgagatgcaacaattttcaagaccaggttgactatgctgttcaacatgccttgatcaactaatcgggggtgattatcaatactttatcaaatatgattaagtctgtggttgatagcacgatagctgagcatcaaaacacggggccagtctttctaccaggtggcgtctttccacagtacaggaatttggtgacaggcaaccagcaacataccaccaatgcaccaccggttcagccgacggcaatggtttcagttccagcaccagctgcaccgtcatcagcacaaaggcaggtgattaatcctcatgtcttgaccagagagcaaccacagcatgttggacagaacattaatcgactgacccaggagcaggtagtacaatgttcgcgccaactcagccgactg

SEQ ID NO: 63044 - DNA, 2746 bp, Oryza sativa
  unsure (1)..(2746): unsure at all n locations
ttttctgataacggctaaccttgacctttttcttcaggcgtgttaccttttgtagttttatatggggaacttctcttttcccattcctccttatgctaactggtgtacttgacaggcatttcgcaggctgtagaaggtgacttagtttatagcaaagagccccctcctggagaagcaacttcagttgatacttcagaaccttgcgatgaccaaataaattcatctgatattgatctatgttctgagacacttccagaagaaacaatccagtctgtgaaggtctgtaatttgcagcaaacaatgcggtgtacatgctcatgcacaaaaagttcctaatcatgcactgtcatttctcgtgtagatagttgattctgaagatttattgaagggtgtctacacatttgaagatgttgtccttcctttgcctgggtatttaccattccacatccataacttcaattttcatattgaatcacattgagaaatatatatggtgtgcttatttctgtaaacatgcagttcgcaagcattatttcctggaaacggaattgctgacatttatcatgaattggctaaaaaggtgctactatcctacaaaatttattttatagtttattcagaagtacttcctttgctttgccaggaacttgtgcattcttgaatttcctctataacccttctgttgctaaacgcaaaaaagaaaaacacatattgtaggttattggttgctagatatgtttactgtgaaatgtgtttagtttcccttttctttttgtggataaacgatacttctgtaatgtcacaggtttaattggctaatatattatgaatgaattacacaatattttttaaagtgaaagattaaatccaagaaataggaatcatattgttgatttgctttcatgtctcaggatggcattagcttgacagagaatgcacatggtgtcaagtaagtttctttattttactgtaaagatcaaaggcacctctaaaagtcaatacttagtatatgtgctatgacaagctttatatctttttgttctgatatcctactatattctcattctgttgtatatattaccttggcttgcatatttcaatttgctactttataccctaacttctatgctatatgatacaaactccatttttaagggagttttcaattacaagcatgaaaggaggttatcggcgggtgttccagcggcctattgattttgagtggtatgccttatcccattgacttttcacttcattagatgaccaaaatcatccccttttctttcgtataaattctagccctgttccactaaaaaatgctttggtgtgcctgtagggaactcatgacttacacagatgacacagcatctttagcagaaactgatttgattggctggaggtccgatatcatgaaatccacaagattaaattaaatagtgaaacctttgttgccatcggctaaatccaacttatatgtatatgcaatccttatgagccgatgcaacgtccagataactcaccggttgaaaccccgatgaaacccttattggcaatcaagaagcaggctagagattatggttctaagcacgacttagtagatcaaactcaatggatgcagcactaagtatgaaaagaaatataatatctagacaatcaagccgttgactgagtttttagggtggtagatgtctaagcaaatctaatctagcaacgcgatttagccgatactggcagaatccctaaaacgagaagcagccgatagagctaaattgatatgctaagacgatattaacagagacatatgataaataggtaggcaaatatatcatccaaaccagagcaatccaagagatcgaatgtactgatgcagacttgaacgacgccgacgtaaacgatactattgcctaggccgacggaacattggacttaccccttagccggagatcaaacatagccccacgtcaggtgccaagtcccgtcggacgataaaataaagtagaaaaggtaaaaggtggcgatgcgccgaattgtattaataccctgggtgtacatatttatacccatgggttgatacaagttcttgccggacaagaaagaaacttttctaaagataaaaggaaaagataaagtccttataggacactaaacacactttcctaaacataaaaggaacctaataaactattcttaattaatagataccttgccatgcggcattctctttaaactcggtctcttctggataagcttcctttagtagatcaatttccttaaccgaatatagcaagaatccgacaactgacgacttggcaactctcatcggctaatctcaagacttcgaagccaatgctgactctaagccgatgactactctgggcttaccaaatttcactgttaacacaaccccagcatatgtcgcacatatgcaaatggattacatgagaagcaaactcactaagcacatgaaccccaagcttttctatgtacatgaattgaatagaagcaacgaactaagctatatggaagtcttacagatttgtccactaacccattattaacatcttctcttgaataagtgtgtctgagnnnttnnnnnnnnnngnnggttnncagcnggntgtncatcaaaacgcgggggggggggagganggatattgttcataatcatcatgaacangagacgncaatcaatgatcaagcgatgagtagcnnatgcatcaaaattcaatatccttcatctgttggt

SEQ ID NO: 63045 - DNA, 566 bp, Oryza sativa
cgtttaggattttcttccctttggcatgcaatatatatcttgtttggagtaccatactaccatgtggtttaacagtatgttaatttgtaattaaccaatctaatctacctgctgttcgttcctctgttggttaatttagtagtgacagtgttctggatcaagtagctaggtaggtgcagtagtgataaaagatcaaacctttttgtgctttagactttagaggagccatcagaaactgcaattgatgcctttgttatcctgttcttctgaactccaaatatgcagagcagtttcctgaggtaaacaaattcaagtcgattctgaacaaattagttgttgttcttgttgtgcaggaggagtttgaggagttcgccgagaaggccaagaccttgcctgacacaatttccaacgaggacaagctgcttctctatggcctctacaagcaggcaaccgttggcccggttaccactggtatatataggccttctgctcttcttgaaacgatgcattcatcaattgagctaattaatttgctgctgttcaagtgctaagattccatatgcttt

SEQ ID NO: 63046 - DNA, 5685 bp, Oryza sativa
gagcgaacgaacgtgaacgagttagggaacgtgaacgagcgaacgaacgaggacgatcgttaacgtgaaatgcaatatatatatatatgtatatatatgtatatatatgtatatatatgtatatatatatatatatgtatatatatgtatatatatatatatatgttacttcgcatttatcctaatacatttttttgtatttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggattggtgcgactcctagcaattgactattgtagtcttaattagacttagcatatacgcacgaaacacttagcatacattactatttagtcttagcatgtaatattatttgagttttaatataatattactttatttgtaattagacttggtatgtaattattgactacggaattggtgtgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaagtttgtgtagggttctaatgtacgacatttacacttagcatacatgacttagattgttaaaacataaatgtctcgtgacttagcagatgtttcttgtatcaacagatggctgaccgcgatgaggaacaaatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgaggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtacaagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtattcggcgttcagatacgagaggctgcgcaacgactaacagatgcagtggaagcctcctctcagggcacgttccgacccgacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcgcagagcatggacgccatgcaaacacaggacgaatcgacctgtcccgttgatgacatcactcagcggacaccatgtgagctgcatattcctttcaagaacttatcaataaaggtaagatttagccattccgctagttcctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcatgatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctgcaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccgccggtagagagatgatcggagcgaggatcagggacacggacttcttgcaaggagatgacattctctggatcaatttcaagggaatctacgaactataccagctggacgccctcgacgtctctattatgagttgctggattttgtaagtatatcgttcggttagatttcttactatacgtctcctttaataaattaggtccttgtatataagtagactatagaaaataatatactcccttttatcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctatatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcacggcggttcaagaacaactcatgggattcatcaacgaagaaatccttgatcccaagggtgaattctactacgacggaaacacaattcaccggtccttagcttctgagctagcagcgagtactactacgtcgaaatgatagctagctagctaggacatataatggattgtaattaatacatgactacatatgtttctatatgcatgtgtacacattttctataatgtaaatatattttggtcatatatatatatatctatatacatatgcattaatttgcataacatatatatatgtgtataaatacatatatattatgcatgtatatacatataatataatataatatatatatatatatatacatatatatatatgtatgcatatatatgtattgaaacatatatatgcatggtttatatatatatatatatatataaactatatatatatatataaaccatgcagcaacagggccatgcaaaaaaaaaatggtcagctcgatctttagtcccggattggtactcccggtttggaaaccgggactaaaggggggttacgaaccgggactacaaagggtttctccaccagtgaaacataattagtttgtacttttgtttgaattgccatgttagattgaaaaggcacttgaagctgcaggaggccctaattacatatagagattaaaagataaatagacaaccaaataaatagacaaatagacagtacataaaatttcaagatgttcctacttggctcctagcaatcttgtgagcggtaggaaaatttataatctagttcctgcacactgatgacagatagaaaagagcaggacacactgctacagaatagcacagggaagatggccctataggtgtcataacagctaaaccagcacctatagtgcttttcctgcacacacacacgcgcctgaggggacaccaaaggcaagaacagacacattttgtgtacaataggtgccagtttttaattggaactgacacctatatttcctatcaaaaaatggtgtcggatccagctaaaaaccagcacattttgtttctatcccatcaaaatagtttataggtagaccaggatagaagtaatggttctttagatgaggaggagagccaaacacgtcattattttctccctccc

SEQ ID NO: 63047 - DNA, 4614 bp, Oryza sativa
aggggggaccggcgaaggtgtggtctggccacctcctcctctcgccccttcccatcgaccactggtgcttggcctcctctctgtctcaccccttttccacgctgggtggcctggtccaacaccgctcctcctcactggcacttaggagaggtcggatcgggtatcatccctcctcctctctgtggtgcctccttcccaccaccacttgggttggcctgatccgacactgcccctccctccagtatcgccccttcctaccggcgcttgtgtcaaaatttgtgatttctttgatttgtgcaaatgtggaatggatatgaggctgtgggatgtggagctgctagattcattgcctcgattcgagtcgatccattaagccgacatttttttgtgttcttgaaatttgaaaggtgcctgtttaggccccttcaagtccacctcaaaggtgctgcctgctaggtgctggttgaaaaatccagcacctaatgatggttcccaactagcacctgttgttatttttgtattagtaacccatcgcaggtacaacaaagttcagcatagagtatcacaattttcgcaactgatgccattgtcagccatttgaatttaaaatctataattatactagcaaactgctcattataaaaatgtggaaattatacatagtactccaatattatggccctagaagcctagaataaagacttcaagaaaactagttaaaggcatgtgctctataatatgtttgccaatcatgcagtccaccaatatgaaaatcaaatttctccagtcctttgaccactagtgtaatatcccaagaacaaagtttccagaaatgatgtaactaaagtgtcatgtgcaatttcatgttatttaaattgttttggcctttgtttggatatttcctgcattatgttgacgtcgaaaaatcttgtggcacatatgtacaagatatataataattcagaaaaaaaccatcataaataataaatggcatgaatagccttcttaaagggggagaccaaaaatggaaacattataaaccatataagagaaaggaaacaattacttgggcactcattcccaaatggtcttggccgagcaaaccaacatgtgatagacatttgattagggagctcacatataatcaagtgcatatattaattgctacaacatgtctatacgaacgttttgttttttttaacaatggggcgaatctcactaaataaagtaaaatgaagaattatgagttaagttttgaaatcagatagatataaaagctccatcacttgcaacatgtgcgttgccttaacaccgaaacataattaaattaagtagaaaaactggataatacacgttaacacaaaacgcttttattatctgcgattgaagaagtgttgtagtagttgcacgatatcactactgtaacctcttataaacttcatacgtgcatagttcagtctgaaagttacgaagaaacagtagaaagtaatagcatttaaggaagatgaaacacgcaaaagattacaataataagtaatatcgcacaagcaaaacacaaaccaagttatgaatcttgacaaatgcttgtctagatgtatagcttaaggagctagctacatctaggacaaagggagtagctcaaaaatgattgttgtcattcaaataagataaccatagcacaactagtgtagtggagcaagatcacgcgcattactaagtggacaagaaccgcgtattcacgatgaataattcttgacgtgtcatgcggatataaagggcaataataattttgtcatcaataacactgaaaatgattgaatgttacatttaccgaacacacactcttttaaaactatcttcttgtaatgaagttccatatagcataaatgaatgataaaacttttagcatctattaacggataaaaactgctactgcatcgccaaatagtttcttgatgtgccatcactagcacaaatcctcacacatatgtgacgggtcatcagtgacagctaagcagaaccgtcacggactcccttatcaataataggccgcataggcgaccgtttcagatgaagacccccatcttcagttgttacagatgacccctcatctgtaatggctccaaacctagccttaacatctctaacggctgtaggatgtagtcgtgacagatgaggggtcatctctaacagctctgcaaaatcaactattacagatgataccctcatatgtaatggtttctcttcttgagctgttacatatgagtatatcgtcagtcatccaactgttacaaatgacatgccacatttgtaacatttatgttctaatgggtgcccgagctgttacatatgacattcttcagctgttacatataaattacgtatgcgctagtccatacacgaggtgaagtgaacgatagaaattatgtcacccatagatttcttgaaaatacaggagaattgtatttcattacattaagtagaaagaaactaggttaaaatatataaaaaaccaggggagaaaaaaagatcccccaaaaaaaataaaagaaaagaatgcacacctcacacacatcacccaaaggcaatatctattaattgcccgggttaattgacctgaaattatgtcacctataaaaagaggaaaatgaaaatacagataccccaatgatttttcattgaaatgatctccatacatggtggtcgtacttgcattcattaatggaaagcagacaagagtaggggctaactagcatatggtgttcttacacaattaattgacgtgaatgttaaagcgggaagaatatggcagaaaaaaaaagcatgaaaaatggatgcatcgatccataatcgatgaaaaatggatgcgtttgcttgtcataacgacaagaattccaaagtggtcggctcagagggccatgcaagcatccataattgtaaaactgttcgtacatatatatgacaatctagcagggggtgtttgctgataaaagtgagcgcacacaggtatgtgtgtgtatatgtgtgcgcttgtgtagtggtatgtgcgcccacatgcgtgattctatcttcgatcccaaagaggaatttaagatagaaaactaacaaaagcaggatagtatatatgttcttttatatgcacatgcttaagtaatataatcttatctaatagaatacgtcacaactataatttatgtgaaatagaataaattaatacattgcgcacatcggcagagccagttcttaagcatagaatatgagcctaatagttctgtaagaggtctaatatcctactaattaacttattaccaaattaattaaatgattatattatgtaaaaaaaatgttccgggccactagccgtcgaaaccagcaagatgttgcaatttttgtggtggacggctagttgcttgcacgaagggtactaactaatagttaattcggttaatttaatttttgccaggaagctccaaatctaggactctagggggacatgcagcctgtgttgtggaatcatggtgtgggctgcgctagctctagtgattcaaaaaagctgtaaaagcactgtaggcattcgaaaaagctaggttacgaatatcttaaaatgcacttggacgttatggcagacattctatcaaaaagacaaaaatatgtcatcaatataatcaagagaagtggtccaatgacaagattttgttctatgtgtatgttggaggcataccacgaaggatcttcggccggacctgccgaaaccaaggacttaagcgacaagcttagactggaggcaactggcgaagatcgagaagggaaccgtgtggtcgaaagtctcatgacaaagaccatggctcggacactcagacttcgccgaacaagaacttcgtcagaaggcggtgtgggtgagggcgataaggtgaaagccttggcaggagggcccgggtttcgccagatgccgaacctcaccgaaaagtggctcaacgggccactgtgcccaggaaggtttcgctaagtagatgggccaagccatgtagcccaataagggcccataaatgtaaaggacacagtgtgtcctagatagtctctatcacaagaataaccatataaattcccctgtaaaatctaaaccctaaaggagagaatttgtaatggagctataaatagccctctagtgtcttgtaatgggggatcccaaaaatttttcgctaagtaatacaattgtttttacttccaaccactgttaagagaaccacgtctttcgacgtgacacagttgtctattcgacaacagtgtacattgtgcaatcgaagaaaacaaaagttgtaaagtacaattccatgcataccatttttctccttttatgtcatcgtgccattggaattttttcgctgagatcgactaaccacggagatgagaaaaatacttgtctccctttattaaataagggattgttgcgggtgagataaaaaatatctatggcaacgagctgcccgtaccacgacccctatgaaaaagatttggtaatttcggaccccagcaagcaattattgtgtccaaaaattttcggctaatttttcaatttttataaatatggttaaaatgtatatatactcaatcaga

SEQ ID NO: 63048 - DNA, 3929 bp, Oryza sativa
  unsure (1)..(3929): unsure at all n locations
aaggattgaataccttgactacctgcttgcacgtcgactctagaggatccccaagtgagtgtctttattttactgtgaagatcaaaggcacctctaaaagtcaatacttagtatatgtgctatgacaagctntatatggtggtgttctgatatcctactatatgctcattctgttgtatatattaccttggcttgcatatttcaatttgctactttataccctaacttctatgctatatgatacaaactccattttaagggagttttcaattacaagcatgaaaggaggttatcggcgggtgttccagcggcctattgattttgagtggtatgccttatcccattgacttttcacttcattagatgaccaaaatcatcaccttttctttcgtataaattctagccctgttccactaaaaaatgctttggtgtgactgtagggaactcatgacttatacagatgacacagcatctttagcagaaactgatttggatgttctgtccagaaacaaacctacaaaagccaaggaagtaaatgagactatatctagcgcgatttcaaatgctcaatcacatgattccaaggtggcaggaccattggatagctctatgccaggtagtgaaactggcttagtagaggaaaagtctgtcggtagctcagatatgttagcaaggaaattggccataaaattagcatttactctaccagcatcctcctatgctacaatggctattagggagttgctgaagacttcaacctcggtatgtttctcaactaatattatattactattcttttactagaatttaaatgatgttaaatggactctgtttatggtgttatgcatagttaagaatgcatgcctacttgagaattcaaatacatttaattatggcagttgcccaacagtattgttaatattttaggacgtcaggagaaaatattgctgaatatttcaatatatatgctattgctctaacatgttaacaaataacaacattcatttcataattaccttctgctcgtctgcaggtcacgtatcagaaaacactcgattgttaattttgttattgacatcaattctttatggggaatcttccaagccgcatcttagaggagttgacatagttaagcaacatgagttggtatggtgtttgaattgtgtttgtgtaatttttatcgcgtggcactaagttattaacttataaatcctgatctgattattgcagtattgcatttaacagcccaaatgaatcggcattgagatataccatgctgctcggcctgctcccgttcggtgcatactgaattgctgatgcacgtttgtgctattgtgggggttaaaaacttgttttgccactagaatatgtggcatgccataatattgtatgaacttttgtaaccaaacagggatattaaagttgagaacccttgcgaggtttccttcttgtctgggttttgaatttttatatgctgtgtttgttgatcggagctcaattatcgtaatatcgggcaacaaaatcagtttgaatttgtgtcttgcacatgcggccggctggcaactggacggcagctgggctgcacatttgacgcagcctgacggtgatgagcagctgggcggctgacttgaggctgcaacacgacacgacgcctggtccagtgtggtaccccaattccactagccctatctggaatacgaaaacggcagcacctcctcgaacataagggttggtagaataagcctacaacaactggtgctcacagtgagccccagaggggtttataccttggaagtacaagaaaataattgatgtatggcaaccaaatacaaccacaacacacagatgtacaccctgtaggtgcataactcatttattattataaccggttaccaaagttcgcatctgctgctagctctctacaaagaaaagatgacggaaatttgggatacaactcagtatacaagaagagcctaagatcctgcacattttcaaccgaccagcaggacatgcatagcctaaatggattgatgatccaatggtgtctccaatctcagcctccaaaacaacactaaggtgacaaatggcatgccctaagtcaggttctggatcttgcgtttcagccacagggcccggacgtcaccgttaagcgagatgaatatttcccggttccccgcctggaggaacacatcgggggcaaccgatttctccacctgagatagctcggccatgccgttgaggatctggacgcatctcgatatgctgtagctgtcctctggcttggccaactgccagtcgtgattcgagttcttgtactcccctgagtcgtcgatcacccggtcgttgctctgcctcttggagcaatgccatgagcggggctgccactgcgatatcgcctgcgggaacatgtgtgtatctctgttcgtggctctgatatgcgggggagtttgctggaaggaggactcttttgagattggtgactgcaggcgaggtgaacgttccacgataaagtcttgttcatcctcactgtggtccaggtctgcgccagtgtataaaaagcgcttactttcttctgccattatgccttctgcgcaagggaaggggtattaatcagtatacaggtccagacattccgatccattaagataagggatgattagaaactcaagaattgtttgcaaaaatatatatgagaaatcagaagcatatctttagtaccatttttcccgaaaggattcctgcagtcctcacatcggcaaaacaaagagcaaccagtcccatcctgtacataagaatttagttgagaatatttttcaccaaatgtttagcagagagcttgaattaagaccaaacctggtagcaatcacagtatttctttaggcaacttgatttcttgcaattgcaacctcgcctaggcggagttgaagaagaagaatgatgagcatcttcctgtaaatgagaacacattgaaattactactacaaaccaaaggaaagatcaaatactgtagcaccagctttttcagttaagaaaacaaccacagcttccgcatttgcctcagatcttcgattaattttcagtgacatccgtttctgccgtgaaagaagcaccttgcgagtggtctgaactgtttctgcatataaggccttgttgaagcatggttggcatccacacttttcagaacaataacctccaccagcaaagcatgggcaatagctgcataagcaaacgcttcaatatcagtcttagttcatgaaagcacaagcaaccaaacagacatagagatccaaatcaatttaaacttatcatatattcgtactgatggcgttttgctatccataatatttgcagtaggaagaaaaacagcttcttgataacatagaagaactatggcttccatagtagcttttgtaggctgatcgcaaagttgtaagctttccgccattagttgcacatatcaaaggagtactagaggtaacatacaatgggaaatcatactaataatcaaaaggtataaacatataatattataacagagcatgggattccaattatttattcaatttaaacacattacacaccacatggagcactcaaattacacatactaagagaatagaaccgcaatccattcaaatagctgtactatagaacccaacaacaaaggggtttttgaactacgagcaatatatctagtcagaggggatcatacccgtaaaacgtcgcgcaaatccctatctctattatccactaaccaaaatggatgcacatagctgcgaaaatcgcatggtaccaaacatttccatttcctctcccctttttttcactaaaatgtctaaaccttcccagaatcgtatgaaacagagaactacaaaaatcaaaaaggatcagaggtttcttacagcttcaagcatctcgacttcttgcag

SEQ ID NO: 63049 - DNA, 685 bp, Oryza sativa
tatgcatgcgtacccattttcaatagcgtaaacatattttggtcatatatatatccatatacatatgcctttgcataacatatatttgtataaatccatatatattatgcatgtatatacgtatgatataatatgatatatatctatataccgataggtttgtatgcatatatatgtattgaaacatatacatgcatggttcatgtctatgtatatatatatatatatagcccgtccatcaccagggctatgctaaaaaaaaaaaggtcagctcgatctttagtcccggattggtactcccggtttggaaaccgggactaaaggggggttacgaaccgggactacaaagggtttctccaccagtgctcttacatatcactttttgtgatctttgatgtacaactttaatcactattatatattaaaacagagttagagtatttacggctaatttttttccagtagtagatgatgtacccatcgatagtgaggtgttcatggtaacttaatcaatctcaagatatgtcgggcccagtttttcggaggtgctcataaggatagaatgtgcgtatgtattcatatagttgagtgcccacgcattgggggcacatgagattgtaatgtgtttattttaaaaaaaaagagtacctagtaaaaatttgtattggtatagtgtcggcaacta

SEQ ID NO: 63050 - DNA, 769 bp, Oryza sativa
caacttccataccacaccaacgaggagaaaacgggaagaacccgacctaacgagactagcccggctacttagctatactaggggaggggggacgacccctctccctcccgccgccggcgatgaggccgccggaatcgaggaggaagaggggtcgagagagggtgatttactgtagcaagggaggtttcaagagagagcaggaaggttagcaagaggggtcgagatttcactcagttcgccttggttaggtggggatacaaacaagggcatatggaactgataacattcctgatgcagcagttgggcgcaagagatttttaggtggttgagcataaccaccctctctatttatatcataatatttatagtttctactttgaattcctaatttcactagaactcaaaccatcaatttccaaattcatccaaaaagaaatcctagacaaatctcatgctgtgtttaattccacaccaaaattaaaagtttgattataattgaaagtttaaataaaaaagttgaaagtttatgtgtgtagaaaagttttaatgtgatgaaaaagtttaaagtttaaagaaaaagttggactaaactcggcttcagtcacgcaagcaatccgactccgtgatcagactggctctcctggccggcctgtcaccgagccgctctgcacaaacaccaagctggcctataggcgccactgctgctgcccggacctgcacacctgcatacatcgataccacattcatccaagaactgcgtgcagcgtgc

SEQ ID NO: 63051 - DNA, 2745 bp, Oryza sativa
gggaaaaaaaaaggttttttttgggaaaatttttttttttaaggccacatgtttaactatttatcttatcaaaaaacttttgtgaaatatataaacttatatgtatacataaaggtatatttaacaatgaatcggatgattagaaaagaattaataattatttaattttttttaataagacgaacggtcaaatatgttttaaagtcacggcgtcaaatgttagcgacggagcgagtaagaattttggtaaaagaatcgaagatcattcagttcactgatggaagctgccattgcccattgcgtgcaggggtggctcaactgagagcgagaaggggtgagagggtgaggtgcggctactcctccagggacggcaaggaggcgacgcccgccgccgccgtgaaaggcgcgacgtcgatgctcgcggcggcggtgacggcgtcgtcgtcgtcggcgccggcgacgatggcgctggtggacgagcggatgtcgacggaggggaccgggctgagcctggggctgagcaacaacctgctggggtggatcctcctcggcgtgttcggcctcatctggtcgctctacaccgtctacacctccacgctcgacgacgacgacgagtccggcggcctctccctctgaggccttgttcggttaatccgagaaagagattggagaggggattgagagaataattctacactataataggagtaaaataaatcctctctaaatcctccgctcgcgcgttactcgacacgaggcggcagttaattattttgcattcttagttggtgtagagaccaattgaagttaccacttcgatgagtccgtctactgatcctgcctctatctttttttttttttactgttctgcaaataggcggggcctgcctatgcttgagtgtgcatgtcgaatttggtgtaattaattggagacgtgcatggatattttgtaactaattaagttggtgtttaccttgagtagtagctggctaagtttttcatgaaagtttcaagccagttatgcgttccactatatatagaaaaggttgccacatgcatattcctcttcttttgcttggatactagatgatgaaaggaatggtacacctgcagttgcaaggatggttcccaggttaattgctttcaactctctgtaaagttaaatataaaccagcactaataatgttatgaaataaattaagcaacaacacgaaaaaaaaaagaactagcactatgttcaattgctgcagctaaattgctaatggtataaaactgtcgatgtgtttgtcatgcctagagatcactagaggtttggattggctcaacactgacaaaaaaaaattgacaatttgacccatttccgaaaacttatttcgcaaatgaaccgcgcctaaaattacttatttcaaaaatgaaccggaggttcaacgccaaatgctccggcgttgagcttagccacctcagtgccaggtcaaccagtgctaaatgtcgtgtcaccgtggatggcaggccgactcggtgtgccgacgtgtcaaagtttagcgccacctgactcggcgctgaggtgtctaagctcagcgtcattcaatctggcgctgagcttcgagacattaaggcccacctgccccggccgagagagcgagctctctcatttctctcccttccccgctccatgaaaactacgacggcgatggcggcgttcctctccgagccctaatccccctctaacccatgggaaatcaaggggatttggaggggatttcatgtggaggttgtggagtaaggtaaccttctcaaaatcctcctatattttcttcatttggtgatttgttttggagaagagcatgaaccctaggtttgtcgtttttgtgagacaaggaagatcgacttcatttatcggttaggtgagttctataggttaattttgaggggatttcattcatcggtactgaaccctagttggtaggatggatttggtaggttccaatgtagggtttgggaagaatttttattctcattggcgatgtagtatgtagtgaatcgaatgaatgtgatggtatgaagtttgtgccacattgtctagtttggtttacttgtgtaagttagtcttttagtacccttgtcgttgtttaattgaaatagatgtactaatagtattacttactttgaaaggtggtcggactttgtagatggagagagttgttcatgtgcactatggtggaagtgtcctagagtcgagtaatggtggtagtcagttcgatgggatgtcggtgaagatgattgtttttcaatctaagcctaccttcgaggagcttttgtgtcgtacgaaggatattctgggttggtcggacaaggtggtatccattcaagatagatatgatatggggggagagcctatttcacataagcaaatgctagagttgaatggagagaccgaatgggaggcatatgttgagatagtgaaggaatcacggttcactatgtgcacttagttgtcgtggaactacgaacctattttgttaaatgtgcttctgcttggaaactgggttgggatgcttctgcatgggtgtaggggatggtttaaaagttaaatgctaaattcttgatataccttcttcactctcttggcgagcttttgcctacttgccgatgatgcgtgatgtggagaacggcaacacctggtctgtgctctggagagcacctttcccttgcgctggggtggtgggggttcaagctgccccgttc

SEQ ID NO: 63052 - DNA, 855 bp, Oryza sativa
aaagagagtccttataataacccaatacgatattaattaaaatttagaataaaaataaaataaaatacaaaatcagaaaaaaaaagaacagttcatgtaggaatataatttgaaaataactaaaattcgaaattaaagttaagcaatattgaaacaagagtccatataagaaacaaatatgatattaattaaaattcaaaataaacaataaaataaaataaaaaaacagaaaaaaataaaaaacagagttcatgttggaataaaatttttaaacaatttaaattggaaataaaattaagaaatatcaaaagaatagtctatatagaacacaatacgatattaattaaaattcgaaataaaaaataaaataaattcagaaaatagaaaaataaacataagagctcaagtagaataaaatttataaataactaaaatttgtaataaaaaaataaatactattgaaataagagaatctagaacacatgacaagattaattgaagttcaaaaataacaaataaaataaattttaaaaatagaaaaataattataagagttcaagtaggaatataatttatgaattaaaaatatcggaatgaaagatatgcaattttcaaaaaaaaaagtcaatctagaacacaacgatgacaaatgacaataaagagggaagaagcaataagcctataaaggagtagagtactagtggttgatgggatatctaaaaactataatcaaaaccccaaatagaatcccaatgatgattaagaggagtgacaatgggtatgtcgttaagcagcttggtcacgacggttggcgggacttatcgagcgtaaaaataaaccccaatgataatcatg

SEQ ID NO: 63053 - DNA, 603 bp, Oryza sativa
atttaattcaaattccaatctttagaagcctatatatcctaaaccgtagatccgatctcagtgaaacctagacctaaattcatctaaattcaaatgcttcattttgatgcctaatttgttattttataattttatttgaatttattcaaatatcaattgaatttatatttgcctttttcaaatattttcttttaccccaaaataccctttagccactaaaaagccgccggttggaactttacgccttccatggggacgtttgcggtctattggccccgacgtcgaaccgttggttgtaaagcccggcaaaaccaaacccaaggtcgaagtgctgctcctggcaccccacgccttgatgcgtacaacggtcggagcttcactattccctcgacctcgcacagttagctcttgagctctgtgtgatcctagccgctcccccgccacttatggttgttggagtaacacttccgcctcgctaaacctgcacaaaccttccattcctttagacgtttattggctatcgcaccggctagagaagatccaaacctaatcgttatgctttaacgacgactagcgaacaccccaacccctaattgatattta

SEQ ID NO: 63054 - DNA, 801 bp, Oryza sativa
ttgccaatcatgcacaccaaggggtgatcgatcaaaccatgcaggtggatcagttgtattcagctgaaatgacaagctagagcaagtaaaaatgatcataacagtagcagcccactcagcaagtatgttgcttgacattcatcatggccaacccatcatgccaacaagcaatagaggtgttcatgcatcctatctccattatgattgcattgacataaaaaaaaggaataaaaaagtttatggctggttaatggtaatggataactacagctcataagttggcaggtgatggagggtggtgaccagttgttgcaaggatttcctttaaccatgtattagtacctctttccgtcttctcattgttaaccttatcctccaattgtgcttctagcacaatctagaagcgaaatgggagagtgaacagatcaagcataccctattcaagtttcagttcatcttaagcccaaatctcgcttctagaatgatctagagacctttggattagactagcctctcttatcgcaattcaagccacaactggattcaggtacggactaaccagtagcagagaagggcggaaacggaacaattgaccatccagtgtgtcagtacttcctagtccaaagtaagaaagcgagctttattgaactagaaactcgtgatctggaagtttctagatccacgcaccgagatttgctcaagcgacacaccccggatcccgattcctctcgatctacctcggaaccagggagcctattgcctagacgcttggactacaaaattctcgtcccagaacccgaa

SEQ ID NO: 63055 - DNA, 751 bp, Oryza sativa
actactttgtgatagaaaatggagaaaactgatgaagaaatcctatagtgatatatccgatggactttgcggatttatgcgctggacccatcttctcctttaactctcgtgattccttcaacaacgaaacatgacaataagattttacaggtaaagctagtgtaggacgtgggggtggatagagggaggtcagtgcaatgacggcccaatggcgggcaataggggaatcaagaaaacctcagttaatggccgctcggcggtgatagaagaagaacaatgtaggggcacctatgagaaggggaaataacagataaggagaagaagttaaatcaggctaaagtgacggaggaaggaggggcatagtttgagaggggtgctacagttgggcaataagactaaccatgaattgacggaggggttagtagtgcgctagataggggccaccgggccaggttgtggcctaccttactgtctagatatatagcaccttattgaaccatgatttggcggaacaacgatattgtggagattagagaggattgttggtcggtatgacgttgccaaaatgatattgtttgataatgggtagttttctaattcattacagattatctatgtgtgttcccattggtttcttttctggtatatgatgctacgactgaagggaaaagatttatgtgtaatggaatgtgttaattaggatttttttttgtttcactttctctctagatgacatagttctcttagattt

SEQ ID NO: 63056 - DNA, 1506 bp, Oryza sativa
aacaaagaggtataagcacaaaatttgacacggttaatcacattgtcaggagagctgtgatcaccgggagagcagtgagggtgaagtcccagctgaagtcccacaagcggttcgccaccgcgttccacagctactgcaacctcgtcgacaatgcgaggctctactgcaccaactccacgggcgccgccaaggtgagcttaccaatgcattccgtgttcggttaccgatgttgttatcggggccggttttataacatcaggcacattgagaaatgagaattcaccatcgctcgctggctctctctacagctgataggatggaaggacggcgagagcaaccttctagtggaccctgaagaaatcggctgcttggagagggtgagccacctcaacgacgaggccgactgcgtccacgagatctatccggacggctcggcggcggcggcctgggaggccctggtcacgtcgccgtcgagggcgccggcgcagcgggagatcatggcggcggtccagaggagcgaggcgcgcttccggaccacgtccacgccctcgtagctgcagcacacgatcactcgtgtcaggttggaattttcttttcttttgacacgatttcaggtaggattgggggtatttgggtgttggttgtgtgtggtggctgccaaatggctcgtgggacacagttcgtgttatgtacgtatcatactgtacattgtatcaactgatcctgactccgttaccacccggcatattgtttcgttttgccgggcgatcgagctgcatcgaatggagctcgtcggagtcatcggtcatgtacacatgtgtcttgtacgatgtattccggatctagacaagaaacaacacatacttttcatggtcacttcagtgaaagcactgatgaaaaaaactcaatgacacttcccatcgaaacacttgtgtcaagatatatagtttgttcgttgagccaatgtccatgttggcatgtcggacgccgtgcaacctcctggcacatatatatactactacgttctgatactctgattggtacatgctcacctggttggctggttcttcaggatttggatctgtggtcctgtacctgacacccaccgttacatttctgaatctaagatagtggcaggagttgcacttcaccggtgcaaacgcccgcttacttttcaacggaaatctaccgcgtccaggtggcggacgcccattcgctcagaggtgatagaccacgacaccacgccacgcatggataaccagaccagaagaactaaacacgattcgcgagccacactcctgctgtcactcgttgcatctcacctagagaccagcagagtgtagtgtgctgtgtgcctcttgctagctaagcaaggagatagccggagccatggcgaccatcgccgctgccgccgccgcccgcaccgccgtcgttggccggccgtcaggtaagttcacaaagctatcaacagtgctatagtatacttcctgtgtccctaaatattga

SEQ ID NO: 63057 - DNA, 768 bp, Oryza sativa
taccagtttactaattttggttgatttttcattgtaatgttcaaaaacctgtaaagtgatagataattcggaaatttggttatacggttaaacttttgatatggccatgcgcagcacaaatagttttaaatcatactttggttaaacaatgcatatttcttttgttttatttatgtattaattaattgagttagaaaagtgataagcatatgtatatttacttttgccgctaagataatttctattatgtgagcacacccttaatttgtatcctaaattcaccactgtacagtagaacacactagcctatatatctccctctcgagtgcagcgtgagttgacgcgccaaggcctactagcaacagagctgcaagcagagtggcagtgtgagtcgtaccgagagttgaagcacacatagccatctctctcgttgtttctccacgtaagctttttgtagcactagctttctagttgcaacgatggggttcatcagcggcgaggagctcgccgtgacgctggcgccggtggccgtgtactggctctactcggggatctacgaggcgttggggagcgtcagggctctggacaggtacaggctgcactcgaggagggacgaggagagcaataacatggcgtccaagaaggaggtggtgaagggcgtgctgctgcagcaggccatccaggtcgccatctcacttgccgtgctcaaggtttgtcgtctcacaaccctcgacgttcagctagctagcttttgattgttgagtgatc

SEQ ID NO: 63058 - DNA, 14542 bp, Oryza sativa
ggcggtaatagcccgcaagccctaagaaactccgaacctgagtgactgtccttggtggggtccacttggtaaccgactccacatttgctggatccaccgctactccttgagcattcacgatgtgaccgagaaactgaacttccttaagccagaagtcacacttgctgaacttggcatatagctgatgctcctttaacttttcaagtaccagtcgaagatgctgctcatgttcttcctcggacttggagtagataagtatgtcatcaatgaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgataacctgatcgcaggtctatcttagagaacacagtagctcctttcaactgatcaaacagatcatcaatccttggcaaaggatacttgttcttgatggtgacctcattgagtgcgcggtagtcaacgcacatcctcttggttttgtctttcttctccacaaagataatcggagcaccccaaggcgacgtgctcggacggatgtatcccttctgtaactgttcatcgacttgcttcttgacttccgccaactcgctggctcccattctgtaaggcctcttgtggatcgatgcagttccaggtaccaagtctatccggaactcgatatccctttttggtggcattgttgtcagatcgtccggaaaaacctctggatactctctgactatgggaatatcctccagcttcttagtggttttctccactgctacctcttgtccttcaccagcagcctggtttaaactaatccctggcttctgcggcactggagactggaagattaccacctctccttttgcattggtcaacttgatggtgcggctggcgcaatcaatcactcctctgtgccttgtcaaccaatccattccaagtatgacatctaggtccttggattcgagaagaatgaggttggctggaaaaatcaacccttgaatttcaactgtcacagatgggcagtagtgagttgtggtcatgccacctccaggagtatgcactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattgacacgggcctgaacgaacttgggtccagcacgtcttggcttcgggcactttccaaccgtgtgtccgggtttggtacaattgaagcagagttcgggtttttctcccaacctcttgggctgttctggcagaactggctgaactgattgagctggaatctttagtgaactcggggtagggttgagactgtgctgctcactgttgttgtgactatcactatggtgggtcttattgaagctacccgggtggtagggacggtgctgtcggataatcatggtgaaaggtccaccgtgacgtcccatcgtgtaacgaggcttctgacacttcccctggggagtcctgaactgggctgccttcctcttacggttcattttgttacactgctcctcttgacgaatagccttgtccacaagcttctcaaagtcctaatagtctatagagatcaactggttggtcaattcatcatcaagaccagacataaacttctcctgcttctcggcatcggtacgcacgtcctcaggggcgtagcgcgcgaggcggttgaactcatgcaaatactctataactgttttggttccttgttgcagggaacggaactctctcttcttttgtcccacaattccctcgggaacctgtgctttattgaaactatgacgaaactctgtccaagtaacctctgccccagttggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaggtgggcggcttgacacgaagaaattctaacagtttggactgaggaggcggaggaccaaattgcgggttctgctgctgctgctgtgcttgctgttgcacctgctgcaacacctgatggtactgtcgctgcatctgttgcatcatcattgtcatcatctgagtctgattgtccaacacctgagcaattgttgggttctcaggtggtggggacggactgttgtcagatgcaccgttggcacgtgctccattgatcggctcttcgctgccactggcgttgttcgagtcgcgtgaaccattccttgtctccatctgaggggataggtagaaatatgagaaaaggaagaaaacaggggctcagaaactaatcttgcttatgaatttaagtgcaattatcttaatcttgattaaaacactgaaaaagaggcacgaaactcctaattgaggcagtcataccactgacacatgatatcgaccgccgactaacccacaagcaacaaacctaaacacgaaaactagcaagcaaacagactaagaaggcgataaagctaagggcggcgactctgaagctcgaggcggcgcttgcaaacgagggataggactgacatctaaagtagacaagggataggaaccaactcatgctcaaatccaaattaaacaaagcaaaagaagactcaaataaataaccgagcatgatgatttttatgcatagaacatttttcatgaactcaaataaagacactaatgcaactaaacaataaattaatgcatagactagttgcatggaaaatgatgcgcataacattgcccccatcgaatatagacacgacctaatgcataacccccaataaattcccgactgactgtcgaataaactccaactaaaatttttctaaagccctagactgagctcattttttaaaaaaaaatccgatccgaaagaacgaccaagatttttcccgcaaaccaaaggggcaaaactccaaatttttcccgaaacaattccaggtgcaaaaaggcatatgcagatgaaaaaggggttcagagggctcttagggtttccagttggcttgtcctacggtcaaggtcggctctgataccaacttgtcacgcccagaaattctcaaaccagaatttctaagctgaatgtgcattaaatccctgtccaggaccagccagggtacacaaacgacaattgttgacatacagatccacgtcttacaaaaatagaaaagattacaaatgcagcggaaaagaataaaagcgagctaaaccgggaagcttgacttcagcagcgggcgactccactccacaggcaatccttgacggcagcgacgaaaccaactttgacaaaacagctccaactaggaagatctccagctctggtgtgggggaaaaagagagcaagactgagtactacccactgtactcagcaagtcataccggaagaggaggtatgatgcaggatataaccaaaggaagctaggggttcttttgcataaagcaggcatttcaaagcagtagttgaaagcagtaaaacagctgtagtaattaatcaatattaaccaaacactgtccaacgctacaccacgttgcaacaggcccaaccaaccacctgaactacaccagttcattaagctaaactagggatgagactaatcacggtgaatctggttgatcgcccataaccgcgggcacggctattcgaatagttttactctggctagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaaccgccatgggtgcgaccagcaaaaccatgcacccacagcccaccattcagtgtattttaattaactcacaccattgcggtggcaccaatctaaagctatgccaaaagacagagtctatgtaataatgtgatccccatttgtgtactagttgaactaagcatggctaagcatttcctaaaccaacatctaatcattttgatacccaggttatcaatggcatatggtaaacaataaatggctgagtaataggacccatcccacatgatattgtaaaagaatgcaacatttaatagaaatacgggatatttgtaaattgggtacaatatgatcaaacgtattgcatgacttgccttgctctcgcactgatgagatcacagcaacgtcttcgagaaactgcggatcgacgaaacggccgaaacctacgcgacaaacaaagcacacaagcaaaacatgctataagactacagaaacaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataaagcccagggctgacgtcagcgaggggagggggtatcgccgacaggcgggccccactggtcagcggcactaagggggggagagggggcggctggcaagcgggccccactggcagcggcacaaggggaaaggagagggaggcgccggcatgtgggccccacgggcagtggctcaagggggagggagtgggcggcgacatgctcggcacggctcaagccggccggccatggcgaggcgacgacggcgcacgaccgccggcggtgaccggcggcgcggggagacggcggcggccggcgcgaaggcggcggcggcagccgaagacgacggcgcacgcgcggagggcggcggcgctcacgggggagaggaaaggaaggaggaaaggggattcctcaccgaggcgatggcggcgaccggcgtgggaagagacgagcggcgatgaccggcgacgcggaggcacggacgggcggcggcgacaccctaggagaagatggagaggcgttaggagaggagacgacgaccacggcggcttgaattgccggccggagatggaggggagggaaaaactcaccggctcgcgaggggagaggtgctccggtgggattccggcgacgcgaggcggcggccgggaaagctcttgcggcggcgaagctaacagcggcggcggtttggcgcggcggcgactctagcggcggcggctcgcggccaaaggcggcggcaagcggcggcgctagcaacaagcggcgcgagcgcgataggaggcacgggagagcgcggcgagtgcgaaaaacgagagaggaagacgcggggagcgatttataggtgcgggagggggcggacgtggccggggaggtggccgatttggccggcgacgtggggagtggagggagagtgagagaggtggattcgaaatcgaatcccgccctctcgagtgcgcgcgcgggccgggagatgcgggggaagaggcggcgacgtgggggggacgcgggagcggcgcggcgtgggcgcgggaagagcggaggaggcggcggcgtggcggattcggcggcggttgccgtcggaggcgggtggctggaggaaggggacgacctgacaggtgggccccacctgtcagcgtcccggagagagggggaaggagaacgggccggcccacaaggggaggccgagcgcgggcgacgggtggactgggccgacggcccaagaagaggaaaaaaaaaggaggaaaaaggaaaaagaaaaagaagaaaggattttcctgggattaaaattgcactttggtgatttttaattggtaaaaattatttccaaggctctaaaaattccactaaaaatcctgttaatatattgtgacatgtggaacccaaaaaaaaattccacatgccgattccgattattatttgcatttattaactagggaattagctcttggttaattaagataatttcttcgggcaatttatttaaccaatttttaaagcaagcaaaggggggaaaacttcagggcgtgacaggacacttcctagccagatgaccaggttgcccacacacaaagcaagtcctctcatcctggttaggattgttgttgttcttcttctgcttcttgaagttggtggtctgttgagctttgtatttccccttgctcttgttctgggccttgtgcacaacattggcactagactgcccaccatcgcccttagacgcggcgtatttttcccgagttttctcctcaacatcaagagacgctatcaacccctcaacggagtattcctgtctcttgtgtttgagtgcagtaccgaaacttctccatgatggaggtagtttcgcaataatgcacccgtccacaaatttgtcgggtaagacacacttaaggagttcgagtttcttagccatggtttgtatctcatgagcctgttcgactacagaatggttgtcagccatcttgtagtcatgaaactgctccatgatatacagatcattgctagcatcagtagcaccgaatttagtatgcagtgcatcccacaactccttagcgtcggtcatatgcatatacacctcgaccagacgatcgccaagaacaccaagaatgcatcccacaaagagagtagtggcttcctcgaattgcttctgctgatcagcagtaagaattccttcaggtttgccagtactcacccagaagcatttcatagccgtcagccatagagtgaccctgatctgccttctcttaaagtgcacaccggtgaatttatccggcctcagtgcatcggcaaaaccagccatagtaaaatcacggcgcctataataaggtttttggattgttgaaattataagcacataatgatttaatttattccataaataaatcatgatattgcagatgtaaactagattgaacgcatcattagatctacacatgtaaactaagcagtaaaacatgaacagatcaaatatgcgcaacatgtcgaacacgtaccgaggtggcggaaagaccggttgctcggcaggaactactcgcggttacgagcgtcgacgaaggcgtgaagcacgcgagcggagaggaaggcgagccgtcgcggacgaatagggagcagtcgcgcaaagcgcttcccaaaaaccttattgccgccttctcccggtgcaggacgtcaaaggcagaggttctggagacctgctctcccgatcaccggtgcacgccggcgagcgggatggagtagtctacgagcgacggcgcggtacatagtaggaggtaaaccctagattgatttcgcgtgtgttgcatgaaggcggcggctcggtttatatagagataggtcgcctgatcacggcgcccgcgtaaaccgaaccggacaagtcgcgcgtaacctatccggactccacgccgtttttcacgcaccggatttttcggaatgtttccaaaacaaaacaaatccgattttcccgtagcaaaacaaaactgtaaaaggaggctgcatctgcgcaagggtgaggagtcaattttgcggaccaccggcgagcgggatggagtagtctacgagcgactgcgcagtacagagtaggaggcaaaccctagattgatttcgcgtgtgttgcataaaggcggcggctcggtttatatagagataggtcgcctgatcagggcgcccgcgtaaaccgaaccggataagtcgcgcgtaacctatccggactccacgccgtttttcacgcaccagatttttcagaatgtttccaaaacaaaacaaatccgaatttcccgcggcaaaataaaactgcaaaaggaggctgcatctgcgcaagggtgaggagccaattttgtggaccattcgatgcgtacatcgtgcacgcgcaccgcctgccctgccaggcgagcgagcgctcgcgtgtgtttcccctcttctctccaccacacaggcttcaagtggctaggagggcatcctcccttttaaggaggtccccctctcctagaataagcaaggtggtactaaactccacatgcatgccatcccatgaggtgggcttttgtgattttccaaagaattaatcttcgaatgggccttagcccatctattaattccaacaagcaatacacagaaaattgcaacttggtactccatatcaaagaatataggcatgtgtttgattcaatggttggaatgggttggattggattgaattgaacacctttcataggtgagatgagatggtccttaatagaaaatactacatccgtcctaaaataagtgcagcagtggatatttgtgcccaacatttgactgtccgtgttatttgaaaaatttgtgaaaaatttgaaaatatttagtcacacataaagtactattcatgttttatcttctaatagcaatagaaatactaatcaaataagatgaacggtcaaacgttgaacgtgaatagtgcaaaaatgcacttattttaggacggagggagtatttcccttagatttgagttaccttatcccttaaaaactggcaaaccagtccaacctatttttttctctcactgatacgtgggtcatcattttttcttaaaaaaacaaagaattgaaggattggtttcaggatagaaacaaagaaccaactccaagttgaaagtgtagagaaagagcaaagcaaagaggctggcagagagccatatctcatgctcctccaagagcctggcgatagaggccagctggtctagggagcatggccttggttattgtgcccctgcctcctccattagcagcgcttcgcgaaggcgcgcacatggctacgagaaggtgagcctggggtccttgatgtccagctccaatggggcggtgcctgcctcattgtcattgaggggtaggagacgaaggtagcaactcgtgtagaggttgatggcggcagcaacggtggctaagctgtggaaggtggcatgctcgccgacgaggttgatcttacctaggccgtggcacaaaccatcattggtgatatgacaaatcctttctgctagtgtcgaatcaaattgatcgatgttgatgtatgcgataagcttattaaattgggactcaatattaccgaagtttggtactccaagcaacaacaacccaaaggcaaccgcttttaatccctttggatacactccttctgactcactttgaactctcgggttttagggcctaaactatgcaaactacacggatgtgtatccctatatatgctattcggcacgtataggccacaccacccatagtgaagggcacactttggtgttttttgcgcttcagcttttgattatttgtgtatcagtacataaaaatggtttttgttttgagacatgggagcaacaaataaaacattaacataggttaaaaggggccacatacttgttttgttgccatgcaaaacgaatgcaatgtgcaacaattatgctcaacactcacgtactcataaagttgtatgacatatacttcttgctggcttggtggcctacagtatatgaagaaaggcatgctaaataaaagaaaacaagttaatacaacataggcttacgacacaattaatttggtcgattcataaataaggaagattcgcaagaaattaattgatcaatagcaaagattttattattgattgcacctgaggtagttgctagatttgtttattcatcaccagcaagaatcatgttgccatatcaatattttacttgttgattcttctttcccctgtatattcaagtaaacggaaaacactagataatactcgtattagataaacaattctatccatgatctgaaaaaaatcaaaatatgccatagtctacatttcattgtagaaaaaaaaggatacaaaggattttttttattttctgaacctttttaatatttaattttagaaataaacctatcgaaattttattttcaagatcttttggccacgctaaccaaactggcgtggcaaaataatactgtcacgcctgccatgatagcgttatttggtcacatggcaaaactgtcacgtccgctataggtggcgtgccagtgttgttttgtcacgccagacaggttgtcatgaccaaaaggttcagattttagaaataagttttgaaaaggcttagttttaaaattaaaaattaaaaaggttcaaaaaaatacactaattcccaaagaagaaccgggtctgtaatatgatgttcttaacttgattttggtcttgaagacactggaagaacatacaaacagaagagtataaattagatagtacatgttggaattaatggacgggccttagcccactcgaagattaattctttggaacatcacaaaagtccacctcatgggatgacatgcatggggagtttagtatcaccttgcttatttaggagagggggacctccttaaaagggaggatgccctcctagccacttgaagcatatgagccacacgcacgcgctcgcctcgcctagccagggcaggcggcgtacgcgtcgaatggtcagtcaaaattaattcctcacccttgcacaaatgcaacctcctatccggttcggttacacagagtggagatcgtgtcccttgcgcagatgcaacctcctatccggttcgattatacagagtggagatcgtgcggacaccctctgtgctgcaccggcgatcgggtcgctcgtagatattactccatcccgctcgccggcgtgcaccggcgatagggagagcagtgcgcgccttcgtcgtcgcccgcaaccgcgagtaattcctgctaaacaaccgatctttcagcaacctcggtacgtgctcaacatgttgcgcatatttgatatattcatgttttactgcctaatttacatgtgtagatccaatgatgcattcatgctagtttacatctgcaatatcatgatttatttatggaataaattaaatcattatgtgcttataatttcaacaatcaaaaactttattataggcattgtgattttactatggctggttttgcaaatgcactgaggccggataaattcatcggtgtgcattttaagacaaggcaaatcagggtcactctgtggctgacagctatgaaatgcttctaggtgagtactgacaaacctatgggagttcttactgctgaccagcagaaagaattcgatgaggccactactctctttgtgggatgcattcttagcgttcttggcaatcgtctagttgaggtgtatatgcatatgagtcgaggtgtatagagccagatatttttttttgaacccggcaaaagctttgtcatttatattaatagagtaggaaaaatggtttacatacagggggttactaaaattcccctcctgcaagaggttttgggctgcagactacgtgatctctcctaaaatatgcaatcctccaagagcaaccgccccagccttgacctaggttcttgcctcttttattttcgccactatcgctgcagtagttgaggcgtggtggcggaagattcttgcattacgctcacaccaaacctcccagcacattagaattatcatcgacttcaaggtctttgtcgaggtgggagtgcacgataggaggaagtgacaccaatcggtccccgaggtaagcctaccccaatcatgcatgagcaggtcccaactttcccatcattggatttcttcccagattctgcaggttactctacaagaagtcaataggtgcacggcagattcctgggtgactcgacataggggacatagttgctgattctgccatcctctcttctgcaatctatccaccgtccatatacagatttggatgaccagccatgcaaaaaatttacattttggaggggcccaacacttccatatggtttcattgaaggtagatcttgtggcgccgatgaattgcagccgatatgccaattttgtcgtgtatactccgttggctgtcagtttccatatgatggtgtcttcatgctcattgaaggccggtggctgaagtagtctaacccaaaggtctacgtattggcgaagatgttccgacgtggagagttcctctgtgcggataacggagatccatactcctgcgtccacggcttccctcacagacctattttttcgtcttgaagcttggaagattagtggcgctaaagacttcggcgttcgaccatcactcaagtgagagtgccagaagctcgccttctttctgtcaccaatagtgctggttgttgccacagcgaacagatctctatcctgattgtcacagggtaccggtgttcctatccatggcttatcgggggctgtccattcgtaccatagccagcggactctgagagcctttgcgaatttgtgcagttccaagatgcctaggctgcccaagtcctttggcctgcagaccctttcccagttgactttacattttcctcctgagatgttctcgccccccgcccataggaatttccatcatagtttgtcaatttcgtgtagtgtgttttcagggatctttagagcagtaaggtgatagattggttgcgccattaggactgactttgttagtgacgttcttcctgttgccctcatgagtttcccttgctagggtgctaactttgttacgatcttgtcgagtatcggctggacgtggatcttttttagcctagagacagtgaggggtagtcctaggtatttcaaagggaaagtagcaaccctcgccgggaacgcaaggaagatgtcatgtagatcgagattcccgcaacggatcgccgctatcctgagggtttaccttcagcctggtgacctttccaaacattgaaaggaattttgaaagatttgtcatatctctggtggttggtgaaatgaagttagcggcatcgtcggcgtaaagtgaggttctcaatctcgccgcccttccattgagagccagatctttggccttggggatctcgtgctcctttaggaacctggcgatggagctggttcaaggagcatggcattggctcccgtgccccggccgccgtctcctcttgcggaaaaaactcccctgagttgcttcacttttctagaccttgaagcccaactcttgcattgcagctgcatgcccacctaagtacctattactgtacaataattcaactttgttatcaaatataattgtttgcataggagtacagaatatttgaacctttgtttctctgtggttctaaaagaaaggacaccaaattcgtcgcaaactattctcagccaaaaagggaaaacgactagtttagatatgattattcatttacgagtacgggttttcagtctttataaactaactggaactgtttgagatcgcttaatcactgacaattatcatgcaaccctatgtgatatgttattaactaggaatatatctctaacattaacactgctaagactagtagcatctaccgattgagggaccaagttggttagtagatgattggaaaaagtacactgaaggtccctcaacttgtcatcgaattacaaaatcatcctccaaccgcaaaaccagatataggacatccctcaacttacaaaaccgttcactttaggtccttcggtggttttgatcccggtttcgtccgatgtggcggctgagtcagcgtgggacccacgtgggtcccacatgtaagggtgtacagtcagcacctctcccttcccccttctcccccttcctcttctctctctatttctctctctctctcttcccctctgcaggatgcccggcgggtggggagctcgtcggggcgaggtgggagaggacatccggcgggccgtcgatgcggcggcggcggcggcggcgtctacgatgcgggagaagggagagcgtcacaggctcaccgcgcgtgcgacctcggggtcgggccgtcagagaggcccgggcggtggcggcgaggacgccaaggcgcgggactccggatggtggcggcggcatacgacgcgctgcgggcgccagtttgggaccaatattagaggagcagagaaaattagggccaggccgtcatctcccgacgatggcggcgaggcagaggaagggcggcgcggcgaggagggctcgacgaagaagatgaggagcgtggtgctgcgggaggccatggcggggctcccggagcacggcgacagtcgcgtgaggtacgacgacacgtggtgacgggcaagcgagggcggcgaaggcgagcccacagcggtgg

SEQ ID NO: 63059 - DNA, 670 bp, Oryza sativa
agctgctgtctaataatgctaattcagttatgttgccagtgttctcgaatctttgtagtatataacaaagctgtttcctggactgtgctatataaccgaataatggtttggtagtgattgtcttctcacttatcactaaggtgttcttttacttcattctgaaagaatatcacttcaattataaattcttatggtttctggttttcagtctgaatatccattaagttctatagctttacaacagcaccgagactgactgaagaatgtgacgtctatgatatgcaatatgcaggtggcgtttcgcaccaaggttttccatccaaacatcaacagcaacgggagcatttgccttgacatccttaaggaccaatggagcccagcactaaccatttccaaggtttcctttctcgcttaacgctattttacttttgcgaggcggttgcttggtctctcggcgttgggctgaacgaatcccgcaaaaacatgtgctctctgcttgctttcaggtgtggctgtcaatctgtccctgctgactgatccgaaccctgatgatcctctggtccctgagatcgctcacatgtacaagacagataggcacaagtgctagaacacagcgtggacctggactcagaggtacgccatgtagcacctcaaatctctgtggacatgt

SEQ ID NO: 63060 - DNA, 2509 bp, Oryza sativa
agataccaacaggatagagaacgcctattgctcagcaaaatccacctgttggagcccagtttgtacctgaacagcatatgtataatgtgcaacagcctccgcagaactatcttagcggtaatttcaatctccagtatccacctcggtcacctcagatccaatatcaagcaggaggatcacctcagccctagtttgttccccagctcaatcagtttgatccgatacagcagcagatgcaaggagtgccccatcaaaagccttaggccgacatgattgcagatgtgatgagggagtagtttgggcttaagccaaaggactctggaaatttgtatcggcacccttatcctgagtggtttgaaagagttccactgcctaaccgatacaaggttccagatttttcaaagttttcaagacaagacaatgtttcgacatatgagcatgtcagccgattcttggctcagtgtggagaggcatcggctgttgatgctttgagggttcgattgtttcctttgtctttgtccggatcagcattacatggttttcttcattgccttacacttctgttcaaggttgggccgatttggagaagcaattccatagctcttctatagtgggacccacgagatgaagctctctgacttgataggagttaggcagaggcatgatgaaaccgtgcaagattatatttagagattcagagatatgaggaacaagtgttatagttttgccttgacagattctcagttagccgatctcgcattccagggtttgatagctcagatcaaggagaaattttcatctcaggaatttgaaagcttgtctcatcttgcacagaaggtgaccctacatgagcaaaggtttgtagaggctaagaagaatttcaagaagatcaatcatgtatatccttatatgtatgattccgaagtggcagcagctgaatgggtgaggagcaaaaaggttgtgccatgtcaatgggtgaagagttttggaaaagaggaaaggtatgactttgatatcaccaaggctgataagatttttgatttgctacttcgggagaaacagatacaacttcatgctggtcacataatcccatcggctggggagctagggaagagaaaatattgtaagtggcataactctggttcccatgctactaatgattgcaaagtctttaggcagcagatccaagcagctattgagggagggaagataaaatttaatgattcaaagaagccgatgaaggtagatggacatcctttccccgtcaatatggtgcatacagctgggagagcagccgatgggggaaagaattcggagttctcaattgaattcagcaaggatgtcacgcccagaaattcatgaaccagaatttctaagctgaatgtgtattaaacccctgtccaggaccagccagggtacacaaacgacaattgttgacatacagatccacgtcttacaacaatataaaagattacaaatgcagcggaaaaagataaaggcgagctaagcctgaagacttgactcctacagcggacaactccattccacaggcatccttgacggcagcgacgaaaccaacctcttcgagacgtcttcaactgagaaggacttcaactctggtgcggggaaaagagagcaagactgagtactacccactgtactcagcaagtcataccggaagaggaggtatgatgcatggtatatccaagggaggctaaaggttcttttgcataaagctagcatttaaaagcagttgttgaaagcggtaaaacagttgcagtaattaaacaatattaaccaatcactgtccaacgctacaccacgttgcaacaggcccaaccaactacttgaactacaccagttcattagctaactaggggtgagactaatcacagtgaatctggttgaccgcccataaccgcgggcacggctattcgaatagttttactctgatcagaggtgtacaactgtacccacaagacacagccccacgacacattcccgtgcaccgacatgccaccatgacataccggaaagaggccgtgacaggaccctttgcataacccctgtaaccgatcgcaccacaccttagggttcgcccccgtccccagcaggcaacgggcagccccccctttcgtgccgcgatgaatccggaagccgatcaaccggacagcccggccgacccaactccatcacgcccacccttgcctgggtacgtcggctagagaaaagctacactacaagcccagccgttgcccacgctggcttgtggtaagcacgataaattcttccagggtttcccgcgaaccggtccttaatcgccatgggcacaactagcaaaaccatgcacccacagcccaccatgtagtgtattttaattagccaacaccattacggtggcactaatccaaaactattgccaataatcaaagtctatgctttaatgtgattccccttttgtgtactagtagaactaagcatggctaagcatttcctaacccaacatcta

SEQ ID NO: 63061 - DNA, 10248 bp, Oryza sativa
gcggcttcgggtgggggcgccgcgccgccggcttctcgtcgcttgccatggcgctggaacgggggaggacggccggagtggcggctcgttggggacggcctcgcggaagagcaacggccggaaggacaacggcggcgacaacacgtcggccggccaactccctcctcgccgtctccatccctacttccctcccgctgtcgccgtctccgtcttccgctcctccctcgccccggatgggagtttcgtcggagcggcatcctcctcctccacctctccactgccattcccctcaagctcccccttcgctctgcccctgtggtctcgccaccgacgctcctccccgctcgcgtgcgccgacctcgtcgaccggggtgacttcaacggggcacgccgcgacgggacactgtgctcgccgccgccgacctcgtcgagcggggtgacttcgacggggacaagagaggccatggcgatgcccgaccgtggcatgctcctctgcaccagcgaccgcgcccgcgcccgccgcaccgtcctgccgcgccgccctggctgctcttcgccggccaccgcccatggagagggaaggagagaggaagtgagttgatggggagggtaagaagtggtgacgtggacagtctaacatgtgagtcccacgctgactcagccgccacgtcggacaataccagggtcaaaaccaccgaaggacctaaattgtaactcgatgacaagttgacggaccttcggtgcactttttcctagatgatttggtcctgcactaccaatttcttattaggatttttagcggtaaaaaaatgagttgttatatatgagctgcagacagcagcacaaaaactggtgttccactattagtttgacttggccgacagagagaggaacacacattctttttagcgagatgatggaaggaacacacattctttttagttggaatggcagtttgcaacacactggattgaagaatcagtagctgtagagatgttcgttatcttaaccaatcatggagttaggtaatctattagaatattcagcttattctgccgcggatgcagatcgtgattgctgttttgttttcgtgggaggtcgtatttatatgtaggctaaacggggtaaggaaatttgagaattacagagtaaagtctatcaccggtccctaaacttgtaccgttgtatcattccggtccctaaactcgcaaatcgaccgttcaggtcctcaaacttattcgactgtgtcatctcggtccctaaacttgcatatcacttgtttaggtcctccaacttgttcagctatgtcaccctggtccctaaacaggatggtctaaaaactttatatcaaaaaataattcataaatttttcatgtgaactctaatgaagacgaactttatatcaaaattatagctctcgacacgacctacaactttgtagttgaaaagtttttgaattaaaactgtttagggtcccaaaatattattgcatgtttatagattttgaaattttaattttaaaattacattttgggacaaaaaatgacttaaaataaaaaaaaatcaactacaaagttgtagatcgcatcgagggctacaagtttgatataaagtttgtcttcattagagtttacatgaaaaatttataaattatttttaaatataaagtctttagaccgtcctatttgacccagatgatattcaaatccaagtttagggaccggggtgatacaactgaataagttggatgacctaaacgagtgatctgcaagtttagggaccggaatgatacagtcgaacaaatttgaggacctgaacggtcgatttgcgagtttagggaccgggatgacgcagcggtacaagtttagagaccggtgaaggactttactctagaatacactagactagagtctagagtatacatagacatgctgcatagtaccatgtaagtggccaatttttttttttggttggcaaaacagattatgtgatatcgccccacaaacgtgcaagcacaagttatatatttgccatcaaacctgcaagcacaagctcaactctagatattgagaaaaatacatatatccggctaataatgtagctacgctttgtgtaattatgatttttcgccactgatgttataactcatgaacagatagattctacataataaatattgtctctttatctaactagatgaaactccgcgcgttgcaaaagtttagtatgataagagcaaataaaaataatatttaagatagctaaacaacataagtttacgtaagttgatgtggtttatataatgatgattcaaaagtaaaagtaagaagatgtagctttataacagaagaaaaggaggcagataatttggactatacatttacgatcaaagggctaaaaataattaaggttatatggtttaatgagagaagaaaacgaggaagataatttggaccatagattaatcatccaaaaactaaaaataattgtgatatggcttaatgagagaagagataaataacatgaactaagtgaggatgaactatatagatatataggatattataaaaaatgatggagagatttaaaatattatgtgatttatgtgacatgatgatttaacatgcttacattttaaagctctaaaatttaataattataaaataagtaatataacattctgtacagatgttcaaatgtaatagttgctagtggaagatgatgtgaccttctttttgcatgttgagttttagattttagtgggttgtaactttatataggataattaataaatattacctatcttcattaacaaattattattattattattattattatcatcatcattatcgtatacaaaacaaatatattcacatataccagtcacattaaaacttactgaaaaaagagtagtgggagcccaatcataccagagctggaatagtctagttttttttctttttttaaaaaaaaagagagagacggagaaagagaattcaaatgacaagctggattggaggcccatcatatcacgcttaaaaacctctcctcaccctcgcgctcacttcctactccatctgctcccgccatcgcagtatcgcaccaatctcaaagcacaccaccatggcgcgacgtcgcatcctacccctcctcctcgtcctcctcctcaccgtcgccgtggcaacgtcgtcggcgtccgcctacggcgccgatgatggcgtgaccgtgatgaggcgcgttctggacaccgccgcgcctgcaccggccccgggccccgcccccggcggcgccatggcgaacacgacgacgagcgggtacatcagctacgacgccctgttcgcggaccgcgtgccgtgctcgctgcgcggcgcgtcgtactacaactgccatcccggcgcggaggccaacccctacacgcgcggctgctccgccatcacgcagtgccgcggctagctagcttaattagataggccgccgcactgccggcgagatcgtctcgtcgcgccatccttttcttctctcctgcagtcaattgttctttctgttggatctgatttggtgattgattcatgatttatcggtgtaatgttgtatacttgtcaaattgttggaaagatatatatatatatatatatatatatatatatatatatatatatatatatatatatcttaattaagacactcctaattcaaattgtgagtgatgttaatttgtgcgcatcagcgcagttaacagagagtgaatgtgaagttggtgccagtatttgaataatggatcaaaaatgctagtaattaatacttccaggcggtcataatccagctttgttctaacatttacggtttaacctggtttaaccatagtccatggttgtaatgagctgttcgggactttggattttattcatgcaattttttctttctggttttgtaatcaaggattttgtattacctctcctgtatgtttgatcagaaccgttgtgcaccaatgcaatcttcggtttattttggcaatcttcaacaattcgttgatcgtaaccactgcagatgatgagaaagcctgacagcgaacgaataatgtatattataatctgggatccttggatgtaaatgtaatttccagagtaaccgacaaaatcatgtgctgcccttcctccaacctctgcgtggttgtcatgctcaaaaaatcacggcagaagaagcggagagagatcagataaaactgtgtagttgttgccacgtttctgcaacgcagaatcaactcctctgacttcatctattcaggtcaatttagacatataaattatgttggtatgacagctgcagaaggaaacatgagtagtggtgatccgtgatcaaagaggagatgcatgcacgctgcccactaattcaacaagatgatgatggcgggaacatgcaaacattctcttagttttttttatatatttttaagaatggcattcttttatttggaatggcagtttgcaacacatggaattgaattgaagaatcagtgtagtgtacattatcaatctatcataatccaatcatatcgattgatggcccattgggatcttcagggaagaagtctcatgtggatgcagtcctagttgacctcaggctttccgtaatccaaacaggagaatttcctcacctggttggtactggagctcaaaggagacgaattttttttatttttaattttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccgccctccgcgagggcgattttgtactgtgcgggggggcgcctgcaaatgggcggcgagggggcatggaattttgcaggcggcccccttgccgccctgggggagggcgattttgtactgtgctctatatttttgtataaatatcaatagttatcaaatctttttatattgaaaactatacaagattaaaatctccaagactggtaaaatacaattttattattttttagggcatatttggattgttaccgtacaaatattttgttaccgtacaaatattttattaagttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgttctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcatgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgctccgaagctaggggcgttcgaaggcaaacgaggtcctgcgaggatggaacatcaagttacgacggggtgatgttttcgtacaaaaacagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcgtcctctgctcaacgtcagtcaagtgcaaacctctgttcaaccttacttggactgcggtgatatcggcactgatatcccgtgcggcatcagcctatgcaagatggaaataacaaattcagtagttgtcctatattatgcaagataaatgaaataattgtaagaagtaatacaaattggacgtaccgccacgaagtagtcccggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgttgtgggaagagctcgttgatcacctcctctttagctaacacccagtcgtcaacgtactgctgtacacgtggagcccaaagtgctcctgctagctgtccccgtcgagtcaacctgtgaagagaggtaaattatatggctcgatgaagtaattatcataaaaagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgatcgtaacgacgctgcaataaacatgatcggaattagacatgttatgtgaagaaaaaaaaaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcaacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactcattcggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtccacgggaccaactgctgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgcagcctcaacaagcctacaaagtggtagaaggcctggcgcacgcaacctgtatagagcaaacttcaaacataagtacaacacaaagcaaagttgagttgaaatgagaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtccgaacactcattacatcacaacagcattttattttctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcattgtgtaagatcctgagatcccgaacccatatatctcctcactccatgtatgaaagattgcttctttcctgaaataatttgagacgtacacattgggagatatgccacaatcactggcagcagtaagaacgtgtgagcaagaaaggtgatgaagcttcggcttcatacaactgcaggtacatccaccatccgccttcaagacacattcctgcacggcttgcttgcgatagataccacgtctgctcctatcaacacacattatttcataccgatgcacttgtgtgccttgagcaacaactcgatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgcttatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatc

SEQ ID NO: 63062 - DNA, 6616 bp, Oryza sativa
ggatgctatataccaagaatcagaatctaacaaaaacaagttcaaattcagttcaaacttgctttcaactagttagtaaagtagttaatattaatacgtcaataattgaaaagtttcatgctcatttgaattgggtatatactcaattacaacaatggtgcccgggcaccatggagcaccaaacaaatttaatatataggacactcatatggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttggattgggtatatactcaatttcaacaatggtgcccgggcaccatggagcaccaaacaaatttaatatatatatataagagggatgtccttaagtggcatagaaagaaaacatctccctagaaatatgccatgcacatgtttagaaatctggacttgttgtcactcttaaattaacacgagttaatttgcagatgaaacctataccaagcagtacgtattgaaaaggacatcgatcgatggatcaaacagttggaacatgcatgctactaacattcaggaaagtcagaacgtctagaagcgaagaagcgaagagatcgagatcgttggcgagcggaaaaaacaattcaattaatggtgaaggaattaatgtgacactgacacacgtcatgtaggatatgttagttctcatcttctagacatgtggaggaatttacgtaatatggtcatatttagtccgttaaaaaaaattaacctcgacgtagaagtattctcttctaatacaataaatatatatatgatcctatcttaaaccgctttcacaaaatgaaatatgtattattatataattaattaagtatcaactatttttttagaaatagcttcgtatgattttataaaataactttcatatagaatatttttaaaaaaacacaccacgcgtgaaaaataagagagatgatgagttggaaaaatagagggaagaatatatacagccatatgtagtcatatcttttttaggttaagtttttctgagactcagagattacctcggtagcaccatcatcgaaaccaccaccgctatttggttgcttttgttggaattaatagatgggctaaaaccattcgaagattaattctttggaaaatcacaaaagcccacctcatgagatggcatgcatgtggagtttagtactaccttgtttattccaggagagggggacctccttaaaagggaggatgccctcctagccacttgaaacatgtgtggtggagagaagaggggaaacacgcgcactcgctggcctggcctggccaggcagggcaggcggcgcgcgtgcacgacgtacgcgtcgaatggtccgcaaaattggctcctcacccttgcgcagatgcagcctccttttgcagttttgttttgctgcggaaaattcggatttgttttgttttggaaacattccgaaaaatccggtgcgtgaaaacggcgtggagtcccgataagttacgcgcgacttatccggttcggttacgcggagtggagatcgtgcgggcgccctgatcaagcgacctatctctatataaaccgagtcgccgccctcacgcaacatacgcgaaatcaatctagggtttacctcctactatgtgctgcgccgtcgctcgtagactactccatcccactcgccagcgtgcaccggcgatcgggagagcaggtcttcggaacctctgccttcgacgtcctgcaccgggagaaggcggcaataaggtttttgggaagcgcttagcgcgactgctccctgttcgtccgcgacggctcgccttcctctccgctcgcgtgctgcgcgccttcatcgacgcccgcaaccgtgagtagttcctgccgagcaaccggtctttccgccacctcggtacatgttcgatatgttacgcatatttgatctgttcatgttttacttcttagtttacatgtgtagatctaatgatgcgttcatgctagtttacatctgcaatgtcatgatttatttgtggaataaattaaatcattatgtgcttataatttcaacaatccaaaaaccttattataggcgctgtgattttaccgtggctagttttgccgatgcactgaggccggataaattcaccggtgtgcactttaagagatggtagatcagggtcactctgtggctgacagctatgaaatgcttctgggtgagtactggcaaacctgaaggaattcttactgctgatcagcagaagcaattcgaggaagccactactctctttgtgggatgcattcttagcgttcttggcgaacgtctggtcgaggtgtatatgcacatgactgacgctaaggagttgtgggatgcactgaatactaaattcgttgctactaatgctagcaatgatctatacatcatggagcagtttcatgactataggatagctgacaaccgttctatagtcgaacaggctcatgagatacaaaccatagctaaggaactcgaactccttaagtgtgtcttacccgacaaatttgtggccgggtgcattattgcgaaactacctccatcttcgagaagtttcggtactgcactcaaacacaagagacaggaatactccgttgaggggttggtagcatctcttaatgttgaggagaaagctcgggaaaaggacgccgcgtctaagggcgatggtgggcagtccagtgccaatgttgtgcacaaggcctagaacaagagcaaggggaaatacaaagctcaacagaacaccaacttcaagaagcagaagaagaacaacaacaatcctaatcaggatgagaggacttgctttgtgtgtggccaacctggtcatctggctaggaagtatccacagcgcaagggtatgaaggcacctgcagggcagacttctaagtctgctaatgtgaccattggcaacactggagatggaagcgggtatagtaatttacctactgttttttcagttaatcaatctactaattggtgggttgatactgcggccaatgtacatgtttgtgctgacatctcattgttttcttcttatcaggtcgcacggagttccaccgtcctaatggggaatgggtcacatgcttctgttcatggtgttggcacagtagatctgaagtttactttgggaaagatcgtgcagctgaagaacgtgcagcatgtcccttctatcgataggaatcttgttagtggctcccgtctaactagagacggatttaagttggtttttgagtctaataaagtagtcgtgtctaaacatggatattttattggtaaaggttatgagtgcggaggcctgttccgcttttccctttctgatttctgcaataagtctgtcaaccatatttgtggcagtgtggatgatgactaatgtttggcactcacgtttatgtcatattaattttggcttgatgtctcggctttccaacatgtgtttaattcctaagttttccattgtcaaaggttctaagtgccatagttgtgtgcaatcaaagcaacctcgcaagcctcacaaggctgccgatgagagaaacttggcaccactagaactactacattcagatctttgtgaaatgaatggggtgttgatgaagggtggaaaacgatatttcatgatgttgattgatgatgctactagatttagctatgtgtacttgtttaaacgaaagacgaggctctagactattttaaaatttataaggcagaagttgaaaatcaacttgacagaaagataaaaagacttaggtctgatcgtggtggagagtttttctcaaatgagtttgaattattctgtgaggaacatggcatcatacatgagaggacgcctctctattctcccgagactaatgggattgctgaaaagaagaaccgcacactgactgacttggtgaatgccatgttggacaccgcgggactacctaaggcatggtggggggggcattgttgacctcgaatcatgtgttaaacagagtttctaaaaaaaataaggacaaaataacatatgagatatggattgggagaaaccatcactttcttatttgcgcacatgagggtgattggcgaaagtcaatgtaccaataacgaagaagcgcaaactgagacctaaaactatggactgtgtctttctgggatatgctcatcacagcattgcctatagatttttaatagttaaatctgaggtacctgacatgcatgttggtacaattatggagtctcgtgatgctaccttctttaagtgctttttcccaatgtaggatacacacagtagttcgagccaaccctctgaaataattcccagttcaatcacaccaccagaacaaactgaacatacacatgaacatgtcactaaggaggatgtcagtgaagctcctcgaaggagtaagagacaaaggacggctaagtcctttggtgataatttcactgtgtaccttgtggatgacactcctaagtcaatttcaaaagcttatgtatctcctgatgcagactactggaaggaggctgtccatagtgaaatggattccattatcgctaacgggacttgggaggtgacagagcaaccctatgggtgtaaacctgtggggtgcaagtgggtgttcaagaagaagcttaggcctgacgttactattgaaaagtacaaggctcggcttgttgctaagggctatactcagaaagaagacgaagatatctttgacacttactcacctgttactagatttactacaattcgtgtgctactttctctagcagcctcacatggtcttctcgttcatcaaatggacgttaagacaacttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcagtctttgcagtcaatgaggcagataaatgtgtgtactatcgccatggtgggggtgatggagttattctgtgcttgtatgttgatgacatactgatatttgggcaaaccttgaggtgataaatgaggttaaatcattcttgtctcaaaattttgatatgaaggatttgggagtagctgatgttatcttaaacattaagctaattagaggtgagaataggattacactcttgcagtcccattatgtggagaagatcttgaatcactttggctacattgatagtaagccttctccaacaccttatgatcctagcttgttgcttcgcaagaacaagagaattgctacgaatcaactggaatactcccaaatcattggctcgctgatgtacctggctagtgcaactaggccagatatctcctttgttgtgagcaagttgagccggtttacctctaatccaggcgatgatcactggcgtgcgcttaagcgagtaatgcgctgtctgaaaggtactatggaattggggcttcactatactgtgtatcctgcggtactggagggttatagtgattctaactggatctctgatgtggatgagattgttaacaaccaaatttggttatatcagtatcggagatgaggataagaacgaagcagaatcaaaggtggagatcgattcgagaatagagtaagaatcggttggagtccggatcggctacgatcaagatcggctgggtccgaatcagactgggtaagccgatacagccgattctgacaatacgacttggtgtgcaacatcgggttgagttgatatgcttcaagatgattgccgcgcatggatagagtcctgagaagtctaccgcaaagagattccttagagatatgtttgggcaaaagtctgccacaaagactcgtggtatcttagagtttattagagataagagtcgtgtccgatatggacatagtttgtattttcgggtataaatagaccccgaaccccatgtaatcaattaacacacacgttcaatacaatttcggcgcatcgccacccttttgctttagttttatttcgacgagttcttgctttcgggttgagctgcatcggtttcaatcttcaacaagaggtaaaacttgttatgacggcttgcgttctcgggattagtgcttccatctttatgacactctaatcttgtttatgtaattcgttgagttatcatatatcttacataatctttggcaatatcgctatctaacctacaatcggctaacatctatcggtagagggcagccgattaggttagacatcgacgttgacttagattatatgagatatctaccactctatgaaacttccagcgacttgattgtttagatattgttcttcttttcatacttaatgct

SEQ ID NO: 63063 - DNA, 2456 bp, Oryza sativa
gccgacacaggtttaccatatgccgacgagaggggtcccagaccaacaacaggttaggtcccagaccttactgtgccaggaagcccaggggtcctccccgacaccaccccggcgaatccacatgtctctcggcatcaaggctcccctgataagctagttactcagctaggggtgtcccattccacccatgtggtcgtacttgtcttatgtttggatgaaattccaaggaaacggtccttaggtgcaagagcgggaaaccgtatacccggtacgttccccggtccgcggttttggaaattcatttagttcgcaagcaccgacccaggtgtcgggttttccaagtcttttgtaaaacccaagttttacccaagaagtttttcagattttaagtttgaaggcgcccgtcgatactcgcacagggtgcacgaatatcgagacgcaactagatggttacaaggggacacgatataacaattatcaaaggaaggatcaaatgcaacaaattaggtaggtccgccaatctgccttgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggatttacggttgggaagatattgaatttctaagatttttggatttttggtctaaaggaaaaaggatttaattaaattctttttggaaaagaaaaagaaaagaaaaggaaagagggagggattatagacttttcctcgggcggctagggcgtggcccaagggaaaaggagcggaccgaccgagctaaatgggccggccggcccaaggcggcccaagtgcgcgcgcgcgggaggggaggagagagagggccggtggaccgggctcaccgtgcgcggtcccgggtgggacccgcttgtcagcggctcggctcaccgtgcggagggagcacgcggcgtacgcgcgcgggcggggaagggacatggtgcacgcgtgcgattagcggtggaagcggtgcggcgggcccacgcgcagcctcacggctcgcggtggaacgcgcgcacggggaggggctgaccgcggtcggcccgtcccgacctcggctgagctggcgccgacgtggcgcctacgtggctgccacgtgggctggcgggaggtagacgacgacgccggccggaacagacggtggacaacagcggcgagcggcggagcgaaccacggcgatacaggcgaaagcgagcacaccgggtggttgcacgagacgaggggagacgagccaacggctcggattcgccgtaggaagcttgacggcggcgaatcgcggcggcggcaaccggcggggagggaagagggaaacggcgacgaggtcacgaggggtcgattcccggcggtgagagcatctacgcggccacgggaatccgatgctagcgttggattgggcggagctacgccgagcgaggctggcgacgagcgggtgctacggagctcgagcggcgacggcggcgagcacacggcgagcgacggcaacggtcggggcggcgccggctagctacggggaggctactcgtgctaccaccgaaaactaagggggggagatggagcgaggaggaaaaacggagagaggcactaccgagatgaggaggggcgctgtgacgagaggccgacggcgcgggagtgatctctccggcctcgggctgaggaagaggaagaagagggcgcgcccggagtccccttccgtgtccttgctcgtgccggctcctccgacacgcgcaacgacgaacggcgacggcgaacagagcacgggaggcggcggcaatagcgcggaggcgaatgggagaagaaagaaaaaggggggggggagctcgggtttatagggggcggcaatgtcggtttcgaaaccgactttggcggtcaaggcgcgagctggcgctccggctagcggccaaaacggcgacaggagggagggaggatgacgccggcgggaggaaaaaggggaaaaaggagggggagaaaggggcttgtccccttgcctcttcgggaaaaggaggagggagcgggggcgtcgcggcagagggaggagggaggctctgcctctgtcccttggcggcttgcgcgggagtggcggggccgaggcgatgacgacggcgatgacggcggggcggtttggagcggcgcgacgacacgggcgacaggcccgtgcaggggctgacggcggcggcgaccgggcggtcggccaccacggcacgcgcgcgcgggtcgcaac

SEQ ID NO: 63064 - DNA, 8509 bp, Oryza sativa
ttttttccacctctacaggcggtaaaggtttcaccgagttgggtcaatggcgcaatttgggaaaattgcaaaaaccacactaaatgtcatcctgattttgaaattcccctaataagattatttgcaaatacacagtcctaattcaccttgattcgatattcctcaacatttgccgttgttcgcattttttttccttttccctcatgtgttatatgacttagcgcatctaactcagtgtgacatttgggattgtttttacaatttttccacgcaaacaagatagcccatgtgttacgcccacatgtgcgattaggtatgaccgaattaagcaaaatgcccatggtcgagcgccctcctgttccacagctacactcagggccggtcctgggattttgaggccccagggcaaaaacttatatggaggcctctatatatatacataaactaatatatacatatttatatagtcttataaacacacacacaacatttaatattcgatgtgataaaattatctatatataacattttaaaacttcaaagagaaataaatagcagtagcgagcagagaaggtgaccggcggacgatcgacacgagcgtggctactagcgagccgcgatttgccgacttgttgtttccgtttgcaagacgccgagaagtccttgagagcgtaggagcagcgagcggcgtgatgtgatcgaggcggcacgatgcgagtggcgtgatgtgatcgaggcgaagcgacaggagagtcagatgaagatcgcttcggtttcgctgaaacaagcctaacaatggactaaaattcattttctgtattcggctattcagctgcctaacttaatatggacccatggcccatggactttatatactatatgtgtacaggggcccctagatttggggggcctcgagcggccgcacggcctgaccccctcccccccacccaaaacacacacaagggccagccctggctacactcaacctcccacaactctcctctccttcccttgctctaaccacttcattagcaaactttaaatgttttcttctaaattatttatttttcaattaaacccttctattatttgcaatttcatctttataacaatatattggtcgacgggttatatctgactatgatatttgagggacgtaggatatggctcataccaacatatgcatgagtatggaataaaaacatgggagacatgagttttatactggttcaggctctcgtaaagggtattggacctctccaatttatatgtattgagctagggtatatcacaaaagaagaggaagcaggctagctaatctagcctaccaaactaatctcgatgagcaagacaactggtaatactcggtggctagcagaaaaggcttcctcctagtgtgaactcgatgtggcctgatggaaagcttataattcgatacccctcctcggaggccctatatttataagaacatgacccgttgtgtaagtagaactcaggatcccaaataggatatgggcagataagaccttatcatccatatattggactacactgtccctcattaagtggatcagattccttcattgtccatatttttattcatacgtaggaacaccatatcgtataagaatagataaatacggtattcctggtgataataagtgcaagtatattaggtatgtcatatctacaacattgacaatatcacacaattatatcccgctgaaaatgatataaatatttcaaccgttataattcgttaaaattcaatgttccatgtaagagagtgtaatatttcaacataaatactaatatgtttcacacttaatgtttttgtagtgttcttttggatatttcaataactattttctatgttcttgtggttcctgtggatattttataatgtttcgacaagtacaattcgatgttttcatgtataatataaaatacttcaactagaaacataataattttttatccaaaatatatttatgtgagatcttactgtaaagacttatttacaataatagaacagtgtagttagatctcatatcagatagacaatatagtaaaaattagtttaaattttgcttaataaattattaagggaaagaagagagagaatggaagtggagacaagccgtgtgtgagaagtatgcatagcctgatgcacgcagaagtcatcatgcaaagagtggatagagaaagaacaagtgcagggagaggggtgggacaaatatttcgtgtttttattaggccaagtgtgtaggcgtctccgtgaattaatgagcgagatgattaattcgtgttgtgactagagtcatcaggccttcatgcccatatacatgcaatcatttagaatatattaaaagttatctaaataaaatttctatttgcaagacctttttgatatatttgaaaaagaattacaatattttagtcattactgaatatttttaaaatttgggtaaaattttgtaatagatactttttccaaaataaagtttcattttaaatttacaaaattcaattaattttctactaaaattttaaattttcaactcagttgttgaaactttcaactcaaaactcaaaatttgaaaaactctacccaatagttgattcttttcactccaaatataaaactttctaactcatattttaaaacttaactgatatttttaaaataactactatccgttgaggttggaaatggaatcggtattggtatagcgtcgaaaagtctgatgcgcagtcgaacacggtcacaacaagagggggcgaggtggaagaggagccgcactgctagtatgggcatgcataggtcaaggttcacaacagctgcggagctggaacagaacggaggggggtgcaccactttgccgaatatatgggcacattaatctaacagatagtgttttttttcatacatagaggggataataatgctctaactaatggtattttttttctgtagcagcacattgctctaactaatagtattcttgtacaacttttaacataaaaaattgaaatgtgataagcaagaaaaattcttaccaaaaataaagggtagaaggaagcctcgaaggaaaacaccatgaagagaaatttagccagtgcaggttgcaaaagtcctgaagccaggggcgaagccaagataaatgatcgctagggtcattactaaccgggtctatgttttcaaccagaacggattgaaaacaacgcaatttcgatgttccaacttgggacaaaagtagattttgagtgaaatttggaatagtttttcaagaattcaaatttgaaattgtaaaattaaaccaaattaataaaaaaatatcaaattttggtaaaaaaaaaagccatattgctatatttggaatctaattttaaatcgaattggtgaaccctgatacaatctgggtgtgttcagacctagctacgggatctgaacccttccctcccagcacgcaaaatagagcgaggttaccacatgattaattaagcattattagcttataaaaaacttgaaagataatagattaatatggtttttaaaacaattttctatagaaattattttgctagggaatttgaaaagttacgagccgctggccttatgcatggtctcaaatctcaaaaactcaaagtatatgcatattcggctgacatataaccataaatgctaggtaattttctatttgctgctgctagtattgtttctagttgtcaattggaatttaacacaacaatcaacaattaatgtcaccggggtctaatatttgttttcaccggggtcatagctggtaaaataaagaggatatgagaggttaaaataaaatcatcggggtctactgaccctggtaattgactgtacctttgcccctgcctgaagcagatgccttcgtttataatcttacaccagttatttaataaccacaaatttagatgttcaatagttcaaaccctaacctataatatggataaaacgaaaaagcactatcagtattcagtaatcacaataccttttgatttttgagatttatttggaacaaaaagtaaattagattagaagaagagtagaaagtcgatacctttcctgaaaacttttggccttttggagataacactagaggatgtcatgacgagttgagattagagaacacgatgatggagatgtgtatagcttgagatgtgtctaaccacgagatagcaattgatttccactactcggcgtcgacggcgatggccgatcagggctgctgatgtcgaatcgacaagcatcgggtcggcgacaggaaacgattgaggagagcgattcaagtggtatagaaggaagaaaaggagaaaaaaaaaagagaaaggtgaatgggcgggcggggcggggcggcgcgacaaagtcgcggggggatcgaggcgtcgctgccctctctggacgaccacaagatttggtgcttgcgagcccatgcaccagtgccttttgcttatgggaaaaaagtgcacttagactcctttaattgttcaccgaatctaattcgttacccttaactgtaaaaccgggtagaatgactccccgaattattaaaaccagtgcaatttgactcctccagtggttttggagagcggttttgcttacgtggcgctaatgtggcagtgctaacccggttttcattacacgtggcgcttatatagcatttagaattaaaaaaatatatgtggggcccatccgccattcaaacgcaaaatatatcatgggacccaccgacatatggaccacgtgtcatcctttttccttcccttcttcctcctccctctctctctctcccttctctctcttctctctcccccttttctcttccccctttcgaagcatcggtggcggcggcagccgggggctggagtggcgacggcagggtgcgggcgagggctggagcggcgacggcctcgccaccgcctgccccgtctccaagcagtcccgccgccactccccctctaggcccggccggtgctcggatccagcgcgaacccggatgttggaagcaagcagtaattatgcatgtgctacttaattgaatgtggaaatgtagatgaaatcgattttttttgactgaaatgaaatcgattgtgaaaatggatgaagaagcacacaaacctgtgagctgcagctgctgacgcagcgggcaatccgggagcagacagggacgacgagcttgtcgaagtggtgctggtcgaggatctcgacgatctcctcgagctcgtcggtaagcagcacctccttctggcagttggtcgccggccagtggcggaggaagatgtcccggacgacggatgctgccgtagtaggagagctggcggtggcatgtgtgcacccaccgcgtccggtgtagcggcagcagcacgcgcgccatgaacgcccggtgctcctccttgagcggcacgacgaagccattgatgatgctgccgcagatctcaagcagctcgccgacgccgcagtggcgctcgggctccgccggggacgtgccgtagacgaaccggagcagcgcgacggccatggtgcgctgcctaaacgcgcgctcgacggtgagcttggagtagagctggtggtagacggtcttgaggcggtcgcgctcgcgcgggtcctcggaggcgaagagcgccacgaggccggcgaggaagctccggtcgacgtggttacggagcgtcctggcgtccgcggcggcgaccgcggcggtgagcacgtcgtagacgaggtggaggtgcggccaccactggtggagaaaccctttgtagtcccggttcgtaacccccctttagtcccggttttcaaaccgggagtgccaatccgggactaaagatcgctatctttagtcccgggtgaaatacccgggagtaaagatcgatctttagtcccggttggtaatcgatctttagtcccggttggtaacaccacccgggactaaagatcgagctgacctttttttttttgcatgcccctgttgctgcatggtttatatatatatatatatatatatatatatatatatatatatatatatatatatatataaaccatgcatatatatgtttcaatacatatatatgcatacatatatatatgtatttatacatatatatgttatgcaaatgcatatgtatatagatatatatatgaacaaaatatatttacattatagaaaatatgtacacatgcatatagaaacatatatagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttactttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactctttttttccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagagtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagtcgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgacttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactaggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccttgactttgaaggtgccggaagaggagcttgcgggggagtaggtgtagcagcacgaggaggagtcggtgcaggatcctgaggagtcgatgctggagcctgaggtggagacggtgctggcggagcatgaggaggagacggtgcaggatcctgaggaggagatggcggagccagaggagatggtgcacgagacgccgcttgtcgcccagggaggatgatgtaccgcctgcgccatataataatggcatggcatgtgtttcgtagatgcgtctcaccgtctcctccagggtaatccagctcgaggtcctcgtacgcgcattcgaccaactcaacttcgaccttggagtatcctgctggaatcggcctgcagtggtaagtacctgaagggtccgttgggatggccatgcccgacgccaccttcatgttgtgagagattatttattagtaatcaacatatat

SEQ ID NO: 63065 - DNA, 12302 bp, Oryza sativa
cgagagggccgcactggatcagcgggccgctgagctcgaggcgcgggtgaaggagctggacgcgagggtgcgcagcggcggggcggccgcgggcgacggcgacctagccgcccgcctcgcagctgccgaacacaccatcgccgatctgcagggcgcgttggactcgtccgccggggaggtcgaggccctccgcttggcaggcgaggtagggcccggcatgcttcgggacgccgtctcccgtatagatcgcgccgggcggcaggcgggcctctggggcgagcggaccgcgaagtatgccgccaaccaggggggcctcgcccagcgtctctcagagatggccgggaccctccagcggctccccgaggagctcgaggagacgatcaagtcatcctcgagggacctcgcccggggggcggtggagctcgtactggcaagctaccaggccagggacccggacttctccccgtgggcagcgctggacgagtttcctcccgggaccgaggacaacgcgcgcgcgcaggtccgggacgctgccgaccacatcgtccacagcttcgagggtacggccccccggctcgcgttcgccctcgactacgacgaagagggcggtgacggcggtgcgggcgacagcggcgatgaggccggcgacccgggcgtgtcgtaatgagcccccaggcccctgccaaccttatagagtttttttctttcttcttccgaggctttcgggcccccttcttgtatagactaacttaatctgcaatcaaataaagaggaaattttttgtgtcaattctatttgttgtgtgtatgagacgaggatggtctgtgccgcggtccttctgtgtctcggcttgaacaagggctcgtgcccaggtcccagcctcaaacggcgcgggtcggggctagtgcctggggagatccacatgttgagactggccaggccgggagcgtggtgaccgggggttatgggtgacccgattgtgggcctttgccgattcccccccggagttcaccacgccccggggcacggctcggttctgggccccttttggcgattttagccggcccgggccaccgagggcagaatcgagcacgagcgtgctaattcaagtcaagattcagcaaaaggaaacaatggcacagacacagtccttaggaaatcgaaaaatgcttttattgaaatacagaagagaaaaaagataggtatatgcatatgtggtagcccccggccaaccctgcacgccccggggggggtgcggggttggcccgagcccgagacctgacacccgacccctactaggggtagaagcgacgaaggtgttcgatgttccacgggttaggcagctctgtgtcgtcgcccgtggccagccgaacggagcccggccggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctgatagcgcgcggctcggagggccgcgcgccgccttcgctcttctaagtagtcgaggtcatctctgcgaagctgatcttgatcagcctcgcaatacatggtggcccgaggggaccccagggtgagctcagatgggaggaccgcctccgcgtcgtagacgaggaagaaaggcgtttccccggttgctcggcttggcgtggttcggttcgcccagagcaccgctggtagctcctcgatccacgagtcgccatgcttcttgaggatattgaaggtcttagttttgaggcccttgaggatttccgcgttggcgcgctccacttggccgttgcttctgggatgggcgggtgaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgacgaccggataagcctcgggccacttagtgaacttgtcgatagcaacatacagatactcgaacccgcccggggcccgcctgaacggacccaggatatcgagcccccagacagcaaacggccacgaaagaggtatgatctgcagggcctgggccggctggtgggtttgcctggcgtggaactggcacgccctgcaccgccagaccaagtcgaccgcatcgttgagagccgtcggccaatagaaacccaggcgaaaggccttgccaaccaaggtgcgtgaggcggagtgggctccacactcgccttcatggatatcggcaagaagctcgacgccttgttcccgaggaatgcacttcaggaggactccgttagccgcgcgccgatagagggtcccttccaccagcacgtagtgcttggagatgcgctggacgcgttcactcccttcgcggtcctcgggtagagtcttatctgtgaggtacgcctggatctcagcgatccaagcgatcaatctaagggagctgggagcgctctcctcgggtcccgaggcctggactccgacgggcctcgggggccgttcaggcgcgtccatctcccctagggggtcaggtcgcgccgacggctgggcaagcctttcttcaaaggcgcccggtggggtctgggctcgcgaggaagcgagccttgagagttcgtcggcgaccgcgttatcccgtctgggcacgtgccgaagctctttcccgtcgaaatggcgttccatacgccgcacctggcgcacgtaagcgtccatctgcgggtcagagcaccgatactccttacagacctggttaacgaccagctgggagtcgcctaacaccaggaggcggcggatccccagtccagctgccaccctaagtcccgcaaggaatccctcgtactctgccatattgttggtcgcccgaaagtcgaggcggaccaggtatctgaggacgtctccgctcggcgaggtcaacgtgacccccgcaccggcgccctgaagagacagggacccgtcgaactgcatcacccagtagacggtgtgaggcggctgcgaggggcccgagctggcctcggggatggagacgggctcgggagctggggtccactctgccacaaagtcagcgagggcctggctcttgatcgcgtggcgtggttcaaagtgcaaatcgaactcagagagttctattgcccatttcaccacccgtccagtaccctctcggttatgcaagatttggccgagggggtaagacgtaaccaccgtgacccgatgcgcctgaaaataatggcgcaacttcctcgaagccatcagaatagcgtaaagcatcttctgggcctgagggtatcgggtcttggcgtcccggagggcctcgctaacgaagtagacgggccgctgcacctttcggcggggccgatcctcttcgccaagggccgcatctccagggcgcttttcgtccgagaggccgcgcggggcgcactcggcttctgtgtcatcgacctcggggtcggagggcgacaagcgcggccttcccgcagtggccccggggccatcctgggagtcgggggggcctggcaccgtcggacaagcgggcagagggccagctccggccgtcgggggcctcgggccgccgttcggctcgggggcctctcctccctggtctctcccgggtcgagtcgacacagagtgggggtgcgcagagcgagggttgtcctcgtcgcgctccacgaccaacgccgctctgaccacctgcggggttgccgccaggtaaagtagcaacggttcatctggtttcggggcgaccaggaccgggggagaactgaggtacgccttcaactgagtgagggcccgttcagcctcctccgtccaggtaaacggcccggaacgtttgaggagcttaaataggggtagcgccttctctcccggcctcgatatgaaccgacttagggcggccatgcagccggtgacgcattgcacatccctaagtttgctgggggggcgcatccgctctatagctcgtatcttctcggggttggcctcgatgcctcgggcagtgaccaagaacccgagaagcttgcccgcaggcacgccgaacacgcacttgtcggggttcagctttatgcgggcggagcggagactttcgaaagtttccgctagatctgagagtaaggtctcttggttgcgcgtcttcacaaccaagtcatcaacataagcctcaacgttgcgtcctaactggctacccaaagaaattcgagtagtacgttgaaaagtaggacctgcattctttaacccaaaaggcattgtcgtataacaataagttcctatgggggtgatgaatgcagttttttctcatcctccctagccatgcgaatctgatgataaccagagtatgcatctagaaaacacaaaaggtcgcaccccgcggtggagtcgacaatctgatctatacgtggcaaggggtaagggtccttaggacatgccttgttgaggtcggtgtagtcgatgcacatccgaagcttgccgttcgccttggggacgacgaccgggttcgccagccactccggatggatgacctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctccttgaccgggacctcgtcgcacatgatcatccgctgcctcggggcggccgggacgaaggcgctgagcctctcgtcgccacactcgggcttggacgccgcggcgagctggtccgcgcgctgctccatacaagcaagcgcgacttggaggtcgccatggacggtgatggggccaccagggcccggcatcttcatctggagataggcgtagtggactgccgccatgaacttcaccaacgcgggtctccccaggaccgcgttgtagggcagactgaggtccgccacatcaaagttcacccgctccgtgcggaaattggcggaaccaccaaaggtgaccgggaggtcgatatgacctagcggccaagtgtgccccggcgtcacaccgatgatcggctgggacggccggaccaccatccccggggccttgatggcgtcaaaggctgcgggagaaagaatgttgagggctgcacccccgtctatgaggacacgccccaacttcacattgcaaatggtgggggaaaccaccatcgcgatctgtcctccccgggcaacgcacggcgggtggtctgtcatgtcgaaggtgagggccacctccgaccatcgcgcccgccgcgtcgcctcatgggtaggggccgcggccagaagctctcgcttcatggccttgaggctccggcgagaagcgtgagcgcacgctcccccatcgacggtggcgaccgtggcctgaggctcctggaaccccaggttatcgtcgccatcgtcgacatcctcggcgggggccttctgcttggcctcacctcgctggttgccggcgggggccgccggggccttgccatcacggcgctcctgtctcctctcctcctcccacttcctcgtccgctcggccaaacttttgaccgcgcggcagtccgcgaggtcgtggagggaggtgttgtgcacggagcaccacttgccggtcgggcgctccctgctgggagcgccggcctccttctttctgttgctcgcaggcctcccctttcgggtggcccgcgaagcgccctcggcagcgaggacgtgcccctcgtcgtcggaaagggccgacctcttcttcctcctcctgtcccgccgccctgatcgagcagcggacccgggggcggccggagctgccacactggaaccggaggagttccaggtccaggcctcctccttgcgagccacacggtccgcaagctgaaaaagctccgcggtggtctggggctccttggaggcgatcttttcgagcatgcgattgtgccgcacgccccccctgaacgcatagatcactgcgtgtgcggggatgcatggtatagtgttgcggacttgacagaaccgctgaatgtacgagcgaagagactcatcgtcccctcgctgtaccgcgtgcaagtccgcttcttcacctgggcgcggatatgtgccctggaagttcatggtgaactgctggcacaaatcctcccaagagtgtaccgacgcgggtggcaagttcatcagccaaccccgcgcctgacctttcaggaccatgggaagaaattcgccatgaccctgtcgttacccccggtggcctcaatcccggtcgtatagatctggagaaactcggcggggttgacgcttccgtcgtatttttcggtgatggtgggccggaaccttgggggtcaacggacgttccgaaggctcgccacaaaggctcgacagccggcaccgccaaccggggacatgggaggctggcccccatgcccagactgaagtggcgctccggacgaggaagcgcactccgttgcgtgggcagcacgacgaccattgcgtcggcgctcaatattgaggcgggcatccggccccccacgcacatcttcttgggtcggaggcgtcgacgagggaataacggacgaacggcgggtaacggccgccgctcgccgcgccctccgcatcgacgacacggagccggtggtagcagcgccagaggccttgggggcgaaggactgcccgccggcgcctaggcgctgctgtgccgtcatgaccaagttggccacatcatccagccaacgtcgagctggagtctctggatcggggacgacgggcgggtgacgtaggagcgcgcccgcagcctggagcgcgccctggggcgtgctgccatcgccgtagacgaggaggcgacgctccccgtctcgccgtccttctccatcacccgtgggtgacgaagtcgcggatctttcgatcccctcgagcgcctccttccgcccaagacttcggcgaaagggggacggtggagtacgagctcgacggcgcgggttctgctccctgtcgtcaccgctagcgctcggagagaggttgtgcgccactgcccgttcggccattgggctgagcgggagaaacttggcgcacacgaaagaggacgagggcttagaaaagcacacgcgccccctaccaggcgcgccagatgacggagcgtggggctcctcaccgggagaccgcgcaggcccccctttgccggttcggccgggggcgctgagtgaggttcttcaccctcgatctgtggaatgtacgcgagagagcaaacgcacgagacacgggcgatgtagacaggttcgggtcgctgagaagcgtaataccctactcctgtgttctggtggatatgtgtgagaaagagttacagagagccggagagcaagagagttcaagctctagaacccctcttttttccttctcttctcagagtcgtcccccttcctttgtgggcaaggtcctccttttatatttcaaggggataccacatgcaccacttctacctactcttcttttgggtggggacccaccctatcttgaccaaatcttgactcgcgcctccgcctggaagctaaatcaccgcttgtccttgagtgatgcccagcgccgtcactcgtcggacacaggggatcaccctgtcatctcttcattaatgggcggagatctgcaatggctgctgtctgaatgaccctccgatgggatgggtcatacctacctccactccgccggaaacagatgcaacgtgggagcacggttgtctgccgatgacgtgaccggcgtcagtccagtcacagaccggtcattcttctccaccacacgtcagtttagcatgccgcacatctgcccttcttcaaacagtgacttccttgcaatggttgcgatgaagcctggcatgaatcgagccgggactgacgtgctaactccaggagttaccacgccggctccagctagggacgagtgccaagaggctctcatcattccgacaggacggggcgaggcgtgtgacaggccgcctgctgccacctaacccgcgatctgaccggtctgtgaccggtcacacactgcgaccggtcacggaccggatatgcgtgcgccgtgctgcattaaatgcggcgtggcgcgcttgtccatcccgcaataaatgcggttaggtgagcgccgctgtgcccacctaacccacacacgtggcgccaataccacagggggtcggggcgccccagccctcggggccgaaacaagagcggcccgacccctcggggagacaaaggagggggtggccacctctccctcgggcccgacccccccgagggggtcaggccacgtgggtgaccgcggctgcccaagcctctagtcatgatacccccgatcccatgtcaccgacataattaataacttagacgcggtgtctaggttagaggttacctttgtttgttgtgtatcccacggttttgtcagaggtaggcggcaggtggtgacagccctgaattctatcccagtgatcctccacgttcggatacatcatagagctatagctggaaccacgctggcagacctgcaggatcggtgcccgaagcagcagataggaaattaactttgcttagcttagataattaaaacccatagaaagtcctctctagcctagcctgcctatcatcagttgttgtccttggatagtcttagccttaggtagattacacacgttccctgagttcgatatccttttggggtcacccgaaggtgaagtgctacagcggtattccgtgcgcttgcggatttatctgtggtcataagaatgaggacggtggttggtactcaatcttactttatcccctccccctccccagaaagcagagattggatcagatgatgagttctttgatgtttgagcttgttccggacgtcaagtattgcctgtggtttatggaggaagcttcgctttggtcgtgaagattaagtctagttttatttgtttttctgctgcgtatgtgagttttattttgttatttttgtaaaacatagatctgtctatcaaattgccgtatgtatactctggctgattctgaacagagatttaatacacattctacttaaaattcgtgttagcgaatttttggacgtgacgaccgatttctcaggatttgtcaacgtttgcggctcaggttgaatgccacggtgttgcactgtaaagaggccctaatacccatctctgctagcttactgcatgtaatttgtcaggttcattctatgaccaaaaaaaaaaatcttctcacacataaagtccacaaattttgaacttcatattgaccatcaggtggcacaacttcatatttaatcccttcaaaatacgattattttttatatttttgaacttttaaaatttttaatttcaaaaataaacacgttcgaaacttatttccaaaccttttggccacgctagttggacatgcatggcaaaacaatactgtcacactggtctggctagcgtggcatcattatttggtcatgcatgtctggttgacatggcggcgttatttggcgacgctggcgtggcaggataaaactatcacgcctgctataggtggcgtattattttaccaggccaggtgagctggcgtggcccaaagattcagaatgtggaaataacttttggaagggtatatttttaaaattttaaaataaaaaagtttaaacaacaaaataaattatcaaactacttgtacttcatatctattgcaattttaagataccgataggaatgtccaactcttgagcagcaactccctaaggtcatacgtgtttattgccagttcaagcagcaggaaatgtatacagcttagatggaatatctgctttgcctattcagtctttgagaaaaaaactcaatgcaattagtaataattacattgttattggcattccatatattcatttacacaagatttaactcttatatttttcattacttaagggaggacctatacaaagcagctcaactacaaacaaaaaatatcgatttcaatgaagactccactgagcaaacgaaaaggtataccctattttgggaaaattggaaccatgccattataattttgcaaaatttgagatattactacatacatcttttcttatcctcttttactataaagttatagccctctaatttccaaagcttaacatgcaaagacaccacatcatcatccactaacaactattacatttaagtataatgcaagcacactatattatctataatttaataatttattaaattttagagatttaaaatgtaagcatgttaaatgattccacataattcacatagtctttcaatatatctctccattattttttttataatatcctatacatctatatagttcatcctcacttagttcatgttgtttttctcttctctcattaagtcatatctcatcaatttatttttctagtccttatatgattaatctatgattcaaattatcccttttctttttcttctctcgttaagccatatcatctcaactttttttagcccttagatgtataatctaaattatcttccttctttttttttctttcataaagccacatcattttactttgacatttgaattatcattctacatattatttaaatttaaatcacaccaacttatgtaaacttatgtttaggtaagcttatgttgtttaagatatctaacacattatgtcagggttacggataaggcatacctcctatcctgcgacttgtgaaatataccgatatggtatacctttacgtatatggattatttacatatacatcgtatggaatttacttcaaattaaggaaaatatctttatgggtcaagtgatttctaaagtcctactcgtaagggataaagtttctgttataccgtcccaggtccgatatcctcaaaacctttcttggggtcaagatgacccacggtataaaagaagaccccttgggagaggttcggatcatcgaatctcttcgccaacacacccaccaaagcttacgaagatggagtacacagaaccaactcgccgggagatctcgtcgaaacctcgactacgatctcgtcgggatcatctttttcgactactctctttgtaatctgttctcatcatcatcaatcccatataaactagactagggctattacctgataaggggcctgaaccagtataatccttgtcttttgtctgttttgatgtcgtactacgtagaccctcgttccaacgtaccccaatactctactcatccggtccacgagtatcactcgtcgacacattatttttacttattgttatcatagtaaacttcaacagcaacgcgtggagtttcacctagttattttaattttaatattttgtgacaaacaaatataggctcaaacccttccttatagtaatttttccctttgtagtaccaaagaactgttattaactattctcaagtgttagaaggacgagcatgtactacttctaacacccctcaaaataacaaaatctaacagaaatactgactgcaatctcttacgaactagtatttcatacagcacatacctctattagcactacaaatctacgcaaaaagggtaattattcttcacattgctaaagacttgctgcattatcatgcaagcatatcctactattttatattaatactaatacattgttgaaccaaatttacgggtcagcatatcctcctcgacctatagaacccatatgattccatacaattacatccttcgattattccaaattatttgtttttttagacatcttctatttttattattgtcatgactatctttcgaaacttacatgtaaccaccagcgaaatatatgtcatattcaaaattttgtttgcatgttcaatggaaacacaagggattcatctggaaatgcttacaatacaaactattgttctcaaaatatttctaaaaattcctgcagaaacgtcccactagtacacatgtgattatgctggacggcggcggctcattttggttccaggcgggccataaatggctccgcctggaaccaggcgaatgtcggggtcgggcagtgggccgcacgggataatcgattattccgtgcggtccgct

SEQ ID NO: 63066 - DNA, 6635 bp, Oryza sativa
ctaacatctatcggtagagggcagccgattaggttagacatcgacgttgacttagattatatgagatatctaccactctatgaaacttccagcgacttgattgtttagatattgttcttcttttcatacttaatgctgcatcagttgagtttgatctattaagtcgttcttagaatatcaatctctagcctgccttctggttgccgattagggtagcatcggagtttcagccgatcttatctgatttaactatatttactctatatgctttgttgatacgttaaatctgccctttatgttaagatattattgcatctaagtatattcagcttatgtttggtatgttctacttgttttaatatcttaatatagagttgtatcggagtattagccgatacatgctagatctactagatcggctatgctatgaacatatatagtcctgttattaatatatatttcgatctaagtgatttatactgtctcggcatggcgaccgatctatcccaatcacttgatttaagtgtatatccatataagaattatatattgtgaatatctatagccgatcgaatagatttagttctttattatctatttacaaccgccgatcgatttacatatgacatcagctcaaagataaatgatatgtcatcggcacttagccgatcggctatcgtttataggtttaactgtggtttctttgtttttatttcttattgattgcaggatcaaatcaactggcacgctagcacacccgaaggcgagttttggacatgcactggagttaagcagatctcacaggcctcgtgttttacgtcaacagagatcaaagctactagtggatatgtcttcacactaggtggtggtgctgtttcgtggaggtcttgcaaacagactattttgacgaggtcaaccatggaagcagagctgacggcattggatactgctactattgaggcagaatggctacgtgatctattaatggatctgcctattgttgaaaaaccggtgccgtctatccttatgaactgtaacaatcaaacggtaattgtcaaagtgaatagttctaaggataatatgaaatcgtctagacatgtgaaaagacgattgaagtctgttaggaaattgagaaactccagagttataacgttggattacatccaaacagctagaaacctggcaaatcccttcacgaagggactatcacgaaatgttatagacaatgcatcgaaggagatgggtttgagaccatgtgagttatactatggtggtaacccagtcaatgtgatcggtgatcggagatcccgtagattagaacctgggaagaacaaaccattagtaaactagaggagagtaccaatctataccctctctaagtgaagatgcatgtactctcgtgagctgcaaggcaggttggctatgccttaatgagttctgttggctttaattagcgaagatgttgtcctgcagtgcattcttgaaagaactcacctttgtgagcttgactgttggtcgcagtctatggagattttgggtgaatcttctaggaagcttactaaagacttaggagtatgacttatacgctccacccgaggggtagtctatagacggtctagtaccagataagactctgagtgaaacttgcttgcacaagacttgcaattcaaggcgtagtccattgttcaagttgtgagtaagtgtagcttggagttttaggtggatgttcaaccttaatcggtcttcatcgaaccgctggtatataaacagtacattggaaaagacaaatctcagtgggattttgagatttggtgggggattgttggaattaatagatgggctaaggcccattcgaagattaattctttggaaaatcacaaaaacccacctcatgggatggcatgcatgtggagtttagtaccaccttgctaattctagaagagggggacctccttaaaagggaggatgccctcctagccacttgaagcatgtgtggtggagagaagaggggaaacacgcgcgcgctcgctggcctggccacccagggcaagcggcgcgcgtgcacgacgtacgcgtcgaatggtctgcaaaattggctcctcacccttgcgcagatgcagccttcttttgcagttttgttttgctgcgggaaattcggatttgttttgttttggaagcatttcgaaaaatcaggtgcgtgaaaatggcgtggagtacggataagttacgcgcgacttatccggttcggttacacggaatggaggtcgtgcgggcgccctaatcaagcgacctatctctatataaaccgagccgccgccttcacgcaacacacgcgaaatcaatctagggtttgcctcctactatgtgctgcgccgtcgctcgtagactactcaatcccgctcgccgacgtgcaccggcgatcaggagagcaggtctccggaacctctgccttcgacgtcctgcaccgggagaaggcgacaataaggtttttgggaagcgcttcgcgcgactgctccctgttcgtccgcgacggctcgccttactctccgctcgcgtgctgcgcgcctttgtcgacgcccgcaaccgcgagtagttcctgccgagcaaccggtctttccgccacctcggtacgtgttcgatatgttacgcatatttgatctgttcatattttattgtttagtttatatgtgtagatctaatgatgtgttcatgctagtttagatctgcaatgtcatgatttatttatagaataaattaaatcattatgtgcttataattttaacagttttctcggggttgccacatctcaaatcgcgcaatcggcagcgtgcgcgctctctctctctgccatggcttccatggccatcatagaagccctgtgttggccgacgatgcctgcttgcgtggtgaatggaggcatctcgtcgatggctgctcatgtggtgaaggaggccgcgatgcttaccgtgccaatgcaagggatgggatcatgtcccgtagcgtttttgagtgggtaaaaattaaaggagagatgggatgtctagtagggtgtgttcgaattcacattttcttaatttatgctcgcccgttcttcatgtacatgctttccgatagaaaatagctttaagaaaatcatattaatttatttttaaattttactaatacttaatttattatgcgctaatccgtatcttcgttttacatgtgctaaaagcatacctaaacctgtccttccgaacacacattgtattcttaaaatacaaatttcaaaggatataaataattatgagtattcttatcgaggttgccctgccatcccacagcccaagtagctgtactaaccataaagacattctcaatgtaggtcattggttggagagatatcataatactccttccatactaataaaggaagtcattttaaatagcgacatggtctccaaaacacaattttgacttcttgttcctataaaaatatttattgaaaagtgatatatgtatacttttatgaaaatatttttcaagataaatatattcatataatttttacattttcaaactcaacaacttgagagttatttatgatttatattcccaagttttgatttaaatattatcctaaacgactttctttacgagtacagagagagtatgtgcatatgtataatggataataagatgaaactcgttgaaaaaattctctaaacgtgagccatgctacaattaaaagaaaaaggcggaacctagtctaaaatacttatacctggtagtaagcttatatcctgatagtaatcgtttaccatctctataatgtattttaactgataacaataatatatttaatacttattacatgctattccatataagttgttgagttgttcgtcggtccggctcaccgagatggaatttggaagaaaacaaaagtagtgtcctcgattcgtctttggatctctctccaggacaggcaacatgttcccactggtttattagtcaaatgctatcccccagcagacgccagcagacggggtactctcgtacgcagccgactgccgacgtgcgtccgtactccgtaggtgctcatctctactacctccgtcacatattactatttgttttgtcaatgtttgatcattcgtcttattaaaaaaatttgaaattattatttattttgtttgtcatttgctttattatcaaaagtactttatggcttatctttttttatatttgcactaatttttcaaataaaacgaatggtcaaatgttacaaataaaaagtaaaaaacgtcacctattatagaacggagggagcaggacgcaagcggctcctgatggatatttaattaggcgatggtccaaatctatcggagaccaaaattatcgaaattctgaaaaaaatcaaaattcaaatattttttaccaaacctgaataaatatagctaattaagttcaaaaaaaataaaaatttaagataaaataagtttaaaaaatatcgaaccgaaatttacaaaccctaccaacgtgacagtggacacgtaagtgtgcttagcagctcgaagcacgtactcctttagtgaaagaaaaaaaaatatatagtattagatgtgacttactattatggatctaatatgattcataatactaaaatgtgtacgtatgtataacacatcgacacgagtattacgcgcgcatagacacgtaatactggtagaaaggggtgcacgtctggtaacttacaaatgggcccgcgggtgtgataggacccacacatcggtgccatcacgctcctctctgacgtaaccctctcgatcggggggatgctgatgagcgactgaccgcgcgcggccgcagtcgcgcggtcagtttttaatcttatcccctatatatactactagtatactatactcttccttatactactatatcccttatactactatactatatactatatgtatttatacacagatatatacacttttaatatatacatgcacaaagtttatatagtatagatttaaaaaccgaagatacttatatattaaaaaaaaccggaaaaagacccaaagaaaaaaccgagaaaagggggaaaacagcagggaaaagaaagaaaaccggaaaaacccggacgcgcctacggatcggtcgcccgatcgatttggagaaaaatcgggcgctgacgtcagcatgccgtcagcgtccgatttacatgcaaaaactactttaaattgatttttctcttaaattacttatccaaattatgatccgattacaccattaaattcgttgcaattaaatcttcaaaacaagaccacacatggatatattctgacgaaatttttttagtttattattgaattatttttaaatgttgcacgatgttccaccaggtatatcggaattgtttcactaagtagatcgaaaatgtttcactcgtttaaatcgggtgttgtttcaccttatataaaaacaatgtttcagcaaataacgaaagattatttcagttcactgtaacatttgatccatacatagtaaaacattataagtacactagatgaaatatttttcggtggaacaaaaataaaacgattcccttaatagggctttccaaaatatgtgagttttttttttgcaatggagtatttcagctcactgcaatattagatctatacatagtgaaacattgtgagtatactaggtgaaacacttttggtggaaaaaaaaataaaccgaattcccttaatagggggttttcaaaatatgtgggttttttattgtaatggagtattttagttcactgcaatattagatctatgcatagtgaaacattgtaagtacactagttgaaacatattttgtggaacaaaaaataaaccaaattcccttaacagaggggttccaaaatatgtgagtgatttattgcaatagtatgtaggagcagagacatggtggggcccagatctgcatgcagcacgtgggggcgtgcgcgggggagcgcccgatccagctcccctgcgtcggtcgcccgggagcaagtattatcggaaaaaccgtagaaaaagaggaaaaaaccgaaaaaaaaaaaggctactggtgcgctctcccgccgccctcctctcccccgcgcgccacgtggctacgccgcgcggaggaatggcgctggtctgaccgctaattagcagtttcgctttcgatctgcctctgttcgtgtggaaagtccacctcccggtgtgacgcgcgcgggcgacgatcggagggtcaaagcgggggaaagttccggaccttaatcctcctctaggtttttcaacgtcacgacccacgagtcgtgaccggcggggatctacgaacgtgctagtggtactacgtcctaacggcatgtggaaattcatggtaccttacggtgtaacgtcacgtacgttttccccacgctggaacgtatttatgacacattttttctactacgagcaaactcaaaaaacaattactatgattcttttttaaaaaccatatatactcactccttctctaaatgtttaaatgtttgacgccgttgacttttttaaacatatttgaccgttcgtcttatttaaaaaatataagtaactactacctctattttttaatagatgacgccg

SEQ ID NO: 63067 - DNA, 560 bp, Oryza sativa
ataaaccagtggtgggcgagcgtggtagcgtagtggcgatgggcgaacgcggtatcatgtggcgggtggaggagggagccgcaacggtggaggtagccggaggagaagccatccttctctacggcgacggcctactccgcccgccgcgtcgtttgtcgtcctcgtcgtcggccgagccatccttccctacggtgttcgcgcgagcgcgcacctatcctcggaggtgatccgctccttcatggagctacgtcgcctccggttcgagctcaccacggaagaaggcgtgctgcccgccattgtcgctccgcaccccgcttgccctgctcttgacggagagaggatagagagagagagaggagaaaaggagtgaggatgacatatgggccccacaattttttttattctgactaggatgccacgttatccaaacaacccatatgtactatcatgtaacctattttgcatagtttgaacatttaaggggtagacattcctggtatttcagttaagggaccttatatagactcgatgtaaagttgagggatgatatgtgaacttac

SEQ ID NO: 63068 - DNA, 797 bp, Oryza sativa
  unsure (1)..(797): unsure at all n locations
cacgcctgatgattgacatccactcttacaccgncaaancatatggtttatacattatttattattggattaaattgaatggtaatttactgaaagatatttccaacattataaaccccaagaagatcttccctggcgcgtgtggaagtttgatcagatattaagcattttagataaagaaattaaataatctggccctcttcaccaaccgaatgtatcagagattagcatttttggataaataataaggcggccgagaagagggtagatttttttcttcagttctttgcgctccaatccgaaccgcacgcctctcatctgacggtcgcagttgagtcggtaacaaattaacaaggtgataagcgatccagatttatgaagaaacacccattcttctcttcgaatttacacaaggaaacgaattcatcttaacgtacatttggattccgtttcgatttaacaagcaaagcaatcgtttcggaatagcagttgagatattagactcggattcgattcgattcaattcatgcaaataaatagataagcacagatcacctactgatcattggcaattaatccaggtctgagatcgatccgatcgatcangctttctttccacattaaaccaaaattttttccggggggggggaaaccggggggggcccttttttttaataaaaaatttggcgacgatccctcgagaattagactatttaccatcaaattcgcgtgcctcaatttttttaccacccaatccggatgccccttataatatgtcaataggactgcttaatagt

SEQ ID NO: 63069 - DNA, 612 bp, Oryza sativa
tacccgcgcttgtcgttgcggggcctggtgatctccgcgtcgccctccgccgccgccgccgccgagggtgcggccgcgaccgcgccgtcgaacgacggctcggcgggggcgtcggtcgtcgtctcgcgcgctggcctcgaacccgccattgcggccgccgcggattcgccaccgctgacggtgggtggtgttgaagttggagtggactgcgtccgcgaagacgcgaagttggcttggcagttggaacggcgagtaacaagttgtccccggagacaacgcgagagagggtggcacggcagcagtgggtggacctgcagcgcgggttggtggacttggtagttgggcacgtcaggagtgggcaaatgggctgggccggaatgccggatttgtgcacggcggcgtgcaccgggacatctttctgtttgaagtccggcgtgtaccgggacatcttactgtttgaagttcgaagtcaagtaaacgtctactcgaacgttcggaatttttacggaatgggaaaaaaactactccctccgtttcataatataagccattctaacatttttcacattcatatggatgttatatgcggggtaccgagctcgaattcgccgt

SEQ ID NO: 63070 - DNA, 1414 bp, Oryza sativa
  unsure (1)..(1414): unsure at all n locations
tggttgccatctgcaccaaggttttcaantgtaccatcttgaggaatatcacttttgttacctagccagttcagtaccttgtcccctagataactggcatacctataggggcccttttggggcccccgggaaaacccccacccctttttccaaaaactttggtaactttnttggaacgaatgagttcctnctgcgggtctcctaaaagaatccatgaatttgttcttcacgttgctcatcatctgttcaagttcatccctttgctcagctgtcagcctatccaatgtgattggaacaatattggttgggtccacttcagctgatggatttttggcccccattttatttacgggaggtttgactcctgttcccggtgatggtggtggtttttcggccatcgggatgaagtcgttgaaaactcaggtcccaccgggcgtgccaaaagagtgttgatgtaaaaacacgaggcctgggagatctgcttaactctagtgcaggtccaaaatcttgcctttaaggttcatgagcatgccagttgatttgatcctgcaatcaacaagaaataaagncaaagaaagtagtagtccataaatgataccggtcgaccagccgccgataacgtatcatttgtactcgagccgatgtcatctttgcatcgataggctgtgcgaggcaataataaagaaactaaatctattcaatcggctgtagatatcaatgataaataatcttcgtggggttttcccccccggngaaaattttaattaaattaaccctttaaaaaattacagagttanatttgggggataggatcgggtccgccatgccgagacagtataaatcacttagaccgaaatatatattaacaagaacactataatcattcacagcatagctgatcaaatagatctagcttgtatcggctaatactccgatactactctaccttaagatattaaagcaagtaaaatatatcaaacgtaaagtttgtcacacctaaaagcaataagatcttaacataaagggcagatttaacatatcaattcagcacatgaaatataaggctaaattaggtaagatcggctgaaaccccgatactactctaatcgacacccaaaaagcaggctagagattatagttctaagcacgacttatgagatcaaactcaactgatgcagccataagtatgaaaagaaagacaatatttaggcaatcaagctattggaagcttcataaagtggtagatatcctatataatctaagccaacgtcgatacttaacctaatcggctgctctccagcgatagacactacccgattggaggttagatagcgatattgtcagagattatataagatatatgataactcancnncttncatagatagggtacagagaagtctatcaaaggtcg

SEQ ID NO: 63071 - DNA, 521 bp, Oryza sativa
gctcggtacccggtcgaacaccctgcgcagccgcagcgcgttcaggctgccgttccggaggcggaacgacggcgagggctttcctcgacagcgacggctttgcggcgacgccagctgcgtccatctcgcgcgcttcccctggcgattacacttgtcttctcgaggggtttattaggctgtgtgaacttatttctgatcgaggcgcgtaaaacgtatatgatggcgtagagagttgcccgggttcttatagacgacgaaagtgacccaaaaaaaaaagagagaacatgtcgtcgttatcacgttattactgtatattagtattaagcaaagttcaatggactggaattctgctagaccaaattgaaagaaattaattatgttcggacacacttatctaacacaagttggctgtacgatcaatcagatatatatccacgtcaacaaactcttccaacatgcagcccactttttatttttttgacaggcgagagaggtttggcaggattgtcccaaaaatgcca

SEQ ID NO: 63072 - DNA, 504 bp, Oryza sativa
ccagtacaatatttgtggtagcctatctatctgttgtcgacttggcagtctgaagtgctaactcgtagtcgacaacagggtagtcttcctcctcgaactcgtgcccggcgagatcagagataacgctagatccctacagccggcctccataggtaccagatagggtcctcctaggcatatctctgatgttaatatccggcggcttgtcctggcgtatgttggcttctgttgttccttctattgttgcgtgtcccctctcctcctagggggtcttgtatttatacccataggtgtccccttgtccaagtagaactagggagtccaatatggatacaatccgactagtccttgccgtttccatatagaactctagttgtctttccttatccagaacttcctccaactcaaagtcagtttccgtataagacatggtatgtggtgggtcctgccgagatttagtcaactactattgggtatgtggtatccataaccctgacaatatgg

SEQ ID NO: 63073 - DNA, 615 bp, Oryza sativa
agggcgaattcgagctcggtaccctatgagcaagattcatgtgacattaaggaaacttactgatatatctcctaagtatggcttcaaagtttttaggagcaaatcttccttttataaccaatctttgttgcccatcaagggatccacttgttcccatctcagcaagtaaaaacatcatcacatgttcaggttgcctatgcattctggaagtgtaaacgatgatttcagttagctcatggtaatttatcttctctgaaataaaagcaggcctagagcatatggtatggagtggtaaaaaagtgagatcatacgttttgcacaaatccatgaagttcacaaaaactgtcttctttgtgccttccctaagaacttgaggaggcctcataacagttcttcgtctatcaccagcaagatcaggattattctcacgcaggatattaaatactctgccaagcagctgtcaccaaatagattgaaagggttcattaacagaaacacaattgaatactagttgaagctgagctgagcactacatgagatactaataccatatcaatagcaacaaaaacataagaagatcaaaataaaaaaaaatacttaaaagggagcaatgct

SEQ ID NO: 63074 - DNA, 506 bp, Oryza sativa
ttactagtgatatgatactccacatcacatgtcagagtaaaatattaagggtcacaagttaaacaaaagatagttcataaatgcctatggttaatggttaatagtacctcctgtcacaaaataagtaatgttttagacaactacacggtcaccaatgcacttgttttattataatattttaaaattttatttaatataaatctaaccatattatttttgaaagttggatcagaatatttaaagaaaaattgatcatcaaagttgtattccaaaaatttgtgaatgatggagtacaacattggagtagtacactccaatatggtgatcgtggcaacgtggtacctcaacttgtttcaatatggtgaccatggcagcgtaacacctcaacttgttgagttccatggtgatgctctccaattctcactcgagagaacggggagggggcatatgtcccccacgaccaaaaaagctatctcatacgacgggaaaatcaaccaagcctcata

SEQ ID NO: 63075 - DNA, 550 bp, Oryza sativa
tttccttagttttctctattagatgaaaatcgattaaacttccgaaattcataactaaatcatcgtaactcggattcgagtggttcaagttgctaaattcatctaaaatcaagatctacatgttaaaaatatccacatgtactgtttttgcttgtttttgtactattttgttgattttgttctttcgctttagtttccgatgttccgaggagagcgttttcgttgaggaaggttcagaagtgtttgcggaagatcaaggcaagtcacacagatctcaaacaaccctttgagcatgttgaacccgtttaaagctaatgttttatttcaacttatgcattattttcgaatgtcatcgggaggtgagcctttcccgattaattaatggccgaatatgactttattttcctatgggttataatttgactagcatggaccttatatattggattggttcagctagatgttatttatagttgctcctagccatgcttagaaacaatagctcattaaagggatgaatcatactatattattaattatggttatattt

SEQ ID NO: 63076 - DNA, 769 bp, Oryza sativa
ctataaatataaaaccaaacaagtggcatctattggcataacaggaagcatccaagaacccccaaaatgtggtacaagtctctagtcattgccagtaaattgaacgtagactggacgttttgcaaagaatgcagtatgctgaagttcaattgtccttccaattgttctgaagcatttagattaagttttgagatcaattttagttcgatctaacaaattattgaccacgacaaatcaagatcacttacaaatgtcctcttcaaattaacagaacagataagaaattggccatacatacctctgcaatatactttgagtaatcgtcttccacagggtatttctcgctagcatagaaaagcatatgctctataaaagaagaaccaagcataagtgaatcaaacaatacagagacacatacatgttaattactgcaaaacacatgccatgaagctctctacatgcgatagtacaatccaaccaagataaaaaaacaattcaatgaggtttgaacagtgcctggtgatgcattaaaactctttaaaggtacacactagaaaatatataaaagagcaacatacaaaacaaggcaaattaaacatacactaagcacatcgatagcatgacacacagtgacacaagaaagttgtgcttactttatctgtccaaggaaaaatagttacaatgactagtgagtaaattaaatttctaattgaataacagtgtctccttagatttttacaatcaccttaagtatccaaataatatgttc

SEQ ID NO: 63077 - DNA, 541 bp, Oryza sativa
  unsure (1)..(541): unsure at all n locations
tattattttcagtagtacgcagccgcataatattgaatcatgcattaataatgcttggagtaactaaaatggtgttcaaacttcaaaccttttcagggattatactgaaggccttccttacaatttcaacctcaacctacaggaagggcgatacgatctgttgttaattgaccaaaaaggttctacaatatgccaccatgaaaataatctccaccaaagaaaataagatgaacccataaataatcactttcgatgtgtcgcaaaaatgatagcttcattcacccaccttctgctaatcattctcgagattctatgatgaagtcaactttagatgccagcctcaaaagagtatagacaccagcaacagcaatagctttctccactgcatcctctagcaaagaaaaaaaanaaagggccccaaaaaaaaaaaaccccccactactgaatacagtggatacaaaagaaagtagtgcaactaagacaataatgcaagttcataaaagtgccagaagtatatgaactgacactgctaaatgctgac

SEQ ID NO: 63078 - DNA, 713 bp, Oryza sativa
tagggcgaattcgagctcggtaccccaaaaactgattttagtactgtgccacgcaacgaagaaatccgaatcaaactaagccgggatggatctccacgctaccaccacgccgccggctcatgaagcggagggagagagctgagagagaagaaggaatacctccggtgccgaaccgccaacggcggcggcggaacgagcgaggccggccgcgccgcgccgcccccctcccaaaacctgttcacaccggcccgcggcgcgcgcgcgcgcgcgcgggaggaagggcgggagtcgggaaggagtggaggctgcccgaaccgtgcgtgccggagcggccaagctcgccggccgccgcgcgaggaggaggaggagaggcggagcggggaggaaccagccgagccaccgccgggggagagaggaagcgaggcgaggggagatagagagaggggaaggagacgacagatggaaggggaacgggggcattttggtcatcgccattttcctcactttgttagagcagggctatatctatatttctaggtgttaaacatattaagatttgaaaaaaataaaatactataatgtctttatcaaataatttattggtgaaaatggaaaggtcgttgaggggtagaagaaaaagaatttaaataagatgtgagtgataggataagtagtattttagagtgacaagtattgttagacaaaatttgaat

SEQ ID NO: 63079 - DNA, 629 bp, Oryza sativa
aatatcagtgagatctttttttttttcagaattcactaaagttattaatgacacagtttgcaaactttaaagctcaacacatcacgtgtaacattttaacttgattttctatcactatctgatctctctattacctttttgcttccaagataaggaggatctgctgactgccattgcagatattttttagtggttgcaactgctacatcatcttaagttggtgacaatgacatggggcttaaaatggtagcctgtgttgtctaatttttgtgttcttttagcatgacaagtgattccttcaatctgattcccatctatagatgataaccaatttagttatctgggagatatcataccagaatttattctgacagttttacatgaattagaatttaatctgacagacatgaactctgcttggtctgcagactgcaactacaggaatcaccggttcagccattttctgcaggacagcaaaaggccttgcattcctttggtcactgaagtactggttaacaaaaaaccaacgctgtcagcaaccggatcaacatttgtcacaaccggaatatgacaaccctatagtttcaaaaattgaaagcgggtggagcattcaactcttttttaggagg

SEQ ID NO: 63080 - DNA, 13898 bp, Oryza sativa
cttttttttcattaatgaagagccgattagcttcgattgttgcttccagtttagctctctcgcgcatgtctgctattctttgttgtgccctttccagcttgaaacgatgttgctctagatatacagccagggaaatgatgtcggcttcatcttctgggatctggtggtggatctcttcaaacctggccctgattgacccgcagccagtaaccaaggaatccaaggaactccctagccgttgagcaatatccatgagtttggtcttgagatcatcatcaagagggaccaaggctccactggtggtttcctcttcttcttcatctaggaactgtttaacgtcaaaggaaaacatattggccaagacctggagaaaagataaatcgggattattggcaaagaaaatatcgcagccgatatgagaagatttaatagtactaacaggcacaacaagaggtggatgttctggtgttcccaagtgatgactgtccacagccgacggggtgtgctcactagatgctagccgacgaggagatggagatcgaggaggctgaggcaaaaaggggaggagattaagtttttgtggcaactaataggagtaagaacacaagtttaaggttaccaatggaggcggagtggatttcttcttcttagcagcccttggcttcttcgtctgctggaaaaatggcaataaattcatatgatgcacacttaatcggatgataatgtgaagaaagatgcataccaccacttttaggggccggtgttggagcatctggcgtcttgttgggacttggtgtaccagctggaggtgtcccagctcgacccgtagggcttgcggataaggccctggtgtcactcatgccagcagcagcattatcaatggcctcctctatttcttcattctccaggacctcctctacatcacgatccaaaggaggtagatcatcggcagcaaacttttgcttctttgctacctttttcgaggcggcaggaggtttagcagccgatggcttgacatccgattgcttagtgcttttccttttacaagtttcaactggaatcggttcatgagtttgcccatatagtaaattagttgtcttgggggccatatagccgatcactgaaggagctagtccaccaccatttgggataatccctgcagcatagttaatcggcttcccactttggctagtgtaaggcagtgaggaatctgtggtctgcgaacaaggaaaagagatcaagtatcgattaaacatttgctcaaggttagaatttttcaaaaagaaaagtgtacctgaggcatcgagtccgagaagattatcgtgaagaacattgaggctgatagatggaataaatgcttcttccactcagcccaccatcgatcgaagagtgtgctcctgtcacgcccgaaaattcactagtaatttctaaacttatttgtgcataaaatcctcgtataggaatcagctgacgtgcacaaactgataatttaatatacaaatccatcgtaataataacattacatacttacaaaagaaaagaaaacagcagcggattaacggtctagcgatggctttagctccactcccacaggcagctcaactggggtataagccaaacgtcttctccttcgcaacttcctcaattgaggtttgattgattattgcaaggtgagtacatggaatactccgcatgccacacagcaaatatgcaagtgcacaaggataccaaaggatggcataatatagggcttatttgcaaaagcagcatttagcaaatatttgagaatagtaaaacagtagagtaattaatcatcaatattaatcaacactgtacagcacacccatgctgcacaggcccaaccatccttaacaaccatacccggctgtacagatctaactccaaaccaggaatgtaccattccaaaccaggatctaagcaaattattaccagttatagcatcagtgtgagactaatcacgaaaacattgttagacccgcccataactacgggcaaggctattcgaatagttttactctggccagagatgtatcaatgtatcactgtacccacaagacagccccacaacacgttgccaatgtatcactgtacccacaagacagccccacaacacgttgccatgcgcctcaataccaccacgatacctcggaaaggagctgtgacagtacccctcgcataacacaatccaccacaacgcaccgttcctggatcataatcaccccctcaattaccagaggcatggactccccagcgacccccacggacttctcgccacttcacagtctggcgccccataatgaattatactatacaaaaggaaatgccgttacccatgctagcttgtggttggcatggttaatgtttcacaacagtagctcgcgaaccgatccttaattgtcatgagcacgaccatcaaaactatacgctcacaacccaccattatcaagttttaattatcaattgattatcataacacgatttatcatcgtgagctacctttaaatatccagctttaggtaatagtgaagctttaggctgtgttcgcatgttcagcttgggaacatagtgcctccgcacggaaaatggagcgatccattagcgtatgattaattaagtattagctattttttttcaaaaatggattaatttgatttttttaagcaactttcgtatagaaactttttgcaaaaaacacattgtttagtagtttgaaaaacgtgcgctcggaaaacggaaaacgatggagaggggctgggaacatggggttgcaaacacagccacactaatgtttctaagcatatctaagtaactatactaatatatctaattgaaccattatatgaggccaactagtcaaattgtatcccaaggtatcaaggaataaggtaatcaatgcaaattggccgtagcaaaggtataagttcacaccaccggtgacattcgaaaataaatacacagttgaaataaatagagaatttaaatataggatcaacatgctcaaaggagttgtgtttgggatctatgtgacttgccttgcaataatcggtcttcaattaatcttcttgaacacttccgacgcactcacgaatcttcgcaacaacggaaacgatgagctaatacacaaaacgaggaaaaagactaagaaactccaaataaacagtacatataaactaaataaacatgtagatcatgattttagatgaatttagagacttaaacagccttattctgacttcatatgatttagttatgaattttacaagattaatctgattttagccttatatacagaaaaggatttacgatttatcttagaaaaggaaaacgggcgctgacgtcagcgatgatgtcatcacggacaggggcttccaacgatcgccggcgatctagggctcggcggcgcaaatcgaggataccggaagaaagagcacgacgacgggagctcaccgaggggcggcacgacgacgaacgacaacggaagacggccggcggcgaggtagaggcggcgatgagatcgggacggcggcgacggcggctttccgacaacgagcggcggcaacggaggggtggccggggtgcagctcctcctttcgaacccaacggaggtggcgacgaagctgggcgacgacgggaggagcagcggggcttcgccgaagatcaaaacgcgacggcgaactcggccttaacggcgacgaagggcttcccggggtcttcggcttcgggcagatggtggccggtcttccactcttcgctttggtcccattggaggcgacggcgctgaccggagatgtcggagtcgacggctacgaccgactggagcggcggccggcggcggagcgaggagacgagcgcgggcaggcggctaaggttagggaaaagctctggaaaaagatagaaacggaagaggaggtattgatactgctatttataggcaaaggtggaggaaataggctcggacccgtgaggatttggcggcggattggttaaggttcgccgggaaaataggagatgaactccgcttcgaatccaagcgatatacgatgggatttgctccgattcttgaggggaaagaaagaggaggataagggaagaaatcccttcaaccaatttgggaaacgagtcacgggatgcaacggattctacagaggaagcgggggcgtcgagttgcatgggcagtgggcacaggagctcgggttctgtccagagatagaaggagtactgtagcgataggaaggtgaaacagacttttgtctgggctaaaagaaaagaggcgagggacaagaaatagacttcttcgggaaagaaggagacagtaagcaggcaaagaggaagaatgggctgaagactggcccgaaaaggaaaagggaattttatttacttttccatttaaattaatcatggaaatgatctttgaattgttaaaaataattacaatgctcaaataatttcaagaaaaatcctgaaaataatttgtcgtgacacaaggtcacggacaagattggggatagacaggaaaacacccttttcctgcctatcctgagaaatgagcccgaataccaaatgatcacaccctgagtgacaagatttttagtattccaagatgtcctgtctgctacaggctttttgtctgctctatatagtacacagctttacatgtgagattacaattgtgctctttgttgggcccacatgaaattacaatcgtgcccctgcatatcaacagaccctaagggcattttggtacattatgggggtcattatagtcttttggtgccagctagatggagtggttgagtggtccctgggaatattctcttggcatctttattgtccaagtcgccttcttcatggccaagagtcttttccaccaacatggatcttctcctcgactaagggtcttttccaccactacgggtcttttccatggcaaatagtcttttccatctcgaccaccatttccgacttatccggtagctgatgtcacagcctgatttccgtttcaggatttataaattatttaataaattattattagaatttatattaaatgttcattaatttacaagtgaagttaaatgtgggaaataaaatttcctaaatataaagcatggctggatttaatttttattaaattctccatgattaattataccctctgaaattttctcggatttttcagagctcaattcctaaatgatacaaagaacagttcagtaattagttaatcaattaatgatctaattataattatgttaagtgcttttcttgtttaaaaatccttaaattataaattgttgtttaaaaggaattattagaaatgatcttaaaagcctaaaagagaagatctaattttaatttgttaaatctcaatataaaagtgggctagataaaattttgttaaatacttctcttgcttctatagttcctagatttttctggaatttatttgagccaaggaagtatttttaatcaatggaatatcatttcatgaataatttaaatagaaaaaggttttaaaatctcccttttggctttgggccgaaagtcggcccaagtctctctctcccttcccccggcctgcgcgtgctcggcccgttcggcccagtccgccgcgccctccctcctctctctcagccgctgacaggtgggacccacctgtcaggtcgtcttcctcctccagccaccaaccgccgactgtagccgcaagccgccgccgatctccttccaaatccggccgcctccttccttctccggccaaatcaattgaggggaaataatctcctcgatctcctcttccttttctctttaggaaaccgagctaattcgtttggaaatcgtcggattcaatgccgatttggttagcatctctttccaaaccctaaaaccttccatctcgctgccggtcgccgtgggcctccgtcgccgcctcctagcccctataaaaggatccctgagacctcctcaatccaccgtcaccttcgccttagcccgccaacgcttgtagcgccgcctccgcgttagctcgtgtgtcgccgtcgtcgccgtgagtccggccgtgccgcgccgctgctctagtcgccgccgtcactcgggaaggccgtcgccaggttcgcaaggtcgccgccgtccttgtcccgtcctccgtttccgccgcagatcatcggagcgccgccgactccgtcgccccgaagctctccaccgctgccgttggtccagccacgccgcgccgttggtccagccaccaccttcggtcgtcgtcgccaccgtcgggatcgcgaggaggagcagcacctcgtccacccctccgtttccgccgaagatcgctggaacaccaccgtcgtcgttgacccaatcatcgccgccgcttcgacctcgccgccgtcgtcatccgtcgtcgtttgccgtcatccaagagctcggtgagttcgccgcgtcgccctctacccgttggtgccctccgtttgcgtcgccgcgccatcgattgccggcgagcacgaggtgccgagccgccaccggcgatgacgtcatcgtcgacgtcagccgtagacccgtggtggattagatcgatcttggccgtccattttgtttagattagatctcggccgttggtttcgtagaccgcctctatgcacccggtctaccgtggaccatctttgatgacgcaataaatcccttttgcttttcaaaaataattcattattgcgtcataattcaattaaaatctatataaatgctttaatccggtttaatctttaaaaattcataactaattcattgtaactcagtttaatgtggttcaagttgcaaaagttgtataaaataaagatctacatattaaaattatccataaattgaattaaatttatttaatttttttaaatgggctttaattagattaaatcttgtaaaattcataattaattcatatgaagtcagagtgaggccgttcaagtctcctaattcatctaaaattattatctacatgtttgtttacttcttatgtattgtttatttggtttttattagtctttttcctcgttttgcgtgttagcttgtcgtttccgtcgtttcgaaggttctcgagtgcgccggaagtgttcaagaagactaattgaagacccgttattgcaaggcaagtcacacagatcccaaacacaattcctttgaccatgttgatcgtatatttaaattctttatttatttcaactgtgcatttattttcgaatgtcaccgggtggtgtgaacttattcctttgtatggccaatttgcattgattacactgttccttgatacattgggttattataatttgactagttgagctttatatattggttcagctagatgttagatataattgcttagccatgcttagaaacattagcacataattgggataactaatgtttcactattacttaatggtagagatttaatgatagctcacgatggttaatcgtgattggtgaattaattaatgtgccaactaaaacttgataatggtgggttgtgagcacatggttttgatggtagtgctcatgacaattaaggaccggttcacgagtttcggttgtgaaacattaaccgtgtcaaccacaagccagaatgggcaacggctggacactttgcatagcaaggctcatcgtggagtgccagactgagaagtggcagagataagcccacgggggtcgctggggagtccatgcctctggtttttgagggggtgactacgatctaggaacggtgcactgctttgagttgacatatgcgaggggtcttgtcacaactacacaaatggtgacatgtttagcatgggcacatgatgatatggtgacatattgtggagttgtgtcttgtgggtacagtggtacacctctggccagagtaaaactattcgaatagccgtgcccgcggttatgggcgggtcgaacaatgtctttcgtgattagtcctacactactcattaataataatgtggtaattgatggtaattaatttagctcctggtttggaatggtacattcctggtttggagatagatctgtgcagccgggtatggttgttcaggatggttgggcctgtgcagcatgggtgtgctgttcagtgttgattaatattgatgattaattactctactgttttacaattcttaaatattttctaaatgctgcttttgcaaatgaaccctatattatgccatcctttggtattcttgtgcacttgcatatttgctgtgtggcttgctgagtatgtcatatgctcaccttgcaataatcaatcaaacctcagttgaagacaagttgcgaaggagaagacgtttggcttatacctcagttgagctgcctgtgggagtggagccggagcttcgctagactgtaattccgctgctatttttcttttcttttgtaagtatttacgttattattatgatgaatctgtatattaattgtcagtttgtgtacctcggctgattcctggacgaggatttaatgcacaaataagttcggaaattgctagttaatttctgggcgtgacagctgacctgttattaactcaggaaatacgcaaaacggataatgagacttagtgacaaggactcactcgaacggtattttccgactcgaatagtgttttccaactcgaacaacattttaccatttccttgttcgaatgaccatttgccactcggatacttagaataaaaactcaatcttacccaatctcttcctctacagtgttttgggccgaatagagaggaacggtggtgacccctagctacaacaagccccctcacgggtaagggcgaagtgtgttttcggccgaaaccgtgttcgaatcaaaagctaggggagaaccgccgtcctcctattcagtcgaaaaacactaggatagaaaattttgaagttcgaaagcggttattcttgtcagtcattatgcatttatttgtttattatatatatatatatatatatatatatatatatatatatatatatatatatattgttatatgtatacatattctttatgtattgaatatgcacatttatgtcaaagtttgctcaacaccatgcggcagtttgatctgtagtcaaagcttttcaagtttggtactggaaaaagaaaggctatgaagatacccttgcttctctctaagcatcgttggcttcgagctcacacaccgcacaatcctcttcgagtcaaccagacaacggtggtgacgctcacaaatctgattcacaggtgtgaagttattttagggaaaactaacttggaaaactttttggatatggtcgaaaacgcttgttcttttgctccgtcgaacctattgtggttgggaacttaattatgtatattttctgtggttgggtaccatttgctattttctctgtatgcctgtgcttcatcatcatttcgtttttgtcggggaagcaggtttatttgaaccgaaaagttgtggttcgacgcaacaagtatcattcaactcgaaacatgaagctcgttgcatttcgaacacacgagaagttgctcttttctaaagcaactaaatgtgatgatgaagagaaggaaatacattacgatgacacttgtattttttctttaaaatttttccaatggcaaagagaacatcgagatggtagtttgcgtgacttcgttgtcgagtttagaaaacggcgttcgaataatgcttcgagcagcattaacttttggcaaacttttagaccatctgagcgtcaacttagaatatggaaaaggcgctactcaattgtcccttacacgggaatgccttctcctctcaatgtcatttttcctttttcttttccttttattccgcaaagactcgaatcagaaaagaattcgagcgtttagctttggtttttgaaaaccgccgtccccctttcctttcgaaggagtgacgaggtcaaaatcgcactttatcttgtcgcatggaatttccactttctgctcgaatcggttatgagtgtttgagtgtttcatcgtttttttggtttttggacgatggtaaaacttgttcgaaaaccgccgtcctccttacctttcgaaggagtgacgaggtcgaaatcgcactttacctcgtcgcatggaattttccactttccactcgaatcggatatgagtgttcgggcgctttatcattaggtttttggacgaaggtaaaacttgttcgaaaaccgccgtcctccttacctttcgaaggagcgacgaggtcgaaatcacgttttacctcgttgcgtggaattttccactttccgctcgaatcggatatgagtgtttaagcacttcatcgttaggtttttggacgatggtaaaacttgttcgaaaaccgccgtcctccttacctttcgaaggagtgacgaggtcgaaatcgcactttacctcgtcgcgtggaattttccactttccgctcgaatcggatatgagtgttcgagcgctttatcgttaggtttttggacgaaggtaaaacttgttcgaaaaccgccgtcctccttacctttcgaaggagcgacgaggtcgaaatcacgctttacctcatcgcgtggaattttccactttttgctcgaatcggataagggtgttcgagcgttttatcgttaggtttttgggcgaaggtaaaacttgtcgaactgcgtggagtgctttttaacctgttgtcaagttggcttttcttctccgaagcgtgcggaggattttctcgatttgttatcgtgttggattttcctctccgaagcgtgcggaggattttctcgatttgttatctagttggattttcctctccaaagcgtgcggaggattttctcgatttgttatcgagttggcttttcttctccgaagcgtgcggatgattttctcgatttgttatcaagttggattttcctctccgtagcgtgcggagtattttctcgatttgttatcgagttggcttttcttctccgaagcgtgcggaggattttcttgattcgcaaacacatatacaatccattattgataacaccctacgtcctgtttatatgtattaacaccgagaagaaaagagaatcttacaaggtggtcggtattgtacacttcgagcaacatgtttcccccttttttttttctcttttttttcttcttccttttcttttttttacacatagaacttcttcaaggaaacagcattccaagtatgctttaattcttctccatcgaggtgtgccagcttgtatgctcctgttttaactttctttttactatgaatggtccttccaacagccacttcatttagtgttttcttgagggccaaatcaccttcttctatttgcctgattttcacttttttgttgtaatagcttttggtttcttctgtgttttttgccattttgtctaatgcttccactcttatctcgtgcaacatttccaaggtgatttcccttccttcttcgtctttttgatcaaacacaattcgaggtgaattcgctcccacctcgcttggtgtcattgcctcatctccatatattagcctgaatggagtcatgccagttgatcgaacaactgttgttcttaaagcccaaaggattgacaacagatcttctggccattttcctttggcagaaccttccagccttttctttatggcttctactattttctcatttgctctttcaacggcaccatttgttcgaggatgacccacagaagcaaagttgatttgcaggttaagacatttacacatatctttgaactttcctgactcggatcgttttccattatccttgggtattccaaatcggcatatgatattcttccaaacgaatctttgtaccgaagcagatgtgattcgtgctactgcctctgcttcaatccaccttgtgaaatactcaattgccacaatgacaaaacgtaaatctccttttgctcttggtggaattggccaaactggtggaattggttgcaactctcttggtggtgcttttgacgttgcaccaaatttttggcatgccttacatgtcttaatgtacttctctatgtctttgatgatagtaggccaatatactcattgtcttatcaccttcgatgcaactgatcttggtgcttgatgggctccgcacagcccttcatgtatttctaccaccattttcattccttcttctcttgttacacattttagcaaaggggtagtgactccactcttgtacaactgcccttctatcactttgtattttcttgacattaactgtattcttcttgcttcttcttctttttctggaagttgttcactaaccaaatacttcagaattgactctctccaatctatctcgccatgtatgtttgccacttctcttttctcataacttggttgaattaacacatcgaagaatgaattctccaatggttggcctgtggcagctgcttttgcaagctcatcagcttccccattttcttctcttgttatagtttttactgttatcccaaggaagtgtttttcattcagccttgcttcttccaagtactttgccattgtctcttcttttgctttaaatgttttggaaaggtgacctgccaccagctttgaatcagttttgattatcaatcgacgagcccctagtgctcttgcctttctcatggctaataaaaccccttcatattctgccgtgttgtttgttgatgggaaaactagctttgcaaaatattttagtgtttgcttcatcggcgtttttacaaccactgctgcccctacgccagtggcattgcatgctccatcagagtatattatccatagtttttcatcttcttccttttcctccacctcattgggagtccattctgccaaaaaaatctgccagaacttgagactttatagctgttctcgaggtatacttcaaatcaaatggtagaagttccattgcccattttgtaatccttcttgctacctccttatttgtcaatacctctcctatcgggtatgctgacagtatcgttatgtcatctgatattaaataatgtctcaactttcttgaggccatcacaattgcataaatcaacatttccacttctgtgtaccttgtctttggcccttgtaaagcttctaatacgaagtaaactagcatttgcttgttttctttctcttgcactaatgctgcacttactgtccctggtgtcgctgctacatacgttagtaaaggttgacctttctgtggacttgctaaagttggcatattctgtaactacatcttcaaatcatcaaaagccttctggtactcggccgtccactcaaatgtgtttgctccctcttagggttttgaaaaatggcaaaccctgctcttcagatttagaaaggaatctgctcaaagaagccattcttcctgtcagcctttgcatttccctttgtgttttttggtggctccatttggtgaatcgctgcgatcttgtcaggatttgcttctatgcctctcttagatactaagaaaccaagcaactttcctgctcttaccccgaaaacacactttttcgggttaagcttgactgaatattttcttaaattctcaaatgtttcctgcaaatccttgccatgagtgaacgcctgtttgcttttcaccacaatgtcatccacataagcttctacattgcggcctaattgctttgccaatactttgcctattaaccttgcaaaagttgctccagcattctttaaaccaaatggcattcgaataaaacagtaaattccaaacggagtgatgaacgacgttttctcttcatcttcatcacaaaaacttaatgataaccggagtactgcatctaagaaacccatcaactcgcagcaaactgtagcatctactaactactctattcttggcaatgggaaatcatcctttgggca

SEQ ID NO: 63081 - DNA, 15673 bp, Oryza sativa
tctctctctccgccgtcgccgccgagctccggtccgccgccgtcgtcgccccggaccatctcccgcctcggcgccgcctccttcggcttcgccgcatcctcgccgacctcgtccacccctccgtttcgctcgctgaccgccggagcaccgtcgaccccgtccacccgagccgcgccgccgccttcctccgctccggtcgccgttcccgtcgtcgccgtcgacccggggtgagccgtggaccgccgattcgtttcccccttccctcccctctctcggccgccgctccgccgtacctatggccgccgccggcgaccataggggcgcgggcgcgccgcctcccgtcggctgtgccggcgtggccgccttcgggcgcgccccgcggctgccgcgtggggcccggctgtcagccgcccgcgcccttaggtgcggctgacgcgtgggacccacggcgccggccggtgcgagcctgggtgcgcccggtccaccgtggaccgtgaggctgccgcgtgggccccacccccgtggacccggtccgcacgcccctcccctcggctgacgcaataaatccattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttataaaattatgttgctttaaattattgcattatcgctttatttaaattcccgcgttatcactgttttatctagccatgcctatttacctttgttatgaccttattattgttattgttattatctccttgttcaccctagaataaacaaaaccccaactagtggacactctactcatggtaccactagtatgattttaggtagatgcttcgctattttaattaggtaacattaggtggtttttcaactcttgactttgggaatattcatatcacctggacactatggaatggtttggttattgtggaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggaagaagtcgggggtcgatggacatctctaggacaaatgaaggctacacgagctgcggcccggtaatcgagatgtcatggcacagggctggtgtcctgctgctaggggctcagtcctgcctgcctgtcccgggggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaatatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttccaaaatagctttgcgcaactaagtgtctttaaatgctatttactgcaaccctaaccctttatattataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagcgcctgtggtcgtcgccctagtcttccgctgtttctcgtttgtctttgtgtgtgctgggccttcgttgcccatgtaataaattatctatttacgcttccgcttgttaaactctgaattgtatcaacttttggtgtaccttgcctcctgggacaaggaataatacacgcacgtaaggaacgcccgttgggttatttccggtcgtgacaatcatcctcgtcatcttcatcatcggatagacatccacgaaggacgcatgatcgccgacaacccaccgctcccagcgctgggtgtagagctttcggtcgttcacttcgggatgtccgatggcccgaaagattctgacctggagcaatagagaaatgcgatgggagcaccgacccagaagagttccttcaggtttactccacggtactctacgctgccggagcggacgacaacgcgttggcgaattacttgccaaccgcattgaaaggctctacacgttcatggctgatgcatcttccccccctactcaatctcttcgtgggcagacttgtggcagcaattcgtagccaacttccaaggaacttacaaacgccacgcgatcgaagacgacctacatgcgttgacacagaacccgggcgaatccttgaaggattatgttcggcgctttaacgagtgcagaaacacaatccccgagatcaccaatgcttctataattcgcgctttcaaatccgatgtcagagattgctatactactcaagagttggcaacgaggcgcatcacgactactcggagattattcaaaattgtcgactgatgcgctcatgcggatgacgcattgagacgcaagaacgacaaaccgaagaccggaggagagaagaaaccagccaaggacgcacctaagtcaagcaaaaagaaaaatcgcaagagtgggaaaaggaaagctcaatcagaagttctcgcaacagaatacgcggaccctcccaagcacccagacccacaaggcagcgacacgaagaaagcatggtgccctatacacaagacggacaaacattctctagaagattgcctcgtcttcaaaaagtcgctcgcaaaacacatggcatcggaaaaaggcaagcgagtacgcgtggttgagaaagatgctgaggcgcctactcaggaattggacccagcatacccagattccgatctccatgtctcacacatcttcggaggttccacggcatactcctcaaagtgagaatacaagaaagtggaacgtgaagtctgttcaacgtggcagggggctgcacccaagatgaagtggtccgagcagaagatagaattctcagaagaggacgaccccaagactgctgtcatcccagggcgatatccgatcgtggtcgaacccactatttgtaatatcaaggtcgcccgagtactgatcgacggcggcagctcaatcaaccttctcttcaccagcgccttggacgcgatggggatcccatgaagcgagttgacacccaccgatcaacccttccatggaatcactccttagttatcgtccaaacaattgggcaaaattacgttgcctatgactttcggccaagcaaacaacttccgaatggaacagatcacctttgatgtcgctgaattcgatacagcatataatgccatcattgggagaactgcactcgcgaagtttatagccgcatctcactatgcgtatcaagtgctcaagatgccaggaccgaagggaacaatcactattcaagggaacgctaagctggcagtacaatgcgacaagcggagcctcgacatggtcgagaacacgcccagcccgcctaccacagcagagccacccaagaaagtgagcaagacaaacaagacgccgaaaccagacggcgcaatcaagatcgttccactctccagtgctaaccccgacaagaccgtcaagatcggggcatcactaagcgagaaataggaactcgcgctcatcaccttcctccgcaacaatgctgacgtgttcgcttggcagccgtccaacatgccgggagtacccagggaagtgattgagcacaaactcatggtgcgacccaatgccaagccagtaaagcaaaaactgtggagatttgcaccagatcgaaaacaagccatacgagaagagctcgacaagcttctcaaagccggtttcatcagagaggtactccatctagagtggcaagccaacccagtcatggtacggaaggccaacggaaagtggagaatatgtgtcgatttcaccgacctcaacaaggcgtgtcccaaggatcactttcctcttcctcgaatagaccaactggtggacttaacagccggttgcgagttgttgaacttcctcgacgcttactccggttacgaccaaataagcatagcaaaagaggacgaggagaagacagcattcatcacgccgttcggggtattctgctacgttaagatgccgttcggactaataaccgcaggaaacactttccagcgcacggtccaaggtgcacttagcgaccagctcggaaacaatgtcgaggcctacgttgatgacattgttgtcaagaccaagacaagcgactcattgattgacgatctgcgggaaacgttcgacaacctccgacgatatcgcctcgtgctcaatccagagaagtgcacgtttggagtaccatcaggcaagctactcggcttcctcgtctctgccagaggaatagaagcaaatcccgagaagatcaaggcaatcgagaacatgaagtcacctagaagactcaaggaagtacagaagctaaccggatgcatggcagcactaagcaggtttgtcactaggatgggagagcgaggacaacctttcttcgttctattgaaaaagcaagacaaatttgtatggacacaggaggccaaagaggcattcattgcactcaagcgctacctatcaaatccacctgtacttgttgccccccaacctaataaagaattatttctctatattgccgccacgccatattccgttagcactgtcattgttatcgagagagagaaggtgcaacgaccagtctactatgttagcgaagctctccacgacgcaaagacaagatatccatagatccaaaaactgctctacgcagtaatcatgacatcaagaaagctacgccactactttcaagcccacagggtcacagttgtctcctccttccctctcggcgaagtcatgagaaacaaagacgttgtcggccgcattgcgaaatgggtagtcgagctaagccaatttgatatccacttcgtgccacgaacagccatcaagtcccaggtactcgtcgatttcgtagccgattggaccatgcctgataacaggtcagacaaccaaatcgacaatgaaacgtggacaatggcgttcgaaggcgcactcaacagccagggagcaggggcaggattcatcttgacatcaccttcgggagatcaattcaagcatgcaattcacctcaacttcagggcaaccaataacacagccgaatacgaaggactactcgccgggataagagctgcagctgcactcggagtcaggtgactgatcgtgaaaggggattccgaactagtcgcgaaccaggtgcataaagattacaagtgctctagccccgagttatacaattatctcgcagaagtcaggaagctggaaaaaaggttcgatgggatcgaggtctgacatgtataccgtaaagacaacatcgaaccagatgatctagcatgacgtgcgtccaaacgagaaccacttgaacctggcacctttctggatgtcctgacgaggccatcagtgaaagaggcaagcggcgaagatagcccggtcgcccccgacaccagctcgggggctacggaggtagaggacgccgttgccgatatcgagaccacggacgactggcgcacccgactcattaaattcataagcagcgaagagttgtccgaggacgacgcagaagccgagaaaatatcccgtgaagcaaaagtctactgtatgatcggcaacgatctatacaagaaggcaccaaacggggtactcctaaaatgcgtctcgtccgacgacggcagacacctcctcctcgacatacatgaagggatctatgggtcacatgccgccggtcagacattaatcggaaaagctttccgacaagggtttttctggccaaccgccctcaaagacgcctgcgacatggttcagcggtgtgaagcctatcaattccacagtaaacacacaaagctgccagcgcaagcactccagactatccctctcacttggccgttctcgtgctaggggctagatatacttgggccattcccacgaggacaaggcggctacaggttcctattcgtagcgatcgacaaattcaccaagtggattgaagcgacacccacgggggaaatcaaggccaacaacgccatcaaattcatcaaagggatattttgcagattcggattgccccaccgtatcataacagacaacggctcccagttcatcagtgccgatttccaggattactgcatcaggctgagagtccagatctgattcgcctcggtttctcaccctcagagcaatggacaagtcgagagggcaaacggcatagtactacaaggaatcaagacccgcgtctacgacaggctcatgtcaaacgacaagaagtgggtcgaggaacttccatcagtactatgggccgtgcgtactacaccgacaacgtccaacaaggagacacccttcttcctcgtgtacggctcagaggccatcctccccaccgagctatgacatcaaagtacacgagtacataagtactccgataaggatcaggaggagcagcgatacgacgatgtgaatctactcgaggaacatcgcgaacgagttgctgttcgagcagccagctaccaacaagcccttcgccgttaccacgagaagcgcatccaagcacgcacgctttcgatcggcgactacgtcctccgacgggttcaaagccaagcaggacgcaacaagctctcacccaaatgggaaggaccgtacacgatcacacaagttctgcggccaggcgcattcaaaatcgcagacggcgatggccacgagttggcaaattcctggaacattgatcaagtacgtaaattctatgtttaagtcaatagtatccatacttgtaagacatcttacagcctcaataaagcctattttttaagtacagacgacaatcaaagtgttccttcccgatgatcccttacccagatgacacctagcgttgaaacctatcctcatgtccctttacgccgtcttgacaaggcctccgaggaacctaagggaacttcggctggggacgcccagagccgataaggccttgtcagatcctgtagagacgaaagaccatgtcagatctggtcgtgtaagagttcttgccgtgcatattaaccaagccatgtaatcggaaataaactttccaacttcacggctgaggggctaggatcagtgcttgttcaatcgaggcaggtcaaaggtccaagagccttatcttccgagaagaattctccgatgacaaggctgggggctagggagagtgtataactcaaacgactgatcgaagtcgcgaagttagatagatttctttttctattccacaagtatttcttacaattctatcaaaatccaaaactatattacactttttccaaagacatttgtcacaggacatggagactaccaggaaggccaacaccagtccatcgactggaaaaccatctccgccagcggcgccatcgacttcgccaggccatctatctccgtaggagttctccgagaacgagaaaacccttcgcggaggaactcgaggtacagctgcggacgatgatctcgtatataggccagcacgtgccccccggcatatcggcttgagcgacgacactcctgcttcaaggcctcgtcgatacgttgaccgatgccttcgagctgagcgcaggcccccattcagccacgagatgtatccggccgccgattcctcgggatccccacggggtactcggagctctctacagactctcgacatgaatgtgcagcaactcttcagatacgagttgaaccacacgtcacgaccccggagtgtctctacggcctggtcctttctcacctccagcatagtcctctcgagttccgcaacctcaaacttcgtcctccaatactagatgcgacgatcctggtcaacaagcgcactctcgagatctgctcagcatggaaacgactaagtcaagctgctcttctatcccgagaacacaacaaatcaagtcgatctagacggaagggcaaaggaaatggtaacaaagacaaccaacctaagagagtcgccgccatgctcgtttccacaggcgaacttcgatctacatcgccttccggcacatatggttcggacgcaagtaacggaacgaccactggcaactcaggctgcccgcgctgctggacatcctcgacatcaacatctctacaaaggacaacaaagtactcgagatcaaaatgccaaacaaagctaaggcaatgaccgcacacactagggcggttgggaccaataaaagttttacaaggcatgactaaagagtacaagagagctaagaccctactcttcaaaaagcgggaggacggactcccccagatcgtcgacctcctccatcacatccttgcgcgcgtcgctagccgccccctgatccaagatcttccgcagatcgagttcagggtgcgcaagccttacacacgcaaggacgtggcacgccccggtgtagatcccgttagacgtctcctctccgatcctggccgcatgcttggaggggacctcctccgtcgccatcaccagctccgcaagagaagacgtcagcgagaactcatcgggattcgccgggatggtggacttgataccgcactccccggcgagctggtgcagaccagtataggtgacccgcaacgagccacggatttccaacaagttgttctcaagctctgacatgcggtgctcgagcccctgccgttatcgctcgttgccgggcaccagttccctcatcttctggaggtcctcgcgaacctccgccagatcgcgcgccagtcgattggcgcgctcgttcgccgacaacgcagccgccgccctcgcctccgcgatctcgaggctaacaccgcgaacaccagcctcgaggaggcgccccatctcaacctggagctcctcccaggtgaggacggcagccggcgaaccacgaccagccacgagatcgctggctgggccactaggtgtcgcctcacggctcctgggcacgaccacgacatccgtcgaggccacggcaggagatgcgctggaggtccctccagacccatcttgcgccgcctttgctcgcaccgccctgcgaaaggctacgattgagacagagttcgacgaaatcacgaaacctcaaatttattcacttacttctcgctgagcgtcacaagccgctgctgtcgcggaggcgggagagacgcgtccgaggcctggagtacaatcgatatgatgtgaggtggaagttttccgactaggtgatcaaataacgggagaacttaccgagggagtgggtgtcttccgacgatgtccgactacagaggagaacttcctcccctttttcggaacgtcgccgccactcgtcgtggcagcggcaacagcagcgtcagacgcctccttggcgaccttctccttcagcgacgccgccacctgatggtccacgagcggcccgatgatatcagtcagagggagagcctacgtttcataaagtcataatgcgatcccggaagaaaaatgcaaaaggacagctaagtacacttacattgatggcagcgtcgtgctcggttgcccctttctcgcaaagggggacggggacgttgctcgccgttgtcgggccgctgatcatcagttggccgacgcggcgctccacggttgcgctattcaagcctgtagatcgagaacagaacccgataagccgggaagaacacgcgcataagagagtcaatttaactaaaaaggaaataccccgaggagaaacccgggtcgcgtcctctggcccagaataatcaaaggcgggatgggctcgagcctgaagcggttggatccgcctaccaatgaagtcggcagcaacttcataccccgacaacccccgttctcggaggtcgtcaacgatatcgatgaaagattggagggacggggtcaaggcgggtttggtggtccaagatggaatcttgtctggctgttcctcaggtaaaatgaagacaggatccgaatcctctatctgaagacagaaccacctcccccgccatttgctgcgagatgaggggcactgaaaggggatgtatcgcgacttcaggccatcccgaagtcggaaaccaacacacccggacacctttttggattccatccagcgtaactcatagtaaaagcggaagaggtcaagaaacggctccaccctaatgtaggcctcacaaagatgcgtaaaaatactcaggaaggcgatggagttggggttcaaatggagcaaggaaagaccatagaaattcaagaccaaaaggagaaattcagaaggcggaagaagaaaaccacagagaataaagtcctcaaccgcaaccatgcgacccaggacaggctggggtttagtacctcctacttccctctccgcggccccgcgaccgggaagggcgccatcctcctgcagtttcttcagtgatgcactggtggaggtagacttgtcgagatccatggccaccggagatcgccggagaaaggaccgagacgagttggctatggtttttttgcaggagcgaagaagacgagggacgcttggaagctggagagttttttgaataggctgacctcaaatgggatccccaaaactcccttaaatagacgcacctccgccggtgcgaattcccaggaaaggagagagatggccgccggaaatttttaggtccgttacgcgcggcagtttttcggacttcaatttaaattcactcatgaccgttgagcttcactcgacgttgtcgatcactccttgtctcttggtccccacaccgagaacaacgacaattttgacatcagaagtcgcaatcgatttcacgagttcatttaagcagaagtcgggggctactgtcagggttacgggtaaggtataccctctacccttcgatatacgtcacgtatcgatatggtatgtttgtgtgtatacggacgttctcagcataggttaaggaagtccatcatggagtctacagatggaaagagtcctactcggatagaactgggtcgtcattatatcgtgtcgggtccaatgtctctgagtcttacttagagaccagctgacctacggtaaaaaaagggaccccccgagaggacctaaggcatcgaatctcagagccaacacatccaccacagcctacgaagccggagcttatcgaagccaagtcgccgggagatctagtcggatcaactcaactacgatcttgtcggtatcgtcgagcttcattattccctttgtaatctgtggtttccatcatataatcgcatatcaactggattagggctattacctaccaaggggcctgaaccagtataatccatgtttcctgtttgcttgatgtcgtactatgtagatcctcgtaccagcataccccaatactctctatatccggtctacgggtatccaccgtcgacagttttggaaatggtgcttagaggaatccagggatgaagcccagtagaagcccgtgggtgcagatgaaccccccaaaaaatatcttttagttattacccccatatctcggccctatatgcacccccctcagcccaatatagtgcacccacagcccaaacagcagtccagttaacgtggtaagcccatgagcaggccagtagggtggaagccagatcgatgttttctcctctcgacttcttgtatcgtgtgccgcgccgccgccagtcttgacaactccgcctcgcgtctgtttggcttccacaccgctgctctcaatcagccaatcccagtcagcacttgcccatctcggcatctcaccgtcgccggtcgccctcttctcagttggcgaccgccgcgggcaggaagccgacagctaggcaaccaggagctagcgtcacaagccaacaacgacatcagtccatctccaccaactgatcagcacacaaccacactgtgcgttagtagagccaaggtaagaaaacatgcttcatctatttctttttcaatcaatttgatttattagatacgaagccctaaaatttttattggttgttaatttttatattgtaggattaggaggccaccaagcttcaatttggggtccttcagaatcggagtaagattgcagattggaggaaaaatttgagaatttgaattgaaggtgcaatttggatgtaagtcatgtcaattttcattctatttctttagttgaatgaatgataaaatctctacacatttacatcttcatgaatcatcttttgctcatgggtcagtagccatttatcaatgttattagtggttttcttcattttaaaaaaacaatgttttccacttctttattttattgatgcatgtatgtctctattgttgatgtcaaaaatttatcgatcagcggttgcattgaaaatttagcttgaagttatatatatatatatattgatatacttgtggtacaatcatgaacccctccatttcgctctagcttcgcccttagaggaatccatgcatttgggtgctataagagcaagttcagcagtatagttaattgctagctataaagattaataaatcacttacatctaatctatagcgaactcatataatatatcgctttagatatatatattccatacaacattattaattaatacatatcccacgtctttttcatatagattattggagcacattctacgattggccaaatctatagcccacttttttttctttctcctctctcctccaccttaaacataaatctatttgccatcaagatcaacgagtttatgcgtactagctagaattattatcttttttgtctttgtatgtttttggaattaatatatcagataccaatttttgttaccatttaaaaaaatcaaaattattttgattatatatatatatatatatgagtaaaatacacggccggtccttaaagttgagtgcgggtgtcacttaggtctataatcttgtaaattgcacatctagatccacaatcttatttaagtgactcattgaggaccaaaggatctctgaccaggttgactggcttatgtggcggtccagcgttgcaaaatatttacattttgccccctattttgcttcccgtcttcctaaatctctctctctctcggacacaggtcggcaggtgcgcacggcgaggcgttggtggcgagcggcgaacgccgacatggaggggcgggcggcagatggtggcgcacggggcgggccccgctgccctcccgcgcggcgtcgccgactttgcccttccgctccgagagcagaggaggaggtagtgcgagcggccggcgggggaggcgggcttgctcgggcgccggtggcgcgctcgtgtagccggcagcggaggcggacgtgaaggcgggtagcggcgcgcggggacgggccaacagtcggcgcgcacgacggcagacatggcggagagacggaagtgtcggcgaggcgggcgtggcggagaggcgggtggcggtgtccactcgatggggaagagcggctcgtgcaacaccccgcgcacgtcgccggcgcctcctctctcgccgctctccacccctgagccaaagaaaccgagagggagagctccatcgtgtcctcctcgccttccactccatcgtcggccgccgagaaggatgcattgccgattgtcgtcaagccgcgctcgccattatctctttcctgttccatattctactcaccattccgaagatttctccttttgatttcatcctctatcgtgcagcaaatcaatgggaacgccactgtgtcatcgccggccttgggacgtgctctgcgcgacgtcgtcgtgatctcatcgccgttcccgtcgttctggaccaagtcaagccgagccaccacgccactagtatccccacaccatcacgaccaaaacccctcaagaaccgtggagaatgaagcatcatggacggagatcggcatcatcttctccaactctgactgccggctaccatcgttgattccgcctcctctggtgagccattgtccgattcctcgcgcatacaccatacctgtcacctcactaacctcgtggacgtcatgctagatcttggagccgtttgagctgtcaccgtcatcccggaggttcttaccgccgccgccaatgtccatccatcgccaagtcctcgtcgggcctctccaagccacagtcaatcttcagtgagcctcctggtaaataatagaaccacatgcatgcacgcatttaagcaatacatggtcgtaggcgcacatgcaccaccacccgaaaacgtcttccgctcggactcgccgccggcgctactccgatgtccactaaccgagaaaagtagaggaatggaatcacagtaacatgctcttcattttgtcttttggtcgcaccccgaaacgagccacctatcgccgccggcgagctcgccaagctcacggcctcgaggtgctggtagagcgcggcgacgaggaagagcgcgagcggtgaactcggtgagtgcatacgccggcgacggcgaggacggcgcacggcggagctcctccacagtcggagccagagctcccggatccgcgcggcgacgcagtggcgcttggcgaggcgccacattcggagccagagcggcgcgcaggcgcagttgctgctgcaggggcgggacgacgatgctactattgcggaggggcttgtttgtaaattggtgcttgcgtggcgtgtcacgttggcggtcagacctggtcagaggtcctttagagctcaatgagtcacttaaacaagatagtggatctaaatgtactcgtgcttttatatatatatatatatatatatatatatatatatatatatatatatatatatatatatagcacactcatatggggcaccatggtgcccgggcaccatggtttcaaatgcacaaaatcacttaaatttttcaaaattttcaaattgtgagtatatacctagttataagaattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttcaactagttagtaaagtagttaatattaatacctaaataattgaaaaagtttcatgctcatttgaattgggtatatactcaatttcaacaatggtgcccgggcaccatggagcaccaaacaa

SEQ ID NO: 63082 - DNA, 3646 bp, Oryza sativa
  unsure (1)..(3646): unsure at all n locations
cccccccccccccccccccaaggcccaaacccccgcccgcctcgacctcgacaagccacggccatggcgtgcgccttctccgtctcctctgccgcggcgcctctcgcctccccgaaggtgcccgtctccgcgccgtcgcagccgtccctgccgttcccccgctcccttctccgccgggaagtccctgcgcctctccgccgccgccgcctcgagatcggctagggcccgcagcttcgtcgcccgggccggaggcgaggttcggcgcgatttgatgtttgatttttttggggtggtattggtgcctctgtgagagttgggattgacgcgcgcccgcgtgtgtgcgtgcgcagggggacctgccgttggtcgggaacaaggcgccggacttcgaggcggaggccatgttcgaccaggggttcatcaaggtatggcggtaatccggtaaccacatgcacagctacattgcgccacgcacgcacgcgcggcagtgttattcgacataggggattaattggcccaggaaaaaatggggcctatttgattggcagtgtaattcaccgtgagatttgataatttaacactcttttcaatgggtttcgataaattgacatcctagcccactttcattcactcatatggtcccacatgtcatcctcacaaatgtcaattaaagtaattgggcaacgaaaaaagtgtgaaattatcaaattttttttacattcatcataggggattaattggcttgggccaggccaaaagaaaaaaaaagtggtctattcgattggtagtctagattagatgttaagtccatatccacggctgtttaatgtagaagctgtatggttgatcgtgcttccaattgatatcttcgttggtcgtgtccttcactccttctgtatatgcaggtcaggtcaagctgtctgagtatattggggaaaaaatatgtggttctgttcttctaccccctggacttcacgttcgtctgtccaacagatgcgttgaccttgtcgtgctctgtcatggaaatgccttttttttcagttttttttcattcctaaagtctaaatgcatgtttgtaagctctgcagagatcactgctttcagcgacagatatgaggagtttgagaagataaatactgaagttctcggtgtttcgattgacagtgtggtatgctaacttttacccgcatgactttagatgttgttacggtgtcgttacctggtctgttgctctattgagaatttcgtatttccattccatctggacatgtagcttttctcttgacaatatttgtggtttcttgaatgccttaaggttgtgatcaatattttagctttcctctttatgtgatcaatattctatttgttcttaacgtctgaatatagagcattagatgaacccttgcattaggccataagttttaacataagattgccacgtgttgaactttcattctgtattataatgaaatgtgtggtgtttgttatgccttatggaaatattgaatggaagtaaaaaccgatgctctctaatatttagacaatagcgttataaacattcaattcagttattttgaaacaactttgagaaatgagactgatgtaacgtcttaatactctggtttgcttctgccaagangattcattgcatactcaaatatntatcncaaattatatccagtaaaagtattgattttgctactattacagtgagtagtttgtagccagtagtggtactgtaatttattttttactatcctctctttctgcttctgcataaagcatttcattttttttatcttataggtatcattcactgttactctgtcgactataaatatttaataagtggccccaccctatgcttcataagtgtcgcatactaatttggctttgaaatatcttttgtttgcagttttcccatcttgcatggattcagacagataggaaatccggtggtcttggtgatctaaataccaactgatttccgatgtcaccaaatcaactagcatagtggcccgcgcagattgcgcggctagcatcattatatttttttctcttataatagcatatatgttttctcaatgtattattaaaatatattaaaataacaacataattttgtgtgtgttcatgagagcgaacttccaatattcctttgaattttagttatttgtaaattgtatttctatatgtactctaaattctactttaattttattagttttattctgaattttaaattcttatatggattctatactcttcttctaatattccttattttaattcctaatttatattatttggaaattttatttctatatatggattctaaacttatctttcaatattttttaattctgaattttaattatttttaaattatatttctatatggactctatattcttcatccaatatatatttttttatttcgaatttttttatttctaaattgtatttctagatggactctaacctctatatttaatttttcttattttttaattccgaatttccattagttctattgtataccgacatggactctagtcttaccttcctatattccttatttttaattccgaatttcagctattattaaaattgtatttctatatggactctgttttttctttttcttagattaatgtgagaatttctagaccatgagagcgaacgtggaggcttctttttctattcctttaataatataatagatttcaaagtcttttggtgtactaatccctgatcaggtatacttcagttatgactgcctgttggctatatatacaatatatgtctttcttctggatatttacttgtttgtattcaaagtcttttgtcatgtattccttgttcttaatctcataagagctcatactttctgctgtcaggggattgctctgagaggattattcatcattgacaaggagggtgtgattcagcattctaccattaacaaccttgctattggccgtagcgtggatgagacgcttaggacccttcaggtagaatagcaagataataaaattgcatctgcaaacatgcatttcttttcaatatacatggcatcttggcagttttttcgtcttgaatttaccatagtctagtgtctataacatcaaaaattgctcaactagttataactgtgagtgacaaagtcagataggaaaattttttgcaaatatgcaagttcgtaatttgttttcctatggtgacaggccctacagtatgtccaagaaaacccggatgaggtttgcccagctggatggaaacctggggagaagtcaatgaagcctgaccccaaggacagcaaggagtactttgcttctatttagacattttatttacattcatggtcaagttttgccatagcctttgttgggtcacacattgctcttatgatcgaaattgcagttatgtggacacattgactttctgcaaataaagttttgttgtgtttcattttggatttgttctgctcccatttaaaaaggaaaattcaaccattgaaaaataatcttatttgattctagtcaccttttttaagaaatgctagttaaggttttatgcaagaagttacttaaaagctgtgtaatgtttaataaaatgttattggctcttttgtacctggaagcgt

SEQ ID NO: 63083 - DNA, 504 bp, Oryza sativa
tactatagggcgaattcgagctcggtacccttgaccttgtactggtttgtgtgtgtcggtatttcccttacaaaatgatgagttggtgtgtgcgcgcaggcgcagcgcgctactggttcaaagcacagcagccacaccttccgcgaaccgatcgttcgatcggtccagccgcgtccggtttaatataaaccggcacccgtaaagcgattggcaattcaatcggtattggattgatcaatcatcgtcacctcgttttgcttgtctacttcgatcgccgcctccgcagccgtcgtcggagaggaggaggaggaggaggaagaggaagaggaagaggaagaggaagaggaggagtgggagatgaagaaggaggcaggggcagggagcaagctggggaggtggctgggggcgccggtgcgggcgctgtcgagggcgtgcgactcgtacgtgcggaagatgtctgcgtgcgcggggcacatgccgacgcacgcggcgggcgccatgggg

SEQ ID NO: 63084 - DNA, 701 bp, Oryza sativa
ccatagcatagtggccaggttccgaatcggctgacccaatatcaggttgttgccacgtttttggaacctccacctgctgtcgatccaatacagcagcaaccgattcaacagacactcccagttcaacaggttgtacaaccaatccagcaacaggttgtgcacccagttcagcaaacaccaccaaggcagcagcctatggagccgattcagtagacgccgttaagacagcaaatcgttcagccgattcagcaccaaggttcaataagcgcattgcccgggtttgcaacgcttggtggtcagcctgtacaacaatttttaaatcaagttgtcccagaacacttggttcaccacatacagccggatggcacagtaatgcctcaagttgttcctgagcacttagcacgtaatatctagccgaaccttcataattactaagagggcaacttgaattatcaatatcagcctccttccccgcaagcccaatatcaactagggggactggctcaaccccagtttgcgtctcaatatggtcagttcgagcccatgcaacaacaggcacagggagcagctcagcaacgaccgtgggccgatgtgattgctgacgtaataagggaacagtttgggcttaaaccaaaagagagtggaagcttgtatcggcagccttaccttgagtggtttgagagagttcctcttcccaatca

SEQ ID NO: 63085 - DNA, 8981 bp, Oryza sativa
ataggtgggtcccaccattttttaattaaaaaacgttgactgggatgccacgtgtatgtcacgtagactaaaaccaccgcggattaggtcgatggggtaattcgtccagtttgcatagttgggggtgaagaatatccggttttatggctcagggagtaattcggacgaccgcgatagtttagggggtaattcgtactttttcctcaacaatatggtattatttctgagtctggttgctatgatgcacgacgcatacgtgcagtcgtgcagcatatcgatggaccgaaacctcctgggcctccatggcactccgcgcgatcgagcggcttgccgcggggcggggccagtgcggaacgatggggctgaggcctgcagcctcggacaccgcacggcccgcgcatgcagacaccccctcccgtcgcccgcttccgcggcccggtccacctcccagctaggccagcagccggcgaggcccaatgggaccctgactctatttgggccgttagctgcaccgacaatacacgcgtaacgagcaataagtcgtcctttttctgattttagttctgggaaaacgtcgtgctcgtctgcagaaaagggacagaagtgtataaaccgcgggacaagcacgttctttctccagtctaatctcttacacagaattcagggcgaattctcgaacggttagccccaacacgtggcacttccggattcctggatttggtttcccaccagccaatgcgcagatcgtacgagttgcctccgcgcgttcgtgcttgtgcccgcaaggcagctgggcgcctggtccctgggccatgctgcagctgcacattgactagggaggtgatggcccaagctgatgtccgaaaacgggtggaaaccttccaaagaaatacaaatacaagttaggcttgtcttcggcagcccctcttcccaacccatctccctctttttccactgttaaacggtgtgttttttgtaaaaagtttctatacgaaaattgcttagaaaatcaaattaatccattttttttaaaaaatagcaaatacttaattaatcacccgctaatcgctgctccgttttccatgcggtcactttgggttggaaaggggttccgaatacacctttcctaacatgtagtagtagataattgtatcagaagatggaaattagaccatcttaaaatgaaaatgtacagattagcaaaccaaggaaccatttctgaagaaaaaaagcaaaaacagatttaggcacctgtcggtgacatggggccgggggtatcgtgactagaggcttgggtagccgcggtcacccacgtggcccgaccccctcgggggggtcgggcccgagggtgacgtggccacccctccttctgtctccccgagggatcgggccgctcccgtttcggccccgagggctggggcgccccgaccccctgtggttttggcgccacgtgtgtgggttaggtgagcacagcgggctcacctaaccgcatttatagcaggttggatgagcgcgccacgccgcatttaatgcggcgcagcgcacgcttatccggtccgtgaccagtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcgaggaagtcgctggccattaaatgaaggttgaaatgggcgtccaccggaaaagcgggcgagcggggcaggaggcgtgtgctttgcttgtcagaggtcacttccggctgtagactagccctcattgtaaaaagcatgtttcccttctcaggcagcaggaggcccatgtggtgacccctgaccagataaaaaggaggcccaggcctaggaagaaaaaggggggagaaagaggaaggagggttgggactctggcgaatgggttctagagcctgaactctctctcgctctccggctctctgtattccttcacgcacagatccaccagaacacaggagtagggtgttacgcttctcagcggcccgaacctgtctacgtcgcccgtgtcttgtgcacttcctctctcgctgacgttcctcagatcgagggcgaagaacctcacttagcgcccccggccgaacctgcaaaggggggcctgcgcggtctcccggtgaggagccccacgctccgtcagcaccatatatagattccatatgcctccatactatactagattacgtcacaaatcccaccgtaaaattttggcatcaaagaaaacatcacgtgacttttatttccttcaaaattttatcattacaatagggtaggtaattgaaccaacggaaaatatttattggtgaaaaaaatgctactactcaaccaagaaaaaaatacaaatcaaatgaccatactaaagaaatttcacaaatcagtagagatactttctttttaccatttagacaaatgatgatgtgctcaatgagctttggcattatcaaatattggcggcagataattgaaccaactgaaaagatttatccatacaaaactgctactagaataaataatgaaaacaataaatcaaatgacagtaaaaacaaattttaatcagaaattaatattgaaatcaaaatagaaagacagtcttttacaatttatacagatggttgtgtgctctatgagctgagttgcatgttctcaaaattctgtcatgccctaaacaatgttgaaaaaaaatggatttataattatctactaggggttaaaaatatttaattttcttcacttacacaaatgggctaactacaaggtgtgccaaatggcgcaccatttttctagttagaggtaattaaggcaatattttttaaaccaaagaatggcatttggaccagaaaaatgtctaacgatagtacccacttttgcggctccgaaagtcggaaagcacgcaaaatcgtcgtcggcctaaaatttaaaaccgtgatcagccgaccgatctagcaaacgagtattataatatcaaaccgttgaacggtcaactagagcttcaatgattggtgctaagcttcatatttataattaaccacctctcatacatataacaaataccatagcctagctactaacgagtttgtatatacaagatcgatcatccagtagaccagtacagtgtacatttctgttcaatcggtttcactttcagcagctgccttggatacttcgtatgctagctactaattttttttacttgtattgtttgaccactcatcttatttaaaaaaattgtgcaaatataaaaaacaaaaagttatgcttaaagtgctttggataatgaagtaagtcataaataaaataaagaataatttcaaaagtttttttaataagacgaatgatcaaacagtaagaaaaagtcaaaatccattatataattatgggacggagggagtacttggaatcttggatacgatcatgaagcccacattggcctgcatccatgccaaaagctcccagtctaccggccaactaatctgaacatactgaatttcacacatgcatgggcctgcaggggcacgatcgagacctggtcaccctcgaccagcggcgcacacatgcaacaagtgacaagtctcatcgccttccaaccaatcaacctgctcccgtactattttatgcgccaagtttcttcggctccggattatactattgacctagtagtatatgtaatatgtggctccatattggacacatgtgaattgcaatataaatgctttgcaagcgctcgattattttccggttggattctcccctaattaaaccatgggcaagatatgtttattcatgtgtgtacctccactgcaaattgaaagacttgaacactcgcgatctttaaagatggtcatacttgccaattgatgatctcctaccatctaacttttttcttcgcagaactatcgatcgaaattttgaagcggattcatcattctaaagtatgcaattgattatgagattattggcactcagctgataatttttaacagatcaacgttgaagatcagattttgcagccattggacagaaattaatggatgcctcttcatgttcctcctctccattgccatctctggtgcttccacggtcgaccatttcccccagcctttcctattctaattcccttctcccatataacacataccgcctttcattttgcttagataatgtataaaattcgacctctatatatacaagtggatatacacataccatgcacagtctagctccatggcccaatcggtatatcgcttttggccttcttctaagagcaagtttaatagtatagtcaactattagctctaaaccatatagagccaatgtaaatagctaatctatacaatagttgcttactatactattaatacccgatcccacatgtcatacactcgttatgtcttggagtccgtgctacagctggctacagatctgtagcccgctgctcttctcttttcctttatctctttaaaatatatttatagctagcttatagcctgctattgtacctgctctaaacctaaagatccccttgttcccccttccacctcacgcttatcctactctagccatttcattgtagacgattagttcctccgaattgaagcaaagggaatctccatggccaaactaaggttagaaaattgattatactgaaaaaatggtaaaatttagcaatggataaaaaatggatcatcatacaaactgttgacaagttgaagatcatactactcacttttaggagttgggatcctttcaggtatcaaatctttcagtgagggcaaatgatcttatttcttttcagaatcatcatccaaactaatgttgttttccaaattgtacacttgcttttgcaagcctctattgattttgttctctccaataatttcagagaacgagctactagtcgttatacacgtcaaaacccttcggccgattgtaacaaataatagtcttaatttacatccaaaaatcgtaggagaagacctaaggaataaaaggttaattgaaccttaaactcactgtatatcaaatcatgaagaagccaagatcgaagagaaattaatctcttgcatgtgatgaagatctcagcgagggtaggaagcattcaagtgcgaggccaagcatggcgagtccctccacaccctggcgtgcatcttgagcatctccctcgccctcgccctcgtccgctcgccggaggcgccgacctgcaccaggaagagcagcctcgccaccacgccgacggccagcatctcctgcagcaccgccgacgtcgccgagtgcctcgccacggcgtgcagcgcgcgcacggcgctctcggcgcccgccgcggcgggcagccgcgtcgccgcgcacgccaccgccgcgagccccgccgggtgcgccaccagagccaggcgcccctccgcgcagccgcagatgtggtcgatcgccacggcggcgagctcgcacgcgcgccggtcgccgccgccgccgccgcagccctcgtcgaggaggaggcgcacgagcgccgacacggcgccggcgtcgaccgccttgacgcggttccggccccacgggcagagccggcagagcacgtggagcgccaccttgaccgccttcgccgacggcctgtccgccaccacccccaccacgccgtcgaccagcgcggctctcgccgacgtcagccgcgcgggggccatcgccgggagcgccgatttcagcaggtggattccctgcatccgcgagaggtagctcggtcgccgcagcacgcacgccatggtttccaagaaatcctcaccgccgctgccctccaagaccctcttgaagctctcctcggagagcttgagcgaatgcaggatgctcagggccgcctcctccggcgagctcgccttcgccggatcatgcacgccgccgcacgtcgtctcttccggcttggccgacgtcgcgtcgtccacgcccgccacggaggcgcgctccttgacgacggacaggaggaactccacggcgccggaggcgccctggacgcaccgccggttgcggtcgctctcggcaacgatgtcggcgagctccctcagcgaagccatcagctcctcccgctgacgacgccggcgcagcagcggccgcgcggcgtccacgatggcggcgacgcgggcggcgtcgacgggggggcgcggggtggggaagcgctcgacggcgtggacggcgcaccacccctgtatgaggcggcggagcgtgtggttgggcgtgggctcccggtccgccggcgccagccgctgcttggtcaccgggcactcgccgtggccgtcggtgaacacccaccgctcgatgctctcccggtcgtaggtgatccccgtcgacagcgtcaccgggtcccgcatgatctccagcgagatcgggcacacgaagtaggacagcacctccaccgccggcgccgccgccggcgacgactcctcacccatgcaagcctagtagcctagcctagctggcctaggagaagcaagaaatgcactagtggtcgatcgaaacaggaaagcttgtggagctagcttatataagggacagaagagagagacgatgacacctgaagtccacgccaagatggatagttccagcgagtaaggcgcaagtcttcgtttgtttttttttatgcgactgtatcaaccgaaaaaagccatatacatgcttgtctagtactccctccgtttaatgttacaagatattttgatttttagttaaaatcaatttatttcatatctaactatatttatagataaatatagtaatatttataatactaaattagttttatcaaataattaattgaatgcattttcataataaatttgttctggattgaaaatgttaatattttttttacaaacttaatgcactttaactttgaccaaagtcagaatgtcttgtaacctgaaacggagggagtaggcttctaaattgaaccctgagggttatgtttaaagtggagttatggaatagcttgggtcatgctccatctcttccaagttttattttgtgacagtactttagtctactccaatcattttttatacgtgaagctgaaactattcggttgagcaggagaggtgaagctagagttctaccaaatagggatgaaaacggctcgaaaacggatggaaaccatctctattgtattctttttcatatttttttagaatcgaaaatcttggatatgcaaacggaatcaaatattatcgaatacgaaaataaaacgcatcggatccaatacaaaatgaatagttatcggaatataaaaatctctcaaactgaacttctcaaatcaacggaaagatgtagctcgttatattacctaaaatagtaaatcgacatttataattttaccagtttcaataataatacaactaatagtatgctttacttttcacgagaacgagatctatattcacataatgtaattagtatggctcagcctaataaaaaaataattagaccaaagaaaaccttaaaagaaacatcttcatctaactaaacacctcaataatcataagcaatctgaacattttagagtggagaagattgaaaccacttgtatatgaagagtttccgaattcgtttttgaccgattccggtttccaatggatggtagccttaccatattcggttccgttatttatataacaattctaaatttgtttcaaaaattctccaaaaaaaaactaatcggcactttccgtttccaaaaacacatctggaaactgtaaattttttgaactgaaccattatcatccctactactctatccgttctattttaagtacaggagtactctaaatacagttgtgggtctctgtatccaatgtttgataatcctttttatttgaaaattttatgataaaattttctaaaaataaatcactcataagtaatatttatgttctatcatctaacaacaataaaaataataatcataaaagaatttcgaataagatgaacgatgaagcgttggacacacaaacccacgattacacttaaaatgggacgtagaaagcatcaaatagacctaatcccatatagtttcgaaaagtcggcgcgctgatcaatttaatatgaggatgaattgaagttagttgtttctcaaaaaattgaagttggttggtgtggaagggagctgcgtgaggcgggcggtggaattataatatgcatgggaggagagggctttgatcgaacgctaattcgctatggcgcgcacggccgatcgttgggtcggtcggtggatggatcgatcgggtcgtgtttgtcggacgggcgcgcgggggcggccaccgcgcgcgccctcatgaccacggaaacgttctgcttccagctttgacctcgcgcggggtgggggttttttcttaatcaatttttcaacggttactgtgccgttcctcgcgtctactcttctcgcgcgtcgtttctcaggtttgctcgctctcgtttggctttgaaaattcgtgatttcagctcgatcgagtgtagaattttcaagccgcaattaattttctgccgttgtttttctaccccaaatcaacgttttattactgtgaggacgtacgtatgttgtcccttccgatcgatcagcagccagcagctgatcgagcttatatactccccacttaccataatataagggattttaagtttttacttataatgtttgaccactcatcttattcaaaaattttgtgcaaatataaaaaacaaaaagttatgtttaaagtactttggataataaagtaagtaaaaaaataaataataattctattttttttaataagacgagtagtcaaacagtgcaaacaaaaactcaaaatttcttactctctccgtttcgaaatgttt

SEQ ID NO: 63086 - DNA, 708 bp, Oryza sativa
tcctgcaccccgcttgaaaagtaaataatgaaagcaaaaggaggaaaaaccagtaaactatgaaagcaaagaaagaaattgtctcattgcatgaacagtgaacaataaaagtagagaaagaaaccgtttgattgcacgactggtaacggtttcttctctcttttgtttccagggtagtaactgtttcaaggcagggattttacatcatttcagcaaaacaagttcagattccggaagaaatgttccgacattatctgttctaagatctacacaacagaaacaaagaaaaaaaaatgttcagtcacctgcaagtgcatttctttaccaagttatcgttggaagaggggttacccttgctagtctggttacgacggttactatgcaaaaccgaaaaaaaaaatcagacaaatttcatcctaagtttaaatttttatttaattttttagtaacttattaaataaacctggtatttttcattaccacgccatggcaaacaagtaaccacccatatcttaaacccaagtcacaagcgctgcccactgacacctcggccccacaggtagataataatattattagtcaacgaggctgtcctgtgtagcaggagcaataggtgccagtgggcagcgcttgtgtctagggtataagatttgggtggttacttgtttgccatggcgtggttatgaaatataccaggtatatttaata

SEQ ID NO: 63087 - DNA, 1538 bp, Oryza sativa
ctgccgccgcaccccgccgtgccgaagctgccaccgttgcccaagcgtgagctgccgccgcaccccgtcgtgccgaagatgctgccgcaccccgtcgtgccggagctgccgcactacccggccgtgccggggttcccaaagcacgggctgccaccgaagcctgagctgccgccattgcccacggcggagctgccgccggagcacgaggttcacgacccggagccggagaccaagcagccatgatcgtacatacacacacagtattttttttttagacaatggattataaaaaacctggcctctacaccttgtgaggatgtacacagcctaaaagtaacaaacacgagtacacaagactataagactctcccgttacatgggtaaaacataaataagttttaaagatggataacaagcaagaggaactaaaagctaagcttccatcattcttctaaagttccacccaaaagtagagaagatcagctccatcatacacttctctaaaagcttgcacttcgcgattacttcaatgccttcgtcttccttaagaagcaaagaccaaagccttgacaactgagttactttgaaaattacctgtaagaaaaatacgtggttgtagccattaaagactataattcatttatattgagccacaaagcccaacaaatcgctgctatacccacccaagtttgtcttttaagcttaggttcaaaacctcttaaccaattttcaaacaagtgtgaactattacggggttgcttgactccaaaagtaagatagatcgcattccaaatgtatctagccattatgcaatcaaagaagagaggttgaattgactcattagagttacaaaagctacaaagcaagctacccttccatcttcttttagcaagattatcttttgttagaatcacccccttttcaatataccaaaggaaaattttaatttttaaaggaatccttagcttccaaattaaagatttcccaggtattacaccattaagcataagggttttatacatggagttaacataaaacaacccttttttttattgctcttgcaaaagaattggtcttgcttatcattcaaattgatactcaccacctttgaaacaatttcaagccaatcttccaagtttttccctacaattgctcttctaaaagagacattcaaagggacccttcctaacacatcggccactactaagtttttatttctaaccaagctatacaaggttggaaattccaaatgaaggggttggtttcccaaccatcggtcctcccagaatcttacttgtttcccattattcactgtgaagtggccaagtgtctggaagggttcttttgctgccataaggctagcccaaaaatgagaatcccccggttgtttttggacctgaaaaatggatttccttaccaagtattttttcctcaacaaattctgccacactccctattcattaattaacttaaagatccatttactaagcatacacttattttgagtctctaagtcctggattcctagccccccacat

SEQ ID NO: 63088 - DNA, 13977 bp, Oryza sativa
  unsure (1)..(13977): unsure at all n locations
tccccccccccccccccccccaaggcccaaacccccgcccgcctcgacctcgacaagccacggccatggcgtgcgccttctccgtctcctctgccgcggcgcctctcgcctccccgaaggtgcccgtctccgcgccgtcgcagccgtccctgccgttcccccgctcccttctccgccgggaagtccctgcgcctctccgccgccgccgcctcgagatcggctagggcccgcagcttcgtcgcccgggccggaggcgaggttcggcgcgatttgatgtttgatttttttggggtggtattggtgcctctgtgagagttgggattgacgcgcggccgcgtgtgtgcgtgcgcagggggacctgccgttggtcgggaacaaggcgccggacttcgaggcggaggccatgttcgaccaggggttcatcaaggtatggcggtaatccggtaaccacatgcacagctacattgcgccacgcacgcacgcgcggcagtgttattcgacataggggattaattggcccaggaaaaaatggggcctatttgattggcagtgtaattcaccgtgagatttgataatttaacactcttttcaatgggtttcgataaattgacatcctagcccactttcattcactcatatggtcccacatgtcatcctcacaaatgtcaattaaagtaattgggcaacgaaaaaagtgtgaaattatcaaattttttttacattcatcataggggattaattggcttgggccaggccaaaagaaaaaaaaagtggtctattcgattggtagtctagattagatgttaagtccatatccacggctgtttaatgtagaagctgtatggttgatcgtgcttccaattgatatcttcgttggtcgtgtccttcactccttctgtatatgcaggtcaggtcaagctgtctgagtatattggggaaaaaatatgtggttctgttcttctaccccctggacttcacgttcgtctgtccaacagatgcgttgaccttgtcgtgctctgtcatggaaatgccttttttttcagttttttttcattcctaaagtctaaatgcatgtttgtaagctctgcagagatcactgctttcagcgacagatatgaggagtttgagaagataaatactgaagttctcggtgtttcgattgacagtgtggtatgctaacttttacccgcatgactttagatgttgttacggtgtcgttacctggtctgttgctctattgagaatttcgtatttccattccatctggacatgtagcttttctcttgacaatatttgtggtttcttgaatgccttaaggttgtgatcaatattttagctttcctctttatgtgatcaatattctatttgttcttaacgtctgaatatagagcattagatgaacccttgcattaggccataagttttaacataagattgccacgtgttgaactttcattctgtattataatgaaatgtgtggtgtttgttatgccttatggaaatattgaatggaagtaaaaaccgatgctctctaatatttagacaatagcgttataaacattcaattcagttattttgaaacaactttgagaaatgagactgatgtaacgtcttaatactctggtttgcttctgccaaggagattcattgcatactcaaataattatcacaaattatatccagtaaaagtattgattttgctactattacagtgagtagtttgtaggcagtagtggtactgtaatttattttttactatcctctctttctgcttctgcattaagcatttcattttttttatcttataggtatcattcactgttactctgtcgactataaatatttaataagtggccacaacctatgcttcataagtgtcgcatactaatttggctttgaaatatcttttgtttgcagttttcccatcttgcatggattcagacagataggaaatccggtggtcttggtgatctaaataccaactgatttccgatgtcaccaaatcaactagcatagtggcccgcgcagattgcgcggctagcatcattatatttttttctcttataatagcatatatgttttctcaatgtattattaaaatatattaaaataacaacataattttgtgtgtgttcatgagagcgaacttccaatattcctttgaattttagttatttgtaaattgtatttctatatgtactctaaattctactttaattttattagttttattctgaattttaaattcttatatggattctatactcttcttctaatattccttattttaattcctaatttatattatttgtaaattttatttctatatatggattctaaacttatctttcaatattttttaattcttaattttaattatttttaaattatatttctatatggactctatattcttcatccaatatatttttttaatttcgaattttttatttctaaattgtatttctagatggactctaacctctatatttaatttttcttattttttaattccgaattttcattagttctattgcccctaatttctattatttctaaattgtatttctatatatggattctaaacttatctttcaatattttttaattctgaattttaattatttttaaattatatttctatatggactctatattcttcatccaatatatatttttttatttcgaatttttttatttctaaattgtatttctagatggactctaacctctatatttaatttttcttattttttaattccgaatttccattagttctattgtataccgacatggactctagtcttaccttcctatattccttatttttaattccgaatttcagctattattaaaattgtatttctatatggactctgttttttctttttcttagattaatgtgagaatttctagaccatgagagcgaacgtggaggcttctttttctattcctttaataatataatagatttcaaagtcttttggtgtactaatccctgatcaggtatacttcagttatgactgcctgttggctatatatacaatatatgtctttcttctggatatttacttgtttgtattcaaagtcttttgtcatgtattccttgttcttaatctcataagagctcatactttctgctgtcaggggattgctctgagaggattattcatcattgacaaggagggtgtgattcagcattctaccattaacaaccttgctattggccgtagcgtggatgagacgcttaggacccttcaggtagaatagcaagataataaaattgcatctgcaaacatgcatttcttttcaatatacatggcatcttggcagttttttcgtcttgaatttaccatagtctagtgtctataacatcaaaaattgctcaactagttataactgtgagtgacaaagtcagataggaaaattttttgcaaatatgcaagttcgtaatttgttttcctatggtgacaggccctacagtatgtccaagaaaacccggatgaggtttgcccagctggatggaaacctggggagaagtcaatgaagcctgaccccaaggacagcaaggagtactttgcttctatttagacattttatttacattcatggtcaagttttgccatagcctttgttgggtcacacattgctcttatgatcgaaattgcagttatgtggacacattgactttctgcaaataaagttttgttgtgtttcattttggatttgttctgctcccatttaaaaaggaaaattcaaccattgaaaaataatcttatttgattctagtcaccttttttaagaaatgctagttaaggttttatgcaagaagttacttgaagctgtgtaatgtttaataaaatgttattggctcttttgtacctggaagcgtttcaatctaaatggcaagcacattgcttataaagtggaacaagaagtcctccattttgcgctcttgaggacggcccagtatgccagcctaggaaggcatgaacaccctggcccatatgtgtcttaactcttactgtaagtatcacctacttttttttcccttcccactgttattgtatcttttgcatgttgaatacatatgtctgatctatgttctaacttttcaaaataaacttttgctcatgcgcaattgcttctttttagcaggaagtcatgagaaaacaaagttaggtaaattaacaaaatggaaccccagcacagagtggacagcacagggctggaagcaatcatcttcaccggatttctgccgctccaaaccatctgaatatggtttaagagtactcctttcccctaactttatgaatgacttctttttttttcttaataataaacatgatattcctcctgttcttatctcaataagctgatcaatggcactgtggcacatatttaatctcatataaaaagaataaatcaagataatagtagcactagtactgcatatcctaagccacgcttataattacactggcagaaccacaagcactttttcttcaccttggaggcccctggagtggtagtgtagtgctcctgccgcagcttctgtgctgcacccattaccagtgcgccagggatattaaaattgggaagcttttctgcagataatgccactcatgcactttttagcatcccctcttgctccactttaaaaagctgcttgcagcaacacaatgcttagggttagtttaattcctgggcataccacaactcctttgccatgtacagatctaatacagcagcctaactgccttatgtaactagagaaagaaaaagaaaaggaaagaaaggatcaaaagaagagtatgcagtgattacggtttcttttctgctttcctctttgtgttttcttttgcggtattttgctcctctctgttccggggtcgatcctcaaactgtgtatatactttcctccttgaagcgctccttttggggcaatggctttgtgatgattagggcttggccttttcctccccttttgggccatatgtgaccaaagctttatttgactgaccacttaccactgcctcggattagtttgaacagaccatgctttgcatatgtagcgtgtaacacattgataccagaatcctataaagaaggtgaaagtttatctgtgcagaaactatataagagtttcgaagtagtcagtaatcactactagtcgctatatattggttttgtgaaaactcaacgacatcaatgcgaggcccagttctgattgttgtgaagaggcacatacaccattgcacttcactagctcgtacaagatgattgagaaatgaatggggatctgttgggaaggcttgagggggaagtcatttttgatactttgtttttgctggctgtttaatcgaccccttttccctgttcgtatccccataaagaactatgttcttgcacgacttttgatgcaaatgcacgcagtaatgaccggtcaatgatgctgtaaacgtgcttttaactacatactttggcttttgcctgacagttaattctgcttgtagtaacactgcagtacaacagaatatttgagcggcgcttatatatgtcaataatcatgcaattaataatgatgcaaatatattcatgttgatcttgatcagtgctatctttgccatatattagtagtaaacatttgttctgttcactcgtagattcggcacattggcactgaaccttcagcagttgcctaaacttaattagtgaatgtttcaatttttgtgtctagtaatgtagtctgctttttagggaacaagaatgctgaaaagccccggctttgctgaacagcatgtggctgttttatgcattactgctcctagtaattgtgagcgattctaatctttccatgcatacacacatacagtctacagagagcatatgggcaataaggggacgctttattccatatactttgagtctagagagaaagaggccgtacacagttcccgattcttttagggcacaaagatctctctctctcagaaaagaaaaccaatttaaatgggccctcttaaaagatgagaggtcactgcaggccacatcagatcgtatcgatcacataaagcatcatatgttgtatcgtcatcattgcaacatcagccccatttccctgttagtaatgtgatcaatcgtatcagtatacgacgagcagtgaacaggtataaaagtatgtatgtacttccttcatgatgaatatattgattgccctctcttaaaacaaaggctatgcggacgtactatacctgtgctacattatatgcatcttttcaatttgatgtattttcagctagtggctgtttagttagatgcatgggtcctagacagacgtgcttctatatatgtacatgtgtgatagaacaaaactgtacatatgtactcaattcattatgttgcttggggtaaatttagttctcatctagatacctacgccaataattcggtttaccaacaattatcccataccattgtttctttcattctcatcattttctcatgaatttcttgtgcatgtatccttatcattttatcatgaataccacttgtcacatatgtccaatcggggaataatgaagttgtggtatgaagtataaatttagatattatactgatgggtaagggaagagaatacactgagataggtaacctgtcccacctgaacaatgtatgagaaaaggagaaataacctgcaaaagataagtggcaaaagctgttacttgtagttttgctatggatcgttcctttcgttttgttttatttttgcactaataggtttggtgggagatgtattggtgtttacatatggtgacatgcatggagccatggagaggtagggaaggcataaattctatcaggtaagagttgcagcaaaggtttgtctcttattactaaatatagtatcccaaagtatatatggattcttcaatttgccattttactatctagttgcataaagattagaaaggaagattccacaactatatattatagtgacaactcaccaaacatggttgtgagttaattgtgctgcatgtcatgatatttttccctgagaaaatggagaccctctgaaataatgaaaaaaatttcaggggttatgacattatgtttaccttatattcacactttactgcgcttactttgttacatggaacaattattcttgaaaaatatcattactaaggcaccttgtctgctccaatgaccaatgcacacttgtcatttcaccaaatccttctagatcaggttctaaattttatggtcgcccggctttgcgcactttgatgcaggaacgcatagaatttagctcaggtcattctttagaggcagctgatcatatacagaagactagtcacaaagatactgtgcacaatccatatgatctcctagctagctaccctctgcatgagaatgtgagaacgccttgcttgaaacttgagacttgagagagatagaggggaaagctggggggcctttgtatctgctttgtcagcacatgcattctacctagccaactttttctttcccaccacaaaatccactttggaccctaaaaattatagcccaaagagaaagaaaaaacaactatgcagccctccctaacaagaaaagcacaaatccacacaccataatctcctccttccttcaacctctgtaccttctcaccccccctctagctactcaaaagatgaacattcaccaacatataaagcagcactgcatcctcccaccacttgcaggttgcagctgaagcagcagtgacctccgtcccccttctatatctgcacatctcattccttctcctttttcttctcctcacacactaccgttgccacatcaaatcgatagattactagattagctaggttcttgtagtatacgtagctagctaggtggtgtggtgtacgtgtgagagatgagggccggggggtgcacggtgcagcaggcgctgacggcggaggcggccgccgtggtgaagcaggcggtgacccttgcgcggcggaggggcaacgcgcaggtgacgccgctgcacgtggcgagcgcgatgctggcgccgccgggggggctcctccgcgcggcgtgcctccggtcgcactcccacccgctgcagtgcaaggccctggagctctgcttcaacgtggcgctcaaccgcctcccggcctccgccgccgtcgcctcgtcgccgctgctcggcggccacgggcacggccaccacggccactactacccgccgtcgctctccaacgcgctcgtcgcggcgttcaagcgggcgcaggcgcaccagcggcgcgggtccgtggagacccagcagcagccggtgctcgccgtgaagatcgagctggagcagctcgtcgtctccatcctcgacgaccccagcgtcagccgcgtcatgcgggaggccggcttctccagcacccaggtcaaggccaacgtggagcaggcgtgcagcaccaccacggccaccagcgcgccaccgaaccaaaaccctaaccctagctgcaccggcgccgcagccaccgccaccgccaccaccagcccggctcatcctccggagatcaaagccaaactgccactgctcgacatgctggcgcgcgacgaggacatcgccgcggtgctcgactgccttgccccggcagcggctggcggccggggcggcggcggcagcaggaggagggtcgtcgtcgtcgccgagagcacggccgccgcggaggccacggcgcgcgccgccgtggacagggtcaggagaggggaggcgaagcagcacgacgcgctgcgtggcgcgcaggtggtcagcctccgcgtgtcgtcgttccgcgacatgccgagggaggaggcggagcggcggctcgccgagctccggtgcctcgtgaagagccgcggcgcgcgggtgctcctcgtcgtcgaggacctcaagtgggcggccgacttctgggccgccgcgcacgccggcgccaggagggtcggcagcggcggcggcggcggctactactgctctgtcgagcacgtcgtcaccgaggtgcgcgccctggcgtcgtgcgacggcggcatctggctcgtcgggttcgggacgtaccagacgtacatgaagtgcagggcggggcatccgtcgctggagagcatgtgggggctccagacgctcgccgtccccgccggcagcctcgcgctgagcctcacctgcgccttcgacgacaggtaaaaaatcatccgatcgatctaaaaaaagtttgttaagttctcgcggcgcagcgtgtcacgtcaggtgaacgaatcatgcacccgcgccggccttgcagaaacgaaatgcctctggtctctgtgatctgaccccttcgttactgagcaatcagtaagcatcagtagttcagtaccatgcgggtgaaagcttttgcatcttttgcgtgctttctgggcaaaagctttaggtcaatctatagctcctcatcagcttcacattctctttttctaatatcgcattatttgaacattcacgagagcatgatatatcgacaatacaatttcagaggtacagcggctgacaaagatgatcagtttagctgatcttgtggagacatgtcgatcggtgaggtgacagtgtgtgcaggaatctaatttccgttttgttattctttctgcagcgcgctgggcgcagtcaatcagtccatgaaagcgagccctcacaccaccgatgggaaccgcccggcgccgtcttgcgggccgcttttgggcggcagccacctcctctccagatgctgcggcggcgactgctccgccgcgacgacgacgcacgagcacgacaccaaggcgtcgttgccccgctccttcgtgtcgtcgtcgagcctcccttcttggctccagcattgccgcgaccagcagctgcaggtgccactcgatcgaatgctaatctttttatcttaattaatcggtcaatcattgctgattttttttttgtcttctcgtgataggagtcgacacatttcgcggatcttggcaagacatggggatccatctgcggcaagccgtctcagcggatgacgctgcatttctcggcgccggtgtcgccggcgtcctccatctcctcctacgagcacggccacggccaccagcagcagcagcaccagcctcaccactcgtggcttctcgccgacctcgacgccaagcacccatggaagcccaagcgcgaggacgacgacgacgagaaggccaagtcgcacgacgactgctccggcgcctccaatggctcggtggaggtggagtgccgttccaggttcaaggagctcaacgccgagaacctgaagctcctgtgcgccgcgctggagaaggaggtgccgtggcagaaggagatcgtcccggaggtggcgagcgccgtcctccagtgcaggtccgggatcgccaagcggcgggacaggtcgaggtcgacggaggcgaaggaggagacgtggctcttcttcctcggaggcgacgggcacggcaaggagagggtggcgagggagctcgccggcctcgtcttcgggtcacgcaagagcttcctctccgtcaagctcggcgcctcctcctcctcgccgtccgcgtcgggctccaccgaggatcaccaccggagcaagcggccgcggacgacgacgacgtcgtcggcgagcgaggcctacctcgagcggctctacgacgccgtctcggagaacccgcaccgcgtcatcctcatcgaggacgtcgagcagggcgaccatcgctggcaggtgggcgtcaaggaggccatcgacagaggggttctccggagccaggccggcgacgaggtcggcgtgggcgacgccatcatcatcctgagctgcgagagcttcgaggcgaggtctagagctggctcgccgctgatgaacaagaagatgaaggtggagaaagaggaagccaacacaagtgatcatgatcacaaattagaaatcgaatcaggcgccccctcttcttgcttcgatttgaaccttgacatggagagcgatcaagcagcagatgagctcagctccggtgatgtctgtctgctcacggcggtcgaccgggtgctgctcttcagaaggcaggatgaaatgtaacactagtgtacatgaaggatccatgtttatcagctagggtagctagctcattgctcgtctaattagattttcctttcatttgttttgatggttttttttgtttctagtattaactttggctttagaggatcatggcattggtgcggttggacaatggcatattatgagcttcgttaagatggagctctgttatatatttgtggtggtggtgatcaaatatattttcatctacacagcggtttggataatgggtataactatattttgaacatgtgtgctgaattcactgtttgaggcgacaaaggttctgagaagcatatccaactgaaaaggcttgtgaatattcaactagtgagaattaatatgaagacgctagaagttatatatcgaacttggagctttcatattttggattttgcagctgctgagttgggaaactattttcatcccccgaggggatatcccctcgttgtttgcatatcacccaaatagttatgaaaaaaatcgaaaaaatttgagaagatgtattaaatgtgatatatcactctacaaacatacaagtttaaattcaactattacaccccgcaacgaaaaaaacaaatttgactgtgaatatatgttaactagttgtagtttaatttgtttttttcgttacgagatgtagaagttgaacttgaacttacatatttgtggagtgatatatcacatgttaagagattttgcaaaagagggaagaagnagttcagaannagnngggngacangcanncnnngaggggatatcccctcgagggatgaaaatccactcccctgctgagtttcacaatcaagtgtgaatttgaactcttcggggccattggagattttgaagtagctacagctactaaaagcacctcaagcggtggctagctagggtactgatgatttcctgtgaattaatacatcagattgtttacatgtgaaccttttttcataatagaaaaataatttggacccaacatttcatatcgtccaatcatctccacaggtttgtgctacccaataggatcgttgggcccacatgtattgtcacaaaggcatgccatttctgcaaacttttttaacctacttggagtataacatactccctccgtcctaaaaaaagacaaaccctggtttccgtgtccaacgtttgaccgtccgtcttatttgaaaaaattataaaaaaattaaaaagacaagtcacgcgtaaaatattaaccatgttttatcatctaaccacaatgaaaatacgaattataaaaaaatttcatataagacggacagtcaaagttggacacggaaacccagggcttgccttttatttggatggagggagtagaagctagaggaaaaacacaaacacgcaaaaaagggttttgtgatcgatcattatacttgccaattgggagttttttttttaacgaactgaagagggaagaactgcatgtcttccaacacaaagtgatattgtgtctaaactacatcacttaacggtgtctataccaagccatgtcacatagacattactctcaaaactacttccccaatatattatttatggaaataggtatataacattctattttttttggaagaaaacttttaaatataactaattagtttcgttgtaacttgattgtatctacaatgtaatttatttttaaattacgtacgtaaatatgtcagaaaaactgtgctagcgcagcagcaaacctacagattgtgggttccaacctctcccccgcgctcataagcaatttttttcccagccagcacaaatctcacggtccaaaaatcacaaattcctaccatggttccttttgcgatatagaaataatatagaagaacaatgtgccgtttcaatgaaatagtttatgtattctaacatcattatgttattagcatagtaccttacgggtattgcgtctagtatccttccagtatcaaatctagtatataagataatgtattaacgtcggcgtggtatctatatatgtacgaaaccctttttttatgagtatcgtatctgagatatccttagtattagatctgatacctaaggcactacgcttatgtcagcataacttcatcacataaagtgttccattggaccacacaccatcatctagtgatccgcttagcgataacatgcaagctccaccactgttctcactaaaagcaagattaattataaagggcaactccccgttaattttagtatatccgaccaatttcctccgctattgttcccatgtgatctagatttcggtctagaacttatttgacggaactattttttttgaaaaacaactacccagtttctttttaaaatatactttctccatttcacaacgtaagactttctagcattgcccacattcatatagattttgatgaatctagatatatatgtgtgtctagatttattaacatttatatgtgtgtggacaatgctagaaaatcttacattattatattatggaacggagggagtaatatgtaatatttgaaatgaagtagctaccgatgatggtatccagtccagatttgacatggaccatccttgatgttgatcaactaataattataataaggaaaaagtccaaatactctcctaaatttagatagaaatccatctagcaccttaaactttaaaaccggacatctaatcccctgaactttgccataccatctatattaccccctaattaaggtggtttcagatgatggttttgcatattttgaaagcttaaatgaacaattccgaataactaatataacatatttgcatatcatcagttataaatcatcaatttattcctatacaatgatatcatactattactatgttggtacttatttgtaagtgagag

SEQ ID NO: 63089 - DNA, 530 bp, Oryza sativa
aatgccaatatcacttttcatggttggatatctagaatgactaatgttcaacagtagattgtgtatgtcaaactgttacatgcttaagccttttgtattcaactcatgaatatatgtggcttgctccatatgtgataactgatattactcctagtagctccaaaagaattaactaacatttgttggaaactatactatagttactttcatgtctgaaaagcttggttgatgatctgggaatatagaagttggttgtttatggtctgtttaagggttgggttatggggcgctgatagcctgatactgcttttgatgttgcctccctgtgtagagaacgggtcctgaactggttagctggaatccccatcctttttttacctgttttcagtagctagttgtccctgttgtttagttttcgtttcttttgtataagaccttgttatgttttggctttcttcaaagggccaggtaatgaaatttgcctattgtctaaaaaaaagcttggtagacattactaattatacttattc

SEQ ID NO: 63090 - DNA, 7043 bp, Oryza sativa
aaaggaaaaaggagggaaaagaaaagataaaagggaaaaaggattttcccagggatttaatattgcactttgcttattttaattggttaaaattatttatagagctctgaaaattccactaaaaatcttgttagcatatttcgacatgtagaactcaagaaaaaattccacatgccaaatccgattattatttgcattaatttattaaggtttactcttgctttacactggtattttcttgagaccatttataacttcaatttaggcttgggaaataacttcagggtgtgacaaaggattatcaataaataccaaaggaagcatgataagcagtaggaaagatatcacgaagaagatgatggtggttttgatcctcattgggatcatgagtttttaggttctgttggaacgaagggatgagactaccgtcgattgaggattgccctggatgcagtgacaatgcagggagttcaagccgatcttgcactaaaggaaatcggctgagtcagaagaggttgtctgttcatcagaggttgggctcacttaatcaggatcgtcatcaagatgaaaacgaggacagaaaaacacaatggtgtccttcttgtattttttataaagaatcagaagagaagggttcaaaggatttcaggaggtccagcagtcgatcaaccatcggctgaaaaagaccaagcaagaatggcgcgttaagagtaaggttacaacaaccgatgaggtggaagctgacaaggcgaagaagctggctaaaggaaagagtgttgcatctacatcggtaaacatggtgtttatattgttgttgctgtaaaaacacgaggcctgggagacctgcttaactccagtgcaggtccaaaactcgccttcggatatgctagcgtgccagttgatttgatcctgccatcaaaaagaaacaaagacaaagaaaccggggttaaatccataaacgatagccgatcggttgggtgccgatggcatatcattaatcttggagccgatgtcatatatgcatcgatcggcagtcattaataagcgagaaagaactaaatctactcgatcgtctgtagacattaacaatatgtagtctttatgtcaatgtatacttaaatcaagtgattgagatagatcggtcgccaagacgagacagtataaatcacttaggtcgaagtatatattaacaacgagactatatgtgttcatatcataaccatagtgaaaaaaacggaacttaacaacgagactatatgtgttcatatcataaccatagtgaaaaaaatggaaccggaaaaaaccaaaaccagaggtctccacggttcggttgagctgaaagaccggacatgcattcaatccggattgaactgggcgggttttgaataaaccgggcattaaaccgccctggtcagaccgggccaaggggataatgggctacatgaaggccagtccaggcccacgcgactgtttatgtacaaaaaacagagaaatgagtggcgtgtggagactcgaacctgggtctttgcactggaagctcttagctctagccatcctaccgatttttcacttgttaaacagaagaaatacatactgcatatattagttattgaaccgcggttcaaccggcggttctccggtcagaccgtcagaccggtgaaccgaggggtcgtccgagtccctcaccggttcggttttttccactatgatcatagccgatcaaatagatctagcatgtatcggctaatactccgataccactctatattaagatatcaaaacaagtaaaatatactaaaccaaagcctaatatacttaaaagcaacaagttcttaatataaaggacagatttaacatatcaatcaagtatatagaatagatgtagttaaaccaggtaagatcagctgaaactccgatgctaccctaatcggcaaccagaaacaggctagagactgagattctaaacacgacttaatagatcaaactcaactgatgcaacactaagtatgaaaagaagaacaatatctagacaatcaatccgctggatgtttcatagagtggtagatatcttatataatctaagccaacgttgttatttaatctaatcagctgccttctactagcagatgttagccgattgtaggttagataacgatattatcgaagattatgtaagatatatgataactcgacgaattacataaacaagattagagtatcataaagatggaagcactaatcccgagaacgcaagcagccataacaagttttacctcttgttgaagatcgaaaccgatgcagctcaacccgagagtaagaactcgtcgaaacaaaacgaaagtaaaaagggtggcgatgcgccgagattgtattgaacgtgtgttaattcgattacatggggttcgggtctatttatacccgagaattacaagatatgtccatatcggacgcgactcttgtctctaacaaactctaagatattataagtctttgcggcagacttttacccaaacatatctctaaggaaattacataaaacatcctaattaatagatataattgacttctcaggactcaatccgtgtgcggcaatcaccatgaagtacatcaatctaaaccgacaacatatgctgtgtcacattgtcggattctgctctatcggctaaccccgtccgactcaaactctgccgatcttatttgtagccgattcagactccagtcgatcctcactctgtttcctagacgatttccgtctcgaattctatcttggtttcttcttcaccttcgatccttggattaccaaatttggttgttaacaattgcctacagaatttgaagctaggcaagccgatgttgatgatgtagaggaggcctctgctaggttgattttgtcaccagaacaagcattttttgagaagccagaggggacagaaaatcggcatctcaaaccattgttttgtcaatgggaagccgatgtctaaaatgatggttgatggtggggctgcagtaaatttgatgccatatgctaccattcaggaagctaggtaggaatgcagatgatctcatcaagacaaacatggttctcaaaaattttggtggcaatccatcggataccaagggagttttgaatgtggaactgacagtcggcagtaaaactgttcctacaacgttttttatcatcgatgggaagggttcttatagcttgttgctcggaagggattggattcatgcagattgagccgactatgcaccagtgcttggttcaatggcaaggtgacaagattgagattgtgccagccaacaggtcagttaatgttgctagtgccgatttagctctttgggagatggatggtattgattgcctgtctggaaaagtttgggatcaagattttctaaaagtgtccgattgtgatatacaaccaatggaagacggagaccccaaattattactttgagggtgttgtgaagggttcaaatttctacaccaagggcacggtggatgatctcgatggcaagttgggacatggtttcatgtcggccgatgatttggaagaagttgatatagatctaggagataggccaaggccgacattcatcagcaaaaaattatcggcaaaactattttaaactgatttttctcctaaattacttatccaaatcatgatccgattgcaccattaaattcgttgcaattaaatcttcaaaataagaccacacatggatatattacaacgaaaaaaatttagcttattattgaattatttttaaatgttgcacgatgttacaccaggtatatcagaattgtttcactaagtagatcgaaaaatgtttcagttttgaaaaaaaaataaaacgaattcccttaataggggtttctgaaatatgtgagttttttttacaatggaatatttcaattcactgcaacattagatctatatatagtgaaacattgtgagtacactaggtgaaacatttttgataaaaaaaataaaccaaatttttttaacagggggtttttaaaatatataggttttttttaatggagttgtgtgtgtaaataagtggcaggtgagaacaagagatatatggtgagggccagagggactgacacgcacgtgaagagaggaggggaggggagcgatccggaaccggatcggtcgaccaatcttgagcaattcgggtctttctattctatcactaacaggcagcaacagtagcagttcgtcgtcaccttgattttgaatctgcccgcaggccgcagtcctgctcccgccgccgtctcggcacggcggcacctacccggcgtcccgacatcccgctcccgtccccgcccgagtcccgacggccgacgctgccagcagccagcgcagcagcacccagccggcagccgcccaggccggccagcggccagcgccactccatctccggctcgggctcggctcttcgcctctccggactgcggtgagcaattccacagtccactcactgtctcactccctctcggcctctctcccttctagaatctagagactagagttctagtagtagaccaataggcagcactagttgttaacagtgaaatttggtaagccctaaagtcatcatcggctgaagatcagtatcggcttcggagttctagaatcagccgatgagagttatcaagtgtcagttgtcggattctttctatatttggttaaggaaattgatctagtaaaggaagcttatccagaagagactgagttcaaggaggatgtggcatgacaagttatctattaattaggaatagtttgttagtttccttttatctttaggaaagtgtgtccgataaggactttattttttccttttatctttagtttctttcctgtccgacaaggacttgtatcaacccatgggtataaatatgtacacccggggtctatgtaatctatcaatctcgatcaatacaactactctcggtgcatcgccaccctctttaccgaggtttttacttatcttccggcggaatttgggcacctgacgcggggcagcatcggttcagttcgatctccggcgaaggggtaagtcctacgttccgtcgggccctgatgaatttgtcatctacatcggcgtcgttcaaggctgcatcagtatattcgacctctttatcgtatgtctctgttaatctagtcttagcatatcaatttagctctatcggctacttctcgctttagggtttctgccggtatcggctaaatcgtgttgctagattggattagcttaggcatctaccaccctgaaaatcagtcaagggctttgatgtctagatattgtgtttcttttcatactagtgctgcatcacttaagtttgatctactaagttgtgcttagaaccataatctctagcctgcttgttgactgccaataagggtttcatcggggtttcagccgatgaattatctggacgttacatcagctcataaggattgtatatataagttggatttagccgatgacaacaaaggtttcactgtttaatctaatcttgtggattttatgacatcggacctccagccgatgtatgctttaaccttcggatcagtgcttattctatcatatcattgctagccgattggtttctactagattatattgttattttattacatcatcatcagccgattgcctttatatcattatctacattggacatatagccgatagctcaaaaccctatcagcatcggctattatcggcatcggctgagattactccatcggcttgtcagcagatcggctatttgatctacggtttacatatcttgtcagttgcaggatcaaactgactagcacgcccgcatctcatcaaactttggacctgcactggagctaagcagatctcccaggccagtgtgtgttttttgcatcaacactagtgtactacccctttatataacaattttgcattgtttgatggttgttaggaggttgaggcatggagaagtcaagcattgcgttgctttttcagaagcatgaagcaaaaaaaaatgcttgtgatctaccaatcccacatgtggatgaagggtcgtctattcctgctgtaaatgatgctccaattgatgaagacatagttgttgatgaaggggtatgtgaagaaactgaagaagatactgttgtagatgacgctccacctccagatgttgttgttgatgaggtttcaattgaaactaaagaagaatctctgccgatttatgatgttgatgatcttgaacatgatccaggcttaagggttcctatttcaagttttgatgccaacgatcaagatgcggctagaagagggtacattctaaaaggtccatgccatctttgggccttcaattttccatccagaaaaatatatggtaaagatcgccgctttagtgttatttggtttcataagtacccttggattgaatatagtgttgacaaggatgcaacattttgcttcgtttgttatttgtttggcaaagaaagtggaaaatttgttacgggtggttggcataattggaatgtaggagctaaagcccttgataaacatgttggaggaacatctagtgatcacaattttgctcaagagaaatacaacttatttgtgaaaaaagggtacacaaattgatactgttattgtgaaggtgtcagaacaggatcaagttaattacaaggctagattgacttattcacttagatgtttgaggtatcttttgcgtcaaggattggcctttcgtggacatgatgaaactgaagaatctaacaacagaggaaacttccttgaacttttgaagtggcttgcaggaaataatgaaaatgctaataaggtggttctgaataatgctccaggtaattgcattttgacttcccctcgcatacaaaagcaagttattagatgttgctctatggaaaccactagttgcatacttaaagaacttggagatgagcactatgcaattctagctgatgaatctagtgatatatcacataaagaacagttggttgtttgcttacgttatgttgataaacttggagggg

SEQ ID NO: 63091 - DNA, 659 bp, Oryza sativa
ccgccgaaagttaacggtttgcccaggctcacaactgaaagactttctacggtgtgcgcgtgcgatgcgcgtagaagactgatttatcaacctgtctttatatcaggattcattacctgactatttgtgggtaaagttcgtagtgcgctgatcgtgcaaaatgattttagttgggaacagttcgcaactctgtcccataaaaatcagcatattcccatctatcccatatccagcgcattgaccatcgggatactgaagggagattccatcatctcttagaaagatcaccatctcttttgtttcaatttgcatatagctacctggaggatttatgaatacaaggattttcatggactattaccatgagattgattttccatctttattcgcgagagcagtggaaagcgatgacgatgtgggtactacattgcgcattcacctactttgtgagcgcatggtcgaagcatggatatgcgcatgctgtgactgccaagatctctttggaagagataaaaacaaacttttaatcgaatgtaatactaaaatatccatggcgggaaacctgggaatccccccggaacttatgaaatcacttaaaaccatcaactcaatgcgtaatgaccctgcacacaatccatcaatacaaagcatttgttgtt

SEQ ID NO: 63092 - DNA, 18412 bp, Oryza sativa
ccgctcccttcctctgtccccaccgccaccgccgccactccccaccgccgctccggccggggtgaagagaaacgctgggggagagagggaaggagggaggaggaagaagggaagccgggaaggagctagagggaggatgacatgtgggtctcacatatcaatggatcccacaatataattttttgtgtgagtgacatgtaggtcctaccttttttttatttttattctaatgccacataagcgccacgtagaacaaagacttggtcaataccgccacgtaggcgccacgtcagctaaaatcaccgagggatataatttgcaccggttttgatagttggaggagtcaatttacctggttttgtggttaaaggatatgaatcatactcggagctatagttgagggagtcaaagtatatttttccatcccaattgtcccacccacctgatactaccatcacgcgacgcgacgccccacggccggcggcggcgcgaatcgcctaccgcccgctgcacaggggcactagacacacatgggctgatgggcacatgacttagcccagcattctcgcttacatatcttatgttgttttttttattaagacgtggattttaccaaggattttattagtatgttttctaaaccgctaaacaatatgtttttcaaaaaattatataaaaataattttaaaatatcaaataaatttatttttaagtttgtaacaattaaaacttaattaatcatgtgactttttcattttacgtatgctaacttaatctatatccaactctattttaattatatgttaatggcttttttattttaggtagactatcttaatcttcgtccaactctattttttaatttttaagtttgtaataatactgcccaacacggccaggatgaagcgtcgatctgaatttctttttcaattttgagggcactctccttctagagacactcccttatgaacggagcatcgaatttgggattgtggcaaatggcaatgcaccgttgctgtgcacaggtgccggccgggcgcgcttacacggctacacctaacacgcctacactcttttttctcatcagtcatcagaatacttacacgtttacatttgtgcttttgacaatcctagtaggttataattagtactaagtgcttagccgatgaacgaaatgatgaccaacaccaccgacacaccaccaaaactcttgtatggatgtttttctgttgtttgcatatcatttaaatagttacaaataaattaataaaaactagaagatatattaatatgtgatatatcacttcataaacacgtaacttaacatttaatttctacttgtaagtttaatttattttttgttgtcatatacagaagttaaattttaagttgtatgtttgtagagtgatatatcacatgttaatatattttttaaaagctttttataactatttgagtagtatgcaagtaaggagtggaagtaaggagtggacgttcaaaactagtactcgctaaactagtcgagatctctttttctctaccgctgcgcaacaacatttgattgaaccatcttacgatgctttttctcaggctcatgcagccatgcttggatgcttgcgttgttgagacttgagagcacggcacgtatgcgaacttgatcaggtaggtcgtcacaaacgcggcgcgcgtcgacgagaggccgagacaaccacccacccactagcgcgcgcaccgagcgagctatctctccgctcggtctcggtcgatcgccgcgcgcgcgcgtggccgagcttgcacggcgccattggccgacgcgagccggtgaggcgatagtgctcgctccaccactctccccgaccatcatgggggtgtcacctcacctgctacgcctgtatatatataaagcaccagcagccatgaagcccatcaacgaaaaactacgtgacagcgtgacacagggggtagttaattactagttattcgcagtgcgtgcgtgtgtgtgtgtgagcgatcgattgatcgagatcgacatggcggtgatcaggggtgtcgtggtggtggtgctcgcgctggtggtggtggcggcggcggcggcggacggtgcaggggagtgcggggcgacgccgccggacaagatggcgctgaagctggcgccgtgcgcgtcggcggccaaggaccccaagtcgacgccgtcgagcgggtgctgcacggcggtgcacaccatcgggaagcagagccccaagtgcctctgcgccgtcatgctgtccagcacgaccaggaacgccgggatcaagcccgaggtcgccatcaccatccccaagcgctgcaacatcgccgaccgccccgtcggctacaagtgcggaggtaagctgagatcgggagcagcaaagaaaacggtgttagtcattaacgcatggtaattaagtattaattaaaaaaacttaaaaaatagtaacagtttttataaaaaatcacatcatttaataatttgaaaaggaggaatagagttgaaaaaaaaaagggaagaagacagcctaatcaacatgtcaaactgtcaactcttgccacgaacaatctatgattatttcatcattttcagttggttggcgctaacaatctaacatgatcgattccttctcaattctctttcacagattacactctgccatgagcaacaaagagtactgcatgcagtgccggtgccgtgtctgtcatccgcttaatttatcgagtttatgtcgtgttacttactaaagctgtatgctgttgtgcgttcgtgcagtttagtgtcagtgtcaaacaccaaataaaagggttccatcttccgtgggacttcgtgatttcagtccgtagagttgtttctccaagtccaggatagtgtgtacttgatcatattatctcggagggatgcagagacgctcccctgaattctctgaataatagtacaacttggtttgttcatcgattcacacttttagttcaaaaaacttgctatacatttttacatcttgtatgctcgcttatgccttatgcccgcagaggagaaacagaggaaacatgcaactagtaacagtgaagaaattcagaggttgtgtgctctgcttaaacgaaaccaaatcctctcacattagtgtacagcgcgcacatggtcactgatatatgagactcatcatttatggacccatatatcagccaccatgcctctctgatttaacgtcagaagatctctccatagacccacatgtaagaggcgcactctcacatgtaagaggcgcacttctctctctgactatattagaggagcatcatcgacggttgtgcatgctgctcgcctgcaggctgatactagtgcttgcaagcttagcaaggggcgcagccacggtactagcctactaggtacgttcacacgtgtgatccttgttatgagccaacgatcgctccaattgacaacgtcggatgtgcgccacatgcacaatgagccaatgattttacccgaatcacaatattgaacatacacaacatcggatgtgcgttagacgcatccatgtgagccaacgattttcactctattagagcacgagaaattgagtgtttcttatcaaaaatcgtttttttttcaaaggtttttatcggagccgagagtgcctacctccgagccgagagtgcccgccctttctgtcaagtaggctactttttccggaacgcacacttttttttaggtttcataaaagcatatttaggtccacacgtgaaagaacctcatgaatatcgaagactgctactgagttgacaccattccaagaattgaattcattccgcaaaccaggacctatatcattaccaactccagacagtcttgcagaaactattaggggatttcaactaatcctcacaatatcggttgtgccccacgcgcccatatgatatcgatataggagatcgttttaaatctaatcggagccacaacttaataagattgactagtcttttaggtaagttatattctactttctccgtttttaatagatgacaccgttaaattttgaacatgaccactcgttttattcaaaaatttatacaaatatataagatatatatcatacttaaaatactttgagtgataaaacaactcacaacaaaataaagtataattacgtaatttttttaataagatgaacgatcaaacgtgtgataaaaaattaacaatgttatctattaaaaaaacagatataatatttttaagttgtgctctccataataagacatcttttgcttgatgtattacaatgacgatgttgctacacgtggacactggtgcaccatcttctagtagatgtatcgttcatcgcagagggcacaaatttctctatcacatataggaggtgcagagcaaaatgatggatccaccaggccccgcgtttgctgcttccgctgaaaaacaccgtgaaaacaaactaaaatggggcgcattgttcacaaaatttcgctgctttggcttcaaacgaaatatagggcgatactcctacaaaatcgcaaacttgttgtgtggtgtacgtataccactcttagaccttgttcggtttagagaggtttaaagaggattggagggggaataatttcaaatcccctcaaattctttcctcatagggattaaccgaataggccttatgattattcttttccccaattccggaggccattttgtactaacattgctaactaatatctccgtaccttatatgtggttaaattatgagaacgttcgactcgcatgcaacaaagtatcatgtgcattagccatttggcctgcaggtcatcacataaggcatacttgttagggtgcacagtacacacgctactaattaagcgaaggtgtgtcacaccctcacacgttccttgtgttaaacatagcacacgccacgacctgccacacttattttgtgcacataaatggcttgtcctaattttaagtcaaattaatgttgtgtttactgttaaactctcgagtattagggactgaactaaaaaacgtgtgattagacgaattgtgaaagctaaaacacaaaatataataaagtttgatttttgaagttcacaaatcctagtgacaaaaaaatagacagtagataatatgtgggaggataaatgacacaatcactaacaagtcggataggagtgctatgactttagagaatatggagactagagtagggagcccctaaatttagggatcttagataggagtttcttgaaacagtgttttagtaactttacatagtgggatagcgagacaattcgtgtaaccattctatccactaaaccaaacatgttataatcgtaagcacatctgacactatgcagagagtatcatctattgtcaggttgagtttgcagaatgacttctgagataatatatttacacatcgttttaagaatcatctctatacatgtatcgtcctgatatttctgcacgtacgtagtgctactttgctagcctattccattaattgaccgggattgccaagtgtccccggtatccatatatgttcatctcgtttttgtgtcataaccgtcataacgtttccgctcctgatcgatcggcttcacgcacgcccagcactatataaccagctcccaagcgagccgggagtagtagccaacgagcttatagaacacaagtacaagaagctatcagaaatcagaaacgctagctagcagtaggaacaaacaatgaggtcgtccccgatcatcttcctgctcctggccgccgccgccgccatcgccgctccgtggcaggttgcgcacgccgcgggcaagtgcggcaagacgccggcggagaaggtggcgctgaagctggcgccgtgcgcgaaggcggcgcaggaccccggggcccggccgccggccgcgtgctgcgcggccgtgcgcgacatcggcacgcaccagagccacgcgtgcctgtgcgccgtgctgctgtccagcaccgtgaggcgctccggcgtcaagccggaggtggccatcaccatccccaagcgctgcaaactcgccaaccgccccgtcggctacaagtgcggcggtacgtacgtattgcgtgcgaagagctttggttagcttcatattataccgtttcatattacaagtcagactttttaaaagtttgattaaatttatagaaagattacaattatatcattaaattagttttattaaatctaatattgaatatgttttgataatttattcattttatattaaaaatattactatattttttataaactcgatcgaagctaaataaatttgatttttaaaaaaatcaaagtgataacagatgtagtatataatatctctgtcgtagaatataaacatttttgcgtatttttcgaaacatatttggacatctatatatccggatacagttcaagaaacacatagaaatgattatattttaaaaccaagtatatgacaagtgtgatggttctctgccttttgtagcttacacgctgcccagcctgcagggctgatgacgacgtacgacggccttgtttaggctctggcgccactaaaagctacctacagatcgcttacagcatactactcctataatactgttgcttaagtgtgctagctataccctgcactgctgatgaataagtatgatcgagctagcaaagcaactctacatggttgggacgtcaacactggttaatctcgtgcgctgcaaatggtctgctagtgtaatcctgtccgcatatgctgcttgaggttgtaatgagaatggacaaagtttactatccgcccgactgatacgtataccgaacatttacgtagcaatgagcgtatgcagatacgccacacaaaactatagactggcatggcatggcatgttgtctgtgttgttgtcacactgttgcgtgtgtcagatgcaggaaaatacatagtgaaaacctaaaaattactaattgaaaactaaaagtccaagatttattacgtcaccatagagtgaaattttctctcaataaaagttttactcatgagtaaatctacgagtgaaattcttactcgtgatgatgtgtacgaatctcaaacattcatttttcaattcaacggtagttctctagtttctgccgtatattttcccatcagacgccggtgctccctgctccgtggcgccgcaacgggctacttgtcacgtgctcccgcctcacgtttgccacctcatgggctgggcttcctcccgcaaccaagcccagaaactcaccaacgccgtggcaaacgctcaatctcagccgtccatcacgagcatatcgcccgtgaataccaccaccaccagcaaaccaggcggctcgatctccctatcccctgattcccctccagcctctgcgtccccattcacctctcctcctcctcttcttctacctcgcgctcgctcgcttccctcgtaaaccatccgcgcgcgtggtccttccatggcggccggggctctcctcctcgccaaccccgccgcgcccacggcgaggcaccagcaccggttgctgcagcagcggaggcagccgcggctcctcgcctcctctcggcctccccggtggcggctctccgccgtgcaggagaccaaggagggggaggcccagacggccgaggagatcaccgagaagtacggcctcgagttcggcctctggaaagtaagcacgcggcgcaggcagctatatttgtcgagttggagagcaaatcgatcgtgagcgcaatcgaatttgccgcaggtgttcagctccaaggaaggggaggaggaggaggggaagacgaggaagtcgaggacggagcaggcgaaggagctcctggccaagtacggcggcgcgtacctggcgacctcgatcacgctctcgctcatctccttcacgctctgctacctcctcgtcagcgccggcgtcgacgtgcaggacctcctcggcaaggtgagctgtcttcctgctctgctcgcacgggctgcggcggctcaccggccggcggcggtggctcacgtggctcccctgctttttgccgcaggttgggatcgcgacgggggagacgggagggaaggtggggacgttcgcgctggcctacgcggcgcacaaggcggcgtcgccgatcaggttcccgccgacggtggcgctgacgccggtggtggccagctggattgggaggatcaagaaggggggcgactgatccatcaagtatactttgatctttgaatgcgtgaattcgttttgatcttggctcgttcgtactgaatcatgacaagtatatatactagtggtatgtgaatcatgtatgtaagcttagatgttcaagtagagggctacccagtaaatctgctgctacttttgtacaaacacatgctaaaacagtataatgatctagtgtatcccgaattaaactactactagcagaaatgggtgttgtgcagattcaaacactcattaagttattaatcataggtacacagccagaacattcagaagcctttttttaaaacattttctgcatgaaacttgcatagaacaatggttgctcatatgctgtacaccctagtcgaactatttacagactgaccctaccaagtagcttaagctgggagaaagaacctgagtgagctataaaaataacacaacgaagcaacgcctctatgtacaatcatatcgatcaccattggaacaggagggtaatcaaatcataagtggagtgataagcaaatatgttttcagatccataccgccaatccagaaaaaaatggctatctgactatctcagtatgtacatcttcacgctgcgcctgcacttcctgttctctgggaaaggatgcagactcccatggaaaccaccggaggaattaagtcataccgaataacctcaatcgacaccagtagatctggtctagcagtaaaccttactggttatccatggttgaagcccacgcctgtaggttcactggctgcagcagacggctggttgagtgcacatggggtgtcacttatttcttcagctaagaagtcgttggtgtcaatctgatcccactgcatttctgctggttatcatgttaaagtacttcaaagttcaatgcacagtgcaacttgtaagctcttatagtatatgagaaaaaaaaaacccaatgactatatttcatcaaggatacatgctgttgtccacatatgagtaatgctgatatcatcatcggtgagaagccagtaatcagcatcagtctgcaaaggtgtagaaggatatcatgggttagagtctaccacataagtaatttgtctattattgagtgctatagcagtgtaagataactgaactataagaatgagcttgtaattttttgttattggttccagaaatttagctgtttattattttaaacaagaattatgtcaagcacatgatcagcaatttaagatatttttgcacttctgctatactaaatcgtccatatgtgaagttctgtaacattgagctttcaactaaagctgctgactaaaaatcaagatactaggggagttcaaaattatgcagctagtgcagcatcaaaattttcaaatgtgtgaattgggatgctgtttttagctcaatgacatgatcatgagttctgccaccctgcacaggaatttatttttataaaacgcaaaatccatataattctaatttaaattgcataaaaatgttttagaacataacttacatcaacatctgaaggagtaatcttcttcatccttccaaaagcacgtgaagcattaagctccggagtttcctggatatcctgctgaacattcaacggcatggtctgcttgctgctatgtccagcttctgttgctatggagggaggctctacaacacttgcatgccttggaggtgttgcagtttcacctagctcctccattttcttatattgactgataatatagtaagggtgttcatcagataatttcttttgaggcaaaagcttcaagagaagaatgaagtgttacctaaccaagtaaatatctattgggcccattgtactccttaataatattctatatctccgttggagataatcaccagcctgcttatggaaagaaaaaaaatgaaataattaatactccctccatttcatattataagtcactttgagtttatcctaacttacgcaaacttgaaaatgtttgacttaggacaaacccaaagtgacttacaatatgaaatggagggagtagcagttgatcatcaagtattgtttatatggagaagtcatttagtgtttattacctcgtcaggatctggaacttcaactgtagtaccacgaggtccttttattgcgattaatgcttcattctgcagaatgagaaaagccaaataagttacatcaaaattttaattcagcacagcccccataattttatgttaaacaaaattagatcaataacaatattgccttccttaataacatagacaaacctgaaagcagggcagtcccttgatgtcatcttcagtaacaaatagccacctaaaaacaggaacaaaaaatatagctcagtacatgattgcacagtataagcatattacaatttgcaacaggtaaattgtcacgagtttaactttccaccaggctttgccaatacttccattttgcaccggttctagagaagatatgttgcagaaaacaccagctttgacgctgcagtcttgacgaatggtggaaatttgtgcatgataagtctatgatgtcagatggttgactggtggttgatctagatcaagtagaagcaagcagggaggatgatggttgtaaggtgtaatgggatatggtgaaaggattcacaaaacccagtgcaaagtgaaacttgggtcaattcactcggtgcaaagtgaaaattattaaaaaaaaatggcatgctagcatgcccaacaaacaggaacatcactacctatggttgctttcgtcttcagttaactcctccatcttttcccgtatttcactgcaacaaataatcaggaacataagaaattactgtcgataattttcagattttggaacctccaaaagctaccaaccttatacttctatctaaagcttgctcctggatgtaaaggttttcaacttcggtctgcaagaacactgaaggcagcttagactcagaacttcttttacaaacattcagataaatttgccatgagtatatagattttaacatgattgcgtaaatgagaaaagtagaccggcaggtaccttgagacatgaaatatcactatcaaggttagttcctgagtcatccgaacccctgtgatgccatgaggttagcatctcacaccataaatacaagcatacaagggaaacagaagataaagattacctccaacggattctgttcttaagcttcttttctatcaaacctgttccttccagtacatttgttatgtcatatatgcgccgtttccgaacctgtttttgttggaaaccatatataaacctgtagcaaaactaacgaaaagaaatgactgttaaaatgagagagagggggggggggtttacccatacatctaatatctttgcagcatcattcaaatctagaatgccatcttgagtctgcttgagcaaattaatgaattttctggtcaatagtcctgaacaaacatcacatgaatagctgtcagttaaaaagagagtaaactgtatcaaatgagatgatgtgactacatttataaagcaccaaaaattcataatggtacatttaacatttagatttccacaattgaaagttctaggtgagggactgctatgatcacctaatgaattgtcatagcgagaactggcaggagtggatggatttccaggtgaacctgcagatacaaatgtgtgtgcattgcattagtcacaggaaacaagtataaagaaaacagaacaaagctgtgataaacaaatactgttaacttaattaatgtcactgatgaggaagtttctacttgccagcattggatataggcgtctgaggtccagctttattgaatttagccattgatttggttgtcctagaagtttttccagaaactggggtcataagtgggctgccaactccttcagtaaacccagggctagtcatcatacgttcacttgactcagcagcctcactttctccacatggagtttttcttttcagctatgcacataaagggggatcatgcattcgtaaaatgggcaatagtattatgtagtggtcaactcaagcgaattgaaaacttaacaagttaacacatgaatcataataagctagataaaaataaatagcaacacctacattacaatctcatgatccaagaaaacacttgcaagggtacaagcaatggcaggcataggtgtataactgctttggtgaaatgattggtggtcattgaatttggaagataactatcagcaatatccatttcataatcctgtgaaatgatatgtgtttctgcaccagcacacctgtttgccgctacaaccgccttgtgcatttccacatggaggagagtatttccccaatgtgatccatgaggacccccaataactaacatactctcaatcacgagtaaataaaactgcttcctagcaaatgcactgaagatgactagatgaacacaacttctagcagaatacgcatttcagacgtcattcagatacattgtcctccaatttagaatcatgacagaagcatctttccgaattgctgacattatcttccaagctgctagcgactaaggtaaaacagcagtggacacatctacatgtcctagaaagtaccaaatcctattatagtaccatcatactatccaagccgacggaatgcaattttcaagtttcaagtgggtggcttggataagtgaagagctattacccagtaacccaaaacaaaaatataccagaagacagacatttcacaaagccttccactttggcgtcaataccacatgactgaatagatagattcatagacagtagtaattctaatcttcccccaaagtatttggcgactgtaacaagccgcccacgaattcacccaaatccacatgttaatctacaccaacacccccaaataaaataactggaaatgccgtttaattgaaccgccatgtcaccttgtaccgccaaatagctgccgcacaaaacctcagaaacccgcacagaaaccatccccgagaaggaaaaaaaacaaaaactagccaatcaattggtgcacacagtaaaaaaacctcttcggtaataagctcaaaaacggcaactcacgggtgtcctcctgatgacaatcccctcctcgatctcgccgccccgggacgccgccgcgaagcggtggtaatcgccgggggccgccgcgaagggcgcccgcgccagcggcggcggcagcggcacgaaccgctgccgcaccgaccgcacgatgtgctgcgccgccggcggacggcctcctcccgacgacatgcctccgatccgcgagaagcgcccaatcgggcgggcgcgccgcgatcaccacccccggacgcgtccgacggagctagggtcccggcaaggcgggcggcgacgaggcggggaggtggggggagtggggcggcggggttaaggcgaaaagcgcgaggttgtgcgagcgagaatgcgaggaggaaacgagggtggggggaagggagggaaatttttagccgcgttcgcgagtcgagtcgcggacgtgtaggggggaagatgtggatggatgtggatgtggactggaagaccggaactggaagggaaggcagcggggaggggcgcgggtttgagacacggcttcttcatggaggggctgcgtgcaaaatatcgcgggcgtggtagttggtgttatcctacgcccgcggctttgttgttggcggtctaggctgcgttaggaggaaatttcaccatcccccatgtaaaataaaacgattccgtataaacatacacacgcacatctaagtgctgttttgggagcttaaacatgtactccatctgtttcactaagtcattctagtattcccataaaaaaattcattaacatcaatataaatatgaaaaatactaaaatgacttgcattatgaaacggaggaaatatttggttctagaattagatgtatttggttctaaaactagatgggatgggatgatttttcacacgtatgtttggttcataggataggatcattctttgtttggttgaaaagatgagggagtgatgggatggacgctatttgtggctaccgtcaacccacgtccgatcccaataggcgcggcctagcaactcggcgagcgagcaagcggagtagggacggcgcggccgacgactcgacaagcgaacgagcgagcaggcagaaggaggagcagcggcgaccaacaggcggacagacgagcgagaaggcggcggaggcgaggcggcagccgcttctcgcggagcagaggtggtggcggatcgcggaggacgccagccgctcgtggaggagaggcggtgggtcgcagaggggtggtcgccgcacgtggaggagaccgatgaggcacagctgcggccgctgctcgcgaaggagatggagaagccgaggctgcggtcgccgctcacggaggagaggcagctgctgctcacagaggagaggcgacggaggcgaggttgcggctgtcgctcgcagaggagaggcggtagccgctcgcgtaggagacggaggagcggcaacgggtcgtggaggtggcggcgtctggtcatggcggagtgccggcggtcgcggaggtggcagcaggtgtgaacaacgatggcggatgcagaggcaagttgacgccgtgtgctacatccaagtgggatgagttcgtccggccgattttgccggatggcttggtcccaaatttgagaggaatattcatctatatggatcaacccaacccactcgaacctcaaccaaacactcctaaaaagtgggttcatcacatcccgtccttgcaaccaaacaccatcgattataagaagcggctggtatgtagtcagcttttgagaatctgaaaaagtcaggcttcccagcttctggcctctagtttattttggattctacaactacatcttctcagaatttgtaccaaaagttgtattgtttagggggcttctgattttgggagaaactgcaacagctagaagcttccccaaataggtccttagtatctttggaaaaattggccaggtatattttgagattagtgaagtcattagaaaactagaccgacatatcttgaaattgatgaagtcatcacaagcatctcgctatcgacggatacgtatatacctatcatataagcactcgtataaaatctataatttgaacccgtgtgaattatttcaaccacaagaaacctaactaattgagctacgttcacttcgccacaaaaataattattttgtgtatatattagtgtcacagcaaattattgtacaatttcaataattataaaaaaggtgactgcaaatatcaaatttatgtgcaattctgcataatagtgcaaacaaaagatgatctctataggttcatcattttatcatgcatgatgccgatcacgcatccacagttccacactacacaccactgttcactaagctgtaagtgggttccaacgtctcgtagatggcaccttgaattcctaaattagattcatccaggattgatttctgtttagacttgtagtattaggccatttccaacccaatgactaggatgatgtccatagcattaaataagctgtcacataggatgaaaaatgatgtggtaagtaaataaatgaggaaagagaaggaaactatgtcttgcatgagacatggtttttacacaaacatccaagacattatgtgagataagtagcattaaatttaagtatgaaatagtggtgtttgcattggaagagtagtgtctagtactaatttcttaatgatgtggagtttatgaaaactacgtctagtattttgggttgagaatagccttaatatatatcatataccgttgtagatttgtttttttacgtgacaatgagtaccggacagacatgcgacaattagttgatacaatcgatctggtcaaacaacagaatcgagcatcccgtagagtccccaacagaggttggggggggggggggggtttaaacaccgcctccggtttataggacaccagtgcgccaccgcccgtaggtgacgtgcataggacgctccgaccgctgcctccaattaaacttgtttcaccgactcatcgctgcccccgctaggttcagcattcagagaacacccatcttcgtcttcgtcgagggcacctaggagtctaggaccaggcgaagcaaagatatcgatggcgccgccaccggcgttagagagagcaatccggattccggccgacggcgagcgtcaagtcctgcccgaaccaattcaccgactccatcggccgtacatgcaaggaggacttgaatgggccgcatttacgccgcagcacagctccggctgacatcaatcaaatgaggaataagttcactatcgtccctcaactttacattgagtgtgtatgatgtctctaatctccaataccagaaatgtctaacccctcatctgttcaaaatcatactaagtaagtctctcgacagtatggatgtctggttttgttgacgcggcatcctagtcagaaaaaaagtttaaaaataagtgggggccacatgtcagccctatcatccttattctcttttttttctagcctgggagagaggggaaggcagcccgacgccggtgggggaagaggcggccggcgtgggaatgggagggggcggcgggagcggccgacgggagaggggggagaggcggccggcctcgtcagtgggagcagccaccgtcccaccggccatggccatcaccggcggcgggagggttgctgctcggcttgcggtgctcgttagaggagtcggcaagatatgcggtagtattgagtcaaggcgacaccgcaatgacaagcgcccgccgcgatagggagatgctaccgttggtcgcgcacgccgtctcggtcaatcagtccttgtaggtggggcgccgtggcggcttttggtcgcctatttcactttcttttgcctctcccccctctccccccagtcatgttggccacctcttctcccgccggcgttgggctacctccccctatctcctaggttggggaaaaaaagagaagaaggatgatggggctgacatgtaggcctaacgtatttcttttaatttttgttgctaaataggatgccacgtcaactaaatcaggcattcgtactgtcgagggatttactttgcatggtattgaacagttgaggggttaacatatctagtattggggattggggatgtagcctcgatgtaaagttgagggatgacaagtgaacttattcctatcatttatcctcacgtcctataaaatgcaacctaggttgagcttctgttggggccaagaagtagtaggatccaaacctctcgaatccatggatcgtcaaagcatcagaatccccaacaaaaaaaagccgagctggaccgaaccacccaatccacgtggcactggctgtggccactgagagggcggcacgtcacccgtttaaacatcttcctccatttcgcaaacgttaccagatcctctgacgtagaatggttctacgtcagaggaaagtctgagactagattcccgttcgtcttgcatcctaaggcagcatctgttccagccttcgttgtttgatctggaggtgatgtctaacccgctccattcggcccattagtataccaaggagaaaaacaacaccgcaatagctaatcgactctgtcgtcggcgatgcgagaatgaacaaaaagagcagaggtcagaaaaaagcatgaggaactgcagtggaggaggggacggaatcaataacgttcagatggatatccaacctacgctacggttccacccgctcccgccatcccgcgcctggggagatgacgagagcggcgtgcggtcaggtcgatggccatggccgacgagcgacagcgtttctcttccaccttcactcgagtagctagttcccaactccctccaccctgatttccacacgcacgcttcctaaactgttaaacggtgtgtttttttcacaaggtttatatacaaaagctacttaaattagtaaatattaaattaatcataagaaaatgtttcactctatttttcgtgcggagggaacataatgcctcgctctattttccgtgcggagaaaatatgttccgtactcaagagaacaaacgcagtcttctgcaaatgggctgaaaggagcagtctggacctcgtctctaggccgaacgacgagggctgaaacagattgcggcaccaaatcagcgcccgcccgcgcccaccccaccg

SEQ ID NO: 63093 - DNA, 1479 bp, Oryza sativa
  unsure (1)..(1479): unsure at all n locations
gccttgatgtattatgcatagcgtaaagagaacataccgagtccagtgtggtgtacccatccttacagcaagcaacaacgagtggtcgcaatgaagtgaacggtgagaagagctctgaatcaatatcctcaaagttcccataggtattttcaaattcacgtagggtaccaaaagcccgctgaagatgaccaatggatgaatgagcataaatcttggcaagatatgcctctggcgtcggtgcccttttctggtgcaaggacttacgtaatattgaccaagcagcattcaggagatcagtgctacaagttctggcagcagcacttagagctgagagtactaaaccttcatcaactgaaagatgaagaggaggaataacacgctcagaacgagcaatccatcttgcaagatattccaaagcaaaaagacccagcttgctgttgttagcttcaaaagcagcttctgctatttcaacacaccaggaccatggtggacacaagactttgttctgatctgtagcctgaaacaaaataagtgcaccgttagtacatacaccgagaagattgaaacatatattcgaaaatgaagaatgttgaaggcccattggtagcccacaaacttataacaattgagaatttccagcattggaaattaggagtcctaactaacagtatataaacagtaaacagacttgtcagtctaaaagaataataagtaccttgcacttctctatgactgatgccaatgtatccaatctaccagatcttacacatgcccggacatactcaacaaaaacagaggaagatattgtgtagcctgatttaagcatcaaatccaaatatttcaaagtagagttcaccccggtcagtttaatcagaagatttacaaccaaattgtaggattcgtcatctggtgagtttcctgttgcaacatccctgatttcacaagataaaatcattttcaatgtgaaatctgtagcagtagtgaccccagtataggcaacatatagacaaaaccaaaatgcaagcncttagagcataatacatgaaaatgctatcgtatatcatttgacaatattctgcacaattcattgacaataataacgttcttacagctgcaagaaaaaaaacttaagttcctgaatgttatacacaatctgtaaggcatcttttagttttatgcactaactacatattataaattatgtatgcaatgttgataaagcatctgagatatgttacatcagagaaaccgtaagtgcaatggatccatggcttttataaaacaaaacgttacatcgtatctatgttacccactaagcatcagaagaatgaaaggcgtgcatatctagtaaactagtcgtgtcactaaagacgcaattcaggccttaaaatttgctgcaaacgacctacgaggttccatggttgagttgtacatgcacattatgacaacaatgaatcagggaatggcgatctcccattc

SEQ ID NO: 63094 - DNA, 1200 bp, Oryza sativa
gccatggcggaagaggaggtggggtttggactagggttttagtaaggtgggagtgagagggaaagaagccgccgacggcggctcagaccggagatggaatggaacggaaggagcggagaaatgaagggtgtgtttcgtaattttgacttgttacgagggtgaatatgtaaatttttgtgcgaccgttgcattcagttcgacggtgtatcactgcgataaaaacggtttaacccacggaattaacatcggagtacgaatttcgaaattgtttgtgccaaattcctgtgaagttcgcctgaattttgagcgatgcaaatggggctcttgtctatactagatcaatgttagagatggggctttgtaagaaccttggcagcacgtagctgcgttttgcattttgcaagagagtggcaaacttacaaacatgaatttgaggatcagatttcaactcccagtatgttattgttgccaatcggtttcttacaaaaagattgctttcggtcagttccatacaacgagaaatgttgccgatcatcagtttgcatactactcttaactaaaatcttctacaagtagttcatgactcttgaggatccccggatgcatgttcctcttccaaagttgaacatggcgcgtcggataatcgcatccgttgtgcagaacttcattgccaagaagctgtcagcactgtcacctttgaagatatacagacaaacataaagcacattacttcggggagccatagaaactccttgcagtatttgattgcatggaggtgcctgttgagtgcaggaacaacattaaaatgctaatattttgtcagctgcaagtcccaagcagcaaatactcctaagtatattgatgggacagaacctcaaacagcaagactgaaagactaatatatatatatatatatatatatatatatatatatatatatatgacactcatatggggcaccatggtgcccgggcaccatggtatctaatgcacaaaattactcaaattttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaac

SEQ ID NO: 63095 - DNA, 8818 bp, Oryza sativa
agaggattggccaatcatacatgctatggttcttgcttttgagtcatttgagtttgttttcaatgcacacttaatgcttgtcattttgggttacacaaatgagttttctaattcattgcaaaagagggaccaagatattgttaatgcgatgtcacttgtgggtttggcaaagaaaaaaatgcaacaaatgaggttcaatggttgggaaggtttcttaggaaaggttacatcattttgcatcaaatattccattgatattcctgcaatggatgctaaatatgtgcctcatggaagatcccaccgtttttacccatatcaaacaattgatgaccactataggagagaagtgtatattggtgtcattgagagaattcatcaagagctggagaatcggtttgatgaagttagtatggagttgcttctttgtatgtcggcattcaatccaacagattcatttgcctcatttgatgcacaaaaaatacttagacttgcaagcttttatcctaaggacattgaaggctccaatttgatgaaacttgagctccaacttgatacatatattaatgatatgagagaggatcatagattcaaaggcctaaacaaaattggtcagctttctattaagcttgttgaaacaaagaagcatgatctgtatgatttggtgtatttgcttcttaaattggtgttgatcctaccggtggcgacggcaagtgtggaaagagtattttctgcaatgaatttagtgaagactaaagtgagaaatagtatgagtgacaagttattgaataattgtttggtcaccttcattgagcgtgatatgtacatgagaaagacataattcactctttcatgactatgaagaagcgtaaagcaaaagctcttgagtcttgattagtattgtaatatcctatgtatctaaagaccttgtattatgtttgaacaatttacatttttatttaggtaagattcaaacttatttgttatttttctacttgtattgaaccatttagagttatataccatatcgtactatcgtttaccacattatatatcgaatcatattgtattgcattcgaattttttttggctaggcctaccctaggttcaaatcctgggtccgccactggtggctactattgcactgggccatgaatttgttgttggaaatctcagttggatttgactataatccatgtttatgcttcattgtatgtgatttgggatccacaaaatatgacaatatgttgtcacaattttttaaaaaaattctgccaaaattatgtcaaattttgttttctttattttgtcaaaaaaaagtttcaaactaaagtcaaatttgttaaattgattcaaaattttaaaattaaaaaatcaaagacaaatatatcaaacttgtcttaaatgtcaaagatatatcaaatttgtcacaaatatgtcagaagatccaaatatatgcatgttttgacgtaacggagtcaaataagcaagggcaaaggggactatttgccccttagttaacactatagttggccaaaagacccacagcccgacgaaacaacccatggcacggagatttggctagatccagacacgtcatggctcgactgttgtcggacccatgccagctaggcctaattgttgggtcgtgcctaggcctcttcctcggcacgacatggcacaacgatcagcaggcccaaatagatgagggaggcaagatagacatttttttctagccatatatccacgaccctgttaacgacaaaatttggtaagcccaaagtcatcatcggctgaaaatcactatcggctgcaacatcttggaatcagccgatgggagttatcaagttgccaatagtcagattcctgctatattcggttaaggaaatcaatctactaaaggaagtttatccataagcaaccgagttcaaagaggatgcggcatggcagtttatctattaattaggaatagtttgttagtttccttttatctttaggaaagtgtgtttagtgtccgataaggactttatgtttccttttatctttagtttctttcttgtccgacaaggacttgtattaacccatgggtataaatatgtacacccggggtctatataatctatcactctcgatcaataatactctcagcgcatcgctaccctctttaccgaggtttttacttatcttccggcgggatttgggcacctgacgcggggctgcatcggcttttgatctccggcgaaggggtaagtcctacgttccgtcgggccctggtgaatctgtcatctacctcggtgttgttcaaggctgcatcgctccgatctcttggatcgctctggtttggttgatacatttgcctacctgatatctcgattctatctctaattgcattgtatttagagacgcatcggtttagttggaactgtctcggttaggtccgatcttctgtcttagccgatatatctctacaatcacaatgatgttctaaatagatttgttatatctatcacattagacagatctatcggctcatcgagtattagattatcatatacaatctcgtgatgcatcggttaggttcgacctactagattattgttgatcatataagtcttgttaagccgataggttcatactaatgttttatcggggtgctagccgataagttatctggacattgcatcggcttataaggattgcatatacatataagttagatttagctgatgacaacaaaggtttcattaatttatctaatcctgtggattttatgacatcggacctccagccgatgtattatttacccttcggatcagtgcttattctatcatatcaatgctagccgattggtttatactggattatattgttgttatattttattatcatcagccaagtgcctttatatcatcatctacattggacatatagccaattgcttaaaccctatcgttatcaggtagtattagcatcagctattatcagcatcggctggaactactccatcggcttgttagccaatcggttgtgggatctactgtttacatatcttgccagttgcaggatcaaactgactagcacgcacgcatctcatcaacctttggacctgcactggagctaagcagatctcccaggccagtgtgtgtttttcacgtcaacagacccaaagagatgagggaagcaaatagacttattccaaggacgagcatgatggactagtggcctggtcgtgccttcaggccggcacagcacgacccgagttttattgggccgtgcctaggctgaaggtgcaacccatgggcgggcacggcacggtttgttagtcgggccgtgctggcctggctactcactaacactattaactcgttttaatggaatagtgtcagccttcatcttcgattttgaaaaggaggatcaaataagcaaactaaaaaaagtaggatcaggttggtagttactagttaggctgtgaaacaaggtcaaatgagcaattacccctaatttatttactgatataaggtgtcgtacctatttgatttcgtgttgtatgtttgcttataatgtactccatatcttatatagtgaaagcaacaagctttcttgcatgaggatgtgccacatcatcaaaaatatattagccatcagatgaagagttcaaataaacaatggtcattggatcgaaagagtgcatgtattaaaaaaaaccatagatgagctaaacatatggaaatttctggaggtttcatctcctcataaacatatgattcaaagagagggaacaaaggaggcttctgatttctcttataacatactcatataatacaacttagctatatctatagttggctaggacaatcgatactttataaacaaattaacttatatcaaaacatttttaaaagctaaggtaaactaatagaccatacacagaagttttaaatagaatcaaaagtcgcgcaaagcgctagtatatatgaaaaatgcaaggataacttcaggaatatgtaacgagaccaccactaggacttcaataaactcctaagcatgggcaccaagatttgtaattggttctctaccaagttgtatctgtttcccccaaaatacattaattcatatgcatttatgcaattcataaagttcaagcgtggattgtgttcaccggtaaaaatcgtaatcagccgccagctgatttgaattaagcttcgtgtctcattcttaggttttatctcggcaaatcatggtttttgaagttatcttttcctgtgatcacgttcatgcatgttgtgatcacgtataccgactgtatataaattcgcagaagagatgtgagagacggatcgatgccattaaatagccgtgatgagcacgtaggcgagacatgacaggatcatatatatccaatgtgaataaaagaacaatattcaaaacagattgacagaatttaagatggttccatcggtagcttggaattaaacatgctgtgcatcgatgcatataggcaaggggctgtcgatcatgcaagttggacaaattaattttggtattttcgcacacgtcatcttatgtggtccgcgtgtgaaaatatgtcttcgcagacggattgtcatatcgtcctctccctccccctcctccttgctatttttttagacagtcgtttggcttcgagagttctacgcgcctagaaaaacattttgccattgtctaggaaaatggttttactagtttaatatgaatgtgactaatttatttatcaagagaaataaccgtccaaatagtaatttattaactatgaaaatctttgtggtaatctaaacatatgttgtatagattcattaacatctatatacatgtaggcaatactagaatgacttacattataaaacagaggaagtatatttataatgagagaagggctaagaaccaattgggagtaattcatttaccgagggaagaataccaattgatagtaaatcaattaccgagagaaggaagtgggaagaaaaatcaagagtaaatcaattactgatagaaggatgtgagaagaaaaatcaggagtgagaaaatgtgcaaacaagagtggtgggaaaggtgtgggagggaggggcagaggagttaagggggagggagggggtgtacctgtgagagtgcgttttagctagcacacaccccaggggcgctttagcgcgtccctaataaaatgtgaatatatgtgttattatgtgagaaaaatacaataatgttagccacgcaatctacacggccatcattctagttatacatatactattaactgagcaaaggacatgaacaagtaatcatcatatttgggaaagtagtgtgagcttataaagaatttgccttcctgaccagtatggaaatgcagataaattgtcaaggagaattgctagctaaatcattcatgaaacaaatatcaatgatattcatataatccaacttaaaggtaaattgtgcaagtcgcaactcgcaagcgataatatgacattcagtaagcagtcttcgaaaaaagaagagaaaatcgtaagcctgcattcacaaggtcacagaacacaagccaactatgcgtacaagcgaagcaagaactaagcatggaaactgcacgacaatacaacttcgatgtacaagaatccatatatgccaggtcaagaagccattacaggtacataacctattaaatctaacaagcagtaaggaaagggctttgcaatgatggctaaaacatgatgacaaaacaaagatgatagatcactggtcaacaccattaataaaactggggagcacccagaggtactctagttgactgcaatggccttcagttcgcaggagtggatgactgtatggaacacaatgtgttgcaccaggaattggctgaccaagctcgactgcagtccaaggttcatcagaatcttcagatggtttcgcaacataaatgcagttactctttccgccccatctttcagggttcgtgcaagagaacgtaggattcctcctatcaaggctgacaaatagagcactattttccaacttttccatcttcatccacttggctgtttgagcagaaaagtcaagacgaaagacttgaaaggtgccagggaaaccatacgaatggtgaatgcctactgagaggtcaagcatgagaagcatgtcaccgctgatcaccagccacggcttaaaatgtacacccacaaacatttcttctccccacacaacccctacttcctgcatgctgagctgaggtgcaaagcgcatggtatggagcctgtgatgaaagtccatcgcaaaaaactcacctttaacgagcacaatctgaagaatgcgctcaccgccaaaagggtgctctgaccaagaattcgttccaacctgccaatagaatatggacgatctcgaacaaagtaggagatgcgatattggcaaattaagtggagcagtaaggatgccatagtatgtttccttgttgcctgcggattgtagtttgggaggcttcaccttagcgccagtgtacatatcaacaaggaggcaattctcataatatgagaagatgagatacccatatgaacaacccaaatagcgcatgcgatttggagtattttgtggagctgaacagcgaagggataaagttctcttggatggatcaccaagctgccatctgcatttatataaaagagtgtacctaaaactgctgcaatggggatgggaattaggtatatctggtttcaggtgaagaggtgggaaggtgaaagtatatatggatgggaaggaagataatgcagctcgccaagagcggcaagtgccactaaaagcaagcaagtcctggaatgagctaagcaaagcaatgatttggtgaagcatgctgtccatgagacctggccaaacatggggttcacacatggtagaggatgtagacactgatgagtggcaggttttcttaaagggcctttctgcaacagaaacttccctgtcaaacaaatgaaaaaaattcaggacgactggatcagagaaagcactcaaagataacattattagtaaagatttagaaatggaatgatattgatcacaatgtcggttcatttaaagaagcaacatgaattggtaacttcacctacagcttgggcatatcgagcaataggctcttgtaacatgctgaggcaaataattatgcccgtttcattgaactgtaacaattccaagaaccacttacagctttgataccttgaacaatagcacagttgtaatctgtctagtgttccaaacccttttttggcccctcaaaacaatgacagaggggtacgttgtagagcaccctcagaacaaatatcaccaaaagtgatgaaaatatttattccgacaacatgaatatgcgggcaatgcatccaatttaacaggaaaaaaaattgtaagcgcatttgattaattcattaatcgatcttgctcctctcgcggcccaatttaaaccactactggcagtgctaccatacaagaatgtcaggtaccataaacgtcctggaactatgtaatcgactagaatcgtgtcgagaccgcattaaattgtacctaaatttgaacaccaaatatccatcatctcccactataccaaattaccaatagtttcacacctcatcactgaacaacagaacaagttatgcactggtgagctagctcaccctacctagttcatgacatcatgagacgaaatcgctatcggcgcgtggtatacgatgaatgagggttctttgtcgcctcacgatgatttgacgcacatccatccactcaggaacatcgaattaacaaaggtgaaacagagaaggataaataaaacaaaccaaatcatggttagggttgcggtgcggacctttggccgagagcggtgagctccgttggcgagggctcggcctgcggcgacggcggccgtggtcttcgccgctgccgcttacggcggctcccgtccatgagcgcttgctaacccgtagcttccccggatgcgccggtgaggagaccaacccggcggtggcgacggcggcggcggcggcggcgcgtccgatgggagtggaggcgaggcgaggaggcggatgcgtcagcgaggtgatgatccatgggaggcccaaccaatccagcccaacttttgatttgggcccacattgctaggcccagttaagaaagcccaaattgggcccacgattggaggccataaaaggagcaggagaaggggagtgagagaggggctaaccgcaccgcacgccgacatcgccggagagggcgccgctcgccggcatagtcgtcgccggagactcgtccgtccatccgcaaggcctgcaaactctctaccttctcccccaaccttgtcgcaaccaacacctcatctcgttttttttttttaatttttatttgatacatttctcagtttctcctcgtgtgtgtgtctgtgtcactcgtgtctccgaatccgatcctaaccgagaagcgcgtcccgtcctgtggtggtgagatctaccccgcgttggtaggggtggatcttgcactggattttgttgttggatgtgctagcgaagaaccctagattgacatggttgatcacgtaggtttatgagaacggcctgatcgtttgcaatgtttaaccaaactctactatcttcttctaatatattgacgcgcaatccttttgcgcattcgtgaaaaaaaaaacgtaggtttatgagagcgtataggtgcgcgtgcctctactagtgtgaaaacaaaatgcgcgaaattggatgcaatgtggtgattcctgaacagaaattttgatgccatgcatgaatggggatcc

SEQ ID NO: 63096 - DNA, 635 bp, Oryza sativa
  unsure (1)..(635): unsure at all n locations
agagttgganacatgagaattgacattccactcggtaccctgcgatggaaaagntagaaaatcgaagaaaaagcttggagctaaacaaggccaagttgatgggcttttatgtttctgtatccatgatgcaatgaacctccactgctctttgcattgtctatacatctactacaacggtactttgggtttttgtctgaagtgaaccaaactaagtgcatactacttgtcttaagatgaattcagtcattttgctacgtctcatttacctgccagccatatggatgatagtagatgcttgtgttttcattcgccatatgggtgtgaaattctggtctttttactataccactgaatttgaaactgagtcgtcgagggcgtgttgcgacttgtgacgaaacagatcgatctaaaaacgtgccaaatcgcaagtaatcacaaactggatcaaattcgaagaattttatattctgcaaaaaaatacaaaatgggtgataatagattttttttatttttaattttttaaaaaatatttacagtaatattatactagagaaaatattacagaaatagacttcttgtcaagcctcccctttcccccccccaaaaagagggggggccccgggggggggaccccc

SEQ ID NO: 63097 - DNA, 2686 bp, Oryza sativa
ggactaaagatcgatctttagtaaaaggttttttcacccgggactaaagatagcgatctttagtcccggattggtagtcccggttttcaaaccgggactataggggggttacaaaccgggactaaaaagcacttctccaccagtgatggtgagaggttctcatcctcttatcccagccggagtcggtcctcccgccctggtcaaagctaggctcccgtttcccggtgtaataggagctcagaagtcttcacccattaaaagcagctgacatgggcacccctcatgtcaggcggcaagatttgacaggccccatcatcaagatgacgtgcgcttgcttcccaagtcaagagacaagacatgcatttaatgcaaaaacacttctccaccggagctagatttttgggcccatgtggtaaccccttgaggtataaaaggaggtccaggcctagtagaagggaggagggatccgggacgatccattttgacgctctaagagcaatctctagccccggatgatcaacaccacattttacttcaacaaggggatcttgtaatccttcactaaaggagcatagcacaggagtaggtattacgcttcttagcggcccgaacctgtataaatcccttgtgtctcttttgcctcgaaaacctcggatctcacccgctgcccccggccgaaccaaaaaaggggatctcacgatctcccgctagagagctcctcgacaagactaatgatcaaacgtatatctaaaaattaataatattatacatttaaaaacgaagatagtagaaagcaacaaagtcatttgacctacttactgatacttacccacaaatctttcaaagataccttatgtttgagatcggagtagggagtcgtaaagaaatggagaagttggtgagaaacccgatcaagctgggaactagtgcgtgccagcgtgtgggtctaaagccgcacaagtgacaatttttccagcgcatattggccactcctatcttggtcatctctgctacgtacagtacatccatgtctcccatgaacattcctctcagcttcagaacgtctgtgtagcctatactgcgtcttttagtttcagaacgtgctcgacgctaatcctgtcaatcggtggtttgaaacaaattgttcaccggattatcacttcgaattagctatttattactataaagataaattaagtatttaaataaaaacttaaaaatagcttagaagaaatgatctatgcaatgccgcctaatgcgatagaaaaaaaaatgcccttttaatacaaaacgtggttttagagaagttagtcaaatgatctactgcctccgatctaaaatataataatattactaaattagacacatcctagtgctattaatcacacactaaaatgtgtctaatccggtactctttccgtttctcttagttctagattataagtcattttgactttggccaaagtcaaactatttcaagtttaaataagtttgtaaacaaatatagtataatatttatgatcccatattagtttcattgaatcgataattgaatacctttttatattatatttgtcttcagttaaaaatgttactattttcttttataaacttaatcaaatttaaaatagtttaactttgatcaaaatcaaaacgatttgtaatctaaaatagagggagtactttataatactatattttgaccaagggcggatctacagtgttatcaccggcgtcaggtgacaccgacgattttcgataaaagttatgcttaaaatacttatccatatattataacactatattctataatataattaacatggtacgacaccgatagatacgttattacaccaacaaatcaaatttctctggatccgccactgattttgatatggacagatataacgaaagagcatgaagatttctcgtttcgattgcgacgcggcgacccccatgcatgaaccagcgacatggaaaacatcaccgcatttcttcgcaccgagcacaaggcggcggcgctggattcgccggccggccggccggtcgccacctaccgctgatgagcccctgggttagccgcagaaaccgcgagcgccagcacatgcgtgcgtgcggccccggcgcggccaaaagcctctgtcggtaaaaatcgtcgatatgcagtgcaggtggcagagaacgatggtatgcagaaaaagccgatgcaattgctgcagaattttcgtagaaatttcacacgaaacagcttgctttagttttcataggagatggatttttcttttttttttctctcccacgttctaaatagtagtgcctaggtgcagcgggcccagctttttgaacttgcgtatttgaaatgggaggaggaaaaaaaatgttcatacacctaaaagcctaaaaattagcttgtggcataagatactaataagtataatatatagcgtatataatataaaattggtaaatatatcaaagtgtcaacatatggaataaaaaatgataggaaatgataaattgggaaaaaaatatagattaatttttcgacgcttgatattttgaaaataagcgatgatgtccttgtccttagcttgaaaaagaattccctttcaatgaatataactagacaatcattcaaatatttttgccccatcttgctttctcaacttttttttatgtagttcat

SEQ ID NO: 63098 - DNA, 5101 bp, Oryza sativa
cggatcctacgccttcttcctccccgccggcgccggcgacgcctccgcgtcttcctccttggagttggacctcgccggcctcttgcctagccccaccgacagggagctggcctacctgctcagcaccggcgccgccgatccggacgccgcccgcaggagcgtcttcatcgtgcactcgtcgtcgtcggccggcctgctgctgtgctgccgaggctatgtcaacccggtgcattactacgtctgcgacccggtggctcgccggtgcgtggccctcccggagctgccatggccgcccgccttcgacaagtccggcatgctctcggtggctgccggcggcggcggcggcttccaagtggtcctctttgaaaagaggggcttcgcgcatggtggagggcacctagacctcgaggttttctcctcggactccggcgagtggccggcgatgcgcatccctcgcccgcaggacctcgccgggttccggtgcttcgcgccgccgcacctccggcacgacggcgccgcggcgtactggctcgggttcgagcccagggaccgggccgtggtgtacggcgccgcggaccactccatccgcctcatcccggtgccacgccgcgtccacgaccccagcgcgctcaaccggttcgtcggggagcggcgcggcggcgcgctcctccggtacgcgcacttcgacgcggcagagttcgaggtgtgggacacggacgacgccacgccgacgcggtgggcgctggtgcaccgggcggcgctcaaggacgtggtggcccgcagcccccgggcggtggccgccaaattcgtgcacggtcgcatcgtccggcacatccaccaccacgacgcgaactggaactggtgctcctccttcaagctcatcggcttcgacccggtccacgacgacgacgtcttcttgttcggggcgaccaatggtagtggatgcgtcgccgcctactccctcacgctcggcaagctgagcctccgctgcaagattgacactgccgacggctcgtcctccttgtgcggctgtgacatgttcccgtacgtacgcgcgtccaccacctcgccccgtgcggacataccaggcatggtgtataccaatgcctagagtggaatatatatcatgcatgtttgtacaccagcgtgtaggttcataaacttgacataatgaacttctctttaaacttattatgcgcatgtttattttactaaaccttttataccaccaaattcgttgggtacaaatatagatggccataggcccaacggcctggcccacggcacaacattttgacccggcccaagcacagcacggcccgtgcctgcccccccccccaaccggcacgaccgggccggcagactaggcccgatacacaaagaatagggagtaaaagtagacatgttatatgccatggtccaaagaatagggacgtcaaatagacttattttagttatatatacatatatatatatacatatatatatatatatatacatatatacatatatacatatatacatatacatatacatatatacacacacatatacataacatatacatatatatacatatatatgtatatatacatatatatatacatatatacatatatatgtatatatacatatatatacatatatatacgtatatatacatatatatacgtatatatacatatatatacatacgtatatacgtatacatacgtatatatacatatatatacatacgtatatatacatatatatacatacgtatatatacatatatatacatatatatatatatatacatatatatacatatatatatatatatattggatcatccaatagaatccagtttaccggattgaaaaaacaaaataattaatacttgatgtaacaatcgatgcatgcatgcagctactaatttaaaaattactgttgcatgcaaattagttaggtatgcagtgtgcttttttttcttcataatattcggtatgtagctgatccaacgttgaaagaacatatgtcttttttgcaggatccagtatatactgttttttttgtatgacttagtatgtactagtacgtagtacatttttggttgctggactatgtgcttttttgttgtaatatccagtacgtatgtacttgatttctttatgtatggtatatacttttataagttagtaacagtatgcatctttttaaattagtagagcagtatataccttttttatgttaatagcggtatgtacttttttaaattagtagaacagtatataccttttttaagttagtagcagtatatacctttttatattattaaaacagtatatacctattttaagttagtagcggtatgtacctttttatattattagaaaggtatataccttttatattttttaagttagtagcggtatatatctttttaaattattagaacactatatattttttaagtcaagagcagagtatatacttcttttaaagttagtatcagtatatactgttctttttcttttcttaaggtagtggcagtatatacttaattataagttagtaggcaggatatgcatttttaagtacatgctattttaaaattaggagtagtaagtatatatatatatatatatatatatatatatatatatatatatatatatatatatatatatatatatatatatatatatatataaacaagagatgcaaaagtatcggtacattctctaagatgcagaagacagcatgtattgagatgggaatatgaagaatagaaaatgtttgaatgtgccattctaatctagatataaacgaaaccatatgctgactataaaccagagcatacaatccaggcagtatatcccattcacttcatgtataccgattctgtctaaacagaatatccaatacgagaagcacaaagctctgttttcttttcggagcaatatactcgactttcataatacttcaaaacaaaataatgccactaaatcacagtttccaaacaaaggctttttcccatggcgcagaccctctacgtagcttgttgcagggttgaggtaagcatttgagtcattggagttaacatgttctgacggcggttggcaaccatctgcatgcaacaaagggcacccacaatggttatctataggctctctacaagagatacatgtcagcatattttcctacttggaagagattaaatgaagagagagagagtaaagctatctactaacctggagatagtctatagagaaaaacgaggcaatgcattagagagctatagatatccatgtagacataccattgaagtggtttactattaatctagtctattgctgagatgtaaatgttttatagatagcaccttactttaccattgcgggtgctctgagaggcttaatcaatgaactaacagaagaataaaatggaattgccatagaaagaatgcataaaaaaaaatccctaccgttttgtgcagcatcgggctagctgccacatcaatcttgcctcatcaatgccgtggatgaaagattgattaacgttgtgacctatgaatcaccgcatcgacctgctgatgagaggtcgctgcctacgacgccatcatggtaaagcccaaagcttgcttgccaatgacgccgctggggggacgatcgtgtcgtcggttagatggacgatgggttgccccgtgagtatgccgccgcgccgccgccgccgatttcgttcgtatcaagcaaagcctcgtttgatctgcatgtgggatttggattaggacgggataacttgttcaagcaattaatctgattagaatcacaagcggattaataattgatctacaagagaggacttaccagcatcgttttagccgcccatcggtgcaacggatgtacatgatgctgcctctatctccctgttggacgctgaatcggaccaaccgtcgagccagtgcgctgcgcgccgcctaggaacgacgatctggagtcgatcttgccgccgcctagaaatgtcaaatggcagggcagtagagtgctgccgctggatttatgtgagttgttagttccagatccgagttgtatgggataattaaggatcatgtgaattcatttttcacgtaaaattgaaacgggttcgttcgatgggatccgatagtaaaatcgtgcaggctcattgagatgctttggatcgacggtggatatagcaggagtacgtactcccaggagtatataatcattttcgtatatatatatatatatatatatatatatatatgtatatatatatatgtatatatatatatatatgtatatatatatatatgtatatatatataggacactcatatggggcaccatggtgcccgggcaccatggtatctaatgcacaaaatcactcaaatttttcaaatttttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatgtatatatatatatatgtatatatatatatgtatatatatatatgtatatatatatatatatgtatatgtatatatatatatgtatatatgtcagcccaaagaggagggaaaatagacttattttaaaaaaaggcacgatgggctacccgtgccttcgggctggcacggcacggcaagtcctgactgctggttggccgtgcctaggccggaggtgcagcccatgggccggcatggcacggcccggtgtgttggtcggcccgacagattttggtccgagcacggctgtgcctgggccgtgccgggccaggccgcctgtttggccatctatagctacaaatataatgtggcaagttgggga

SEQ ID NO: 63099 - DNA, 29670 bp, Oryza sativa
attaacatttatatgtgtgtggacaatgctagaaaatcttacattattatattatggaacggagggagtaatatgtaatatttgaaatgaagtagctaccgatgatggtatccagtccagatttgacatggaccatccttgatgttgatcaactaataattataataaggaaaaagtccaaatactctcctaaatttagatagaaatccatctagcaccttaaactttaaaaccggacatctaatcccctgaactttgccataccatctatattaccccctaattaaggtggtttcagatgatggttttgcatattttgaaagcttaaatgaacaattccgaataactaatataacatatttgcatatcatcagttataaatcatcaatttattcctatacaatgatatcatactattactatgttggtacttatttgtaagtgagagctaataaggagaaaaaagaaagatttaagtcaaaattttaatatatacatatatgttcaaagtgtatgacatgtgatcaaactcatccaacttatatacaaattagataaaaaaaaaaccaatatgtaaaaccatcttagagggttgtataaatggtattgtaccaatttagggagttcaatgtgagaatgtccggtttcaaagttcaggatgctagacggacttccatccaaagtttagggggttatatggactttttccttataatattttgaatggattgtaatactgaaggcctggaagacaagttccctcttttcctcgtcgtgtctcatatatatgaactttgagaagaaattaaacagcactgatgcttatgtatgtacgtactgcctactacgtacctgtgtattcatcagttgtacgtgtctagctcgtgtgggacttagtacaagcagttcttggatccttcaaattaaagcctacttgcagctcagctactacttgctacagttgctatggtgcatgcacggcaaattaagtaattacttaacctacatatacacaaaaagatgtgtttagtaattacttaacctacatatgtagctcaagtactagttggggatccaaggatacagtcatacagagagagctttgagcctttgatctcttttacaatctaggcgcatcatgttctactatcggaggtatatatgactagctacgtacatggcagaaaaaggtctggatcaacccacatatatcatggcatgcatttgctctcttttaactctctctttttttcacccttcttttggaacgtctttcttcggtagaaacatgaaaaaaaaagggggaaacaaatcattttatcaagttgtttttgcatggaactaagaatgtggactggtcaaaaaagatggaggcagtgatatagctttgtttcacgttgtaagaacagaagagcatgatagcatgctacgtctgagctttatttgtatgacccagaagaaatgttatttgacaatcccgaggcaagcctagctagataccgggaagatcagcagggtcttgcataattctagacttgaaggatgactttgcccaactacgaatgcattatgcatatggctgttttgtttccatacttcttcacaacttgggtgaaaattctcaccaactttattttgaagcaattacaaatcgggcacctgaattatttttgactcgattgccctctcctcatgtactacttcacaacacatatgcaattctctcgagtgagtatgtaaaatttgtgctcccgcctctctagttgtgctctctctacctttctcttagatgggcctgtagtgtagtactacacagcacacacacacacacacgattttttctctctcataatttgcatatgtaagtctcttacatgcacgtataaacaactttttgacaagtttcaaattatttttaaacaacttttctcctaaattacttatctaatatatgatccgattacaccatcatatccattgtaattaaatctttaaaataatataatatattattatttttctaattgagatatttttatattatatatgaaacatttactggtaactgctgaaacattcaaagaatataacatgcaatatttgaaatgaactagttacattttttttgtttcatttgtggttgacggtgttgtagttagtatattttgaatgttgcatctatgacatgtatattatatagtgaattaaaacaatttttaaaactggccaaaaaacatttgattttttcatcaaaatataatcgtgtgagatcttgttataaatatttaattgtaagaaatacaacaatgtaatcggatggtaaatcaaaaaaaaatgttttagaagaaaattcgtttaaagattatttttacaagatgaactctaatgaatctagctttagagttgttttttttcatcatagcttatttttcaatatttgctcttaaactataaataacatggatataaaaaaaacactcaaactatttttttcttatatgtcgttttacggcttattatctattttttataagatcaggcctcaagttgttttgcgggtactagcatcgtttgagtacatggttgctagaagactgggatcttttcttaggtagagaactaccgtatctatgatactatagtgatatactactttctctgttctaaaatataattatttatagctgcacacttggacaaatatttatcgcatagcctaaactaaatgtattctttttagacatatgtgatatatttcaacttctccaggtgtatatgtaaaaattgttttattttggaaaagaactatatatgtgggtgttggagtatttcatgtgttctcacttggttaaaaagaactttgatatataaaatgataagatagagttggagaatgcttctaatcaaccgtccgggcggaaggaaaaaatcgaacgcttcttaggctaagagaacagtagggatatgggtgtaggtgcatgcaatcagatttaggaaagatgtccatattgattgaaaattcaaatgttttttctctctgactatttatccaaactacgaataaattttatcatttgattcgctacaactaaatcttcgtaacacgatctcacatcactctgtgctgatgactttttttaacgtctttttttgtgttgcactcagtgttattgtgatgtttcaacaaatattggttcatatttcacatagttatttgcaatgttgtacgtggtgtttttctatgttctagcaagatctcatatgattatattttagataaaaaaaagtttttatatacacgcgcgcgcgcacacacactgtgtgtgtgcagtgtgtgtgcgcgtgcgtgcgtgtatttaagcaggtgcaattggatgtttcacgtgtaagaaaaaaacatttcaaatgaaatttcactttgtaactaattttaagttttttcttgcaacattttactcatagtatcaatgttttttgaaagaggctcatagcattatttagatgtttcaatagatattttctggtgtttcactaattctttataactgttgcacacaatatacttgttgaaacattcaaatacaacatgtaaaacattcgcaaataaagtaatgaaatatcataacatatttattgatttcgcgtgtaacattaaaacaacatctattttattaaaaacataaattacgcaacatagtcaaattctaactgaaatatttacttcttacacgtgaaacattaaattttaatgattgaaacatatatcatttttcaattatgatataatcgtgcgagattttgttgtaaaaatttaattatagcgaatacaacgatataatcagaatgacaaatggataaatggtttggaaaataaatcatctcaaaggttactagtatcgtattaatcaatgcaagcacatcatatagtatcatcacgtagcaattatgtgattagcttgttgatgtagtacactggtagcgtccaatattttgcattatgtgattagcttgctgatgtagtacattggtagcatcccatattttacattgcatgggatgtctgggcggtagtctcctctaaagttaggtggtatattggtttcacgccttctcaaattttggtactccctccgtttcaaaatatttgacactgttgacttttcagtacgtgtttgaccattcgtcttatttaaattttaagtaattatttattcttttcatatcatttgattcattgttaaatatactttcatgtacacatatagttttacatatttcacaaacttttttgaataagacgaacggtcaaacatgtgctaaaaagtcaacggtgtcaaacattttgaaatggagggagtataattttacgatgagtcaaaagttttatagcaacaaaactaaatactctctccttcctaaattgagcatcatatatgtttatgcaccaagactaagaataatttcaatcacatcaatcatgacaccatgcacatattctcccacaattaatacatcgattaaaacgccatgccaattactccctctgtcccaaaaaactaacttctagagtttgaattttgtcccataaaaaaacaacttctaccatactacctaccctcagcacgtaaaatgagaagttttatcccttcaataccctttaactacatatcactcttactacttttttcaataatgaagggcattttagttattctccatatccactaatttcacctcgggatgctaggaatgtatttttttttgggacggagggagtataccttagcatgcgtacattctcccatactgtattaattatattctgatgaaatctatgtccacgcggttatatgatgataaatttgagaaattttaaatttcattatatgatgatcaatttgggaagagggagtaataagattggatcgggaccagtgtgtttggtttgtcagtggatccaccaaatttaataaagtggtgggctgtattggctctaccgtctaccacgaggccactggtaccacatccatggaccatcatgcatgggccatgaaaatctatggcccattttcccccgcgcttctccgttcttcggcccacataaacacactggcggcccgcgcgcacggcgcaccgcgagccctcgcaaagcaaagcatggcctcgctcgctcgctcgcccgcgcctccagcgattgtcgtcgagacgtctcgccgtctcgcgatgaagcgaaaggctttttgtccgctgcgcggctgcgcgcgggcgtcggtttcagccgcggtgtcgccgcgcgcgccgcggccggccggtgtgtcggtgcgcggccggatttttccggctcataaaaccccggggttggctatcagctacgtcgtcgtcgccgaggcgatgattgatgtcgggtgtcacgattgatcagcctcagctatagttctcccatcgactctgcagtgtcatcactcgtcagctctcctctcctcctgcccgtttgatgtaagtgtaagtacgtactcggggacgaccgtgacgcgctgccgaatgccactcccaactcccgctagctaggtacgttggtgggtcactctccatccgccctagcgcacttcatttcatttcatttcctctgccttctcttcgctttcgttggatcatctcgtctgtactatactgtacggcgtgagaaaattgcccacgtacgtacctgtatctcatgaagactcttgctctcgtaatttatggtactcgcacaaagtttgaatgaacggcatgtgtctccgttgaaacgcgaacaggtacgctagtgtcgttgtggggatggaaggcaggcagggcaaatactctgtttttttatacattgttgattcttcaaaaggcatgcaaaaacgatcgatcgactgtattgtaaagctttgatgcataaatgttgtttcgacaatgacaaatgatactaagcggatgtatacatataaaagtggccttttattctgcacagattcagaattgggggggggggggggggagggggggaagacgcgctgactcgataagcttacactgttacaattgctaatccgatactaattacttcggcgaggtgcgccgttgccgttgcgtctgtagctctcatggcgccgccgtgcgtgcgttctcccgcgacaagctagcgtacacgctcactgggggttgcacggtgatttcgcgtcacacgtcgacggtgcagtccgccgcctgcgcgaacttgagcgagacggtggcgttgccgccggcgccgccgcccgccgtggcgctcatggcgaaggcgccgccgacgttgccgccgctggcggcgagcagggccgggcacgtgacgaagaggtggtagccgccggagacccagctgccgaccttccacttgacgcggccgtccaccttgacgtgcagcagcacgtagcccgccgcgatgtcctgcctcatggcgtccgccacgtactgccccacgggcaccgactcgccggacatcaccggcgaccacaccgacacgtccttgtgcccctggtagatcgccggcagctccaccggcaccgtgatcggctcctccctgtacgtcgtgaacacgtgcagcgtcttgtagtacacccccaccctgtcgttcgggttcctcgacgcgatcgtcacctacacgcacacacagaagcaaacgatttttcagtccccccaagaacaagaacaaactgtacaatttttagccagaatttgattaacctggaggttgagggagatggcagggtcggagaggtcgatgttgcggagctggacgtcctggaggtagaaagaaggcttggaggggtgaatcgcgaggtagatgacgagcacgatgaagccgacgaggacggcgagcgtgaggatgcaggcggcgatggagccgcagcaccgccggaggatccagtcgcggtggtgcttgtccttgcccatctcgccggcggccgggccagaaacccaactagctaataatcaactgtgtacagtgcgttgtagtggagcgtgagcgtgagtgtgtgtgtgatactgaggactgtgtgcgtgtgagtagaaggaaagtgtgctgcgaggagtgggggtggccttttattaaaaggtcctaactcctaagcttgataggaggacaggtaagtgtggtggtgcgtgtttcaaaggggattttaatttcttttgggtgtagggaggtgacgaaagctacagctcaactcaccgagattcttctgcttcttctttcccctggacccccttgcactgttgcacaggaggctgccctgtgtattagtgtaccactagtaattaagtacataactccatcaacttagcttaaattgagattggtttgtcgagcacacatgagccaggcagactggtgtccctctggagctctgctgcttgaggatcactccatctccagatggtcaacaggagatgattaccattgcggttggtgttttgcatgtgcacgttgaggctgagttgacctgcggctatggtacccacaacccagtagtagtgcccaccattttacccctgtccactgaactaatattaatctccttcatgtacgcagtacattctcctacactagtattactgatcaggataggatatccagatgataaacgattcacaacatatataacaacaatcagcagcgttacgtgtacgtgtgcgggcgatcaatcatcaatggcactccatacacatggcgtggtcggtggcgcgcgcgcgcgtggctggcgccggagacgggccaaactgccaatctggctagggattacgcgcgcgatctcacccatgtcgatctgagcggcctcgaacggcggcctccgcgaccatcacccgagggccgaggagagcgtcgatcggtgcacggccactacatcacatcgcccgtgcgccgcgccgtccatcgatcgatcgcctcacgcacgcgagatagtacgccggttggtggagcgtagcacgcgagaggcaggccggccgttccggcgtcgcctcaggcgaacagggccaaagaaaaccccacccaaaataaagaaaatatggcagccatcatcagcagatcagctgcacaagcggacgcgcgcatgacgcgcccgccgcgtgcagaggcgtgtgcgtccatccggcatcgtgccggtgcccttcattccttatccccctcctccaccgactgcggtgccctgtgccctatggcagcatctgttccagaagcaccatgctacctgctacgaccctgtctcttaactaatcatcaacgatcatttgcctcctcccgtgaattatcagcgtccagaacgatcttgcacacgccactgcctcgcccaaaaaagaagcttttttttccaatacatacagtggcttgatctggtcatcaatcatcatacaccggatatgcatactactatataccatttctatccattattctaaaaaaaatgaatactactagaccggaaaaaaaactgtagacatttttctttctgttgctgttggataaatttgtggaatatttgcttttatgtagcagagtagcaggatcgctgtcttacagtatattcaaatcaggctttcggataaaaagcgccgacgagaaaagttgtggaagggcttgaagagcttttgtgtcatttgatccatttccatgtagtgttctgagtcaggatggctagcatagtgcgatcgaggtcgtctcttttgacaaaaaaggggggaatttagcatgtaatcaatctcaatagttaaacatgcgcattgcaaaagaagtgagggtaatttactttcatctcttccataaaggatggggaaagagactctaaaagggggctgcaaaaaggatggttattcacacaaacttagcctggaagtaaaatgaaaaatatgactgttctacgcagacacgtcgaacctactaaggtttggaactagtgatgcacacatgcacccaaatcactctagagtaatcaatcagacacttcagatatagcaattgccaggtcatataaaagaactttgtttctattagcaattttgcaacgggttcggcacacaataattcacacgcacacattgcagaacagatccacagatgcaggcaccatgcaaaaatacaagcatacaggatgtaagtagtacatacggccagggaccattgggacttcgaagtacagagcttagctagaagacggtcgacctaataccctgctgtgcttatatcagaaaaaatggaggcaagtgcaccatcctgcccgttcttggacatgtcacctaccatccgatcttctttgttccgtttggtgcatccggtagcagtagcaaattggaggcaagtgaagcacgcatgcgattcacggttggtgtgtaaagtagtagtagtactatatacctaaggagaattattgacgtgtccctgtttttctccgctattttgctcgggaaaaggtagggttgggtcaccatatgtgctataactaatcgttccaagtagtgctagtaactgaagtgagaaatgctgtattagtatataagtgaggagcgtctgtcgcggtggacttctgtgacgtgagatgatcggttactctattttggtcgaaacatgtcctagaaagtttcaaattctattataacttattaaagaaatagaaaaaatagccttcacgttcgctctcacggcctagaaattctcatattaatcagagaaaaaaaacagagtctatatagaaatataatctatgaatagttgaaattcagaattaaaaaataagagatattggaagaggagaccagagcccatgttgttatacaatttagaactaatggaaattcagaattaaataagaaaactaaaatttgtttagaattaatatagaaataaaatttggaataactaaaattcggaattaaaataatatagagtacagagttcatatagaaatacaatttagaaataactgaaattttgagttaaaaaataaataatattagcagaaaagtgtcagcgttatggataccacatacctaatagtagtcgactaaatctcggcaggacccaccacataccatgtcttatacggaaacaacatgtggatataggaggagtttcggataaggaaatacaaccagagttctacatggaaacgacaaggactactcggattgtatccataatggtttccctagttctacttggacaaggagacacctatgggtataaatacaaggccccctaggaggagaggggacacactcaacatagacggaacaacagaagccacaagacaacatacgccaagaaaaaatgctggatatcgacttcatggataagcacggctagtcccctacggtgtctccggatactgtcaggagagacgaaagcgctatctctgatctcgccgggcacggattcgaggaggaagactaccctgttgttgactacgagtagactttcataccgccaagtcgacaacagttagatagactaccccaaatattgtactggtgtgattatggtgaataagagcaataccggcttcggccaacaggatatagggttattacctaacaattcaggggcccgaacctgtataaaaatcctcgtctctatctcttttacctcagtctcgcgcatatactagtaccaacgatccccatactatgcaaataccggaatcgcgacatcaaacgtcgacaaaaagtataaggtccatatagaaacacaattaagaaaaataactgaaattcagaattaaaaataaataatattagaagaaaagtgtagagtccatatagaaatataattaataaataatagaaatttagaattaaaaaaaggaatattataagaagatatagagtccctataggaatttagaattaactaaaatcaggaataaaaataataaaaattaaaagtagagtttagattccatataaaaatataatttacaaataactaaaattcaaaattaaaaaaatatgggaagaatagcctagagtctatatacgaatacaatctagaaggaactaaaattcgaaataaaaaaataaaaaacattgaaagatgagtttagagtccacatagaaatacaattagaaataataaaaattcaaaattaaaaataaataatattagaagaagtgcctagagtctatatagaaataaattttacaaataacgaagatttgaaattaaaaaataatgaatattgaaaaacaagtctagagtccatataggaatacaatttagaaataactaaaatttgatattaaaaataattaatgactatcacattggtagtttggtaaatttagtacaaaatttgaaattatgttgtcattttaatatttttaataataaattgggaatatatatatatatatgtatatatatatatatgtatatatatatgctattatatgagaaaaatataatgatactaactgcgcaatctgcgcggatcattcgatggaaaaaatagtaaaagtgggggtcttttttttttagatttttagtgacagttatgaataaagggacagtttaagaaagcccatggttcctgtacaggagtcctacgcaacttaattgggccgtaaccttggcgttgaggtgctattgggccgtaactcagatacccgagcgaagcccatgtgttattgggccgactcacgctggactagcggccggtttggccggcccgcagcccgttcacagccgagcttctgggattgtaataagttcacttatgtcccttaatttgtcgccaagttttaaattcattactgtataacaatactaatatgatgtatccctcgacttccaaaatcagtgcaaagaaggttctaaagtagtttggatggtggtttcggctgcgtggcatctacgagtggtgttgacgtgacacttcaagttaaaagaaaccataggactcacatgtcagtaactgaccggttaaaaataaaaaattatagttggacccacgtcatcacccatatgtttctcatcttctctcccttcctcctctatctctcttatggttcgagcacggcgtcgtcgctaaggagcgtgggggatgggtcccctttcttcccctcgaatctccccgtcgcctcctcctccacggccgcatggatcccaccgccaagtcaccaaatatgtgaaaagtccttctcctctctcatctccacacctcttttgttgcctgtccaccatatcgcttgctggagttacatcgccgacgccatgaactggtacactggcacgacgacggctagggatgaggcgccaccgccggtagaggagagagacgagcgaagctcacggaggtgggggaggtggccattgccgtcatcaacgaagacgaggtcggatgcatggtgtgggaagaaggactctccccaactttggccgctccatttcattccttctcagcccgacaaggtcgttcaagcctagggcggcggtggcgtgccacacgcgctccattagcctaccacgctactcccacctgctcctctcccacctcccgagccacatttgctgccatttgctcctaagcctcctagcttgtccatgacgccttctccatcctcgccgacctcctcctcctcctcgtcctgcaggacacgctctaccacgccatcgtcgacgccttcctcctcctcattgtcgcccaccagggcttccacgaggccctcctcgacctcaactaggacatcgacacgtcatccctcttccaccccttctccagtgtcgtccgcgccctcccaccgctctccgtattcttcgccgagatgaacatcctgtcctaggactggttgttgcatgacgtcatggcatcgtgcggctaggtgaccgctcaagctcgtgatgccgccaccacccaaatcctctcctactggcggccgaccgccgcgcaactcctctcccgctagttaccgactggacgagaatcagaagcaattgaaagcaaagagggtgagtactgaactgaaggaagtggggcccaccgagatagatacgtcgttggcttatgtctctttaatcgtgtgttagaagatacaaccattagtatgtaagtttagtgtcacgcgtatagtggtgtataagcgtgccattgtattttgtaaaaacatttgtggatgtgtgagtatagtgttgcatatacgtgtacgcgcgtgtaatgggaaaaagaaaaaaaaggtcacttcctgtcaaatgtgtgaagaagaagggtactcgtactcgttaaatccagaaccatctgcagacgcaaactgcaaaagcacaagcggcgaaccgcgaagctaggccgtacgtccactgggcatccacgcaagcatattcccactcggatacgcgggccccacatcatttcaaagttcaaaccgccccgtgccaagtcaccacccccaccacaggtcaagattgacagggaccacatcccacgtggcagcatcccactcctctgacacctcggtcccacctgtcagtatcacacgcttcccaccttctctttccccccaagcctctcacaccgtcgtcgtcgtcgtcgtcctcgtcttcctcttccccaccaccatctcccgcctccactcgcctcctctacgcgtctctagaattcaaaccctagccaaccaggtcatgggcggagagaggccgccgccgatcagcggcggcggcgccttcgcgttcatctccaaggggtggcgcgaggtgcgggactcggcgagtgccgacctgaggcagatgcgggcgcgcgccgaccgggagctggagcacctcctcgcgtcggcgtcggcgctcgcgggcccgccgctgccgccggtcgcggcgggggcgcccatcgcggaggtggagttcgtgcggaagcggatccagcccaagatcatggagctgcggaggcagtactcgtcgacggtgcgcgacgcggggtgggcccccaaggccgccggggccagcctccgcgtcgacctctcggggattacggcgatccgcaacgccattgtggccgaggggggcggcggcggcggcggcggcgggaggtgggggctcgtgcggtggaagggccacgcggacgacgaggggaggaaggagtgggaggtggtgaggatgatacgcagcgggctgaaggagttcgagcgccggagcttgtcgagtgaggtgtttggtggatttcgtggccgcggcgagttcgtggagaaattcaagttgagcttggtaattcgaaagttccatcttaaatcatgatatgctcctacttggttaggacgataaacctttccacttgcttaggtacattttctgtaagttactgataaatgaatggagcaattgagtcttacacattagtagaactttggcatccatgaaaaggaatctaagggagttacatattgattgatacatgttccaatgcttcatcaaatagaaggattgtgtatttgcaaaaaataagtaacatggcattgctccatttttgttcatatattgtttaatattttgtctaactctatatgactaatccatcatttaaaaatattgaaatgcttccctgaaataaagtacttttaaggactgccaaaaagtagcaattccagttgctcataaagccatatcatttacatcaggtgacaactgacggcctgatgcattttttgcagaattatgcttttgagaacactaagtgtattatatgatcatcaatttttgtgtgttaagtggagcactgattcatgtttctcattttgttgcagaaatctctgaacaaagagtcacaagaatccaaggtaatgtcagaacaaactaagcataactgttggaaatcttctgctatttagggcaaatagttagtaacttcagatgaagaaatgcttctggatcactttcctaattaacttgaatttggtttacttgattttattttttcgctgcctagttcagtccagctagattctcagaacatttatgctctactattttgcaaaatgcaacatattagattaacctttaaactttcagttgtttcagaacatttttcgttatagccagttgtaggtcagaattagatgcttatcgctttgtaatggcatagtgaaatactgaaattgtaacaatgactacttgagttatatggcggttgaatttctttaagtccaagttttaagattcttagacactgcattattgagtataactaaatcatatcttttaataaagcatttttccgaaagcagttgattataatgataatgcaatcttcattgttatgtcatcttattaatttcacagagtgcgtgttttctaaactgaatatttgcatacaatccaggaggttctcccactggatcttactgaaattctggcatatcttgtgcggcaatctggaccatttctggaccaacttggtattagaagaggtacggcgtgttttatttgcctgcactttcccaactcttgtcactttggtgctgaccatcgttaaatctttctatattatgcagatttatgtgacaaaattgtggagacattgtacagtaaacacaatggccggctcatttatcattctctttcagctgatagatctttaattggaaatgagaacatgactgatgagcttgatctgagaatagcaagggtgctagaaagtactgggcatcacacagaggaaagtttttggaaggatcatgcaaagtacaagctctcggacaaccggcggcatgttgcaattgtcacaacagcaagtcttccatggatgactgggacagcaatcaatccattattccgtgctgcgtatctagcaagaagtacaaaacagaaggtgacactggtggttccttggctctgtaagtcagatcaagagctagtttaccccaataatatcaccttcagttcaccagaagaacaagaaaattacataaggaactggctacaggaaagacttggctttgaagcaaattttaagatatcattttatcctggcaaggtaaaaatccaattatcatctgattttgatgtattcaaccatacattattcttccccaatgatttaatttctttatttaaaatttcatgctatacagttttcgaaggagcgacgtagtattattcctgctggagatacttcacaattcatttcctcgagtgaagctgatatagcaattttggaagaaccagagcatctcaactggtatcatcatggaaagcgttggaccgacaagtttaaacatgtcattggtgtagttcacacaaattacctagagtatatcaagagagagaagaatggagctcttcaagctttccttgttaagcatatcaacaactgggtgactagagcatactgtcataaggtattgtgtttgcttgtctcgtgtaaaagccctgattgctagggtgaaacttataatgggtgcatgcaggttttacgtctttctgcagcaactcaagatctacctaggtctgttgtctgcaacgttcatggtgtaaatccaaagttcctcaaggttggtgaaaaaatagcagctgataaggagcatgggcagcagagctttacaaagggagcatatttccttgggaagatggtttgggctaaaggatatagagaacttatagatttgttatccaaacacaaaagtgacttggagggctttaatgtagatgtatatgggaatggtgaggactcacaagcagtgcagatggctgctaggaaattgaatttgagcctcaattttttcaaaggaagggaccatgcagattcttcgcttcatgggtgagtatcattttagcaagctgctaaaatgaaccctcattctctggcttatcatttactatttattgacaatggccttttttcttttcttaattttaggtataaggttttcattaatccaagtgtcagtgatgttctatgcacagcgacagctgaggctcttgcaatggggaaatttgttatctgtgcagatcatccatcaaacgaatttttcaagtcattccccaactgcttaacatacaaaacttccgaagaatttgttgcccgagtgaaagaggccatggctagtgaaccttcacctttgacccctgagcaaaggtacagtttgtcatgggaggcagcaactgaaagattcatggagtactcagagcttgacaaagttctgaataacaaaattggttattctggacaagatgggaagagaagtaaagtgagaaagatacctttacttcctagactttcagaagttgtggatgggggactggcctttgctcatcactgcttaactggcaatgagatcctcagattggcgacaggagcaattcccggtacacgtgactatgataaacagcaatgcatggatttgaatttattgcctccccaagttcaacaccctgtatatggctggtgatgtcaagacgcttttattaaactaatatatatatagttgaaggatgttctcattaggtatgtgcctattaagtgttatgcagttcacacactgactagatcctgtacttctgcagtgtccttttagggtctgtatggaattaattttgtttagactctttgcttgtaaatactacatccatttttgttacccaaataggttaggtgtattaatggcagtatgcgtgtatgatgtttccttttttctgacataaacgaatttaatgaaagttaagtcctggagtttaaattctttttgtgtgccttttgtttttgcctatcctatctgtgataaaaaaaattgaacaggcaatttcattttgtgctaggaagtcgcacccagcttacaaattgtcttaatatggtttctaatccttaaatgtctcagattatagataacaaaaatgtcattagtttctcaaagacatgtagacttggttccttttaatagttttaatgtcaatggtttctcatatttatatacttcatactggatgagcaccaaggacataaaagaaaagcttaattatgacactacgaaaaagaataatagatggcaacatctaaaagtagaactaacatgggattaagaataagccaccaactccggcaccattaaaataagtgcttggtctccaattggcaatgttttgtttttgtttttttgtaatccattaatccttcactgttcataaggaggtttattatagtaatttactttgcataaggggctgggatgctttgcttcactgcagtcggtttggtgatgattgttgattagtaggtattattccaattatgtgtagttcaaattgttgtatttctgctatattcatggtaacaaaatggtaacatgggaaggataaagaaccttgcttgttatattacctcttcttgatccctaaagtagcacacagttggaacatattagttatgacttgttatctccatttcaaaattctgtcctcaaaggtaagtccgtaccttttcccatgcaacttggttcccagtagtggttgacagtgcaaaagatcaactaactaatcgctccatctatcaccaatcactgttatccaataacttgtggttgatgatgatttgcatctatggagtcgggtcaactttatcacctataagcggatcatcttccaattcagctgtttatcttacttctacaagaatatctttactatattaaaaggagttggaggtgagaatgtgctctaccccattccacactccacaaggcttttgtggccacatatatgagtttattgatgtacttgcatatatataggctgtttattgatctcatgtagtattgtatatacaattttgtaatttaaagataattattttttacatgccatgtaaatctatgttacatttatttgcatttgtcacaatgcgtggacactatgcaatttgtcctacttaaaaacaggtgttggtggtgattatagcaggctttatgctcatcttctgtgttcatctatgtatagaggtgtatgccatctgtaggatgttttaaaataactgcaccgtatacgtatacatacgtagatagctggttggtatggttttatttagttttggatttgaatatgtgacgtgtatgaatctgaaaactgtatgagctcacgggcctgtgctgtaatatttggcaaaaatgattaaagaaaggacagtcttattttactagataaatatcaccattaaaatatgtttgttatatcaatatcacattttttctgcttcaatagtttctgaaaaaaaatctgttactttaccatcacaaattttgaaatgatctgaatggatattgtgaaaccataattgtcgtccagttattttctttggcgcagcaacacatagggagcggttcactcattccccaaaaataagaagaaaactgttcatttatatttagctgcttataagtagtctttgttgtacggaaggctgcaacgttttatttttacagttcagcatcataattacttctagcatcgaagaattagtcacttgctaatactcctacacaataaaattgcaggccgtactagtttgtcccatttggtgttgatgctctcgacgtagtcagtttgtcaactcatgatgttgatagccacttctttctgagatttttcagggactttgaagcaggcaagtcgtgccaggttatcgacagattctgcaattttctttacttgtgtaaccaagtctgaaagaagtgatgcagtaactgccacatgcatcacttgcagcagagctttatcctctgatagctcgctcctgagtgttttggcagctttgatggctgcagacatggaggttgtagatggtacggtcattgttcgaagtgctgccgagagctctctgagtgcctgagcagagtgtgagctcatctcactgcatgctgttcgtactttgaaggacagctcaggattggcttcaggatactgtcatcagggaaaggtacgagctattggtcaataaactgggttccagtgtctagatcatgaaaattattatgatttgtaggttgtaagtacctgagattttgtgagtgtgatgacataggaagccatagcctccatggaagaagcgcactggcgagaaagagctccaatcttctggtattggctccatgggtgtttgaaactgaattttccatgaccaggctcccatctggcaaagttgcactgcagttttgggaataatgtcacattgcatcattttcaccaccttgcttgaagatgtctgtaggacttcgcctctcggcacggggtatgtatatatataactgcatagtatgcttaccagagagtcttcagtggccttcgaattaagtatgctcttgtacgcttggagaaaggctttgccctccaaactctcactcgtagcgctttctccaaagcattcggtttccattcctgcattcatgtataaaagtttaggccccactctggaattaatctgcctgtagcatattacttctatagctctatgtgagtaacaagtttactattagtaatttaatacatgatatagttgtaattctgccttcagttgtattgtgcacaagcagggcatagttaattagaaacataagtgaaaccagaataacatgaaagggcacactattcttctgtgacatatcggccacaagctgccatttcagcttgcagcagtgcgtacgcaccttcaaggaagtcggccagcttgtcgaggttgccggcggcgagcttgtggaggtcctcgccggcccagacgggcatgacgaagatggtggtgcagaggcaggtggcgacgccgacgacgatggtggagaagcgctggtgcgcgagctggatgagctcctctacccggtagctcgacacggccaccaggctgaaggtcaggatgaagatggtcaccccgtagtcgtacctcgcctttatctccggtatgaaccgcgagaacgtcgccgccgacgctgccatcaacaaattaacatgaatgccactggtaagtacatgctactagctacctactgcttctctcctcgtctaaaaaagttagtgcatgacaacatatgaactattatagccatcgtttcgccggtatatttataaaagaaaagtaatttatgaataaaacttttatataagtatttttggtgatctaagagcaaatgctgaaaaataaactacaatgaaaaaactttaaaatcagtacaaatttaatgttgaaaatttaaattttagctgataagtataaacataaacgaaaagataagaccctaaacattgaatagtcaatgaagaacaacaaacacacatgcatgcatgcatacacacatacctagtaggaagacgaagacggcgaggagtatgggctctccctgtgcgccgcaccggttagccacctgatgcgccccgacggcgatgaacccagccaccagcgtcgcgaaggccctgttcaaccctttgctcagcgtgccacctgtcgcgtacgtacgtacgtacgtccaaaacacaaacacgtcactgagatatgtactaatagcgtactgcgtacgtagttacgtacgtagagcgtggtaggtaccaaggatatatagctagcgtatatatatcgtcgcctagctacgacgatacgtacgcccgcgtgtatacatatacgtatcgtcatctgcggcaacgacgactttctggggatggaattttgtccctcaacctcatttatccaaagctactattttttttttattttgacaaatagattgatatagtatatattacttcacaaacatataagattaaattcgatttctacaaattataaaagtaaattaaactctaatcagtatacatacatttgtaattctttttttacaatttgtataaatcaaatttaagcgtgtttataacttatgtatcatatactaaggatcaacttatcacattttctcaagaatgttttgtaactattcaagtgatgatgatcagtaagaaactcaatgagtaagaaactcaataaggccttgctcggtttagagaggattgaagggaattagagaggattgaggggaataattccacaccatcataggtgtagaataaatctccttcaactcctccctcaaagggattaaccgaataaggcctcaacgagaatactttcccccgtgagaccccgacgtacttggcatgcattagcgctagctagcttggtacacagagaaaattacataccgacggtgtactccatgacgacgacgacggtgagcacggcccagagcgtggagaccccgaaccccttgaaaagcggcgtcacgtagtagagcacggacaccagcgtcagcgccagcccgaccttgagcgagtgcgccaccctcctcgggtcgtccgccgcgatcccgcccaccttcctcgccagcccgcccacccacctcccggccacctccaccgccgctcgcacccgcgcccagcatccatccacccaccccccgccgacgacgacgaccacttggccgccgttctccgccgccgccgccgccgccggcgtcgtctccacggcagcagattgcatgatcgccttgaagtacgatgataagttatcgatcgagctagctatagctagtgatcgatgtagctaattagtatatatagctagcgccgcgtacgtacgtctttgagctgggggcttgatagatggagtagatagctacaagtgaagcacgggagacgatggctgggtgcaggggagaggggacgcttatatagacgtgctcgcgcgctccggtgcagagaacgcgcgggccagctgcatacatgcatgagcgcgcgcggcgcctttttgcagacaggatcaacaactttttcggagaatgacttgggatattgttgttgttgctgctgtttcattttattttactccatccgtttcagtttacatgacgttttgactttggtcaaagtcaatctattttaagtttgacgaactttatagaaaaaagtagtaatatctacaacatcaccatagttttattaaatctataattgaataaattttcataatatatttgtcttggttaaaaatattactacttttctctacaaaattatttaaatttagagtagtttaattttaaccaaagttaaaacgtcttataacctaaaacggagggagtatttattatcgagaactgagatatatattgtgctacgtttgttgtttctcgtttcgactcgtcttcgtttagttgctctcgttgtcgttgatatgccatcggtattgccagctcatgatcatgtcactggtccgaggaaatgtgaagtactcctactagactattttggccgggttaagtttaattagccttgtatcactgggtacaaatcaacaattgttggtttgttttatttgtggtatatataatctcataattaacatttgctatagtacagtagctctcaacacatcagttgtaattgtgcacctttatgacttgtacattcacttggaaacattgttgttggttgaggtagaatgcaacttgtcctttgccttacaaatatatgggtgcggctttatacttagctgactcatggcctgtaaataaattaagcaagctacatctttccactctctgacttttttttaatgaaccgaccaagtcgagccgtactgaagcatttttcacaaaaagaagcactttttttggcatttgtgataagtaaagcaactcttatgcatcatttgaaaacagaaaaaaaaagggggatcgatgacctttttgtatgtgctccatttcatgtccgtagtctctctactacgtaccatcactagtggctatcaagatgtggcctgacttatcaataaaaatttctgaaatttaggtggatctcaacccatagcttatcacattgaattccataaaagcttcgatctagtccaagcacgcacttctatttcctgacagcacgaaatttatgagctttttgttcaatgcatgtggacaaattgttaatcgttgtcatcctttagtcaaaactctttttctccaccgttcagagctgaccaccactaactacaaaacccactattactgtttacttgcttctgtaccacgtaatttccgtagcattcagagctctcatgaattctgtgagcagacacagtggcagtcgtactcccaggtgatccacagtatttgcagacgttgatcagtggttcagagttcagactttactgtctgtctgcctgtcgctagctacgtatgtacaggcacagctcatacagcaatacatatacttgactactgcaaatatgcaattgagtggttcttcattttcctgcaatattcttggtatatatacgttaacgttacgtactcagctagcagctagaatcaaattcattccaagtgaagtagtgaacccaaagtacaatccatctatccatccatcgcccaaaaggctcagctttatttcttttttttttttgaaaagaaggctcagctttatttcatcaagaacacgatatgatacgcatatatacatgaaatggctgagtacacacatgcacaaagctagctagctagcacagagtgatctgaatcttggtgccgatcgattcacaggcaggagagcaacgctacgccgcttatttcgcctttaaattcttctctccctgtccaatcctctctctgtaaatattcgcgccttatcctgctgcataatgcaatcgccaacctcaatatgtacagtatcaaagccacgaaatctagctctcgcgttgtactagaaatgagtcggataacaacagcatcgatatgattcagagaacaaagaagggaacatgtgaataactgtttcgtcagtaaaaccggaacggcacagcatagcataatccagagaatatgtgctcatatgctgcttccagaggttctccctctagtgctagctcttgcattgctagcctgtggcctctgtggatccctgaaatcccactagtagcctacatgtctaaaggaaaatcattaccacattatctctcgaccattcagtcgtaaaatttccgctaaagcgaaggacagataactctgaattaatgtaaagcatcgtttctgccttgcatgtgccgttgccaaaatgcatggagctagctagggtagtgaccctagatcatagtcatatagatgcaatatatatgtggtgacaatttgtaatgggattacagtcaaaaaaaaattgtaatgggattatggaaggtgctgcgaagctgaagaaaaatgggtttagtgggattgcctttgtcgtcaggaaaaaaaagaaccttttggacactggtagatcgatagtggtgttctcagacttaattaagctttagcatcatttgatcacgccgtcatggtatgtatgacttctctttgcactttattttgcactttaatttcgcactcgtcctgtcgaccaccgtacatctctgtcctgtgaagttggtcgtactacgtacttctaggaccatttttctttgtggcagaattaattgagaattctgcactatcaagtatcaactagctgaccttcttgctcatgcttgtctctttctacctgttgcttcattgatcttctagttgggagcgtctctgctttcttcagggagaagagcgttaattgtatcaattaaggatttgagctgaaaaaagaagggtttttctcgagtctgacggctgcatttggcgtttgttaggtcaggatgaggttagtacaaatataccatggcatcatgaagtgtactttggaaaaagaaaatgacgatctagggggatcaaaggacgaactagatgccatgatcattctcctcccctgatttttcttatccgggcgaaaaaaattaaagccgaaatcgccgtcgaattttgtgtctgtgtttcataccaagaatcgcgcagctttaattaatttgcctgttcttgcaaccgcactagctagcgtgtagcgatcgacgagaaccgtgagtggtacggaaaacacacaacttgaccggaaaaaaagaagaactcaaattaaaggtgtccgacaagaacacgtcgcaattggactccacttataattttctcatcgatcgccaccagacagacgccacaggccggagagctggattatattcatgacagggtattcgaattctatctctctctctctctctctctctctctctctcaaaattcagtcacatttcacctttcaatcctccagatcgatcgatcgagctttgttggatcgatcggtgcatgcgatatatacgagcataatatcgatcgatcggcccaatttccttgcagcaggatcgagttaaacagtagaaaggacacgcacaggctaatagaaggcttcgatcgataccacactgcaggaacaacaagttggtaaagagaaacagtttactgctgccatcggcagccacaggcgtcacgtccttggtgagttggtgtacgtctgaatcgagcttgttgcaagcatgcttgcagtgctagcttgcggcagatcttgggcaagtagctagcacaatcgatcgatcagtaagtgaccgaccgatcgagatcgacgtcgaccggaaacatagaggcgaggctacacagccacctcatccagggaatagaacagattttgcctcttttgctgcgatacttgtgagcagctgatgagctcgttgggaataaaggcgaccgcggttttcgaggcagcaaaaccggcctgcaggtttctggagatgcgagaatcgagatcaggttcgtgtcgtgtatgtatgtgctacgtacaaaggtgatcgatcagaagctagaaaaggagacgatatatatgatcaaaatagtcaagcacgatgatgagaaccatatctgcatgagtgcatgggcacggcatggacaaacggagtctaaacattggatggcgtaatatttagacttagtggaggtacaatatagcagactattagctaactacaaacatattataatgagataaaagatgagagagaagagcatcgggctacagatctgtagctagctgcagcacggactccaaagcgcagtgtgtgtatgacaggtgggaccatatattaatagtatagtaagcaactattatatgaattaactattagattggctatagatgaattggagctaatagtgggctatactattaaacttgctcttagggtgtgttcggaacccctggttcccaacactaagtgctcgcaccgaaaacggagcaacgattagcgggtgattaattaagcatttgctttttttcaaaaatggattaaattgattttttaagcaactttcgtatagaaactttttacaaaaacgcaccgtttacccgtttgaaaagcgtgcacgcggaaaacgagggagatgggttgggaagaggggctgccgaacacagccttagacaccccatggacggatttctctgggctgtgcttgtgtacatattttaggctattcccaacccaatgactaggatgatgtccatagcattaaataaactgtcacctagaatgaagaatgatgtggcaagtgaataaatgaggaaagagaaggaaaccatgtcttgtatgagacatggtttctacacaacattcaagatattatgtgagataaatagcattaaatttaagtatggaataatggtgtttgcattaaaagagtaatatctagtactagtttcttaataatggaaagtttatgaaaactatatctagtgtcttggattaggaatgaccttatatatgtttcctagctagatactcctcccgttcccatgttgctagtactagtataaagcagtacggacatgcatggtgtcatggtggtgtatcgtgcgtacatgtgcatcttggtcttggcgaggctcatctgccgctggaatggatgcatccatcgaccatcggcgccggcggcgtggtccagattgtcggccacacgtacgtacgtgtttatttcggagacggtacctcgtacaagttgaaggatcgtaaagtgcgctctgtgtaaaatgcatgcaccctttcttttttttttttagcacgaggtgtcatgtggtacacttacaccaacatgaaccgtgacatctggttgatcacttgatcgatacatggatatacagctagtgcctagtcacgcatgcatcgagtagtagtgcaatttttttttcctttttaacgagcgcagtgcagtcttcggcggtgagggttgagaaccctttcaaagataaagtatagagacctaactcttaaactgggtttgtcaaaaagttaacgatgttattatatactccctccgtattttaatatatgacaccgttgacttttttatcaatgtttaaccattcgttttattacaaatttttgtgcaaatatgaaaatatttatgtcatacttaaagtatatttgatgacgaatcaagtcacaataaaataaataataattacataaattttttgaataagacgaatggtcaaacgtttaattaaaaatcaacggtgtcatatgtagtattaaaataggctttggtagcgcaaacacgttaacaccatgcccctttttttcccctagtctttactcccttcgttctcatttactttttctttttttaccacaaattgtttgtagatacttgtcacaacacgaattctaatataaaaattttaattttatacccttgtaattaattaaaaaaattcacccccatccactcactcatgttgcttgtttgttctacagtttttttttcttcctcatttttaaaatatacgacgtttttttacttctcgcataatgctttactattcgtcttattaaaaattagtataaatacgtaaaagtattagtgaagattatatatcatctgatgataaaacaaatcataacgaaataaatgaaattcatgcaaactttttaaataaaaagaatggtcaaacggctcaaatattatgcgaaaagttaatagcgtcatacattttaaaatgaagggagcatatactagcttaaatataattaacacactttggggttgtttagaatgtagccaaaataaaccttatcatactaaaattttatcaagtttggtaatattaccaaaattttgacaggattcgttatgtatttagcaaagtttggcaacaaaataaatatagatacttttttaacttaaaaaaaatatggttgaaaataacattaatctgaacagccccttcatcaacaataggaaaaagtacgaattatacccccgaactatcgcggtcgtccgaattaccccccgaaccacaaaaccagacattcttcacccccaactatgaataccggacgaattacccccctcgactcaatccgcggtggttttggtctacgtggcgtacacgtggcagtccagtcagcattctatttataaaaaaattgtggtccccacctgtcatacacaactctctcttctctctcacacacactctctctcacttctctatctctcactcttcctctctatccctctctctcacggggtcagcggtggcgggggacacggagcggcggcggcgcgtggcacggaggccgcggcggtggtggctgccgggaggcggaggcggtagcagccgacgcgtggaggagcggcggcggacggcggcgtcgcggcgacggccgagcggaggaggagggcggc

SEQ ID NO: 63100 - DNA, 2893 bp, Oryza sativa
cattaaacacctaagttcccgggacttgctgagtacgaaagtactcacccttgctctataaatatatatgtagttcctccggcctgaagagaagatatagtgaagtgaagattagggtttcgtcctggttcccagccgtcgcctgtggtgttgggtgttagtccgttggttccgctgctgctgctgttgttggtgtttcctcgtccgtgtcgtcggttgtattctcgggctgtctgagctgcaacctaagttaaggtaaataagtcctctatttatattaaggattgctatgattcatatttgtcaccgtgggtaccagcactatgtcctgggactggtaccgagatcgcggtttcgtaggaagcggttcgcgccgtttttcctacgacacgctcctatcaggtgccgttgtacggcggtatcagattggggtgtgacaagagatggtatcagagcataggttggccctaggatcgaaacccctgaataggatggcattatctgaatacaaaaactatttgtgaaagctaaggtgtcgttgtcccctttagctctagttttgcgaaaaatcttttgtgtccaaaagtaaaagctagtcgttcgttttgacttttatcctagagtaaacctatcttcacgcccagttgaagaaaggtgtgctcaagcctttaggagtcttagttaagcccttgttggtaggctaaccttagtaccgccacccgctcggtaggagttgtggtgaactagtgcgtgtgtgagttttgtttggtagtccgtgttcaggtgttaaaccaattgggttaccggctggaacacaccacctatgtcttctgtgatttcaaaaaccgtttagatgtagggttttgattcccctcttttttaatcaatttctgggtgggcagatctcagcccttaaaagcagatgggacgtgttccacccgtaagatccgtgcccctaaccgctttggttttgaggaagagccagtccagccagaaattcccgatcaaccagttaaccaggcagatgagcaagaagctgagagtgatcatatggctgtttccggatcagttaatgatgtctcaagaggtaaccgacccccgccagtggactttcaccaacacatggccatgcaaacacatataatacaaggaatggttcagaatataattgctatgcaacaacaacacacacaagagcgtcaaccccatatggttcaagatgatggccaatcgaaactgaatgatttcttgggatctcgtccaccggagttctcccaaacaaatgagcctattgaagctgatgattggattaaagatatggaaaggaaattaaatctggtacagtgtactccgcaagagaaaaccctttacgccgcacatcagttaagaggacctgccgcagattggtgggataactactgtgctacccatacagatgctagtaccatcgtctggacagagtttgcaggagcctttcgctcagcacacatccctgaaagcataattgatttgaagaaggaagaatttgcaaatatcaagcaaggatcctcttgcatcaacgagtatttgagtcgcttcaatagattggcccgatatgccccagaagatgtagacactgataaaaagaagatcagaaaatttttaaaaggaatggacgcgaaactgcaagtgaaacttttggctcacgactttccgacgtttcagcaaatggtcgataagtccttgttactagaagatgcagaagaagagatgcaggaatacaagagacgcaaagtaatgtccctagagattcaagcaaaagaaggtttgtgtcgaaaaacaaacttgccagcacaatactatcagagagcatctcagcattcaaatggttccggttctacgtctcgttcgactatgtcagaacctggtcagcaagccacaatgatcaacagtaatagccatgaaggaagcaactccgtaccatgccctacaccttcaaaaagacgtggttataaggcaggagtcgaatgtttcatctgccatgagatgggacactattcgtgggattgccctcagaaagccaagataaagtgccttcacaaagtcaagacaaagccagtccaaccaacgacaattcttcccaacatacctggatcaaaaggctcgaagtcaccaaacagtggttctgcctcattgacctcactgcccgttggacaaggtcgtctgaaccatgtgcaagtagaaacaaatgaaaaggttgtgaatctcgagcaagttgaaggagcaggagaagaacaggttccacaggcaagagcaaagccacagtaagatgaagaatgctaagtgaatcaagttaccagaccgttttgtggcaagtacgcaacaataagttgaagaaagactagcagagtctgaagctgtgaagaagtctgaagatcccttttggtttcgtgtgtgtggtccaccttcgaatctcggggtcgagattcttgtaaggggggtggatctgtaacgctccgtttttcgtgagtcgtaaaaaaaactaatttggcaaaatcctaattgcgaaaattttcgttctttgtgtgcgagtctaagttgtgccaagatctcaattcaaatcccgttgttccctctcatcgaaatcaaaatcctccgccttaaatctgctatgccaattcaagtctccgttatctaaatccgaaagtcaatcccttcctttgaatcctcgccaaatacatttccaaatcccaaaatgtccaaacccccgttttgtttcctttccttgactccaccctatgttcccgagaacaaatacccaagttttccttttgaatctttcccatgacttctccttgaattccccttgatacatccctaaaccctcgagttcgaatatcaaatttgaattcga

SEQ ID NO: 63101 - DNA, 1011 bp, Oryza sativa
caggaaatatttttttgggaatacacgagacacacattttttattaagaggaataaatgtatttacagagcgggcctgaaaaccaaaaagaaggggacagggtacaggagaggggaaaagaaaagcataagcctaatctcccgaatgatttggcgacccaagaacaaacgaatggactgtcatggttggtatggctgatctagccatccgccagaggtccacttccccatcatagccctagctatcttcatccaaggtctgctcttctggttgaagacccgattgttcttttccttccagattgtccacgctaccagtgttgcaattgtgtcgaaccctcggcgatgatccttaatcatccttttgcgactgtcacacagccaggcatgaaaggactgctcgttgagaggtagacattcggaatgaccgatagcactaagagcaatccaccaaagctgtcgggactccgggcatgcgaccaggagatgatcaatcgtttcgtcgcgttgatcgcagaggggggcaatgatccgggaaatatgaggagagtctatatgatagcaccataggaaacaaacaaagcataggaaagtttccaagaggttggacctcttgcttatttcctatgaaattgagctataggaatgcaatcatatgaaaaatttcctatacttttatgtgaatcaatgggtttcataggaaaaattccttaggaaattgaatactccaaaattcctatggcaatcctccaatttaagggtcctaaaagttttcaaattcttagatatttttgaacaccaggatgtgtatctcttgttttgacgacacgtgtgtcgtactacctccattttcatttactcatcacttttgattgtgaatatatgtcactacgcacttaaatatgtgattcctcttttgcccttggtgagcctaattaaggtcatatatgtgcggcatatgtatttataaacctctagattctatatcccactaagttaggggtattttgat

SEQ ID NO: 63102 - DNA, 848 bp, Oryza sativa
  unsure (1)..(848): unsure at all n locations
gtgaaatatgctgaaaattgtcttgttatattccaactattgttaaaaggtgtncatagagttaagggcttcttctcgtccncccccccccccaaggagntttgttgtttgacaaccactnggnacccaacgaatgnnntccatatttggcggcaagcctccatcaatttgattctgcgacatcttcaaaaacgtggtccttcgaaaatgttgtagagaaccagcctggaaatgcatcatggattccagcatttggtcatagcaaggtcaagaatatcgacttgtgattgaagccatgagggaaatgagggacccatcgaagatgatgcaaagtatgccttctctaatctgaagggaggtaaccattcaggatccactacaagtctccaagtcattataacacaaatgttttgacttcaagctcgttagattggcaaagtgctcctctgtgatgacaccatccaggcaattggtaatggaggtacaagtttgtcaaatttgtgagcatacctatctcagaaggcacttgtccagtaatgttattattaaaagaggtcaagagtgactaaacttggtagcctccctaccaattttggtaaattcccagtcaaattgttattagccaaatgaagttccttcagttttttgggtgaacactgtggtaaactctcaaatatttttttgaaatctctccatatgccagtctataaatcaaggtcaagaaactttcccattggcacagaattcttcaagtttcgccttcatgaaggcacatgtttacctttctctcgaaaacactcatggttggcccagaaaatcaagaaactcggagggacaataatgttttc

SEQ ID NO: 63103 - DNA, 528 bp, Oryza sativa
tctacccaaatcaaagtgtcgcattgctcatcctcctaacaaaaaaatagtactattatttagacatgcatgactaaattaacagaaaatctaagtatcaatgaactagtaaaaagtacaacaaaccaaacctcaggaaggcaaccaagaaatctccttccggtgtcagttccttcccatgcagtcctcctttttggtcacatgccatgtctgcacttcgaatttgtgccatgttcctccctgcaatactcatcatcgatgtataaaggaacattcaacaataggccaaacctgtcctgctatatcggaaacaaaaggattaaaccaaatagcgggacttacccacctgagctataacccatactagaaaatacgcgcgccgtttggcgtgcttaatatctaaaccgttggttactttgtgtatgtataaaacatgatttataaatgttggtttttagtatgtgagcatgaagaataagtttaacataggcttatatatatcggaaaatagttatatataaaaaaata

SEQ ID NO: 63104 - DNA, 652 bp, Oryza sativa
gtgtgagtcttccttcaaggctggtaccgatggtgatggagggaaaggctgactaaggtgctagatctagagcttcgattggcagcttgtgctgtttgccaatccatcgtgctgctcgtcaatattgtgtgtaggtacactgtgcagcgtgtaattctcgcttgataccgataggtgccaagtctgatactcgtggtatcatggctggtatgcacagatatcaggcatggtacctcgggcaccgataccatcttataaccattggtgcctgatcagtaggacactcgccatcgctgcttggctggctggcgaaccgtttcccactaatgtcttttctccattcaacgcctctccttggctctggtctttccttccctagtgttgctgtggctagcgttgccatgtgtgtcgacacctcctagcatcctaggcattggcgccgatgcattcgcctcaccatgctcctccgtcgaccaatggttctgctcaaggtgtgagccatgagcacgtggcgtggggtgggacggagtcgtagacttgcgaggataaagcggaggtgcggatgacatcaccttcgtaaagtatcatgtcgaatgggcggaatgccgtcccctagcaatcatcatttattaaggcataacaaacaaggcaa

SEQ ID NO: 63105 - DNA, 2687 bp, Oryza sativa
acaagtggaaaaccctttggtcatctagagaaccaacagtgatgtggctttgaatgaatgtggattatcttcagtactctttcatatgggttaattattattaggagttttgttgtaattatgcccaaagacaaatgattgtgctataactatcactactagcaaatgtggtagtttgtgtctgatgacttttgctacagataatattaatgaacatgattttcactaatcatagacaaacgccaattatgcatctgtttgagctgtccacaggcggcgcgccactggcgcgccccagcctctagtaaatatcatggctagtgtagtgggcaccttatccaaacaatgcataaaaagatagcttgaacttgcagctaaattgttcctttattccacttcttttttttattctcccaacagtggactacgcatatctgggccacgttgattttttttttccgaaaacggccacgttgattcggtggtccaatttaatgcacttgcgagcaactaattccgttccataaaaataaaccgatataaaaataaatctattataggatatgactatcatttaaattaagttgtgctaatatgatcctaatgtttccgctgtcattttaatttatttcatgcttacaagtcaatcaaactacagtatatatgttcaagtcaaacaacaaaagaaagctagatcaatctgtgcactcatgcacagcacagcagtagcaaagcttcaaactaactgtaatatctattacatgctaaaagtccattgaacatcctacaaacaattctaggctgtcacgtggtattccaataaatactcttaaatcgtcatatggcactataataaaccaatggaaccattacattcaactactaaatttatctctttaggaaaaaaaacttaacgaaatgatttaacgggagcctcaaggcccacctcgcttgctcccccgaacatagggtctgtttagttcgcgaaaagaaattttttgggtatcacatcagacgtttgaccggatgtcggaaggagtttccggacacgaatgaaaaaaactaatttcatagctcgcctggaaaccgcgagacgaatttattaagcctaattaatctgtcatcagcacatgtggattactgtagaactttatggctaatcatggactaattaggctcaaaagattcgtctcgcgatttccatgcaaactgtgtaattagttttttaatctatatttaatacttcatgcatgtgtccaaagattagatttaatatttttgagcagaattttttggaaggccgtagtaatgcacgtagggctgaaagaaaagctcgggctcgtgagctcagcctgggcttggctcgagctcgaatgccaaaggagccaagcccacgcctccttttcagctcgttgctgaaatgagccaagcccgagctagctcgtgagccactggtttggctcatgagcctaggctatcatgtatttatatggatcattttattttatagtgaagttattatttgtaattatgcaatttatcatttataatttgaagaattgaatatataaacttattttagttatacatgtcgacgatttattcttgatcatctacaaattatatatgaagagatgcttcaatgggaaggctcgcaagccagctcgatctggcttgagccaggaaacgagccgagccgagctcatgttttagctcgtttctctaaccaagccgagccaagccaagcctagtttgttgcgagccagtgcaagccaagcctagtttgttgcgagccagtgcaagccaagcctcgtgtccacccctgcacgcccggcgcctcaggtctccaagctcaacctcttccgatctctttctgttcctattcttttatgttaccaaattaaaagcaagaaaagctataattttagtattaagctgagcataattttaaatgtacatatctaatttctgttctatctaaattgctcctgtatttataattaaattgacaattttagatccaatgttttgctatacataagtaatatgtcattgtgatcttctttacgtccgcttttctcagaggcattcggatgggcgatttccggtgatcttcaatggtgactccggcaccactgggagggtggaatttctctcccggcgatgcaatctgtgatgaaacttggcatcgtttccgaccgccggttcatttctcctctaagttcagctcggttcctttccggttagtggtggatctacctcgctcaaatttttgtttaacaacttcttcggtggccttagccctcagggctgtgattggtggttcgcctgctgatctctctgtttcccttctcaaagatcgttctttctcttttttttgtttgctccaaacaagcgggtttatggatttatcgtttgagatcttacatttgcaatgattttgttctgtgcttctttctttggagaaatggtggaccaaattggcagtgggaatttgatgtttggagtcgtgaacaagagaaagaatggatttttgtggctcgtaagaaacgtgtttctgattctttgaggcaaccttgtcgttcttatgctcaagctactcagcagcgggttattcctaggaagagtgtttttgatagattaaaggagtccttgaaggtgactggcggtgatactctggcgatcac

SEQ ID NO: 63106 - DNA, 1854 bp, Oryza sativa
gtcattagtaaatgtttattgtaacaccacattatcaaatcatggcgtaattaaactcaaaagattcatctcgcgatttacatgtaaactgtgcagttggttttctttttcatccacatttaatgcttcatgcatgtgtccaaacatttgatgtgacggaaaagttgaaagtttgaagaaaaaagtttgaatctaaacacggccaccatgctcaactgcaatgtgttcggcacccaattttcccaacacttcttcctcgttttccacgtgcacgctttttaaactgctaaacggtgcgtttttttgtaaaacatttctatacgaaagttgcttaaaaaatcaaattgatccatttttagaaaaaaatagctaatacttaattaatcacgcgttaatgcaagcatcgttttgcgtgcatgggaggaggggttcctaactggaaaaaaaattagctaatacttaattaatcgcgttagtactacttgattttacaaagtgatgcagaactttgtcctggaaactgttgtggaagcttcagtactgcacaaatgctgcaccttttacatgtgtatatgtgttgcagacttgcagcagacgtgtaacgtgtttatactttatacttgcgattttgccagaagaaacatagtgtggattgtattattgtaagtttgtaacagaggaacatgttactcactataaattttgtttgccagaggttatggaaaattttaaatttaccatgttcaagggaggtgctaaacaaaatcttaagttttcagttaaaatgatcttttttttaagatacaaacttcacaaacagctcaatggataacagtgaaacattcaaactggataaagattaaacagtcaaacaggtacgtttgaatatcatcttttttaaaaatatttttttcttgatcaatgcagaatcaggttcacatctgaaacagtaaaatctaatcgaacggcctaaaaattgcagcttacactcagtaatttacagatgaactaataaggcctgacagccccagcccgtaatgattttcattatatatatatatatatatatattacgatagtttacacatccgaagtatgccaagaaaagcggtggcaatggcaatggcaattacgacgccgatgcaacacacgaacataacatatatcggcgttgaatgcggcggcagttacctggttggatcgcttcatggcggcggcctcggatcgcttgtcgaggttggcggtgaagcggaaccgccgcttggggttcttgacgacgccgaccaacctgcgccatcgccccagatcctcgtacgacgagtgcttcgccttcaccccgccgaaattctccttcaggtagctctccattgcgcctcttcaacctttcccttacaattgggtcccaatccaacgacccccttctccgatcttcttcccaacgccaacccaaaccctttctatatagccaacgcgggcattggtttctttcgcgaagaaacgcgtcaactcgcacaatggcgttcgtgaaggcgactctctgacggcaacttcagcgcaattttttttgtggggaaagtgttcggctggtcggaatcatgggagtttatgcgtagtttcctgtgtttttttagtaagtgaccggacggatgcgagtaggaggaggagggagcagcagcgggaggggatgcgtgcatgcatgatcgagagcatggaggggcagctcctctctcgaagttggttcgctactgacaatgcgccggcaattcaggggtcaaaactcgaaacgagtcttggggggcaacttttcaagacattccatgcagctatgctgcacgtacgtacatgcgtaggaga

SEQ ID NO: 63107 - DNA, 3366 bp, Oryza sativa
  unsure (1)..(3366): unsure at all n locations
ttggtttgttgagtccatcctcccgtctcctcctcgctggttccattcctgcaaatgcataattaagcaacccagccactgtttttcctagtacatatatagagacaggccggccgggccatccactcacgtgtgtaggaaattaaacggcgaaaaacattggatgcactcagctaggacaggggcacagggctttgatgtaagtttgtactacaacttaaagaggatacagttgatccagacactgcggagaggtacaggacaacaacaggatatgtgtgagccacacatcccacacaggatggatgaacagttggatgataacttgatcgcaatccgtcccatttccaataatgttctcattccaaccaatcttacttatatcatttttttccagatttacaaaaataaaaaccctgagacagacaactactgcctctgttgtaaatcaatctatgtacaggacgatatctagccaaacttttaaagcgttcaacaatttatagcttcttaagtgcttaatttaaataagcaaaaatatgggtagatttggctaaaaaagtacgtacattgtatttttagagagaagaccttgcggcccggtttatattgaaagccacattacgtcatacggtagagttggtaatgggggttgccagtttacaaaagatgaacaacttaaccaagtgactcaacgagtttggagaaacaccatgcgatcatcatgcaacagggataaaacctgcagctctaaagtagcaagcacctgatgtctcttagatctattacaaaacaggaataatacagaacattagcagaggtataggctacccaacccctgttcttcggatcttcaaagcggttgtcacatttttcaacttctctgcaaccatttccatctccacaacatccttagtgtgacaaagggctctccgcagcaaaagagagatgattcgaaaaggtaggatcagtggagagtacaacggcttggatctggaaatcatattatttctagtggtccataataaccagcaaacaaccacaaatacagcagtaaaaactctagattcaacttggttagaattgttaattagcaaaaagaactcatcaaaatctcttgttccccacccaaaagaatctctacaaatgcaccaagttaaagaggccatgaggtaggtaaaaagaatgtgggtggtcgatacaagtgccccacctattgacaaaattctgagcactcccagttttttttaattcttctacacactgcattttcacatctctcacacctctaaaggccattgcttcatagagtgactttgtggtgtatagtttattagctgataatcctcagatcatgaggtctggtgaattgactagtacaatctcttcaattatatatgtgacatcatactttctatgtcttcaaaagatcttataaaagataaacaactagcactctttgttaccaactttgagattgtgatgtctcgttggttacaaatctaaaaaatctttgggtatgtggtcttaagggggcaaggatcatgccagaaccatatatgtcttccatcctctagaagccactatgaccctagtttcatccattttctggtattcagaattctttctcgaattgtgatcccttttgaccattacattgggaaactcctctatcctaaagatattttttttctcaacaactcaacacacagactattgtatgaggactcaattttcataactcatttggccgatagaacagtgttcagcattctagttttagtcaagccaatacccccaaagtcttttgggaaagccaaatctgtccacctcaccatgtggtattttccgccctgtttgttaccagctagtaatacctcgccataataacttttgatgtaatccctcgaaaacagaaggtacttgtaatatcataaagtattagttttataagtttactttaatataaaatttatggtcaaagtttaaaaagtttggtaagaacttatctagtcaaatatttatggttggcggaagtaaaagaaatggtgcgcattagagaaattacagagcaagtttaacctttatggtgtaaacgtatgtactccactatacagtggaaaataaaaaagacatttcttacaataaaaaatataacgacataaatagatagtcccttcgactatttgagcgatggtagagagggccatggaactaaatattccacttgactagagcccgatcgagaggaacagaaagaagggaaataggagctatggtaagctgcagggtgtgtgtcaccggggccagcggctacatcgcgacctgcctcgtcaagaagctcttggaacgaggctgcatcgtccatggaacattgagaaatcttggtacgtacaacgtactccgatccatctctagctagccagctagagacctctcccaatcactccctgtttccaattgttggagatatggagataatatatctgacaggagatgagaagaaggcggcgccgttgagagagctccccggcgcggcggagcggctggtgctgttcgaggcggacatgtacgacgccgacaccttcgagccggccatcgncggctgcgagttcgtctttctcctcgccaccccgttttagcatgaacccagcagcaaggtatacgtagtcacaagctcgatcgaacacgcagaaaaaaatatcaatgtcatgtcatcatgtgtacgtgggtatttgttgattttgcagtacaagaacaccgccgaggcggccgtggacgcgatgcgcatcatcttgaagcaatgcgagcgatcaaagacggtgaagcgcgtcatccacactgcctccgtcaccgccgcctcgccgctccgggaggacggcggcgaggggtacaaggacttcatcaacgagtcctgctggactccactcggccagtctcacccatacagcagcgacatgtcggctataaatcaagtaatcaaccagcaaaaaaaaaggttatttttaaataattttttttaaaaaacaacaagatatatattgtgataacataagttagtacaacaaattagccctacacttaaagaaagaaaataacaaattttcatttacagtgtatttttttgttattttagtttctccgactgcagatacacgttggaagaatgtgtgcttaaattgctcctaggtgtactaatatcaatgtccatcaactaatggggtgtttagattcaggggtcaaaagttctagcgtgtcacattgggtattatatagggtgttgcatggggtgttcgggcactaataaaaaaactaattacagtatccgtcaataaaccgcggacgaatttattaagcctaattgag

SEQ ID NO: 63108 - DNA, 2626 bp, Oryza sativa
  unsure (1)..(2626): unsure at all n locations
atcttacttattctgttaataatcagagaagacaaggacacaggaaaatgtgggtagagcaccgaatcccatttatcctcgcgaagtattttagccggaatccaggtccagcggtcaacgtcgccgtccgacgcaaatgggaccgcgctcgagaggaacgcgcaccgcgtcttctccgcggggcgcggggaggcggaaagaaacaacgaggccaccacgcccacgcgacgcgcccacccacttctctttcgtgtcgtgcctcgtgcgttcaacgagccggtcgttcccccgcggtggtgtgcctccctccgcacggtcgtaggcccagaccaaacggcggaacgggaggtccgcgacatatggaataagttcattttagatatctcgtccacacgtcgagtttgaatactgtcatgaacctcgataccagatatagggagagtaccagatcgattagcgtccctaagtggtttcgatgacgggttcatcctaagtggcggcctatgtgacattttagttaggaaaaataaaaaaaggtggtggccctaacatgttagtgacacacccatctcccccttctctatgtgtttgtctctaccctttctatgcccttaattcagattccactgccgatgctgacggtggctggtacatagcaactcggtaatgtgtgtttggggcgggatccattggggtacttgcggtcgcgcatgcagaagaggcactggccccgataccctaacaacgtctcatcgatgatggggacgggggcaggcagccagcggcatgcatgcataggtagtgcaccactagacaagtttggcaccactcccaacgcccaaacaatatctatgtgatgatgaggacgggggtcaggtaaccggcggcatgcacggagaggcagcacgtatccatctcctcatccatcaggtggaaagtggaaccatagcaacatgtccagctctgtctctgcgtcacgcacccgccacgtcacacccttgggctctcgatgaaggtagccaaccaactgctagatctaggcatcgtgcggtgacggccaagtggagaggtcagcctaaggatgtactactctagtagatctcgtcgctagtcaactactcagtgcggtccgctctgcaattcctctccatcgccgtgccgctcggtgctcgtgtccccagccacgccagatccagtcatccggtggcacgcaggtcactgcccctctccccgaatctacactcaccccatggcctcaaggaccaaatgtgagcaggaggtgagtggatgcttcaaccctccctgcctcatgcatccatgcatccccgcctcctcttgcacccgcgcgtgcacgcgcccagccaagatggcgagcgaagctcaaatcgagcgtttccctcgggcctagctaggaaggtaggtttgcacaagtggaatcaggtccaggagcccgtgcgagaaaccaaactcgcgctccttgtgagccaacccatgtgtaggtaaccaaacacgctatgactgtatccactgcatgtggcgactcgatcgagccatcaccgcgttcggaggggggccgggcttcaggcctncccctccccctcctcatcctgggaaggcctatattcgaaactccaaggcgagctaactacacagccacaggcatctataccctgtacggcaaatctgagagacaatcaggaaacaattacaaggtgtcaatgacgacatagtacaccagttcctgtctccttttcctcggggagtgttttagcggaacataatcttttgcagtcgactgcgccgtgcctttattattgacatgtggatctgatgatctccggattcacatgttagtgataaagtcacggtgcactcaaatgttgaggatctcaatcctgttttagcaggactctcaaggtccagggtcaacgtcatggcgacgatatgcgaaggagtactgaaggaccgcgcttttgataggaacgtgcaccgcgtcttctccgcggggaaggtggtggaaacgacgagaccacccaccactgcgctgcacggtctgcacccccacgcgcacacgttgcgtgttctggacttcccgtcgttctctgcgatgggaaaagccggaaagtgaacggcgcatcacggtgacgggcctccactccgcacggtgtgccgggaccaacccgagcgcctcgcagcgaggctcggtccaaccaacgggtggcttgagtcgttcgtgcatcgtgcattggaataagtccactttgactcccttaaaagtgacccgaatctaatccgtgaccctcaaccataaaaccaaataagcgactccccgaactattcaaaccagtgcaatttgactccctcattggttttggacggcggttttactgacgtggcgctgatgtggcgatgttgacttggtttgtggtactgacgtggcgcttaggtagcattagaattaaaaactatatgggcctatttgtcattcacacaaaaagtaattataggacccacatgtcatccctatgaccctatctatccttctttctcctccctctctcccttgagatttgaaaactttcagctcgagatttgaaaattttcatgtctaaatttgaaaaattta

SEQ ID NO: 63109 - DNA, 1148 bp, Oryza sativa
caaatggttacacgagttcattttaagcagaagtcgggggctactatcagggttacgggttaggcataccctttacccttcgatatacgttacatatcgatatggcatacccacgcgcatgtagatatttcctgtatattctaaggaaacctttcacagaatctacagatgggaagaatcctactcgggcagaaccaggtcgttggcgtatcgtatagggtctgatacctccgagttctatgaggaaatctccacatctgcgatataaaaggggccccccggggagggtttagacatcgaatctcagagccaacacaacctccacagcctacgaagccggagcttacgaggagccaagtcatcgagagctagtcgaatcaactcgactacaatctcgccggatccgacaagttcccttgttctctttgtaacctgtgttttctaccatataattccacatcaactggactagggctattacctatcaaggggtctgaaccagtataattcttgtcttttgtttgcttgatgtcgtactacgtagatccttgtatcaacgtaccccaataccctctatatccggtctacgggtatcacccgtcgacaaatctatgatccgatcacaccgttgtattcgttgtaattaaatctttacaacaagatatcgcatgattatattttgataaaagaaaaacatatgtttcaatctgttaatacttattgtttcacatgtgacagcgacatgttacaatgtgtatcttcaccatgtttcataaaatatttaaatgtttcaattgctgttttttttgtttcaccatatataacttaatatttcacttgttggtcaacgctctcccccgcactgtcgtgcgcccgcgttgctcccgtgccgcgttgcttgcctgtcctgcatgtgttgcttgcgttgctgcttgcatactccctctccctctccctctccctctccctcctattacatgtgcctaattttttcctcaaattttaaatatttttctccaaaattatatatctgatctaagtttcaattataccattagatttttgcacaaatacttaattatgttgaaatatttttaaatagacgctacaaatcatacgtgggtaccgagctcgaattcgccctatag

SEQ ID NO: 63110 - DNA, 2177 bp, Oryza sativa
agatggtccccttttctttttcttttttcctttattttctcccgaatcaagtaggcaaatcccaaatcaatccccaaatcaaagtaacatcccaaattcacatcatcatatccacatcccaaatcataaagttacttatacaaacaaatcaaatacatcataatatcctaaaaaattactcaaatacaacacagatctaaacaatgaatcacaaatatgtacatctcagtgaatcacaaatttgaaaaaaaaaagaaaaaacaatgtcgctgccgccgctcgccacgactgccgggcgcccccctccccccagcgcctgccgggaaggaggggggaggaggaaggggaggaaggggaggagttgaaggagagcggatgtggaagagagttagagaggatagatctgaggagagggggagatattcgtctgcccaagttgtaactgtggaggagaggataagtgatagggattatatactacgtgttcaattttagtcccggttggtattaccaaccggtataccaaccgggactgaagatcctcggcctcctgaaatacatctgacaagggatgaaccgggactaaagatcaaaatttttataaccgggactaaaaactatctttagtctcggttctttttggaaccgggactattgtggattttgccagaccgatcaaagatggtttctccaccagtgtaatttaatttgtgggcgttgcttagagaagggtcattctttgtctgtttgtgttgggccctttcggtgccgaatttgtaagagttcgggtcatgcggcctgtttctgtagctcaaagaaatctccctctgagggtaaattgccaaagtctgtttctaccccccccctcgcattaatgcagatgctacggtcctaaactcccggggtaattgcaatcttgtttggagacctaaaaagctagcgctggttatctcgtagccttctcgccttctccaatctactgttgagaatattgttcaagcctccccagcccaaagttccttgccaatggcggacctcaaccctaaccctcatcgtttcctcaatcaaggtcacattgtgcatttgggaggaaatttgcgtgtccctagagttgatctcaccatccctcaaaggcatgttcgtcattatgaagagttttgtgttgctttggtggagccgccggtgtcggagcaagattgggatcaccaccgcatgctgattcttcatcacattcttgatgagcatctttttgaggtcagaaacagctaccgtcatgcttctgcggtgggtatgtatcaactccgttctgctatgcatagagatgccctggtccatagtgagccatttgtttatgatggagtgctttcggtaacttttgtgaagcatgatcaaggcccaaattggagagcatctcagtgccatagagagggttggttccttttcttggttttcccccttgactttgttgattggtaccatctaaaccttgctacggctacatttggccaactttctttttggcttgaaagggatcagatcaaggggagagttctgataagggctaagtttaaggataatgattttgtgcctcgaaaaattgttttgcatgatccggtgggtatgggcggaggaggagaatcatggacagtttccgtgtttttgttggaaggggatttcattaacatggctcctgatgaagatctgccccctgcgggccctcaaccaaatcctaatggtccagatgatgatgatgatcctaatgtgggcaacatttggcagatggggcagcctcctgctggtccaggtgacttggatgatttggtccaacagcagcaagctgcaaaggctgaggtagaggatgcttggggccaagactatccaatgggccaagtaatggaggtaaatcctaatggtctgcttgctttggtacctattgtttcagaggatgctagcgcttctgttcctgctattgctgtacgtaatagggggaaaaaggatcaggacccagtccaagacccgaagtccagaaattcttagcttacttggataaactggctagaagtgaatatcctagacaccattatttttatccaatgtctggcctgaatgagaagattgacctcttgtgtaaagaaaagggaaccatgcaccaatttcttgcttctagttttgttctt

SEQ ID NO: 63111 - DNA, 87552 bp, Oryza sativa
  unsure (1)..(87552): unsure at all n locations
attacttctctgtgtttacaaagtacaacaataacaacacttcttacgaaaatctcgactaaactcgaaaccctaacttttctctaaactcaactctctcaaaatcgatatcggaaggctacacctaccctctctatttatatccgaggtaagcaacctaaaaccacgaatcaacgttgtacaagaagtcctaatcccctagaaaaccttcccatacaaaaaaacgaaccttacaaactccaactgtaccaaatatagactccctccaatttcgaccctgcatccattacgcacacaatatctctatcatataccatataaaatcttcaccaaccacgtgcattgatctttagtctaagcatcccgcatgatatcctgatcttcctgacgtcatcttctcctgagttgactttggatccatcatcgacactaccctcccgaggcatcaagattcacctacacatgcatcaactaagaaaccatattcgatcacaagttctcaccaacttgactcatggtagcacacacataatatccatctagaattcataaacaataattatccacaaatacccaaataaataacccgaaactgaaaccgacaaaacgtcggccggtcagaccgcgccaccgcagactggccggtctgaccgctgtaagttcaagtgccttaatttggtttcggtgattaatgacaaatctaattatatgagactaacgtttttatgagcctttctttgactagtcttatttggatatgaaagtaaaaatgatgggaggtatgtattaaacttcacatattctaacttggtctctcttgtggatccaaaatatagtgtgagctctctcattgatcctgattgattatgtgcgtatgtgttcctttatatccatatgtatgtacacttgagggggagcttattctatattttgtttattataagatttctatcttgatttgaaaacatctttcatctcatctctctatttgtttatatcgggttattatccatcaccaaagagagaaaagattgaatgatcttggattaaacaattcgtataattgttacgttggtgatagatgataaaccgatgtttatgggattaacctctcttttgcataagttgtctactaggtcatttcccgataatgagatgtggaagacatgcattcttttgtgatggaccttaatcatgacaaggatgaaatgcatggagataaaatgatatgtaccacttcttatctcctactttttgataggttcatatatatgatttccatgttattgatatataagtgtgagactaatgtttacttgagtcttatcttatttagtctcatttacattgagaacatggagatcatgaaggtatatgttttatgttggtctacattattactacatatgccttctctttatgtgtataggataaaccccaattggtcattctctaattatgcatacacttgcatctcttgtatttatttgtatgcatatatttagggggagcaaatcctatacatttattgtgcatgttctagatccatgttgttcacctattatttatatcggatctttgcacttgagcttgcatacgagtatatgacacttgtgatgttaatgaaaactcaacgaacatatctatatctttcatatgcaaccggttggtcatcaagtgaaggatgacaaccgatttgttgagactaatgttctcctttgagatgtgaaaaggaataggtcccactacaatgaggctaatgaatgacaccatgggttaatggtcaccaagccaaggacatcgtcatgttggcaagaatgaagtcaaacttgtgatgagaataaagtcttgacaaaggatggtaaagacctcggcataaatatggttcaactggatggtcacaagtgttgatcttggctcaagcattaaccccaagttggatggcgcaaggcaaaggtataatggagctaagaatgttttcttagtcttttcccggtcttggtgtttggtgtagaccggatttgctagatagacgccgtactatcaagaggggtctatgaagcgagaatgtggatgatcttgcgccatattagttcatatgcatgtaggtgcatttggtgggcttgtctagccaagtgtggtgagtattctcaagtcctaaacaaagagagatgtgggcaaatcctataggtttgggtagcctcatgtggttatgtccggtggagtatcctttggagtgtgagccctttttccctgagaaaagttgtgtttcttggatggattgttcatgggttggatagccctttgaataagctttccatagagtccaagaacgccaaattccgagacccgtgtcaagaaatatcgccgttttactaacggttggttgtgctgaaaagtgacctgcggtctgaccgtgggccttaggacggtttgaccaggcctgttagccggtctgaccggcgtgataaggccggtctgaccggcttcaatggtctgttgcactggtctggtttatggtggcgatacagagccaccagagccgcaaccggtcagtccgagccgatgacggtctgaccgagccgtggacggtctgaccggcctctacactgcggtcagaccgaccaagttgagtgggctcaatgattgccctgtaacggctagttttctagccgttacaaagtagtccggtctgaccggcctcacaacagcggtctgatcggcggagcacagagttggggatttcggttccaacggctagttttggtggttgggggtatatatacccactccccagcagcaagggcgaggttttggcactccattacattatcttgaacccttgcaagagctctcacacccttgggcacttagtttatctagtgaggtgttagagagtgagttaagccaatccaagtgcattgtttcattgttatagctagtgtggtacttgatcatccgcggcaagcatcctagacttgttactcttggaggttgccgcctcctagacggcttgtggaggtgttgcccggtgacctctccgaggagattgtggaggaggcctggcgccagttgtgagtggtttggagttcaccaccttcggagtgaaggaagaactaccctagtgatcgaggctttggtagtcctctccgtgggccggctcccgccttgccccctttgacgaagggggcgtgcgatggcttcgtggttgagcggtggagttgggctcgcctcaacggggattaggaaaccggcaagtttccgaacctcggtgaaaattccttgtctcttgtctcctttattttgtgcaaatttactttgagcaagtttacatactagagtttatttgtgctattatcaccctaagcttgcaaacctcaacataggctagtttctttgtgcatttacttgagactagttgatttaggttttgaattgtgcaaaaccattttgatttacgcttccacatacgaaactcggttttagccaaaagtttgaaaaaccgcctattcacccccctctagtcagcctccttatcctacaaccgctcgccatactccggtctgatcggcctaccctagccggtctaaccgcaaccatcagacatgtccatgttcatcacttgataacattattcatcatcactcctatctgactggtatacatgccctggtccccccggtctgaccggtgcaaaaaaaaatcaattatcccacatgccaattaatcaagatatgatagtctaatattctagaggtttctataggggtaagatgtgtttgtgtttttataactatgagtgtacgcatattatgaacgtctgcatttgtttcgtgtttataagaaatattaaagaagcttcgccgattattctctggaattaatcactgccatgaaactgcgagacaatagctgacgaaccatcccgtgcaaatgccacaaacgcgggccactggatttccatcgacgcaaaaccaacagcatcgcgacgtaccgtccatcccaacggacgctgccatgtgggccccacttgtcatcgcctggtagcgctccccctccacgtataaaaagttttgcacacccaacctctcttcgccccttcttccatctccatcgtcttcgtcctcttccgatacctcacctcaccatacagctgctttctctctctctctccatccacccgaagcagaatccccaaaacaacagcgagagaaaaaaaattcacgcggcgaagccaaaattttttgttgatttcgatttggacataaaccctagctccaatctccccatcgccgcgtcggccccgaacccgtgcgcccccccatcgctcgctgaatcgaagggcgcctaccagtcgattcccccaagacgaggtaatccgctcgaccccctcgagagagagagagcctgggagagaaatcggtgttgttttctgctgaatcgatcgggttggcgggcgatttagggttttgggaagggtggctcgccgccctctccgaaggggactagcctgcgcgtctcgatctcgcggggagctagggttttgtgatccgagtgcgaggagggactggtgtcgccctggttctgatgagaattggcagtggaatgctcagattggctgccggcgacgacgagaggagcagctcccttggcagcggcggcggaggaggcgccagattcaccgcccccaaggtccgcacgcgcgataagggcgcgctcgtggccctctgattcgaggagggttgctggtgcgtagacgtggagccttctctgaggagagtgggagatgacgaggatcttcgtgcagcgcggggctgccggctcctcgtccagctccagccgctcggggtcacagacactgcagcagcagcagcaactgcaggcgacatcagcggttgcccgggaggaggagctgccgccgcagcctcatcagcatccatcggagctcacggcttcagacaatataactgaccatctagtggaggatgctgataacagcagtaatagtaataagccattggggctagatgatcccacatcagagagttcaagctctgcagaggagagggctgttatggagaaacctcccaaagacgactccagtgtgatcgatcctgctttcttggtggaggaattaacaggcctccagttttctgatcagtttgagcaggaaaatctagtgcagtcaggtattggtccatcacagattgctggtgcagcatcacacccaccacctccaccagctccaccagccccaccaccgaaaccatcgtctggtaataatgggttaaggagaatggggtctggaagctcaaacaatgcacggattggatcttcaagaaggccagttgcttggccaccagtggcagttcggtcatctgcttcgggttcccgaccttcttcacctagatcacttgctgatagtgaagggtataatagtgcagatgagcagggcccctgttacgcctctaattattatgattcggtatgatctcttgtctgcttctattttatatgaaaactttaatatcgtatttcctatatcagctttgccatttgtcaatgattgcatggcatgaagatgatgtctaggatgtggagataatgtcatagatcctttggaagtttggatcctttgtagttgcatgatacaataacattattccttttatcgttaatggtaggtttgtcacattcgcaaacaggcacctttttgtttttgacaacaactaatgtagtttatatttcctcaggaaagggagcgcatgtttgaacatgacctaagacgagtgagaggatttgaaatcaataagatggctgaagatgggaattgtctgtttagagcagttgcagatcaagtttatggtgatccagaagcttatgacatggctaggcagatgtgtgttgattacatggtatgtttattgttacatctatatcctttgccattaatccataaactagattcacaagcttggaggcagtgttctaacatgttaatctgttgcattcaaccttgccccttatttgttcactattggcagggctaggcagatgcgtgttgattatatggtatgttgtgtcgttgcatctgagtagtaacaccgtatattatatgtattccgtccctaggttcaattcataagccaacattaatatttggttaatatttctcattctctaccctgtcgcataatttatctcactattttatactaagttattggctctgtaagatcttggataagtttggggaagcaatatgggtagatggtggaacattactagtttgagacagcctgcagtttcgtctactgttagttagggttgaaacatagttgcaacttgcttctcctttgctggtcagggtagatattggtttctgctgttctgtttccttagaggtagcactcagctagttatacaggaattaaaatttaataatgaacttaccaagggaaaagtgctgtctgttctaccttttgacttacatattttgtgaaatgacatattaaacaattatatcgtgtgcaacaaatgtgaagccatgcctagttcattgttaatgaagcatttgattcaagttcaagtccagactcaactgtatcgtttatcgttgaactgataaacttcttggcaaggatctatttgtttgcagcatgattttcttcaccgtcttttgcccagtcatctactttcacagtttcacatggaaaaaaagagagaagttttgagggatgctcctgtctttatgccagcaggacctttttctttcctagtgttctgttttggtttctgtattttttttaatgcatctcctgtctactatgcaatcaccaggacattgcttttctagtgtctttttctgtatatttcacgcatttgggagttttctttaagaagttgaaagcatttggaagaacataccaatttgagtttgcagcatggtattaggcatgcattgaaatcgtaattactccctgtcgtctgagttacttgacacattagcaccatgtgcatagaacaaggagtataattcaaatttctgatgtgattttgattgtatacacatctcatccacaataaatcactgttcctgaaaggggcattctgtattctggaatatattgcctcgaaagcccgaagtaatccccagtttcctgaaacctgaatacctgatctattttagactatgaggtaacagtgacttcccctttgaccaagtggctgatatgctcattattgttatcaattcttccaggaaagggaacgtgatcatttctcgcagttcatgacggaaggttttacatcatattgtaggagaaaaagaagagataaggtatgctattcaatagatcctggctgtttaggatatattccaactgcttgctgcttttccttacactgagtgtcttcgaaccgttgtgctgtgcttgtgaacatcctcgtattttttttttgaaaatgttatgaaactaatgtttttcagtcagctgacttgtcttttattttaatctactatagagcatgtgcgcccctggaaagcatgtttttcagctgtttgaatcttgttttgcagatcttaatgaacgtctgcatttaatttttttaaccatttatgcttccacacaacagctgtgcattttccctgactttcagaatttcttttttttattaaaaataatgctatcatgtagatactgagcgcttgtttttcaacttcaaaataaaattaggacttaggacaaggaaaaatttagaaccttaccttcttccactgcaaataatttatgttgacatgcttgattctcaaggtatatgggaacaatatggagatccaggcatttgctgagatgtacaatcgtccgattcacatatattcctatagtacaggtaactgtaacacatatgttgctataggattttaacccttctctgtagttgcataaactctttcatagtctcatattgtttgctcttactgcagagcccattaacatttttcaaggaagctacaatacagatgtccctccaattaggctaagttaccatcatggtaatcattacaattcggtggttgatcctcgtgggctgacagtaggggcaggcctgggatttagttcccttagaggggtatgtcttggtccatggttatcattgcccttatagcctattctacagttgagtgtttgccaactggtattctttgttaataaatgaacttcatttcctttctgtacagacaaataacgttgacagggatcaggtgaaggctgcaataaaagcacagcaagatcagcagattgagaatgtaagtactggtaattgttttcaaggggtacttgccatctcaacatctgcacaaattaatcaggtttaccttgaattgttagagtataaaccgaaatatacttaattcttttcttgccggcaacatcaggcacttctggctgaaggacgactatactctgatttggagttgacagagaaggaaatagagcggatggtgatggaggcctcacgagcagagtatctaaagcagcagcaacaacaacttaacttcagagagtcatcaacatcaggggcagagccatcttcttctgctgcgagtaagcccaccattcttggcattggactacctggtagaccacatacagaaactttgataggtttgctgaaaccatcatgatttcctattctgcagttagtgggtcttctcggtcagctgggactgccgatagagttggcgaggagtgcttcgttctcccggacaccgtgctaacccgcagcatgcagctcctcctggcaatgggcttcaactacatccaggtcatggaagcctatagcatatttggcgaggacgtcgactcaatgatctactaccttgtggagatgggaggcaccggagcctctgcaggtggtagcaatcgcaggaaaggaaaagctgctgagtgatctgtgtacctttcaccggctatgacgaatcgaaataaaaatagttatgcataagccacaggagagggatggcaagactcgtggattaaatgagctgaaatgtcaatatactttccactgtatggagtgataacaaaataaaattcacttcttccatatgtggcctggcgttttcatggctgtcggcacttgtccacagatgtctacacggaaaaccctaaaacattgtactacctccgtcctatattacttgcttttttgagttttttaagtttttgtttgtcaatgtttgatcattcgtcttattcaaatttttttggaattattatttattttgtttgtcatttgctttattatcaaaagtactttacatatgacttatctttttttatatttacactaatttttcaaataaaatgagtttttgtttgtcaatgtttaatcattcgtcttattcaattttttttggaattattatttattttgtttgtcatttgctttattatcaaaattactttacatatgacttatttttttttatatttgcactaatttttcaaataaaacgagtttatgtttgtcaatatttgatcattcgtcttattcaaaattttttagaattattatttattttgtttgtcatttgctttattatcaaaaatactttacatatgacttatctttttttatatttgcactaatttttcaaataaaacgaatggttaaacgttgcaaataaaaaatcaaaaacgtcacctattatggaacggagggagtataatgcaaccaaaggttgcgaaggaagttgttgacgtcgagggattcaagcatgagttctggcagtatgccagtattaccaaacattgtataatgcaaccaaaggttgcgaaggaagttgtggacgttgagggattaacgcatgagttctagcagtatgccagtattacctgcaggctccggtctcagctagatgccataactgaaagtatttattatagctaaataacacaagatttggagggagagatgtccctctaaacagccggacgtcataactgaaagtatttatagttaattaacactgggttttgtagatttagagggagagatgtcacttcaaacattttttaaaaataaattatgaacatgttggagattgaatacagaataaaaccacacacccattgtcattgcactattaagtgtatctcaaagttgtacgcacggagagtggcgtaattctaataaccagatttatttgcacttaacagtatatttgtagttttacgcacggagagtggcgtaattctaataaccaaatttatttgcacttgacagcagaagttttgtaggtatttttgtcaagccatccatgagatttcatttgaacgaagtaattctaagtcatgagatcatctattaaaacttctcaattcaagtttctcaatataatgctcgtgtttctgaatgcctcataagatttctcaatatagtggttcataagttctctcaatgttgtgcgtgatgtaataccgatataaatagttttgcttgatctactgaatcacaaaaccatttgccatttttagcattttccatttgtattctatacagtgaacacattcctcgagcctgagcctgaatttgaacgcagcagcgcttttccaaaaaataaataaataaataaataaataaataaataaattgaacgcagcagtgccaatcaacactactgaatctgaaccgaatgaattcacaccggttacactataaaatacaagtacatttcttttaccattaccgttgctacaaacaaacaccacaataaattcagacaaaattttctgacacactttgcaaaatcggcagcctcttggcagcacacatctttcttgcaagaaagatccaacatttcagccaacgagtaatcccatcaagaagaaaacaacagtttctgaattagaatgcaatatcgaggaaatggtggttgaaacactgaaactgataaaaacacaatcactagaaccaaagccagacatcgtttgatcatgtctttttgtatcgaaaaaatattattactatttatctatttgtaaccgtatggatcatgtcattttatatgccacagatatactttgaatctttttttctaccatattttggtatagaccaaaatacccaatccacacatggaggaggagatgcatttgtaagcgacaatgtaacgttataatgcacgtgtgacaagagcaacatttctcatatgaaaagtgacaatgtaatgtcataacgtgtaacaagagcaacatttctcatatgaaaagtgacaatgcgattatgcgacgtcataatacatgtgtaagttgctatttacagagatacacactaaaatgtggttgaattggacaagatagcacgatgatagacacaacggcactcccaccgatgatgaagaggagaaggtaggcccgagattcagtgtatagtgatcagggactagatgattgccctagtcagctccggatcgatgtgcggtctcaaaggtcgatcatggacgagtgctgctaatagaaacaatgacaacgagtatcacatttggattcggattccatggagtatttggattcgaatgagcttttctccgtatcatgatgactcaacatgttgtgagaaattgtttccttagaaattttattttggaaatagaagtgcatacacgcaatttgagaaattcctaagcaattgttcctacccaccaataacggaacaacatgtgcaactctgcaattcttccatgattatcataattggaaaagacaaccgcgtacaatataacgtaattataaatagaccttccaatgaaaaaaagttgaaagaaatactacttgaaaaacaatacgattgtactatctccgtcccataataagtgtagccatgagtttccgcgtctaactttgatcgtccgtcttatttaaattttttttataatcagcatttttgttgttatgagatgataaaacatgaatagtactttacttgtgacttatgtttttaaattttttcaaaaaattttcaaataagacgaacggtcaaagttgggcgcggaaaactatgactgcacttattttgggacggaggaagtacatcgacagttttagcagatagaacaatatatacgacggatatttattgaagtaaatatttgattctagagacaagggagctgtgttaaaaaaagtagaacttacacaaacggcataattggatcaagacgactagtaacccatatagctaactacaataatgaaagcaatgagagcatactcatgacatgtgaaaaacaggccaaaaccagttccacgatacttggccaccatccctaaatattcgcggtgcaaccccgctaggagaacgaaccggatggtcaagatggcgaaccggatgaggcggcgacgacacccccggcaaaacgcagtgctatcattgttttcttcttgaatcttattcccgcctgccaccaaatctgtcttcgcttcagccttggagccggagccggaatctgcaccaccgtcctcctggagctcatggatggattgcttggagtgctccatgagttatttttcctgaaatctctcaatgctgtgaaagggataagcgaataattataaacgattgtattcttttcaaaaaaataaacaaataagcgattgtatgatatttttcactggttgctgattgcaggaggtggttctcaggtgcgatacttatagtagattaatcgaagaaacgggagtcagcatcggaagtagcttaggttcggttcggttctgtttaggactcgcgtcgcgcgccgagtttggccgctgaacgatttggccctggatgcgctgctcatcgtcatctacctgggatccacggattcacccatcgctgaagatactggagaaccccgcgccctccgtgtctacgcgtcgtggcgaagtcctgtcgatgtcgttgctccttgctcggttcgtgacctccgccgctgccattgctagatcgcgacggcctccatgtcctgtgcggcgaagaggaagcggatgcccaggaagtgcgagtaggcgcgcacgaaggcggagaatccgatcccgacgtcttgtcctggccggcgacgacgagcggttgcggaagtcggcgaggtcgaaagggacgcggcagatcgaggcgcgccgcgcgtggggcgagggtgaggtcggaccgcagccgcaagccgtgcgcgagcacgaggcgctcccctccgcgcgggcggcggtgttgaaggtcagcacctgcttctccaactgctcggctcggccatgcgggtcgcctcggcgtcgcggctctcctcccccactcatgcacgctcgactcgttcatagccggcggctggtcctcgacgttgtagatctcgtcctcctcgtacaccgcggacacgttgcacgggatcagcctgtcaatgaacattgaacaccattgttactgtgcatgaatttcagtgcggtttaacaagatgaaagcaatcaagcgcacaaaagaaacatctcggagaaattcagagttcagggaatgatatgaatttatttttacatccaccggaatggattactatgatgaattattggtcacagttttcttttgtcggaactgttaagcttaagtatataatagagtaaattgcatcggtggtacacgaacttgttaggtgaatgtaatctagtacatgaacatgtaaaatgctcgttttggtacacgaacttatattgcacgtgcgaacgatcagtcttggaaaagtactaaagattgtgagctacagcataatcagtacagatatgaacaaaaaaaaagaactattttgatgatcaaacaagttgatcagcatgacaacatgtcataattctaatggatactacaagtttatgtgctgaaacaattggtttcaaatcacatactcatacggtatgttctaaggtgtggttacagaagctatactgtcaaaaattgatgatcctaaataaactcctaacgtgatccaaaactcagactattcttaatcaaggctcagtagcgtccccgttaatccaatgcattgtgctcaataaagctaagcaaacatttagctagattcaaaaacatttcgtcagaataacatgaaacagaaaatcaaactttctgatcgtgcctatttccctattcgtccacttcatcatagcgaaatcgatgaactaacccagcgcacaattctaaagaattctcaacggtttggcgttagaagtgttcatggattaatttgcaagcagcagaagataaggttgccatgaattcctctgcacatacaactaattcagtgaatgcaaatatctagctagagaatcgtgtgaagtacatgaatgatcagattcgctgcaccaaaaccataaaacacgcgtgaattcacatgaggatgaaattaaatcttgcaacaaaaaactcgatcataataagagatcctacatcgctggccggtctgactgccacataacccacagtctaaccagccacacccggccggtaaacaacaaccgttatttcacaaaaccaatcatctattatactccgaaatctcataacaagaaactaatctttcacacatataatatcacaaaccaccaatattattaacacataaaatctaagtcactacttcattttacatacgtagacgaagagcttgctgaagatggtggcgaagaatgagaaccacataagtaggcggtgcaggatccatgaaaatattgcttgcctcgctttcttactttttttttttgaccggactcttactcttactccaacgatgcagatgtgcaaggggatacaaggaggggtttgtggctatttgcataaaggcagttgtaaaacattttattgagcaaaacagtaaaactgttgagtaattaaagtaacattaaatctccactgatcaacgctacaccacgttgaacaggcccaaccaacccacctgaactacagtgtattgggtcgatttattaagatgggactaatcacggtgaatctggtcgaccgcccataaccgcgggcacggctattcgaatagttttactctgatcagaggtgtacaactgtacccacgagacacagccccacgacacgtttccgtacgccgacatgccaccacgacataccggaaagaggccgtgacaggacccttcgcataaccccctctagccaagcacaccacacctcaggtttcaccctcgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatctcgcgaaccggtccttaactgccatgggtgcgaccagcaaaaccatgcacccatagcccaccattcagtcgcattttagttgaataattacgaccatgaagcatggccagatgtctcgagcacgcagctcactctgatactaaaaaggtctaatactgtaattatcccatcaactgagctagtggtaattaagcatggctaagcatatagttctagctaagtcatcaaagtaacacaagctaggcgatttattacccatggttgacaaaggacagatatcaagtaaacatggcacaagcgagcagataggtaaaaccctgaccccatgtgattagcaaaacatgcatatttatttgcaaacagtaaaacatttgtaaattgggatcaacatgctcaaagggaatgtgtgacttgccttgcttcttcaaacaatcttccgaactcctatccttgcgaccgtgatcttccgaaacgacggattctacacgtaggcacgcaaaacgaggaaaaaatctaataaaaaccaaggaaacagtatataaaaagtaaacaaacatgtagagctcaattttagatgaattttgcaagttgaatggctcaattcggagttcgaatgaattagatatgaattttagaagttttgagccatttatatgaatttctagaattattcacgaattattgcgcaattattatttatttttacaaaggaaaaggacctcgctgacgtcagcaaggggcggccggcgccgacatgcgggccccacacgtcagcgagtcaaagggggagggcgcacggtggacatggtccacacgtggcctcgggtgcgcctccaccacgtggacggcccagatcgacctgagccgatcgggcggccgaggggagcggcagccaggggcacaggcgcggcacgaagccggcccggccgagccaaggcgcggcggcggcggcatgcggccaccggcggcagcagccggcgacgtggaacggcggcgggcggccggaggacagcggcgcgcacggggacggcgacgcaccccaagaggcggagatcggcaagaaagggggacgggaaaaaaaaaggaagggaggagaggtcctcaccggaagcggcggccggcgcggaggaagatgacggcgacgacgattgcccgatggcggcttgcgaggacggagggcggacggggtcgcccttgaccttcagaaggagaagagggagttcgggaggggaggaccgatgcggggtgaccggtaacgacggccgaccgcgacaatatgagaaggatctcaccgacgaccgaggaaggaggagctccggcggatttccggcaaagaggggcggcgaccgaggtcctcctcgtccttgcggagctgagggaggcaacggcgcgggtcagcgtcgaccgaagcggcggcgcgacgcggctggagtcggcggcggcggcggagagaggtggttcgcgtggctacggcgctacggaggtggagaggggaaatggagcggtggccgagcttgcccgggcggcggcaaagctggcggtggcggcggcgcagcgcggagacggcggtggtggctgaggcacgcggctggagaacgctggcgagcggcggcaatggggaccggcgtggggagagcggggaaaagcgcagggagctcgggatggagtgggaaacgaaagaggggagcacgagggtgctttatatagggctcggggatggagatcgtgcccgggagaggcgggatcggctggcgacgtggggtggcgaagtggagctcgggatggcaacggttttcgcagggcgtgggggaaacggcgcggacgtgggcggcgaccgcgtccacgcatgcgcgggagagggaaccacgcgaggaaggcggcgacgtggggagcacggggtggccatggcggcggttggggcgacgggaggttggggaagaagatgacaggtggggcctcgggtcccacctgtcggggagagagagaagggaaaacgggcgagggaggtaaagcagacttgagggagagagagagccgagcgggccgagggaggaggctggcccgagagggagagaaaaggggcgcgcaggccgtgggagggaaggaagacttgggccgaaaagggcccaaagagaggaaggaggattttatttgttttctttttattttaattgatgcaatgatctttgtgctattaaaactatttctcaagctccgaaaattcacggaaaattccggagagtacattagggcacaaagaatattacaaaatattcccggccaataatttttaaaggaaattttaatttcctctataattcacttgattaagttgatttaacttttatttaatttctagaaaatgtattattaattgatttttattcccgaacgaaaatcagggcgttacactgaacaaggttggtttagtgatcaggttttggatgatctacaggggaaaacatagatgcaatcagattttccagaaaagagtaatcagagggagggaaagcagatagtcattgaggggggacagattggaaatgttgatctcaagtacagtggtgaaccaagcacagaggttcctaagggggggtctattgatgcctgacatgatggtggtggaagacaagataaagtgttcacaaatattaagagacaaagaattggcttttaagttacagtatgaagattcaactatgatacagctgaatgtttgtgaatcaaagaaatcctcaagtgaagaaggggaggtgcttggtcaggtggacaagatacagtcttctcaggaacagttatttggaggagggcagataaatgatcagatagacagcatatctagaaaagttgcagaggggatcctagaattggagatggatgaggaggataaggagaaagtttctttgaaagacagtgaagattatatggattctcaggaatcagaaggaagttttggccaagagattagatatagacttgactgaagatgtgacaggaagtcaagaataggagatgaggaggaacaaaagaccgaaggacaaggaggacaagaaaccttatgagatggccattgaaagaaaagaagcccaaaatgcttttatcaacaaaggtcagaaccagatcccttcctttatacatgattcaaatttgtctttagttgacatggctagtattctaggggtaaatcttggttgtgctgtggatgatgtagaatccaatgtgcatttgattaaagagttggacttggctagaattaacctctttatgaaagagggacaaaactctgattgccattttgatgatgtgtccaatagggagataaatcctgtgatacttgaacttaatgattctaaaaattccggagaggaggttgatgactttgaggaaattgagtttatgctcaagcaaatacaatcttcagctagaaaaatgaaacaaaaaaagggaaaccttgagattttcaaggtcactcctaaacttaagaaaaggaaaaagaaaccaaaagaattatgaaaaggcatattctggaatattagaggcatggggaacccgaaaaaatagatcatttgcaggacctaattagggattcaaatgtagactttgtgggaattcttgaaactataaagcatgatttctctgctggcttacttcatagcttaagtggacaaaaaaaaattaaaatgggaatggctactctcatgtggcaggtcaggggggattctagtgggtgtaaacatatacaagttatcatttgtaaatgttactatggagaattttcatatcaggttaaagttgtagaatatttgagacaaaaaaacatgggatctgttagtaatatatggggctgctcaaccagagcataaggctgtcttcctagctgaattggctaaggagttccaaaaatctaagggaccctttgtggctggtggagactttaacattctgaggaaagaaagtgagagaaacaaaagttgggggttataataagtggaccttcctctttaatgcaataattaagcagaacaatttgagggaggttcaaatgggaggaagacaatttacttggtgtaataaccaagataacccaactttagaaaaattggatagagtgttcatcaacaatgaatgggaatttgtttaccctctcacctctgttcaatctttggtaagagccttctctgatcacaatcccatgttgttggacactagggaattagttaaaaaaaagagtatgctcagatttgaatttagttggtttatgagagaggatctagggactttggtgcaggaagcttggaacaaatccttttcaggtaatagcattgaaaaatggcaaaagagacttagctatctaaggaggaaattaaaaggtttgaataagaattggtaaggagaatataggaggagaaaaactgaaattttgaacaaaattgatgcaattgacttaaaagctgaaaatgttggcttgagttgtagagatagagaagatagaagagcctggaattgcagctgaaattcactattagggaggaaaaaacgaagtggttccagaggagcaaagaaagggaaatcatggagggagattgtaatacctaatattaccatgccaaagctaatgtaggaagaggaaaattctgattcactctttatctcaataggaaggtatcattactgggcaagccgagcttttgacatacattactcacttttacaatgagctctttggtaatcccaaacagaataacttgtttttaaacctagaggggatcacaaaggtaagaagatgcagaaatgttaataaaacgtttcactctggaagaagtgaaacaggtagtttttgagctaaaacagaataaggctcctggtcctgatggtttccttggtgatttttatattaaattttgggatttaataaaaggtgatttactggatctggttaatgacttccatagaggtgtgctagacattgagagactaaattatgtcataattactaaagacgctgctcaaatacaaaaatttagaccaatatgtttgctgaatgttagtttcaaaatcattacaaaagtgttgatgaatagattggatagggttatggcttctatcatttcaaagaaccagaatgcttttctcaaaaataggtttatcatggaagggattgtgattctacatgaggtgttgaatacttcacacaaaaaaagcaaagtgggatcatttttaaggtagattttgagaaggcctatgacaaagaggactgggtgtttatatatagaatgcttgaagcaaaaggctttcctgatatgttgtgtgattggatcatgagagtaattaaaggaggaaaagtagcagtgagagtcaatgatgagataggtccttactttaataatcataatgggctgagacagggtgaccctctctcccctctgctattcaatttggcagctgaagcactcactacgttaatacagagagctaaaaacaacaatctgactgaaggtctgactgtcagtggtaatgaaaaggtggccatcttgcaatatgcaaatgacactattttcatgctgtctgataatttgaattatgcaaaaaaaatctaaaattcattctttgtctgtttgagcagctctctggtttgaaaataaattttaataaaagtgaggttttctgcctaggagaagcagttgagaaacaggagctttacatctagattttcacttgtaaagtactcactccgtcccacagtataagggattttgagtttttgattgcaacgtttgaccactcntcttattcaaattttttttgcanatataaaaaacgaaaagttgtgcttaaagtactatggataataaagtaagtcacaaataaaatggataggaattcaaaaaaatttgaataagacgagtggtcaaacattgcaagcaaaaattcaaaatcccttatattatgggacggagggagtaggtgatttgcttatgaaatacttgggagtgccaattgatcaaaaaaagattgcttaatagtgaccggaatgttgctgaaaataaaatggaacacagcaagacagactccaatcaattggaggaagattgattcttaatttcttatcaattcaagccttagcaatgtccctttatatatgctctcctcttaccgattgacacatgggctagagaaaaaatatactattttagaaaaagattcctatggcaagatgaacaaggatgtagaaattatttagtgcaatggcttgttgtttgttcccaaaaagatcaaggggtctgggattgctgaattttgcaaacaacgaacatagctttgttgtgcaaatggttatggaaattagaaaatgaaaatggtggtggcaagatcttattaaagccaagtagctaaaaaacaaaaccctctcaggagtatcagttaaacctggagactcttattttttgcagggcttgatggaaataaaaaatgtcttctttaaattctgcactgaaaagtaggaaatggggaaaacacccttttttggaagacagttggattggtggccgtcctctgaatatacaatttccttcattgtataacaaaattttcaaaaagaaaaagtttcagtagccatggttaaaaaggaaggttggggtataatcaaattcagaaatactttgcttggagagaagttgagagattgtaataaataagataaaatctatgtgtgagcagatgcagctgcaggttggcagctctattagggtcttgtggaatcttacgttgatgagtctttcatagttaagtctttatataaaactcttaagattcaacaaacacatttccccttttaatttatttggaaattcaaaatcctctaaagatcagattcaacaaacacatttcccctttaaatttatttggaaattcaaaattcctttaaagactagagtgtttcataatcttgttattaaaaagaaaatttttactaaggacagtttattcaaaagagggtggaaaaaaggagataaatggtgtcaattctgttacaatgagcaatcagtgcaacactttcttctgttatttggctagatttatttgcaatgtgttttgttgtgctttgagtttgaaacctaacttagcaaaaaatcagttgtttgggagctggctttctggtttcaataaaaacataaatatttgatgatggtgggtgtggctacagtcatttaggccaattggaataccagaaataaaacatgttttgagcatattttactaaatgatccaattgagatgatatatctagcatataactggattgagtgttgggctatttttgcatagaatggaagcaaatcaaagaaggatgttgttgttcagtttaagacatggctgaagggtctacacaataaggctggaggtatgaagaaaagcatttttagggtgtagtttgtttgttgtgtttacttaggccatcgttgctattttgtcctacccttttagtttcccattttctctttttttttctactatgtcatttctgataatagaaatgtgggctcttagtcctagttcaaaaaaaagtttgaaaagttcatgaattccggacatgttttgagaaatgagaagtgtcggtaggatttttgtcgggaaacttttataaacataaacggatatgataaggcttctatccgtcgaaaactttaagaaaacaaatttgaaaactttttataaacgaatttagtttttttttctcgtaatcgaaaaaaagagtatttctcatatacaaataattagcttcaaccttctttattctaaatatttagatttatactatgtattgagttacttaactaaatagatgtattattttagtcaagtactttttaatttttttcctaatgaatatttttatttttattaggacacgccatactacttataactatagttatagattaatatagttcttttttttctaataaaataaaatgtacaactagttgtattattataaattgataaaaaatagaaatattaatttattgttttaaaaaatattgagttatatctcttcgttgatttcttaggatatgctttgaaaatccctcctcttacataaaatgatatatgcattaacaaatatgattaattaagtgtaagctttttttgaaaaatagatcaatataatttttaatgcaattttcgtataaatctttttgtaaaaagaatattgttcagtagtttgaaaacgtgcgcgcaaaaaaacgaaatagatgaatgagaaagtaaaccaaaagtacttagccttatcattgttcaataacggaacaactatatataactccacaattcttccacgatgattataatgggaaaagacaatcacatatagtacaacaaagctctaaagtattccttccatctaaaaaaggtaaaaaaactacttggaaaataaaacaaaggtacagtcgattagaagatggagcaatatatataataaatactcctatttattgaaataaatataggatcctagaggcaagtgagctattaaaaatttgccacgtgcttcaccgcggttcttgttttcgagctccttccattaagaaaggtaaaaaaaactacttggaaaataatacaaaggtacaatcgattagagatggaacaatatatataacaaatactcctattaattgaaataaatataggatcctagacataagtgagctattaaaaatgtgccacgtgcttctctgcggtccttattttcgaactccacgaggctgcactgcaaagcaggagtgtgtgttggccgttgctggctaccgccagaggaagcgtgccccacgcctacgcttgacaaggggtagtcctaatgggcgngtgatcnctcccttcccttccancaaccacccgcccttcccttactaccccttcctcctccccttcttctcttcctactacaccataaatatttgaattcaaattcaaatttgaaacgggtatgtaaactttttgcttataaactttgggtctataaactaatatttgaattcaaattcaaatttgaaacgggtatgtaaacttttgacctataaactttgggtctataaactaatatttgaatttaaattcaaatttgaaacaggtatgtaaactttttacttataaactttgggtctataaattaatatttgaattcaaattcaaatttgaaacgggtatataaacttttgacttataaactttgggtctataaactttaggtgtataaactttagatgtatagaaatactatatacagaaaatatttgaattcaaattcaaatttgaatcagatataattcaaattcaaatttgaaacgggtatataaacttttgacttataaactttatgtctataaactttaggtgtatataaatactatatgtaaaaaaatatttgaattcaaattcaaatttgaatcggatatataaacttttgacttaggtctctaaactttagatgtgtaaacttgaggtgtataaactttaggtgcataaatttactaaaataagaaagtaatgcggtgtcaaaaaaggaaaccaggtggagggaaagagggggagggggggcgaattgatcgctacccccatcaccaggcgagcgatcgcccattagcatttccgcttgacaagcaccgtactggccttcgcgagctcgcactactgcagcaccctacctcctcacaattgtggaaccaactgctgctgcttggaggaggaagagaggggaggagggaagaaggaagaaatggctgacatgtgagccacattattttttcccttttttttaaaaaaaaaaaagattgtaatagtaatgccacgaagattgcgtgctgcgggaaagtcgtcatgggaggtcgattcggccgccgcgacggctgaacgagaaggccagtgaagatgcaccattttcgctagcggtggcaaaccatgagcgaagatacattttcactggcggataacataatggagccgccaacaaagatagttatcgttggcggttgccttataacagtcaccagtgaaaatgatcttcgctggcgcacttaagctacatggcccgccagcaaaaatgcactttaccagttgcttgctgacacgtgacccgcttatgaagatatttaattattttttaggaaaaaattgaaactatttttagtttgttcacgtacttaagaatcacacatagaggatatattcaatcgagcaatcgatgataaatgttttcttattgttgcttgcaacatctattgataattaatagggttaattggaaccatgtcattataaatttcattgtttggaaaaatgtcattaatgttcatctatttggtattatactattccaatttcacaggtataagagatatgctactacgtacccctcactgtatttctaacattttaggaccaaattacccctttatttttcttcttccttcccctctcttctctctttcagccgacgaactgtaatgacctcatgctcgaggagatggattctaatcatttgggcaaatatccacccgtttattacatgccaattaaatggttattaaaaaaaaagacaagatggatcaatatgtaatatacatcatgtaaagccttatcttatgtcatacacttgtcatacataggtaatgacactaaaaaaatgagttcaataggagcacccaacaaaatataccattgaacaaaacttcagcacgacaaaaacaagaaggttaagatcacggtctgacagtgtatcagcactattaacgtatccacaatttatactcattatcatgcctcaaaactgaacggcaactatccaacactgatccttgggttctttcgttgttacagtatgaaaattgaacccatcatattcacccaacaaaaagaagcattcagcttcagtgcacaaatccaaggataaaagcttaagacaaaaaacgtacagcagctgccaacttctgttcacatctgttggaacagtctcaagcatcaccatgaacaaaaacacggtccttatcatcaagaactaggaagaaacagcttttctttcttcatcatcagtgatcggtagtttcgtaggcacgtcaaagcttgcctttagcgtgcgaagtctttactctgtgctgattaatgcctggagcaggggatgccctgattctgcaattgaggtgcccgcaccattagatcctggatgccctgatctacaacagcaatgcctgcagctgcaagaccaaccaactgttagcagccaattacacatggaaaatatgacgggatggatgatgtcaatgaccaaccaactgtcaatgatttctaaggcaattctgaaaatattataactagtttggtgtgtttacagtcctgggagccaatactggagctgctactagcatgagttcaggaacaaggtaacttgtgcaggctagaactatagtaattgacatcagcagcatggctccaatgtgcaccaattcggcgtcacattggtcaacccattttctgggggtgcctaacagggcgaaactaactagaatcaggctctaattcagtagtaatcccatagattggataaactactaagtaaaaactggcttgacctatgtatcttttggtctagtcttggtaaaattgaattggtttctgttgttgttgagtccatttggacccctggtacctgtgcacctatttcaggctggctggctggccatgtgtcacacaggtctttttggttaattcatttgaagattttgcctaagacttgctgcatactaagatacctgccgggcatttgaaatttggtaacccacttcattgtcctgtacatatacaaaggcttctgttcgctgctagtactaccttagctgaccagaagttaggaatcaacgatgcatttatatgtgtgtttagttcacgtcaaaattgtaagtttggtttaaattggaacgatgtgacgaaaaagttggaagtttatatgtgtaggaaagttttgatgtgatggaaaagttggaagtttgaaaaaaaaagtttggaagtaaactcggcctaacctgcatttgctgttttggttgaaataagattcagagaagattcgttggtaccattaaagagaggaccaattttccagttgctcactaggtgatttcaaccagaagctccggtcgaagccccatgttcataagaccatgctagcaaaaagataaaattagtaaaacaaagcagatgttcaaatatcgctgggataatataccactctcaaacgccaaatagaccgttcttagcaccagcagaggtggggaagcgcgcataataccaatgcctcactcaagatgtgacaggcaagccccactgctatatgaagagctaaggggctgtgtggttttcgagacttattttaaggtcctgtcacatcgaatgtttgaacactaatttagagtattaaatatacactaattataaaatccatttcataatattggactaattcgcgagacgaatcttttgagtctaattacgccataattttgacagtgtgatgctacagtaaacttttgataattatggattaattaggcttaaaaaattcgtctcgcggattagctctcatttatgaaattagtttttttattagtctatgtttaatactctaaattaacgtccaaacatccgatgtgacatgggctaaaaaatttttagcaccatctaaacacccccacacaagcataaacaggagaggggttccatgttccatcaacagtgaaggtaaagaatactggcttgccaatggtatagcagaagggaacatctttgggatctggagaggtgggcatcactgccaatatttagaatcacaaatgtaagttacttctagattagacaaaaagaatgaaaaacttaacgtaagaatcagtaacagtatactatatgtaggtgcagcacgtgctcttattagggaacttgctgcctatggagtcccgaaagccagaacaacaacaacgaacacgaggaagagctcctcaagggggatcccatgggatcattttgtaacctagtttgtaaaaactctgggttttttttctctcttctcctaatatgaaataggcagagctcctgattttacccctaaaaaaacacgaggaagagcatcagatagaacgccttacggacaaaaacaacacaagggtcattcttgtgctgtcgacatacatagcatcctcttgcttattgtaatgaatcccatgtctttctagccaatccttctccatacctcagatgctatctgcatttaagtgatcaaattttcaatatggcaacatatttcaaagatatttggaacaacttaatagcacagatcgtatgcttcaatatgggtaaatggattggcataatataacttctttttaaactgaaactggcataatatgaccataatgatggaaaaaccatgtcaccgcctcaccggtcttgacttcctaggaagttgggacgcttgtgtcgggaggggtttgcatcgatacctcaaatcaaacgcatcactaggcggtcatgtcagcctgcaggggattccctggtcggattgaggcgtggcgaggacggcgctagaggtggctgccggcgaagcgctcctaattgaacctagagcagcactgctagctactaagcttcgtagcaagttggattataggcttaaacaaacaatcggcagcaaaaaaactccgatcgggtcaatcggcgccactgttaaaccctacctattgactattcccgccgaaggcaccggggtgggggggaggagcatgcgaaggccatgacgagatagatacttacaaagggacggtgcaccaggtcaccaaccaattctgtcgacggagtcgggggcgatcgccgcggcggcggcgagttggggaggagaggcggccatggagcttcgcgtggtgagttgggtgactggtggtaccaagaaaaaacgtgcaataaaaaccaccaattaattgaaaacccatgaaaactatatctaaatttctctaagttcatgaaaaaaaaatgcagagatggttatagttttgaaattattttacacaaaatcttaaatccgatctccaagaggaaaaaaagggacaaattccatgtgaatattaccctgatactattcatccttttttttacactcaaacgaagttaaatttagacttgatatttagacataatgtattttatgactatacctatatctaatatttttttaaaaaacttttatgtttgattttcataggttttatttgatggtttttacttaatatgactcaagtatgaattatttaccagtagaactacgtagattggggtaatatgttgtttttcaaggggcgaaaacgactcagaaatggatggaaaccacctttaccgctttcgttttcaaatctttttaagaatcacaataaaaaaaatcctgaattcaaaaatggaatcgaatattatcggatacggaaacagagctaatacaaaatgacgcggatatgggaacggaaatatatcggaatataaaaatccctctaagtgagcttccaagtgtttttttttctaaaacaatagataaaatccaaaattttagcaactaacatcccagatcacttcgtcacaaaaccgagtaaagtttgtacttactgccacaaagtgaggtgcatatcttgatctctcattgtggcaatcacaataggaagtgcagaataatgcatcacataacacaatcactcacagagtgaaagtcacatttaaattgtagtatgtcttctgctcaggtccaaatcccccaaaaccacgaattccgcgtggaccgcgtcgaggaaaaaaccgaactttcctagtgtcccctccacactctcatcgcgtgcttcctgcgctcactctcttctggaagagcttattcccggcgcgaccatggcgatggcggcgctgcgtgaggcctcccgccgtctggtctccaggagggagtccccggcggcctacgcgcgccccttcctcctcacgcactcccggggcatcacctacaggctcttcatcggaggtaaacctcaccccccgtctccgtctcctcccgtttcctgactcgcgcatgccgcttgtgtaacatctccaccatggcgtcatcacagcgctgcagatctttgctcgctcgccgtctctcgtgcgtgcagatctgtgtgattggcggctcggcaagtcggcaagcctgtgcatgcatagtgttcgacgaaatgcccgagagacgcattcaccctgagtttctatccttttacagggctgtcccaattcgcgaccgaggatagcctggcagaagctttctctcagtatggccaggtactagaaggtacatttacttgtaacttaccagagccgagcctagagcacactttggtttatacttcttgtcattactagtaagttggaaactgttcttgttcaaatgcagcaacaattgtcaccgataagatgaccaacagaccaaaaggattcggctttgtgaaatttgcctccgaagaagccgccaataaagcaaaggaagagatgaacggcaaggcaagctttttgaaacagtgtatttttagttcagcctaggccttgtttggaatgttggattaccacatgaacttcacaggaaaccccaaaatccagtttaagggttggttgtttctttcctagcaagttcatgtagaatatcagtcttgcaaacaaggccttagaagttagaagcacactctgtttttcctacttgatttgattaacgcaaacttgcaacaggtattgaacggccgagttatctatgtcgacattgcgaaggccaaaatgaatcgtactacagattccagtccaagagcgacaggtcctcctaagccacctgaccgctgttgatagcatgcgtgtcatcttcatactttcctttttatctgctgcacgagtagtctattgttagattgggagtacctaaaaccatagagagtaatatgaacgatattacaaagcttagaatgttgaatgtccagttttaaagttcaggtgctaatggattttcatccaaagtttatggggaggttattgggacttcttcctattattattgagaagttcatgcgtaataatactggatttccagttttgcaataaaagaagatgtgcccgatcaacagctcagattatgatataacatcacatgctcttgccgatcaaatactgtgccctttccttctttgtcatggacagtatctataatgctgtcgccatgaaatgatctgaaaagtgctgttcatatagttgcatatgctcttgatgaagctgtggtagaacagtgtccttcctccatgtctgtccagtgttctgtatggaactaataatgaattggtgttttcaagtactcctaacttaaacttcatttgatttccctaaaactgtggaacagtaccttgattatacggaaaacatgaattgtaatgcgatggacagacggcacatttttttctgcattcttgtattatttgaagggaaaacattactctttctttttcaaattgaaacgtaaaaaagcactactacatgagattggaacatgcgaacaatgtcaattctactaggcttaatgtcacatcctaggatcagctcaggtgttttatctcctattttaaatggatgataagcacctggccaatttttatagtttaagaataatgtaactacggtggaagaaaaatacacgcgagttctctgctcgatttgtacactgatgaagagaaggccacattttgtcctctctttttcctaaccgcagccgccgatcaccggagcaccacggcggcgacgaagctcagcacggccatggcgctggcggcggagcagcacaggtcgatgagcgcctcgcgtcgcgccttgctctccttcctccccttcctgctcttcacgaactcgtcatacctcctcttcgcctcgtcccgttctctccccccgcctatcctctgttcctccattgccgcagcgaggaggcggaggcttcgctcgccgctcgccgcggcgccgtcggcgtcctgcacggcgaggctgacctcgctgatgttgccggccccctcggagcaggtcacggtggtctcgaacttgcacccgcccagcaccaccgcgaacctcaccagcgtctcgccggtgtaccagtgccggtccaccgccacggcgcgccggctggacacgttcaccgctcggccgcgggcagggtcgacgaccacccagctcagctccagctccgccggagacagcgccgcctccgccgccggcttcttgcactccacggcctccacccggaacggcgagccgaggaaccacggcgacgacgcgggcgtctccacgacacgggagagcaggggcgcccccctgtagtagacgtccaccgccgagacgagctccgacgggaggggacctccgccgccgccgccgagctccccggcgtccgggcgcgggaacgggaacgcgtcggcgaagagccggcgcggcgggaccacggacagcagccgcgggtgccccgccatggacggccactccgcgaggcagagcgcgcgccacgtctccgggtccgcggcgagcgcccggagccccgccgtggcgcagctcgccgccgccagcgaccgcccgtccagccgccgcagcgcgcgcgccagcacgtcggcgtgcaggtcctctatcgtagtagtcgccaccattttctcttcttctctccctggcgccatcaccctctctctcctcttttgtacgatgaaccggtgataactactgcgcctccgccgtggtccggcttttatatagcactcctccttgtgtgccctactagtagtaagcgcggtgaactctggtcaaaaccacagccgtcctggctgcgacgtggtccagtacctgtacagtgcgttggtgtgtttcacaattttctttcgttttaacccgcatgccggtgtggccgtgtgggcgcggcttgcagtgcagggcgccggcgtggcagccgacgagaaggggtcggtggcgcgtgccagggccgcgctggcgcccgtggtacggcgcgacgcggctcgcctcggcgtatcatctcaggccgcgaacgcgtggcgcgccgtgtctcctccgtgccacgccgcggcgcgtctacctgactcttgagtcggtacgcgtcgtgcgatcggctggttggtcgggcgcaaccgcaaacgcaagcgagacgtgccgttcgttgcacttgacgtgacagagaaccaaaagaaaaacaggttttgtttccctgtgcctttcacggcgaccggtttttctggcttgatggcaaagcaaatctgttgtgcaccggtgtaccgtgtgtccgtgtatctgattcttaattgcgtttagaaggatatcgttttcctcgcgggggggagaaggccgtcgaacgatcggcacggcatctgcataccgctgagatgctgacgatgggggcggctcaccggcattaatgtcctgggagagtgagatcgagggctactggacgtgttacgtgtacgacggcttggcctgcgtacgtacagctaccgtgtgctgctgcgctgttgctcttgcagatttctcgtcaagaaaggcgcattgatacagggatatgtacgtccgtgtgtgtcgttcctatcctctcgcggtgacacgataagcctctcctaataattctttttagcacacgagctttctcctgatcttgcgattttctgcatgatctctcgttcggtgttcggtgaagcaatcaaaatgagaaacaaatgtggtaactttctgcttactactctatccatctcataatataagaaattttagagttatgcacagttattaagatggaggtagatggaaaaagtgaatgatggaggtttgtgattggttggaaagagaatgctggtgaagaagttgttatattttagaacaaattcaaagagaagttattgtattttgagacggaatgagtagtttagatgcacagcaatgctacgctgttgttctgtgattgtgcttcagctggggaaagcagagcaatagtattcagagtttagaactgtttatatgcataatgcaattttctcgcgctccatttttgaagttcctcagctttcaaagcctgggcgatcagtctgagcatgtcggtagagtcgcggtcatgattgccagagcaattaaactgaagattaaataaagtcatattggagtagattcagattggccccgcaataagataatcatatatatcctttgatttcttttctcataatggtttctgaagccttggctcggccggccgtcatgggttgcctgaactagcatcagggtttcggggcccaaatcctcatatggtcatatataactgcatgacgttgcaatatgtatggcaaggatctattttacatgggtaaatttgtttattaccgctgtaaaaatcacgagctaaaaaatacatgctactccctttatcccataatataagacgcggtcaaaattgacacggtctccaaaactaatctttaacctataattttccatgtactataaggttcctagccacaaaactataaccatatgaaagtaaatttaaatatcaatctgatataatttttaacaaataaaatttattttatactccattcgtccctaaatatttgatgtcgttgacttttttaaacatgtttgactgttcgtcttattcaaaaacttttctgaaatatgtaaaactatatgtatacataaaagtatatttaacaatgaatcaaatgataggaaaagaattaataattacttaaaatttttaaataagacgaatgaccaaccatgtttaaaaaaaccaatgacgtcaaacatttagagatgaagggagtattatactaagtgttagtgaaatattttaaatgctaaatctttaaatacgtgtgcgtcttatattataggatggagggagtacgtcattagtatgtagatccagagatccagcctttatatgtcattatcatgttacgatgttatgttacaactcgagtatctttaagatggtactaagttatccgattttacattagtataatgttttgagttaccatgtttttaagagaaaagatagttttaccaaagatttggatgctactatggtattacttccttcatctcagaataagtttgttttccatctatttgtcttacagagacgccatctttttcagcgatcattgcattagagtattgggagacaaacgtattgagatttgctaaagtggagaataattatattggagtttgctaaagtaagaacattctttttttttcctttgtattggcatgggtagaaatgggctaaaaatgaagtcttagtgatggagatagtacacgggaactgtctaaagatttcagattgcagatttcaggcttcaggcttcttttgtttgagaccaaaattaaccaatcaaaaaataaatgttgatattgccaaattatttggcttagggcttgttcactttatagtcacttttaaccttaccaaaatttggttatactaaattttaacacatttttacattaccaaatttttagtgctagatatgttttgtttgaagccttatcaagttttgatggaatttttacgagtggaaacttataaaactacgggcctgttaactttgggcctgttcactttggcattgccaaaattttggtaggatttcttatatagttaccaaaatttgacagtaaactaaatgtagccactttttttggcaactttaccaaaatttggtaaggttgaaaatggcatcaaagtgaatagaccctttgatgccgaaaaaaaaccttaccaaattttggcaatgttgtcaaaattttgacaacttgccaaaattttggtaggatttcttatatagttactaaaatttagcagcaaactaaatgtagccacttttttgttaactttaccaaaatttggtaaagttgaaaatagcatcaaagtgaacaggccctaccaaaggttggtagggtaacattaataagaatatgtataatttgttgccttacaaaaatttgataataccaaaattagtagggttaaaagtgacacaaaagtaaacaagcccttaccaatcaaaagcctagtcaattttccccaaaaaattagtaattaccattgtaaaaaagaaaaatggtaagatcacaaatggtaaagaaccatataagccctaattagagctaaagaatgcagctcaggaacatgtggcagtgatctcggcacaaggcatgtttcggagtaaaaacagattcttcaaaaaaataacttcatacagacagaaattcaacattttcagtctaaaaaataagaagatatttggagggagaaatgtcccttcaaacatttttttaagaaaaaattatgagcatgttaggatcaaacacaaaatcttggagttgaaattacataccccttaccgctccactgcactgtcaagtgcatctcagcattttagtctcacagagaaccttctgttgtgttctagactgagataattattttggttaatccaattaatcattatctcgagttacaacattttttctctctagagaaacatctccattttctcatcgtctcccggtttaactgcattattatatacttcctccgtttcttaatgtaaatcattctaccatttcacatttatattgatgttaatgaatctagacatatatatctatctagatttattaacatcaatataaatatgaaaaatgttaaaatgacttaccctataaaatggagggtgtaaaacggagagagaagctgttttctgcgcagcttgtttatgactcgcgcatattccttgtggacaattagtcattgaactaggacaagtctagaagtggaatcgtggaaagcttcgattaggtaaagaaaatgaatgtaggaacttcatctggaccaaatgccacatttgacatccaagttaagattccccatgttgtctcatgcgcgctcgcaagcctctcctttgcatgtcgccgtgtcttcagcggtcaagccgccttcatcgatcctctatttgcacgttgtgcagtactgaattatactataattctgattcagtacaggtgaagagtttttttaaaaaaaaactgaaaacagcactagagtgtcttttcattgaatagggcgtacaggtgaagagttagaagagtgctttggcagcacctccagcctcaagcttgtgatcccgtattctgagttaattccatgacctaaactcaaaccattcggctcttcctcttgtgtagtatatatctgttgacctgctgctgtcctggaaggtttgcttgcttttgtcaccatcttttcgtttctagcggtattgcatcgattgatccatctaatccagcatgttacccagggaaaaacttggctcgaatcagcggccgcgcgtgcgtacgtgctctttggtgcgatcggatctgataagagtcctggactctggacgtgtcttgttaggaaggaatcccgtcgacgaaggctgtttggtcggcgtcgctctcgatctcacgggctcactgtacgtagtacgatgcagagcagttcatctcatggcttcgtttgactgacaacgggcgatgatcggttatcctgtaagacactctccgccagaagctgtgtacgggatgggaaaactgaactgatcgctgatgtatcaggatcagtcgatcagaagttcaggacagatcggacgccgcgatcggtggcgcgtggaatcgacggagaaaattttggttggatgtcggtacgccccaaagttccagttaaacacttccacaccctcttgctctgtggctccgtgcttcagcgaccttcccatggtacgacggccaatgaaccgagctactcgtctactcctttgctagaatgctagcttctttccccgcttcaaaataaaccaatataaataataataggatataacctaggataataatctggatatcgttatcttagatcctctagattgttttttattatacattctaaaatatacttcctcgatcccaaaataagcgcatcaatttttgtgtccaactttaatcgtccgtcttatttaattttttttatgattagtatttctattgttgttaaattataaaacatgagtaatactttatgcgtgaattatgtttttagtttttttaaaaaaaattaaataagacaacgattaaaattagacacagaaattcatagttgcgcttattttggaactgagggagtagcaattttgcacacgattggacacattcaaataccatgaatatggataaggatgtatcctaagccgagtttagttccaaacttttttttcaaacttccaactttatcatcacatcaaaactttcttacacacaaactttcaacttttccgtcgcatcgttctaattttaaccaaactttcaattttagcgtaaactaaacacacccctagtatcatgaattagatagatatctattcatattcagatttatagtattataataagaccaattcagtactaagttgctttttttaagatggagtgagtatctcattagtcgcttgacgcatagttataaatgaacagttggtgtacttaatgcgaaatttgttaggaagcaagtgcaagctgattgcaatcagggagcaaagacatcgcgatgaaccattcagtaatactccgtccgtctcatcataatatagtgatttaagataagatgtgatattttatactacaataaattttgtcttaggttgctatatactatatccatctcaaaatatgtacatccgtggatatctgtgtccaacgtttgaccattcgtcttatttagaaaaataaaaaaaattagtcacacataaagtactattcatgtattatcatctaataacaataaaaatactaatcataaaaaatattaaataaaacaaatagtcaaacattgaatgaacaatgcaaaacattatttattttgggacggagggagtatattatgaaaagtaaccacgctagtgtgtatggtagccgcggaatgggctggccttcgggagttcgggatctttacggattggaataagtgcactttaggtctctctattcgtcgctcagtccgattttcgtccctgaactgtaaaaccgggtacaacccatcccccaacttacgaaaaccggacaaacgaggtccctcggcagtatggagggcagttttggccgacgtggcgtctatgtggctaatttgacttgatcttcatctgacgtgatattgacatggcgctgacgtggcaattcgatccagaaaaatattaaaccccgtggcacccacatgtcagtttgacacacaaattaataaaaaatagtggggcccacgtgagccccacatatcattctcacccttctcttcttcctcctccctccctctccctctccctctccctcccctctcgtggaggagttcagggccgcgcatgtgggcgcggtgccgggagctgcacgaccgagtcgtggcgtccgcgtccccttccctgctgcggcagcccgcgctgcggtccctcctctgcctcgttgccgtcgagctgcagctcctcaaactcctaaacgacaccactaatcaatggatagctagctagaggaagagctcaactgcatgtctgccactctgcatgcttatggttcatggtgtttatggttgggggttgaagccagcttgaacacatgtgtagtacttcggtcaactacattggtagagagtataattggactgagctgcgttggatggatgtgaagaagagcgagacggcacgaggcaagtagcaggtgatgaggctgcaaaatgagaaggaacatgagcaagtgacgacgacacagtcgtgcagcttccggcacctcgcccgcgtgagctccagttcgtcggagtcgggcggcgccgtggccccgaactcctccacgagcccccgcgcggggtccgcgccgctgccgtggaggaggaggaggaggaggagaccacggcggccggctgtgccagtgggagagggggaagaggaggccggcgagcaggttgccgccgagttgcagccgcacacgggcgggaacttagcgccgcaccccgccaacgacgaggttcccgccgttcgcttggctccaccgccccgccggcttcgggcgccgccactgcgcccgcgcgtccgcccgccgctgccccactccgccccgtcggctttgcgccgccgtccgcctgccgccgccccccactccgctccgtcgttgtccccggcgccgctgctatgtggggtgagatggggagaaagaagaggtggggtgagaatgacatgtggggcccagtggcccacgtgggctccaccattttttattaatttgtgtgtgaaactgacatgtgggtcccatagtgtttaatatttttccagatcgaattgccacgtcagatgaagactgagtcaaattagccacataggcgtcacgtcggccaaaaccgctctccataccgccgagggatctcatttgtccggtttttgaaagttgggggacgggtcgtacccggttttgtggttcaggacaaaaatcggactgagcgacaaataggggacctgaagtgaacttattccttacggatttgcgtctcccgcccgctgggttaagaacttacgacgagccgctgtttctgatcgtgtgcaacggtgaattggtaaagtctgctgtctgcagcgaagcccggtatcatgccttgtgaggtgaacgaactaggcgggccggtggctcatcacatccacacaagttatctacctgttcaccactttacctcgttaaacagctccagttcaccaattgcatagtctagagtctagacctcgatcacattccaaggtagtagcacgaaaacagagtacctgatctggaaaaacatagtgccggccatcgcctaccaaagtatgatttgcgggtacactactacgtgcagttaaacttgtcgaaacaaagatttcggtaatacgaaaaagggtggctatcaagctagaaaagtggatgggtttagagacacaggttcaggccatctcaatgagaagtaataccctactcctgtccggggattaatccaccgagtatattattgatcgtatgatctgggagaaaagttatgtcccaagagatactcggacccctctttatatagggagaggagtccgtattacaaggtatagcctatattcctaacggaataggcaaataaagataaaatacagtcgtaaccgactagaatcccgagtatttccttgatatacaagttaaggaatgtaacccgagtcccttaaagatattctacctatatatggcattccatatccagtcggatatacatgccgtgtaaatatggggtatccataatctccacaaaactgccatagtcttctactgacgaaattaagtttgcctcggtaggaactactagctgagtactcagcatactggacggcagaaacagccgtggcactggccttatccactcatatccaagtggagtctcccaataggccgctgcacgggcgacgaatctatttcatccgctgcaagtgatccacatcacgcgagcccccacaacgatccgcgcccgctcatcccctcccgccacgtccgcaaccgcagccaccaccacaaaataaggcctaacctacgctgccacaaaccacggagacaacacacgcagctcgccgaccagagacagagagagaccatctgctagcttagctgccatggccgcctccaccgtctccggcctcgccggcgccaccctcgcccgccggccggccttctccaccggtgcgtgcgtcacagtcacaatcatcttctcacgcgctataaccgtgtgtttaatttgatcttggaatgctcgatttttttgtgcaggcttcacgacgggcgcccgggtgtcggcgaggaacccgctgctgacgaggaacctggagaggaacggcaggatcacctgcatgacgtaagtagcagtagtaggatcacctgcaagaagaattctgagagcagcaagcgtacgtggcgtgagattctgacggtgcgtacgtggtgttgtgtgttgggcctgcaggtttccgcaggactggcttaggagggacctgaacgtgatcgggttcgggctgatcgggtggatcgcgccgtcgagcgtcccggcgatcaacggcaacagcctcacggggctcttcttctccagcatcggccaggagctctcccacttcccctcgccgccggcgctcgactcgccgttctggtcagtacctctatcttcttcaggcacgcagtatagtactcctatataattagtagcaaaagcgttcagtggctacgtgtctaattgttcatgtgggttttgtgattaatttgcaggctgtggttggtgacgtggcaccttgggctgttcctggcgctcaccttcggccagatcgggttcaagggcaggaccgagggctacttcgacaagtgaatgaatccacagtggcttttggttagcttgactgtacggacggatgtgtgcgctgcatatccttccttttgtatagggctctgatttgatcctcttgcggatgtacgctgttgtaattctcctcaactccttaaaactttaaaggacaaatatatgtgttgtggctaaatctttttcgcaattagacacagacgcacgcacaaacgacactgcatgtacagttgtacacaattacacactcgcacagaccaccaaaattactggaccaccaaaattttgtagtatcacaaaaccaacccatgtttaacggtatcgaccaataaataccataatatctgatatcatgtagcaaattttgccatttaacaaatatttaagaacacaaaattgattggtttgtaatataacctttctctttacataattcattgattatacaattgtcaaatattttagaatttgttaaatagcattattgaggagtaagatcctggctatagtatttgtggatgtagcgtataagatcggtataaggatatgcacgtagatgtcataagaagaaatgcaattagatttttacaagttcgaaccctcaatgtgagtaatagttctattcatgtttatatctattgaccgaaagtatcacactgagtatgatgtctgaggtgggatctctaatctagcatactcaactaaccttgactaagagcaggtacaatagcaggctataagccaactataaacatattttaaaaagataaagaaatagagagaatagcagtgggctacagatctgtagccagttgcagcacggactccaaaacataatgtgtgtatgatatataggatcagatattaatagtatagtaagcaactattgtatgaattggttattacattggctatagataatttagagctagtagtgggctatactattacaactctaaagatgcggcaacaatgcaattggcggctagctctgggcttcccctaaatggatttggcatgaaggctgtggcttgagatttgacgccctattctcctaggacgtggtgtgtctttataccggaatacgaccctggttcaagtagatcttgatcccaagtaggacactagatcttgtccatgaagccataacgtctatgacttgaactatgcaatctttccttgtgtgacgcgtattcactcctagtatacccctattcatagatatctttttgtgtacaattactccctccgtctaaaaaaaaagacaaaccctggtttccgtgtctaatgtttgaccgttcatcttatttgaaaaaattatgaaaaaaattaaaaagataagtcacgcataaaatattaatcatattgtatcatctaactacaatgaaaatactaattataaaaaaaattcatataagatagacagtcaaacgttggcacgggaacccaggtttgccttttttttttgggacggagggagtagataactacattccccgtaaagtaagtatgagtgtatgggatacctcatatctactacttcctccgttttatattataagattttctagcattttcaaaagactggaccgacatatcttaagattgatgaagtcaacacgaacatcttgctgtcgataggtatctcgtctaccactgaaagaataattagccataattacaaacacctgtgatatactctcttatttcctaaatatttgacgccgttgactttttaaaacatgtttgaccgttcatcttattcaaaaacttttatgaaatatgcaaaactatatgtatatataaaagtatatttaagaatgaatcaaatgataagaaaataattaataattgcttaaattttttaataagaacgaacggtcaaacatatttaaaaaggtcaacgacgtcaaatatttagggacggagtgagtaggacttaaggtctgttcagattatagccaaaataaacctagacatagacttattcaaaaattttggcaatattgtcaaaattttggcaggattttttatgtatttaccaaatttaacaacaaactaaacatagacatttctttggcaactttactcaaaaatagtatggttgaaaatgacatcaatctgaatagccctaaatcaggctggcctgggtcaaatacaagaaacataaccggtgagctattcttgaacgaacgtaattcaggatacaacatattgttttgattctacataatttataagttgaatttccaaaactcaatcaaaccatcaatcttcaaatatttcaattggatatatgaaaaccatgtgtagattttcttttaaaaaaatcgtaaacatgtacaaaaaaattctgaatttttacattagttgctcgtttgctactgggctagctagcagtctagcaccacaccaacatggctaggcccaagcccaactcgtgatccagtcatccatagtcgactcgactttgggttcgagcgatcgaaactcggtaacccaggcgaggcgaatccaaatgcgaccacccgctggccggcctccccgctcgccgccgccgccgccgcatgaccaccgccgtcctccggccatccccaccggtcgccaccctcctcggccgctgccgcaccgcgcgctgcctcgcccagctccacgcccgcatcgtccgcctcggcctccacaaccaccacgcgctcctcgcccgcttcgccgccgcctgcgacgccctctcctgcccctccgtcgccgcctccctcctctccgtcgccgtcccggtacgcctgcggaacgccgtgctcgcctccctcgcccgccacgccccgctgcgggacgcgctcgcgcagttcaacctcctccgcgggggcgcgtcccgcccggacgccttctccttccctcccctcctctgcgcctgcgcgcgcgcctcctccctccccaccggcgcttccttgcacgccgcggccatccgcctcggagtcgacgccgacctcttcgtccgcacggcgctcatccagttctatgggaggtgcggcgccgctgccgccgcccgggctctgttcgattcactgacaaaccccagcgaggtctcttggacggccattgtcactgcctatgtcaactctggtgatattttgactgccagggagttgttcgaccaaattccacaccgaaatgtggtgcattggaatgccatggttgatgggtatgtgaagtgcggtgacttggagggtgcaaggaagctgtttgatgaaatgcctgagagaactcctgcagcgtacacatcattgattggcgggtatttaaatgcagggaacatgggagctgcgagaacattgtttgataagctagaggaccgtgatttgttcgcatggtcaacaatgatatcagggtgtgcacagaacggttaccctggagaggctttgaggatttttaacgagttccaaaagcaagaaatatgtccagatgagcttgttattgttggtttgatgtcagcatgctcccaacttggtaacatcacattggcaagatggattgaaggttacatcatgatttatccaatagacatgaacaatgtccatgtgatggcgggtctcattaacatgaatgcaaagtgtggcaacatggagagagctactcttttgtttgaatctatgtcagttcgagatgttttttcatattgttcaatgatgcaaggtcattgcctccatggttcagctagcaaggctgtagagcttttttctcagatgctcttggagggcatcaccccagataacgccgcgttcacagttgttttgacagcttgcagtcatgctggcctagttgaagaagggaaaaggtactttgatatgatgaagaatgagtatatgattgtaccatctggtgaccactatgcttgccttgtcagtcttctcggacgttttgggatgctgagagatgcatatgagcttatcaagtcaatgcctggagaacctcatccaggagcatggggtgcattgctggggggatgcaagtttcattgtgacattgagcttggaaaaattgctgcaaagaagctctttgaaattgaaccggaaaatgctggaaattatgtctcgttgtcaaacatttatgctaacattgaccgatggggaaatgtttctgaaactagagctgagatgacaggaagagggataacgaaaattgcaggctgtaccttggttttgcagtagcatggttgagatgagtgagggatttattttgccatatgtttactggccctactggaaagttcagtgaacatctttctgaatgagaggaaaaaccatgtgtgctgtaatgctgtgcatgttgactcatgatggttatgagatcaatagaaaccaagagtttacactcaacctgagaatgcctacaataaatctggcttcatgacataaatgatgtgcttgttaacaagctgtatgggagttaataagaggaacgggaccatcttaagtagactgttctcttcggagtgctttgaattctttctgccgttgataccttatgagaaccagaggattccgtgacactggtttgataccatccacttctgttgctgagtctcatccactttttcaattgttgatgagacgactcccggtgagtgctcgcttggtcattcctaatcttctttactacctatcttagttattgttcatcaattcgagcttttttataatgtgatttctactgaactactacccatcatgcaaactaggatggttacatgggggaaaaggttgctgattatttgccttggcaggatcagtatgtgatgtggtatcctgatattggttgtcattaatcagaaaaaacaagtatatagctcttcaggtatgtccttaggattcctattatatcttggtttccatgtgtggcttgagcttcaatgccctcactaagtatgttcaaatactcagataattgtatccagaagtttcattttgaaacaaaggcagaagctctgccttaattcattgatatagaagaggcaaataacaactgtatatccagaagttgtggagtgcaaaattttggagttttgagcatcgtgcctcggctatacttcctgaaggtgagaactacagggttcaattagacttgctaactgaaagtagcacatagaatgtttgcttatattgccttcatgcatgcaataagtgtgttatttgcaggaaatgtgaaaaaccatggatgttattttgcatcaaaccaaacatactactgtgtgtctctaccttaccaaatattagcaatgccaaaattttgcatgacaagaattcgttagggttgatttgggcgataaaccaaacagccttattgtcacatttatgctttgaaaaccattaggtcatgtgatcacagtaaggatcaaggttttagttgattgagtttacgaaacattacaagagctcttcttttcttggaattacttcagtaataacataattcatttcaattccaatcatgtttcaaaattctgttgcacctgcataccccttttggtgttgttatcagccattaatgataccaatgacctatcaactcgagggcatatgctcacagaaatataaacctggaaaagtcaattatggcttgatgaagtctaatgagtaagctatgcttacagtaatatttcaggcagtttccattaaggcccacgtgtagcgtgtcacctctgggttaagaggcgcgatgctttcagattcctccatttggaatttggtttgcaaatgtggtaactggtaaggtagtaacatgtgctcctattaaattgtgtcccctcatcctagtcttaaacaaaagtgattagacttgttgttgagtggcgtcaagtggaccaccttctgcaggccttgttgctgtttcatctgcatagtgcctgtcacctgtgtggctgtgtgtgtttttgtggcccagcgtcatatcactgagaaatgtttgagctgaaagttttctgactgtacaacgctatgctaaatatacacatgtatcagacaatgaattcgctaacgatactgcacgaagtgtcttctataaaatgcaatgtcgatggtaggctggtagttatcagcttgcagtctcggacaggcactaccgccactatgttgcactatatcatctttcttcctgaatcttcaaatcaaatatagccagatttatctaagatctgtgcatggtgatgtagtgggatcattggcaagtcatgatgtttagtattttctgattataaaaaggatatcagtacacccatagatacatgataatacctgtgctcgaaggtttggtgtttgcatgtgctctcctaggtatatagacctcatctaatcacctagcctgttggagaacctctaccataggtattgcacgatccttattattttggtgtgtgaatctattaggctccgtttatggcagacaaacttatcttcatgtcgatttaattattaataacttgcccacgcattctgctgcaccagtgctcttccaggtcaatgagcttgttattaatgaaatcatgcgttgattcaaacatctccctatagcatttgtattagtagcactagggagtaacgacagtttgggcaatatataaacaatgccattaaattctcgggctatctggttggtccatgttagattcttagtgggatgtgtgaattgcagcactatgtctccgtgtgggcatgcgcacgagtgtatgtgcatgtcgtatcacatgtctaacaccacggtgcacgaactgaatcctggaacgttgtcccgttgaagttatcagcaattggagaggggaagctaattttgtcctgcttcttctttgtcagggataacaaagaggttatttgagcaagtacccgctgtgctgcgagtaagattcgagttatcagcggttgtttaggttggatctcaaagaatcaacatactggtgagtgttcatacaagttcacccttctggttgattaaatcatatgaccaattgttttgtgctagagcaaaccaacattgctttgcttaatgttttcatcaaatgtcaacttttttgcatttgtatattgcatggatacttctcagtatatcttctaaactttcaaactcagaagatattgcatagagataaatagtgagtatataagataaagctagaattgtacgaacaattaaatggaaataaataagatttagacttgtccttagagttgacattaggtctggactttgttgtcatgataattatggtggtattattagattttagtttttctttattgaagacatctatgaagctaatggttgtatttcaaaccatttgggttagtagttatggtttttcttacaatgtgtcagcttcttgcaatagtttagtcacaagttcgtaccatcattaaaatggagtaatcccttcacttaagcgaagattaatgcgatgccctgcactttgaatccactatcttttaaccaaagttaaacaaatcctattgcttaatgcatggttagttgcacacgcccgtgcgtgtgagcggagattaggtgtttgactcactgctgcagcgttaatgcgcaggatctttttaattaggattagaatatgatatttggcctaaacttatataaaagtgggtgttacaggaggccgtgtggcacttaacccccacggcgctgtgtggttaaaatattgaggagatgttcccttcgtgggcgggatgatctattgtctattctctcgatgcaagcaatgaaggcatggaaaaataactgccgacggccaactaggattgtgaagattttttttcctttttatttaagaactgtgaagatctttcattctgtgttttctatcgttcataaaacctgtagggtatgtgtccgttggaagttgcgatcgtctgtttcaaatatttgaacttagcttaaatttgaggtgtaattatcaatgaaacttgttcatggatgtctagctgttgaagtttatttgtatgaatgaaaccgcagttgaaataaaacttccttttttttttcaggaagtatcctaacatctcaaaattctgtctaccctttgattcttgcattttgtccatgtttatccattgcacaacctacagaacaatgaagttgtttactaaaactgctgctggtgacatcattttcgaaagcagctgttccttatggtggattttacaagtaatccatcacaaataaatgatttggaatagactctgaaatgcgaatttaactactgatttcaactatgattgatattgtgaaacataacaccgttatagtattatgaaaatgtattttaagacagatttgaacataccattttcatatatccttctaaatttataattatttaaaagagagtagtggtggtgttgggtttaccataagtccatcaccaactcctaaaactatgacatgtgaaacacatatgtccattctcaaaaccaaatataagtaatgataagtcaattgagtcagtttaaaattttttacagctatataaaacatctaatttcattccagaattaaactctaaattcaaaatagctttcttttttcaatgcgccgatgtgattttctatattctgtaacaacgcactggtattttgctagtattcctgcacattaattacacaagtgtatatactttgactatggatgtttaacctcacccattttcgactgcgtctccacatgtaatatttatagacactagaatttaaacctaagatagattcatatacccaacccgctactacaacccactactacaccgcaccacatcctcaactgcacactactacaccgcaccacatcctcaactgcacatgtaatatactgtacgcagtggtggatccagaaaaaaaatagtagtagggtctgagcaaactagataatgttacagtcccccctcctatctatatatggtaaaaaattttagtggggtcttcgtgggggctcgagaccccgccacccctatgctggatccgcccctgactggacgatgttgtcaaacgaatattgtaaagtgtacaaacttacttatcaaaagtgtactccctgtgtgtttctgaatataactatcttttagaattcaaattttgtgtacaaatataagcatttcttagagtcctactctcactactcagtctaatatctcccaattttatcttcaaccatcatcccacttccaagttccaactatccattgctttatttacagacactatagtttttatctccaatcttaatatgtactttctctgtcccaagatgtagacttttcacataacgtttaacaagtcatcttattaaaaaaaatataaatatcatttattttgttgtgtgttttatcataaaagaaactataatattaacttatacatttacatatttatactaaatttttaaataaggcaaataacaaacattataaaaaaaatcgatgacatcatatattggacagagggtacaataagcaatgtaaaaagtgcttatatttggaaactgatggaataggtagtcacgctgacaagtgacatggactagccatataagatccacttaataatacggcctaattaagccattagcatccgacatactcccatcacctctatccaattcaaacatctaagcgcgacacctcgcaagtcttcactaagcgagtggcatatcagcatcatctgatcatcagcaccacaaatactatatcagtagcacaaatatcagggcctccttcaggacgttcactgaaattcaactaactcccacgaaattcctataaaattcatgcgttccaaaagagctatcatagtattcatcaatacatacctcaaaataagacaagcaacaagagagtccactagaacagcagctggagtttaaaaagtaattaaattgtgaattttgccaataacttggtaccttatgcgaaatcgcaatatatccaactattttgcattggagctcattgcctttgcaaccacaacaagaaggcgcgagaaaactcagtggagattatttttcactcataatctctaattaagctccttagatgccaccatggaattaaagaagagcacatgggtttggcccccatacaccgactaatggcaatatatacgtgcaaagatacatttatataccatatcctgtactaagcaataacctagtggcacagttatgagctcgcatttgggtcaaccttgccttcatagttgccttcaactccgagactttacctgcaattttagacgcatcatcgatgaatcatgatgaatggtggtgaaatattataaaatcaggtaaactgaactcaaacctttgatcccgaggccgatagcgttggctctggatcccaaaaccatccattactgcttctatttgcccaaaacgggagcattaatgctagaattagtcctaactgaggcaaattattttctctacaggtggctatctcttaaccttgatgagtagcagcattgaccaaacccaatgcaacacacaaaccaaaacaactttaagtgagttgtatgtcatcatcattaatcaaggtgggatatgtaagcaatctcggggattacattagtgggttgatactagtatgactttacaaagtttaacccttttcttaattgtaaggtgattaagtcacacaatcaggatgcaacatctccataacactaacaagtcaactaacgaatttaatatctgctctcggcatttaaacactgcaagctggaaacaagaaaaaccccaacggagctgagatttcaaagtgctgctcttatgtgcatcaaacaaagtggcattaatgtattacttatctcgtcgtcattgtatcaagatgcgcaccagaagcaacgcatcggtgcgtgcaagaacataggtgttgcgttgcaccatttaaagacctaattgcataaggtgcactagcagcatatctattcaagaaacctatttattcgattaacataaccatggctcaacattcaagttctctcttctctccttttttttttgacagcaatgctgggcatttgagatggtgtgcccaataaattccattcaaggccacattgaagtagtgaaatgaattggaggtcagtcaaatttctataatctttagaagcaatcaaaaaggacaaatagttgatgagtttcaactttcaactccacacctaaaaataataaataattgtcataattacccaataagtccagctaacttgcttacatggccactacaaagttgtaaaatctactggaggtaattaagtcactagcaaacttttggcacaattaaactagacatgcctatcatgggttacaattttcaaccaggctcactgttgggagattgccacagtcatctagcatgtggctaaagaaaactaccgccgaagtaagaaaaaaaaagagaagattcatcactggaaattttcttctttcagataaatgaaaaaaaaacatttctttgccttgtgtatatgaccaaccataaagcctctcacctcgcacttctctcccacccaacacagattattcaacccctaccatgccactctccagccatgaataccttggtaataaaatgcgtccttccttagcctctagtacatgaagtagtagtagtactgctatactcttaatgctgcattaaagaaaaccaattgacctccccctcaccctcacccatctcatccccctataaatacttgccatctcttctccgtccaaccacaccacccagcaagaagaccccgagcaattctacccgctcggagctcctcccctttcatcgtctccaatcaccatcatctgcacgtctcaccggccctacgcaacagtaagttccttcgccatcgccatgtcttctcctacctctaagcttcatatgacagtcgtgcaaaagtttccatttgaccaaccggctaacgaacgtttttatgggggtgtaggcaagtgggttacctctcgatcgggatgagccgcagcaacaagaagagctctaggggcatcgacctgaagctgaacctctcgctgccggcgagaggggactcgtcgtccaggagggcgatggccgccgacgaggagtcgtcgccgagctcgtgcctgtcgtcggagaacgagcacggcctgcagtggtccaacagcccggaggcgacgtccatggtgctcgccgcctgccctcgctgcttcatctacgtcatgctcccgcaggatgatccgcggtgcccgcagtgcaagagccccgtgatccttgacttcctgcagcaggacaacggcaacaacaacgccaacagcaatagcagcaggaagaccaggagagggtgaagttaaacaaaagggggggcaattctccgtttggcagaagatcaacatcaatcaagaaaaagaaaagcgtctatatgaagtcctaggtccagtaattctcttttgttttgcctattcccccagtgtaaccatgatatattccttactaaaattgtgagactagcatgaaaatccatgtgctggtggcataattttgatacatcatggatacactggggactatatccatccccctctcctggcttccttctttagtggttctaaatgaagaagttttgcttagacataggaccagacttctcatctttgttttgtttttgtttcctttccgagatgaaaagaaaacatttaccctgaaaatgttgagatgattattgttctgaatcacatgatggctttctatcaagctcatgaattctgactcgctgtgctgtttcattagacaaggtaatctagtcgagcatagaaaatggggaaaaaatcacagcaagaacagtcaatcacataaatgggatgtttacgagtctgtcatcacaggttagctgaactaaccaattggtactgctgctcccacgttgcaacataatgaggtcgccttccatggacactctactatctctgaaaaagacattatgtaattgaaaaaggtatgcaattttcaaattaggacgagatatagtatttgaaattgttgaaaaaaacgctgttgatgatgccatgcaatgaatagcgattaattttggcatccgtcattcttatctcttcataatatacatccatctgaaatacgtgctgtgtgacgcagcaacctaccttaattgcttctctagtcaactttgccaagctgatatatttatgttcacttgataaagacatctcagattaagtccagatcttcataatcacacatagagaccagccattctacaagttgattcaaatcatatcagaagggcagagagcaataacaaataaagatggaaaaaaaatgtgcatgaaaaattagatgtcccttggtccctgttgactggtaacggcaaacttgtcaattttattcatcaatcaacgaaaacaacagtgtctctagctgtattctagtattttaatgacaagacaactgaaaaggaatggcccagccaataaaatacaaaactgaatggcaaaaagattaagaaaaggtaactagaactaaattgcaggccgaatatattatgacttagcctaaaaaaaatgtggctaaccgatataattgatatatttgtgagattacttgcactcgccttgtcctgaacaactagaggacacatcatttaaacataaatactcctgcaacataaggacatagctaattgcaaagaattgcaataccagtcaggaacccaacaatgcaaaacagacaaagaaagcattacccatggttctccacttttgtggaactaagttcatggtccaaaaatagagtaggcaagagaaacatgagatcgaagacaaatgaggcttgagggggtcactaaaaacagagataaactgcatttgtacacttgtgttgagttcatggatctcctgaactccatagaaaatcagcattcagtatgcagaaaacgcaagaactggtatattgatccaaaaatgctaaatcgagtgcaaattacgaagctcaacaaagtctttttttttctttcatgctgatgcacttttgtctttcggtgcattcttataaaaggaagaacaagcagaatatagattccatcctaataccagtaacagggatgagcatgactgctacataagcatagagaagaccagaaatgaaccaatgagcattcattctgttgctctgttctaataaactttattagcttcctattgtgggacatcatcaggacaacaccttcaacactgtaaattggcggaaaattcttctgaatcatggagctagcaaaagtgagttatgacatcaccaccaattgtgctcaacttgtgcaatgcacacaaccgaaaaagtggggaaaaacattatgagtgcccatgaatattcgtaaggcccatacattgaattggatgaatgaatagactcaacattaccacattacgaatatgaagagtccgaatatcaatgattgaagttgtgtcgctgtatgcaatacagcataaacattccatctccaaacatctcaaagctagacacaacaaaatcaagtttcacaacttacagttcctggttggataagaatgaatctttcagatgaccgaagaaacctgcagcaatccaccatccatccagcaggatctatggtataacgcatcaaaattggttaaacgggcatacgaaagcgactccaaaacgtcgaatccaacaaaacccccagatattaccgggcaccctcttttctactacctaaagctaaaactaaaagcaactcagcattgacccccaaatcaaaattttaggtgaaaaaaaaaacctgccctaaattaccgcctcggatcggagaccaaataacacggcgctaatccggaatcgcccgggactcctggagcaagcccatccgcagaagaatggctactagatggagttgcttgctcgaattacctagttagaagaagccgagaagacgagcacttccgcttcgattcgtcttttgattttcgaagcgaaaaccccaggaataaagtcgattttacggtttccgccctagggctttcctttcaggttttgcagagctcatcatgggcttttgattgggccgggccttgtgagcaatagcccaactaatagagctaataaatcacgtttttccgcaatatgtactatgtcaatatgataaatgatcctgcgtttaattttgctttttgtcgctgctaagaacatatagccatatttttttatgactagcaaatatgcccgtgcgttgcaacgggtgaaaaaatgtaatgataatatacatttttcatgcataaccatgttgatgacaatcaaaatattagaaaattggaatatcataaatataatagcccaacctcgatgatggcaactttacgatatttgctttaccaaaaataattggattattcatatgacaacattcatataatctaaaatatttttttaatttcattattgcaaataatcaaaatcctatactgcctcacatggtcaagtctacacaaaatagagtcaccgtgcactcttctctaaataacaattaaaatatgtttattttctaatattatttccatataatataacaaaacaaaagccgtgtaggagatggaaaaaaaatcgatggatcctatttgaccaagcgttcatcaatttagcatttttttttctgacagttttttcctcgtatgattttttttatagacgatggaaatatttttttctcgcatgtttttttacaaactactaaaaccttttttctagcgcgtttctttttgcgcttttttttttacatttttttcctcatgcgtttttttaaactgtttttgttttctcgcgcattttttcttttttaatatacgatggaaacttctctttttagttagattagattagattagatttgagatagagaagagatatatatatggaaaactaaaacgacgaatagaaattagacttttttgccgcgctttttccgtcctttttttttctcgtgcgtttttttacgaactgtttttttcgctactttcttatagagtcggacctttctagatgtttttttgggtttttttttattttttaccgatttttttttgtttttcactttacaggaatcagacttttttccctgttgtgggaatcggatctacgtttcttttttgtttttttttgccaggaaatggaccttttttttgtttttcctgttttaggtgggaatcggatctgtttttttaatctacatttcttttttttcgccagttatcggatttttttttgctttttcccgttttaggtgggaatcggatctatattttttgccagggaatcggattttttaggttgttttttcgctgttttttttatattgacggacggtggaaacaagttaaattttttaagagaaaaaaaagtagtctgaacataactaggtagaaatatttttcttagcaagtctattgatgctgcttgcacatataaaatcttattgctcctatatatattggtgattcaagatttttaagttgaacgtgtgattccaaaacatgacgtccgaacaaaaatatttttatatgaacgatattcccactggtcataaatatttaagtttaggatgaaacttggttacattttaaactttgaccattagtaacttctcaaattattagtttaaaagaaaaggcaaaaaattgtttagatttatcttgaaaagtactatataaacttataagattttagaaacttactatgatataaaactgatggttattttttaaaaaaaattgatcagatcatgtcttaaatgtcaaatattcatttattttccaaggacaaacataaactgaagtttttttaagaaaaacgaaacgaaagatcaaaatgcaccgaagttataaactaacttatattcttgaaagagttgagaatgctaaaacgccttgcacttgtacagcaaggccttctgttgaatcctttgaacaatcaccaaatcctctgccattcctctatatttgtactatcgccgtgtttaggtttcaaagttgttctttaaacttccaactttttcatcacatcaaaacttttctacacacacaaacttctaacttttccgtcacatcatttcaattttaaccaaacttctaatttttgtgtgaaagcctatattcaaaagaagcatatgcaggagtcacagggactgaaggagtatataggagtcgaaaggagagagtgtgtatggcagtattgtcctcttccggccaatccacacacctatcagcgacctgtcaactcgtagcacattcacacgtggcagatcaaatgacacgtcaacttcgcagcaataccatcgttcccggaaaataacaaaatgtaatcatagacaatatctcacagtgaagaaaatgattctcgacaggatcagttagctacagggcaagcaggtcgtctcactctccctgcaacatgtgaaggttcgccatgaaaaaacaatcaagctatcattgacatgcaaaagacaggaaagagaaaaaaaacaatcgctcacaaacctacagctacaaccaccgttgatttgtttaagtcacacctgtcgggttaagttcttcgtgtacatttctcacggtgatcaatcacgcagctccctatgtatatgtatgacaagttcagtgttcatccaggccaaagagtagataattaggcagttatttgatggtgatcatgcacgcatgcctcctgtttcgatcatggattggctctaaattccagccactgtcttgagcgattaaacatttctcgaaggtgatgatcaatgggaatcccagggtgatacattgatgctactagaattagtatgctgtcaagtgtccacgcaagaaacaagcaaggagtcaacttcgcatgtgctgatggagaattactgaatcagttgctaatttactctgttcttccgtagaaattctagctgcagtggagaaatggtaatttggtatagaaccaaaagttgctgttacatatgtcaagagatgtctgaatcttctgctccccatgctccaaatctgcttcccataactatgtgcagcataaaagggaaccacctgctctttgtccttttgcgttaagtaaattcaggcattctgctgatgcctgatgcatcttcttcgacatgagaggttaatgatcaaaatgccaacaaaagtctcaattattagctctgttttttttactcttttaataagatgccatcgatccaacaacacacgcattataaggctctttgctcctgaccctccataacatgaacaagaactacacaatcaagaagaagagcagtcgctacaagagaacaagaagatggcttccaaacacaaccaagaacctggaagaaattaaggattaaagcaagatggccatgtaggccatttttattgtcggtttataatttgcctcagcctttctttcccccttttttttaaggggacagatcattaggccctgaaaagtgcaggcactgcctccctttaagcactaacactttaggtcaacctttattagcctttaggatccactttttgttgaaacaagttgatgcatattccaaccttttcttgtcctaaggtacaggagaacctgataggggacatcatgtcacattagggggaattcatagccattggcccctctattttgtttctgtttggacacaagttatctctcaaagttttgttctcttgtcaaaggataatcttaaatttgcataacctaacattgccacatgtgggcgttggataactggcaaactacaagttttatttataatctactattcaatgatagaaaaaaaggatgatccagatcaaccgaatggtagaacaataatgccaacatatgcgcttcattgtagtacgttggactctcaatctagaccatcgaatgcacgatctgacggtcgtctacgccccatgaagctagcttctccacgtgcagttctccatctttcacacgacacgaaacttactccgaatcgaaaacaaatactcttccatgtattttaagttctaaccaaggcacgaacagacaaaggcttttccttctcaaaagatgcaacggtcgatgcttaattaagcaatcaagcttaagcgttcggtcttgagaacggtgacacgctcgcgcgcgtggaggttaagctcgtctcgaggggagctaagcttaagccaccaaaaactgcagcaacccaagaaactcgcatggttatttgcgaatgatagtacaggacagggagtgtggcaactatgcgttgtttatttaaatcagcagagagagagagagagagagagagagattcttgttttttcatatgacatgtttcaaatttgtcacattgcccaacccatgattgtctgtgatcccttctcactcctccctcactcaccaggtgatttgaaacccatccagttttgatcaacagaaagatacatccatgctgcacttccagctcgtcttctttcttcagatgaatgtttttctggctgcaagtcttggccataccagggtctttgcagtctcccagagcagagcagaaaaacataaatgtgacatcttacaacctgctacctcgcattcaatagcttgcagattgtgccaggcacatctactagtatagattttctttttttttatctctattttcaaaaatccggcagggaacagtgactgttcagaatgaaagtgaggttcagaaagtgatttgatcagtttccaattaaaaaaaaaagagaggatactgcgagcaaaattcggaagagatataaatgtaagtgctccaataagaaacggagtgcaatccaaaaataaacaatgaacccaatgtgcattagacttatgataacaacactgcaccagcacagtgcacagctattagatttgatgctgttttcttttcaagtatttgcttatagcacaaagccagaaacagctatcagataaaatatcagaaagtggctttgcaagacataaaaaataatcaggaaagctgttgatccagccagagagcaaggaacatgatgagcataccacaatcctcgcagcagacatggctatctaaaaaatgtcagttgttaataagctttcctccaaggacttctaaattttaaaatcttctatatataactgaagattaaattgcaacgttaggtggaagccatgcttttggcaagttatagcatacaaatgttgcggtggttcacaggttgttagcaccaaactctaattttcttctgtttaaggttatgatacagtattacagtgcataacagtatgcaaactttgaacagagacggcatatgtgttgttttctgaactcgattttgttttcttcataaatggacactgcagataataaatatttaacattcatagataagatttagttcaatttacggaactttgaccatcaacgacttcccaaatgcttaatttgaaaaaaaaaaggtatacgtatatttgaaatgtacgactatcataatgacaaaaattctttatattttgtacactcaatataataaattattagattttgtaaacctattataacaaaagtagtgattacagtttttaaagttttgaattttatcctaaatatccgagaggagtacctaaaacgcctattttattttcaacggcaattaatggaatgaggggtatgtttctagatcaaaatcttgtttcaaaaaccattagttcaaggtgttctgatctcttttttttttagcagcggccacaaaattcctaacttatatcccaatgatgtgtacgtagttaatactcctttcgtctacaaatataaggaattatggattcaattttatctgcaaatcctatatttctataaagttcatcctcaccaagtgtagttaatgctatttttttctcattgagccacatcatcttaattatttctaacccttgaatgattgatctatggttcaaattatgtccctcctttccttcttctaggaaatcatatcatctttcttttgtctttggatgattattctatatcatttcccttcttttcattccgtcattgaggtatatcaccttagttttgcttttgaataatctatttatatatgatttacattgttataaaccatatcattttaattgtttataactttttttcttccatggttgatcacagatgaaaattatataaagtatataaagtgatgtcgtgtagctatatgcatgttatttatactattatcatatataactcccacagcaactcgcggggtttcattttgaagtggagtactattttcccatttcatccaaccattgcatttattgctactaggcatgacctttccattcaattaaactcacatggaaattacttcgaaagtaatttcacctcaacacttaactttgctaaccaatctagagtctactccttatatttgtagatggaaggagtatcatcagtgatgatgagtagaaacactcctttcaagtaaatattacagtactattttttagccttttaatggtcatgataataccattttttttctactctctctatccacaaaagttacacatattacttttgacaccaagaccaataagaaattaaatcacattggatgttaatcaaagagcgaatataaacatgcaactaataagtatttagatgactccttgagttttaatgaagcatgtaatttatctcttcatttaaatcttgaatatataaagactataaataggaacaatttatttagaaaaacttaaatgtaaaatatgtgtaacttttatggatggagaaagtaactttcacagaaggtgcagtaagcaggtacagggaccatcactcctcagtcaaataaaaaagaactaaaattgatgctgagaaaatgaagcaaatagtggatgggggagtgaaaggccaagtttagttccaaaatttttcttcaaactttcaactttttcatcgtatccaaacttttctacacacacaaacttttaacttttctgtcacatcgttttaatttcaactaaacttctaattttaacgtgaactaaacacacccaaagacacaccacatcaaatcttgtgctagtcattggccaatagaccattcaatggcggtattcaattcctctactgaaaccctctccaaccctctcgtaaatgtgctgcaacctcctctttctcttctccctctctataaaacacaagcgaaaataaacgccacgccacgccaccgcctccgtcaaacacggcggcgcaatgcctcccctgaaccctccccacctccactttggaaagctcaggaagcgggcgcgcgccgtggccgccggcggcggacgccagccggctgctgccatggccaagaaggggctcgttggtatcctgtacaagctccgcgacgtgcaccatcgcgcgccgccgacgccgacgtcgccctcgtcgtcgtcgtccccgcactgccacggccggcatcagctctgctacccgccggcgccgtcgtcgtggccgtggccgtcgtgccggcacccgcgcaccagctcgttcaggtggccgacggcgccgcagcaggggcaggcggacgacgacgccgccgccgccgccggctccgtgtaccgcaccgtgaacactgtctacgacacgtcgtcgctggagcacttcaacccgcggcgctcctccctggacgaggcgtcgtcctgcattgctgaccggagcttcttcgccgtggagtcggaggtggaggtggaggaggagaaggagaaggagaaggagctgcagctgcgtgagacggccgtcgtgcgcggcgtccgctcggagcggctctttttcgagcccgccggcgcggagttcttgcccaagcaggtaatgcggcgcacgtcgcgcactacgattaagacgcgcgacgacgcgagagcaatcgatcttgttataacacgagagaggatttcaggaaatggcgcgaggcaagaacgacgacgaggcgacagccatggacgtcgtcgctcgcaagaacgacgacgtcgacgaggcgacgccgatgaccacgccgcagaccggcaagaacgaagcggaagcggcggaggccgccgcgctgaagggcggcgcggtggtgctgacggtggagtcggaggacccctacggcgacttcaggtcgtcgatggcggacatggtggcggcgcacgggctgcgggactgggagggcctggaggagctcctggcgtggtacctcaagctgaacgccaagggcgtccatggcgtcatcgtgggggccttcatcgacatgctcgtgagcctcgcgtcctcgccgatcccgtcgcagtcgccctcgtcgtcgtgcatcaccttcgaggactactcgtcggcgaccatggaggaggagagctaattaagctgttctcgaggaagacgacgaccacgttttgtttttctttagcctcatcaagagatgacaatctctttttctctttttttgggtgctaattcttttgtgtttccacgaaggaatggcaagtgagggaattattgtacagttgctaaaaactaattgatgctgatcattagtgtagattaattaattaattaatgctgagatggctaattgatcactttgctctgctgtgatctctcttcctagcgtagtgtgggtcaagatgtcaaattttcaatggctgacaatttttatcacaattttgtgaagattttgatgacaagattcagaggaatgatgggtcaaaccctgttccttggtctgcaggtccatgaaggcaatgcaggttatctgggatatattaatgagtcaccaacagctcataaatatgtggccttcatgccattggtttctttggagtaatgcggtaccagatgattttaatccaagagattgcaatgttatcaagctgtcacgtactctaccctgcggcaagtattagtaattattttggtcacattgacagggggctgtgtgtttagttcttttcaaacttccaaaaattctgttacatcaaatgtttatgtctttggacacatgcatagaacattaaatgcaaacgaaaaaaaccaattacacagtttatatgtaaattgcgagacgaatcttttgagtctaattacgccataatttgacaatgtgatgttacagtaaatatttgctaatgacgaattaattaggcttaataaatttgtctcgcagtttacagacggaatctgtaatttattttgttattagtctacgtttaatacttcaaatgtgtgtctatatattttaaaaaaatttggacagggaactaaacacggctagggtcaagaaggcactatttgaccactaattcccattttctacataataacataatatgttgataaatatcagattttaaaaaacgcacactacataattttataacgaatgtaggaatgctattgtcgtgcagccaagctagacacggtttatatactatggtcaaacctaaaaagctgttaaaccacatttaattttcgagatgttttacaatggtttttaatgaaagtagaattaagttagaccgtttattttttttctaattcaacagatcatatatatttatactaccatctctatgtagaattttttttactgctactagaactcatatatcaacgactgagataattttattggtgattatactggtagtaaaatgctatagtagaaaccgcttcaaagattctggtattttggctgaaattattggtgtttagttggaagttccttccaaataccagttgatgaaagttggatttctgttcagtttgagtaaaaacatgttgaaatttgcctcgaaattctacaagaaaatgtctgtttcatgagaaatgtttggccttggattcttatctaggatatccacacattaatccacgcacatattgcaagcatgatacttccattttcgcgagcatagtcagtacaaacactactaggactgtttaagttttgtccatgaataagccttacccacagtcctccacgatcataagtccctttcagtgttttcgacttgaatgcgtcgagtaataacacagtgggtccatgaatttatcagtgcttatcatgaagcttaactcttacggaacaggacagactagtaatatcagctaggccccggcagagtccttttaaatctactactaaatgactacttactctaatcaagcctcatgttcagcagtcttcaggagttaccaggacagtctaatcaagggacaagagtttttcactgcctggagtagagactgcaaatttggtcggtaaagtttatgtaaaatggagtagtaactgggttatgaaccttgcagaattcagaagccatttgtgccatttgtaggttagatcaagcagaaacatagtggaactgagtgccatatcttatcttagcttagacaacactcgtagtagtagctcctaaggctagcttaagctttgtccctaaccaccttgtgaaacttaatttatgatgcttaaaggttcaagcattccaagttgttcttttaccctgcaacactgcaagtttgcagcttctagactgctcgctgagacatgttcgttcaatcccagtaaactgtaggctcacaacgagcgatctttgcgtctctattcttaggtcagattgacatccaacgctggatcatgcaacgcatggataccaccaaacaggaacacattgtgcaatgcagagcacttgatcgatgagacgtactactccagagtccagacagatttaagatcgaacagggtattaattacttctgcaattctgcatcctcttcactgctactcctacgtccgggacagcgatcgatcgatcgatcatgcatgcggctgatgcatcacatctcgccaacatgcagatgcaaacacatcaggcgtagcccaaccaaccggcaactacaagcatcgcatgcatgccaatccatctgatcactgatgatttacatggttcgcgtatctttgggatcacaggcttcgactgttttttcgcagcatcttcagtgggtgccgttttttctgtagttcagagatgataagcacagtaaacaggatgtgccgtgttcctgttcaagagatccgggcatgttttgcgctagtggagtggatgatgattgtgatgcacaacatctttgactatgaattgcagatttgcaggttggtgatgcgtgatgtacatacatgtggttgtggacggcataaattggaacttctctgttgtggatttgtatgatcagtcttgtcttgtggaatcatatgctttgtgttttgtttgaaagttgtgttgttattggaaagttgatctccctggtatttctcttttagattttgtttaagagagtcagagtgaaagaaagttaagactcaccgttttctttctttctttctttctttccttttgtttgactgaagacaaaccttcttttttaactgaagactcaccggtttgttctttcttggtttgcctatagtgcgatcttcaacactgaaaataaatcatttcttcactagctggagagataaaatgaacttgctccttcttctctatccatagtaaaattcaatccttaaatatgaagtgctaatagtaaatatacagatggagctgaaacatgtagtgcatttctgacggaggtttctgaagatcgctctaaggagtaaggagtgcatcatcgatttcaggccaaattgccaaggcatgctcgttccaacaatgttttgaccgtttttattttcagatcaacgaaaattgtgccggatttgtcacgttgttcattagcctcgcttctcacgaacctgacggaagtttcagtgacagggggcaattatctaagcctcccgagcccagcgccgagatcaaattgactaactagttaatttcccctgcttccttagcagagacggtcagacttgccaaacccaatgcacaatgcaagctgcaatattgcaacacacgagtcacaagatgttacagcatagttgaaactctcatcaggatttttagagctaaaagatatctagtggttcctgctgcaactttgacagggttaagttaagaagataggagcaagtagtagtttggatttgctaatttagtcgcctgatgcagcacatacttgcaaactctgcaatcgttagagatctgaggaaagaaaaaacaatgcattatactccggttctccttaaatctacaacaaatcgataactccgtagatttttttttgacagttttagtgctgctctctgtctccggattattactgtggattattttatttatctattctttactattataaaaattgaagatatttttgccggtattttggtacgtcatccgtgtatgaattgatttttaagtttgtttgcttttggaaatacatatatgtatttcagccggtttttaagatcgttcactttcggtaatacagagggaatcacataagaattttgtttaaaaaaaactcatatgctaacttgacattatcggactcctaactgtagttcatgattttatatatatatatatatatatatatccaagcgaactcccacagtaaatttcatcttaactaaaccatataataataataagattaaaatagactttacccattgcaacgcacaagcattttttctggttataaaataaattaaatatgttgaaaaataaatttaatatatatagcttagaacatatcatctaagtaatacagtagaagattgtgttttaagaaaacatatttttagagatgatgaacaagtaatttgcaacggcattaatctagggaaatgatatctaagcgaaaaaaaataaatagcattaattgtttgttgtagctatagcggacttctaccactaccactataaggtaggggatcaaagatagtctattagatcttagcggtcgctatagcttagtgactgttatagcagtaaactattagctttgttgggttgttactgtacttaaactacgttctctatctatggataagagaatttaacgccatgtgcctttttatcatattcattaatatgttatttataaattttatgctatgaaatgtataggtaactagatatgctaaatttttaaattttaagtgaattttgacactagtattaatatataatctaaatgtatagtaatttttaaaattccgctattggaacttagcgcctagaaggctacaatagcaccctttatcagcaaccatctactcatacattaatccgtgaccatttgctattctatatttattaccttaggtgtaagcatatttatatttgtgtatattagtttatgcatcttctatttaaataaaatatcctatgctagctttttttttcctttggaaacttattccgatactagtattttgttgaatccaagctaggtagaattattgagatgcacaaccaacaagccaaaacagaggacattcggagtatcagcccaataattatcatctcaccgtcaccttttagcaggtttagtgtcacatctcctcccagataaaaccaaactaaccctaaattattgatcctaacaaagctcacttttttttaggctttattgctactagtatattcgcaaatcgcttgctcgatccagttcatcacgagtccttaattcggtgggccccactcgtcattgaccatcaaacgcaaccggacaagggcaaagccgtaattaccccctcccaaaaccgccacgcgagatacctaccgccagagagcggcggagaagcagccgagcatagcagtctgaaccctccaccgaagatgatgtctatggcattagctatattgtcacttttaacttatttggcactatattaattaagagagagagtgaaggaaggaagaaactgggtctcatgcaagacacagcttcaacacgagaatatatgcactagacactatcaatttttgtattagaagagaatagtgtcttcataatagatgaagaataaatatgattggtagagaagagaaatgatgtatttattaatggtccactttaagaaaccatgggttgtagagtgtagtttctattgtgatgtcttattgacatggcaccatagacactacttatatatactatgggttgggattgccctaaccacctgatttgccttgtcctcagctaaccaccttgggcaagtaagcgagcaagtcagaaagccaccgaacagagcaaggtcacttcacgccattaccttcttctctccaagaactcgagtagattgggcaggagattaagatcctggccagcttcgtctccaagaattcgacgctctggttcaggatgtcggtggaattcctgacgaaagcgctcacgtgagtgtgccccccctcttcccgctcgccaattctcccaattctggtggggatttccggtgccgcctcgccggcgccatggcccatgtgctatggagattattgattcatctgcttgattgttgggtgggtgcagggcgctgttcgggtatgctatgccggcgttggagtgcttcaaggcgatcgagcagcggcctggtcggacggaccatctccggttttggtgccaatattggtactgactactgactcagaaaccccttagcttggagtaattagttcatttggtgtgttcaatttgatctctgggtgataggctgatgcttagaattcgtcgtaattgagtgaattgggtaaaccatacggggattaatttctgctatctgggtacagttagctggattagagcattagaattggtgctaatatgttactgcattgctgtggaattcagtaccaaatcctcactttcacctttctgaagtgctttgaatattggggatctgaaacaccgtatctactgtttggagatctgaaacaccttgcaagagttgaccaatttcagcaaatcttgcaggatcatactagtaatcctcgtcatattcgatgatatcgctggtgtcctcacctccaagtaagtaataatcacacaaccacaactcatcagctgttcctgtaatctgctccctgtaacctggcaatccccttcattgaatgacaggataccaatgtactctgaactcagactcgccttcctcgtctacctgtggtacccccagacaagggtatgtaatgctatgtctgcaacgcttggtccagcaacaaagctgcagctaactgcatgtcctgatcattgtctgaactaaacaagatttgccacaaaactgcagctgcacataactgcatctcctaatcatatctgaaattctgaactaaaaacgagatttaatctaatttgcaacactgagtccagcaacaaatctgcagctgcacaaaaagtgcatctcctgaccacgtctgaattaaataagattttgctttgtcactctgaaccagggaactgacatcgtgtacgacaccttcctgcggccgctggtgatgcagtaccagcccaacatcgaggagcggctgcgctacctgcgtgccaatgccggcgacattctcatcttctacctcaagaacttcaccgataggggctacgatctcttcctccgggggatggagtacatccggtcccagacgtcacgaggctcaagaacgagggtatgttaccagttactctctgtcccatatcgtaaggtgttttagttttgttctaagttaaaattctctaactttgatcaaatctataagaaaatatattaacatctactctaccaaagaacactatcaagacatatttcatagtgtattttaatgaaactaatatgatattgtagatgttagcactttttcttttacaatcttggtaaagttagaaaagtttacctagcacaaaagtaaaacaccttacaatatgaaaacagaggaagtagtagtacacatgttgggaaccatggtcatcacaggattccggaaatgtaacagtgcagtcaaagaattcaggatatgtaacagtgcaggtgtgtaactatgttggcaatggtttgtttctgctgtgcagcggtggttctcgttcggaggcgaccgggcagagaggtcgagctacgttgatgattatgtcgccggcggtggcgatcggaggagcacggcgaggcaccggcgaccccgcgacgattactaacgggctggaccggcgccatagggattcagtagagagaggtgcacaggattggaaactagttgattaggagtgacaaaatttaaaaggcccaaagcaaaacttctcaaaaacatgatgtgtatatatatatagacaggtgatcactgatccatactctggtatatatagctcctcacaatttggcgttgcaggttggctagtttgttggttttcctgttgtgatttgtgcacccgtcttcgatagactacatgattcattttttgaaacctaaggcgaaactttgttccacttttatatttagaagaagagaattaacccagtttataaggaaaaccgggcccaaaaaccacacaattgcacggttaattataggaaaaccggctgaaacccaccgctacacaactgacaacgacggcggagcccaaaagcaggatgtcaccgccaagctaaacacaaaagcgatataacagctcccacatcgcagaagaggtgttatcgttgccgagctagccgcccaagcgacccaacagcgccgacttcacaactgcagcgacactgaagacacgaaagtcgccaaagcgaaaagcagctccgacatccaacaatagacatcagccaagccatcgagaagccacttccttcacgcggccagcaccccaccagaaggaacgaagtggacccaagaagacaaaggcctcaccgagcacaaggtatgaaagcttttgaaccgaaaaagaccatcaacggtcgtcgatgcattggaacttctccgaagcgacgcccccaaggaggacacgacgtgtaacgccgccgtcgctcgtctgaaagccggaacaaggttttcatctggagattgtgggggatatgaaagaatgccatgacaatgcctccaagaagggaaatgacgcccacgagcgccgccgtcgtcgaaccggccaaaggcacggcaaggctttcgccagcatcttcacatcacccacacaagcacccccacattgacggccacagaatagtccatgacgtctcacaagcacccatacctcaaccgtaaccaacggcaaagacggacccttggccaccaactcctacagcaagccgaagcctccgccctccccctagcgttccccacgaccagaacaaggtccggccaaagaagggagggaaaccgaaatgagggagaagactcggtcggcaacgaggaagtcgccaccgcggacgtcaagcccaattcctgcttcacgccagcataagccatcgtcccgccaactccacatccgcacatcgccgcccatccgacgcggaggggacggatccagccgcggacggccagatccagctaggacagcgcaagccggctcgacgtaagcgccgccgcagcaccgttgtcgttgcgaccaccacgccgccacagcctctgcctgcgcagcgctagcgccgtggccccgcgcggacgacgccgaggccaacgccgcgacaggcgcgagcgagccgccgctgcccgcccaccgcgacgccgcccctgcctgtcgccatctcgagccccgtcgccgacttctccctgccgccagccgccacctcaccagtgttgtcctccgctgctcctcgttgcgctgcaccgctctccgccgtcgccggctgcccctcgcgcgcgagccagcctccgccgtcgccggccacacctccgggaacgcggcctcccccgctgccagccgtgcctccgcgagcgctggcctccaccgccgcggccgcgcctctgcgagcgccggcgtccacagccgccggccgcccctccgcgctccttgcgcgcgccgcatccgctcctctcccctccgactgccgtctccggccggatccggcgggggcagcgccggatccgccgcctccacgccgggatgagtcgccgccgccgcgtcctagccgaagacgacgcgccgccccatcgccaccgtcgccaccacctccctcccgcggccatcctccaccgccgcctatgcatcgccgcgtcccctcgccggatccgcttccaggggcgtcggatccgccgcgcccttgccgtcgccggccgccggagccccccaccgtcgcgcgccgctccgtcctcccgcgctgaggaagagctttgccagttctcttggccccgccgccgccttcccgactggccgcacggctttccggcggcgagctccggtggcggcgaggtggttagggtgggcgggggtggcggcgcgggcggctagggttttgcccccgagccgcacgcgcgagagcgacgcggaggaccccactaacaaactagactacatgattcatgcgatgcaacccccactaacaaaccttttgatcattgtgatgaatacataatggaaacaaaccaaagaatattatactgttgatgatggataaaaaaatcaataccatacttgacgatggataaaaaaaggggatttttttttcatgagactccacacaagtggcaagccatccaataagactctccacgagtgacaggtcatacaactagttggagcaaccagctgctatttatagatttcgcatgcaaatctattcatcaagaatacgcatgcaaatctatttgaaagaattatgggaataatagatttcgcatgcaaatctattcaagaattatgagaatcagtaactaactagtgctatttatagatttcgcatgcgaatctatgcaagaactcataggaatatttgactaactaattaataagttaacgctggatattcctcctcgacctgatcaacctgtttcacgccgatgatgccggccacgaaccctaggcaagggcagacgtacctcttgacgaagcggtataccgcgccgccgcgccgggtcccgagcggccccggcgatcgccggcggtggagcgcggggtggggcctcgcgtacagccgcgacgtcgcgcgcaggagcgggtcgctgatgccggccttcggcggccggcgggagctctcctcgaactcctgcgagccgatcacgtcctcgaagctcacgtagccgggcgtcgtgtggcaccgcttgaagtaggcgtcgtgcgcggcggcggcggcggcgtgcaccaggtcgtcgtaggagtgcagccgccgcgagatgggcggcaaccgcgcctccgcccccgccggcgcggccccggaggaggagaagttgtcgctgccattgctgtcgctggtggcggcggcgctggtggagtggtgggagaggaggggctgcgagtaggatgcgcgcatggagaaaactggggcgacgtacgagacttacgagtagccgatcgagggagagattataagaaagaaagtggttaaaagatggagggcggtattagggtttgattatgagagagcatcacacccaactcgtattcggtgaagggggcgtagaaacgtattcggtaaaggggccgtagaaatagtgtatacagttatacgcacccggtttgccgcgcgccgtccagagaagattgaaactcaaaatcgattgaactcactcaactcaacccaaaagatgattgtaaatagatgtcaaatcgaaatagctaggtttcaccaatcatccgcggacggtttgaggaagcatcgatctccatcgaggactcgtgcggagctcgccgccgtcgagccgtccaggtgctcagtttgctgctgccgcggttgacgaggtcgcgctaggattgggagtttgagaggctggctggagagcccggatggccggatctaactaatgaattgttatgggctttggggctgagagatacatgggctgcaggccgaaccaacctgtgggctgagcagctagcggaggcgcttccgcttcggttcgtttgcggcctggaaaccgcgccgaacaggctactgggcgaagtggccaacacctaaaactggatttaaaagaaaaataaagccaagcataacaatactagtatttagattcggtgtaatggatcaatttacggtgaattttggatttttactctgttcggtagaaactggtagtaatataccttaggatttaatttgtcaaatacttttacttatgttatggtgggtttacactcgtcccttgctaatatcttccatagttggcttggtggtttacaacgtagaataaatgttaactttttataggtgccgtagctttgtgttggacggtaagactttgtagtaatgatataatcttcaatggcttaagtactaactcccctctttgtaggtaattttcaggtgaacccactgcgctagtggtcattgttgcttaacgaggagaatagcgatgtggttaaacacatgcacaagttaccggaggctagagtttgggatttcttttccagatttgcgtggaacttgagtaagcggttggagacctagtatccacttttgtcatcttttgttagttggcttctattcacgagacgacttcgttgtgaggtgttgtagtctaagtacccttgttttatttggtcggtggtgttgttcttatgcaaggtgtgatgctaagtactattgacaatgtatgtttggctatgtacgtatagtttggatgtagaggataggtttttaatcatttttttaaaaataaattgacattttctccctctacatgtttatctatgttttgttagtattgttgtattgctctcactaagcctagatgctcgctagatataatgtatttttgcttacttgtactcccctccgtacgttcaaattttttttatgagatagaacacaacctatatacaataggatgtgttccatccaatcgaacaattatattttgaaacggagaaattgtaagaattacaagttgtcctagcatatctgcactcttccatccatcccaaaataaataaaagaaaacttttgcaaaaccataaacagagtaaaacggaccgagacgagaataagccagcggagcacacgcgcaacaagacaatttttttgtttggcattcctatcaaaatattcccaacatagcatagcttctagtggaaactgtgaaccactgaaccaccaccatagacgatagcgtttgtagcttgcttgcaacggacaaaccaattaaataccccctccgtaaccgcgagattctaagttttcaacgaaggctgtatttagttccatgtcaaaattaaaagtttgaaaaaattagaacgatgtgacagaaaagttggaagtttgtgtgtagaaaagttcgatgtgacgaaaaagttaaaaattcgaagaaaaaagttagaatctaaatagggccaaagcgagaaagcttccttgcaaatcctggctgtgtgcatatgtatcagtacttccttcgtctcagtaagttaatttttttttattttttttatttattccaaaataaatttattttaaaagtaataattgtatcaaaattgatgaaagtagaaaataattatattgaaaatagataaatgagaaatagttgcattgacattgataaaacaaaggtattttagttttttattgatgatatgtgaaagaagatactttctccgttaaaaaaataaatctaaaacgggatgtgacacattctgtacaataaatatgaacaaagatatatatttagatttatactagcacactgcacacgacacacacaccagcaacgggggcacacgacacacacacaccagcaacggggattagaagttgacacgactgtctatctggaatcctagctgtgctgcggtagcaactgtcctcagatgctgatactccctgatagccatagccacgacgcgatggggtccccatccatcctcccctcctgctcggttgttttcgcttcaggttcagtgcagtcacgagcgcggacgcccccaaaaaactcgccacgctgtgtgcgcgcgcgcccaccgcgatccccctgatcccattaacgtttcacccgcgcgcgcccacctgccgctgcaatatatttcgccgcgccccgcgccacgccacgccacgccaccttgcgcgcgcgcgcgcacacacaccccagcagcagagatgagggggatgggcgacgacgggatggggccgatggcgatggcgccgccgcgttccggccacgccacggcggcggcaccgccgccgccgcagcacaagatggcgatgatgatgcacatgaccttcttctggagcgaccgcgcggtggtcctgatccggggctggcccggggagcgcggcgccgggatgtacgccctctgcctcctcttcgtgctcgcgctcgccgcgctcaccgaggggctctccgtgctctcgcgccgcctcgcccgccgcggcggcggcgccgcctcctcggatggcggccgcccggcgccggcgccggcgtcgtccgcggcgctgctgaccgcggtgcacgcggccaggatggggatggcgtacctggtgatgctggccgtcatgtcgttcaacgtcggggtgctcctcgccgctgtcgccggccacgccctcgggttcctcctcgcgcggagcagggtgcggccggccgcccgtgacggcggcggcggcgtggcctgtgagcacggtggcctccctcccgcggatggatccaagacttagtccccatcgattccgttaaacgagtatgtccaagcgccttagccagtagacactatgcactgtatcggatccaatgtgaaaatttaccttggatatctcgctaaaataattgtattttgtcgacttgcttgatatctgttcccgtgcagtcttctctagtcgtttttcgtttgtactcctatgtttcaagatggaatgatactactactagctagtattgatgtgagttctctactatgctaactttagatgaaccaatgatttgttagtactctccttccaaaaatatcctttttttaaatggaatccttccaaaaatattagatttatttcatattttgaattagctacatttgtagttttcatgtatttaaaacttaaatgaatagataaattaaatgattaatcggaacccgatgagtcatcttaatattcattggctgcgtacatgcatacactaattgatctttgttacaccttatctccacttaaattattattatttaaatccttcacccttaagatttctaattgtattgggtgcatatattgtatttattagagtgataaagatgataataattgtttttgttctttcgattaaatgtagctgtgtcttatattcgtttcatatgttgatgaaaccaaccctctagtatatgtttcatgctcatggtaacatatactagggtattctttttaaattcctattttgtgatagtgttgtcatcaatcaccaaaaagggggagattgaaagatctatgcactagaattgccttgtaaggggagattggaatatctatgatcctaagagcgcggtgattgttttggtgattaatgacaacccattgttggaactaactatttccatgagttggtgagattaggttaagtttcagcatcaagttaaaagattgaagctagaagatggacattataccttgatgaggagcaagtgaaggcattgatgatgcggggtatgaaatggctatctatggcaaaccggtgaagagaaagcaaggctcggctagaagatggacattataccttgatgaggagcaagtgaagacattgatgatgcggggtatgaagtggctatttatggcaaaacggtgaagggcaagcaaggctcggctacaatggaccatgtggggggtgaagggcaagcaagaggcttggcgccgatggactgaatccggtggtgaagggcgagtgaaggctttgtcatgatggtcatgatggaccgtatgaggccatttgaagctatgagtaatccgtatcaattataagaagaccgcaagatggaatgccgaggatcaagaggatgtggttcttcgatgaacatcaagtcaaaatccaaagtgggcattgatcaaggcaaaggtataattgatttgggactaatatgcttaatgagtgtaggtgagaatagtcccaatagtgaaatggtgttgacatagacaaccctcaaggtgaagcaagaagatgttcctagtggtgtattagtcccaggttgcttaggagtgggctaggatgcttggagatcccccaaaacatcaaaatcaaagtggcgagaagactcggagccgagttagactagtttactttttcgctttgagtttaggaaaaaccgtactattaaaaggggttccaagtatggttctaagataacacaagtgctcttagtggtgtccaagtgttgaaatatttttaggagctgtttttgaaaatgactctactcgggacagagagtcccacccggaggttctgtccggaacttcctggcgccgaggtgaggttgaaaattttcctaagtgttgcccggaagttcctggcacccaggtccggaacctcctggcaaccctccagttcaaatatgtgagtaacggctagatgacgtcacctaaccgttatatatagccaactcgaccccagctcattctttggccattccactttagttcttgtgttccctagcttgttctagcctctcccaatgtgattttgcttcctccacccaaatcttgtgcacttattgagtgagagagtgaatttgagggtggtggtgaggattggagaaggttttgaaggctaggatgacttgagcacttggtgtatctcgttgggctatcacttgaagcttgttactcttggagggtgacctcctagacggttaggtgtcgcccgcaagtttccaacaaggttgtggattgacccgggcaagtttgtgagagcgttattccacctccgaaagaaaacagaggtgaggtttaggaggtcgtcttggtagagcaagcctcacttgtggtgttcttttggtgtttaagttggggatcttagtggtcacttgaaaccaaagagaagtacctaggggtgttggcttgaagaccggagacctcttcctaggccttttcttggcgaggcaaggtgttaatcaagacccggctctttggagctcctcaacagagacataggattctcggtggagaatccgaacttcgggaaacaaatcatttgtctcctctcactctctttatctttgtgattgtgatgcttatctccttatttgcctagttgtgctatcatgtctcccattgtatgatcacttgtgatatcttgtgtattttcatgtgtattactcttgtttgagacatgttgtacctctctatggtttaggcttccttgtgatttaatttacttgttgtgaggtgcttgaaatagcaattcacaactgcccggaagttccttggaagaaagagaggaagttgagcaagaatgaggatcttgctcataagttcttcaaatccaccaaagagggacactttgcctcaagttgtccttgcaagattgatgatgaagccacacttccaagaaagacatcaagaatcaacaaaaggaagtgctacggttgcaatgagaaggggcatgaaatcggattttgtccgcacaagaaggatgatcattgcaatcaatcaagcaagaggcaaaccggtaacaagcaagtcaagaagcaagataaaagcaaaactcaactttcctacaattgccgggtaaagagacatattggtaaaaattgtcccattggtaacattcctaagccaaacctctcatttcatcacaatttgcttaggaaggccaaaaatggcacttgtgccactagggtgattagttcgctacatgctagcacaaaggccatttgggtgccgaaatctcttgtgactaacttccatggacccaacattatttggtgaggcaaggtgttaatcaagacccggctctttggagctcctcaacggagatataggattctcggtggagaatccgaacttcgggaaacaaatcgtttgtctcctctcactctctttatctttgtgattgtgatgcttatctctttatttgcctagttgttctatcatgtctcccattgtatgatcacttgtgctatcttgtgtatcttcatgtgtattactcttgtttgagacatgttgtacctctctatagtttaggcttccttgtgatttaatttacttgttgtgaggtgtttgaaatagcaatttacaactgcccggaagttcctaggaagaaccccggaagttccgggcagctttctctgcttgtgagaaaaagctgccaggaagttccggaccttttgccaagaagttctgggccctgattttaaccgctacgatttgaagtaaattttaggtgcgcctattcacctcccctctaggcgacatcaaggccctttcggtaagcaactattgtatgattggctattagagcaaggttaatagtatagccaactactagctcaaattcatctatagccaatctaatagctaatttatacaatagttgcttactatactattagtatatggtcctacttgtcatacacacattgcgtcttggagtccgtgctgcagctggctacatctctctcatcttttatctcattaaaatatgtttgtagctggctaatagtttgttattgtacctgctcttatattgactatatatgatttggagttagtagtgtgctatactattaaacttgctcaaattgtttttcgggtcagaaaagaagcttcggatcattaatctttcatgtaaaaatcatgtaaagaaataccgctaaggtctattcaaccgggcatcaaccatgtggaggtctgaaaatatgaaaacgaccttgcagggtggcaccgtggcatgtgtggaggtagcactgtggcagcggcaactacctgtgctgtgcatctctctgactctgtgtggtggcgaagatttggaaaggcagcaggaagaatcttgcaagatcattgggtcccgttcttttctctaagcaaaagttgaaaagattttcgtggcacgctttttatatgaaagttaaaccgtatacttcgtacaaaaattttatatatgaaagttgttttaaaatatcatataaatctagttttcaagtttgtaataattaaaactcaatcatacgttaataccaccttattttgcatataaaacttaatttttatttttatttttatcttcagaagaaaaaaaacaccatctaaaaatcgagcgtccagaacctcttattaaaaaaaggggacgaaacagagggttaaaaaaaaaagcttatcaggcctattagcagtggcagcagggatgaaaaagggatgcttacaagaaacagtagcatctttcatctcttctgaaacgacggattgtcaggaccatatttatcaatttagctatttagtaaaaatagcaatatgatgttaaatagaaaattaaaaatttataaataggtagaaccagaaacggtaaaaaataataccactcatatggaaatggtgctcggtcgacccggaatttccgtgactgttttcatccccagtggcaaaaagggaacaagaaaaaaaattaatttgatttttttcatatagtttgtagattagcaattgaaaaaaaaaatactacagttttagttgaactgagcagattattggctatgtattggtcgcaaacttgcttctcatttaccattcttaagagccccaccgaccgctcccttctccatctctgatgagtatgtcgctattgatgcatcttctccaattgtctccaagtacgacacaatcccccttctccttcgtctccgatggttcatgccattgccgcctgcttcctaacaacatgaccttctttgtttccgcggttgatcctatgcactactctcgttcatccctaagcctctggtgctaacgcttctgtctttccctcaccggcccaccgtctctgccactcattgctattcctccatccctctaaacctgctctcatcgaagtcctcgccatctccctcattgacgcctccacctcttggcaggccatggattttgatccaatgacatccattagtggattcagaatagcaaagcataaaattaaaaccgtttatcatgttgtctattcgtaaacttatgcgtgaagattgatgaactgaaccaaatgtgaaaaccccatatacaagactacaaattacagcactattttttttttttgaaaatccctgatatgactatgcctatagaaaatcctatgacgtaaatatgaggtggctttgcagtattgagactctgaacagaacctctctcaaagaaagaactaaaatacgtacttcaagagaactcgattgaatcatggcccaaggcccaaagcccagtcgacgcacataaaatccaatctctcccggttgacggaccgatccccagtggaaaaagtctttgactgcttccactatcgcccgagtatgatttatttcctccaaccacaaaaccggtatatcgacttctctaactattaaaaccggtgcaaacaatatccctcggtagttttggaggtgggtttggctgatgtggtggtattgactaagtctttctcctacgtggcgcttacgtggcattaaaataaaaacaaaaataaaaaatatgtgggatccatatgtcattaaaaaacaattataggacccactgatatgtgggacccacctgtcatcctccctcttcttccctcttcctgcccctctctcccttgtctctctctcctccccggcctttctctcctcgggaagacgacggtgtggagaggcggtggggagcggcggcgaacgagggcggcgcgggagaggaggtggacgaggaggtagtaggcgcggagggagtgggggatcgacgacgacggcgacgaggaggcggcccagtagaagaaggtgagcgcattcctagcaacgagctccggggaggaggaggagtggcggtgcttggcaagggagaggaggacgacgtcgacttggtcggcagtggggaaggcggtggagagcgcctcccatgtcgctctcggatggtgcgcgaggtaatgggagatgcgctgaggcgtcgtggcggcggcgacaacgatagcgcacgggggaggaactcaccggccgtccgcgcgcgggggagtggctcgccggccgtccgcgcgcaggggaggtgctctccggccgttggcgcatggggaaggcgctcgctggccgtccgcgcatggggaggggctcgccaaccgtccacgcacgggagataggctcgccggccgtccacgaactggggagaggctcgccagccatccgcgcgtgggggagaggctcgccgggcgtctgtgcgcaggggaggggttggagctcgccggtggtagggag

SEQ ID NO: 63112 - DNA, 569 bp, Oryza sativa
aaagttagccaatatgcttgttgagaatcatgataccatgtttgatatacaatcaaggatgatttagaaatagtagcatattagatgaagagtatcacaaataagtcacatactcattgatcaatagtaagttatctatctcaaggaacacttcattataattctagacaaagtatgtttcacaatcatctctgtgattgcctctagggcatatcaccaataagggacaacaacgatgctggtgctttggaggaaatggggatggcgatggtgttagtgtgtaggcagatttgggatcagtgtccaatgtgcggtgagtggagtaattgtgtgagggagatagatgagggtaaggaaaatgtgatgctttcgagaatggccagtgggacaagggtaaggaaatggtacatgtatgatagtacttagtgccataaggtttgtagtgtaaaatttgaacatttttagtaaataaagggactaaaagggtgaaatagttaagggttggaatgcaaaattttatagaggaagtgacttgtgcaatagtctcatctacggttctacgagtcatg

SEQ ID NO: 63113 - DNA, 1092 bp, Oryza sativa
aataagttagatgtgtaaatgtagctagaaaaacgtaagtatagactacgtgaaatggttgccccatgatttaaaaaaccaagtatgttttagtatataaatataagtgaatttgacttgtacctttgttttgatatatctgtggcttatctagtttactttttattttttattcctgatgcactaagcaggtttccaaagagcagagaaaattgagtggagccctgaggaaactgcaggaatcacatgaactagctcagaagcaatctatggagataaagaaattgaaggattctttaggggtatgtgcttgccagggcgatagtggcctagtgctccatcatgttttcttagtctttacattattcgactctagatgctcccatcagcttcatggtatactgatatgtacgcgtccattccagaggtttaactctgcgttgaaccatgggacagtttgcagatcttgctcctgcgggttctgcgcaatgttgttagagctgtctaactgctctatcgaaggactagttgatgttagatcttccaatgagaagccacagaaccaagctctactagaatggcgtcctgatgaagatgcggatggtgaagccggctagaacataggagtgctagatgatcacttttgcactcatgcgtgcagttgttgtagataattctttgtaccaacattgttatatgtaaatggggttaaatgcacatgtatttgtaaatcttagttagctgttttgttttccagattgctttttctagctttctctgggtgttgatttgctttttctagctttctctggtgttgagctccaattagtagtgaaaaatgtatgttaaacttcatgtttttttcccaagaaattttgggtgtgccatttgtgcagcaagttgaatgctgcatcttttccttagataatgctagaagaacatgcatcttaagcagtcggaccaccttggtgatgctgtgtgtgttttcagcaaggggaaaatccaaatacccccctacaagtcactgctctttctactcttccctctacaactcaatattggtcaaaacactacacataaagtaatttctct

SEQ ID NO: 63114 - DNA, 1075 bp, Oryza sativa
  unsure (1)..(1075): unsure at all n locations
acatagaaagcaaataatacaaacaggctataagactattgaaatagtaaacaaaaccatttttaatggattctttggttttttcttgatttactgagacttgaatgggcttaaacggagcacatatgaattttctatgaattttagaagattcactgagtttttactataaaagaaaaaggcttaattgaattattgcgcattaattaaccccggatgacatcagtgagggggggagcgccggcatgcgggccccacatgtcatcggctcagaggcgccggtccacggtggaccgagtccacgagaccaaaggaggggagcaccacgtggcgccggcgtggcggccacgtgggctgccacgcggacggcgatggacggccctgatctacccatgggtagatcggccggcggaggtggcatgcggccgggcgtacgcgcgggcggcttaagccggcctggcagccatggcgcacggcggcgacggcccgaggcggcgagcggcggcacacctaggcggcggcccaccggctaggcggctaggtggcggcttaccggcacgggagagagggagggagggaggaggggaggcctcttcgacgacgatcgacgacggcgagcggcgcgatggcaggacgggctccgggatgacctaaagaacaaaatgagggaggttagagaacgagagggaggccgcagcgagttagggcgctggccgaaggcnnnnnnnnnnnnnnnnnnnnnnngtgcaagagggatggcggattccggctgcggattcggccgactgaggggtggacggggtggcgctcgaggaggtgaacacaacggcgttgacggcgcggctcggcgcggcggctagcggcaaccggagcagcggcggcggcggtggagaggagggcgacggcgctagggcgatggggtgcacgggagcggtcgatggcaatgtgaaaaagagagaggaggggccgggggtgctttatgtaggcttgagggggcgggacgtggccgggattggcgggcgaggccggcgaagtgggggaggtggagagagagagagggctcccggccgtttct

SEQ ID NO: 63115 - DNA, 1696 bp, Oryza sativa
aacccttactacgttttaatcagaaaagaaatgatcttactgacatcgctttagtcgctttactagctagctaatcactttggagtttcagtgctaagtgtcaaaaagcgcttgtactggcagctacagtacattacatgatttacatcttatagcacactagtatatacgcctagtaaaaatttccgtaattttgataaattgaccctttgaaaaaacttattttgatattgagccgtgtcaaaaactaattttaaaaatagaccattttctcgcgccatcgtacttggcgctgagctacaacgtattagcgccactttctttggcgttgagatgcgatccaacgtgtcacgtaaatcacacgtcatgcgatgcgatgtcagcgctaaagaatttggtgctaacctccatggtatagttgtataaatagtatgcatgtacattctagccttatggaaggtctatcctggtggtgaagggctgcctctcataacaagaggtcaagggttcgaaccccgtaacttcttatttttcttttttttccttttaggatcaatactgcatacataattatgtagcaaaatagagggtgaaaaaaaatgaaagatgtaattttataccaactattaagctataaataccacatacataattttgctccttccatatttaaaaataaaataaattaaaaaacatccatatttaaaaataaaatgaatttgaaaagcatgtgagatttttaaatagaacagcaaaagatgcttatacttgcttggctgaggatcgaacccattacctcgcagtatttagcacctagagttcaccaagctttcttgtctttgtgtgtgcaatggaagcttgtagataactaatatttgtaaattgaacaaagagtatttggcgatgacctcggatgacgtgtaaaatccgtgacacttcggatgacatctcggcgctaatctatatggcgctgagaaaacggcctaattttgaaattagtttttgggatgattcaatttcaaaataagttttttaaaagggtcaaattgtcaaaattacggtaaaaattatccacattcacgaacaatggatcaaaatgccgtctctcacatcaatctcatgcaccttgcagtgtttcccgccggctccgccgcccgtgcgcgtgtgcctccaacacattacctgcatacttgcatagtgccctactgtacatatgactgtatcactggtcactgcatgtggcgactcgacatggagatggggggcctctcccagcctcccctctcttgggctttttggccgcgagccaacacaggcacacagcgccgcccgctgtagcgcgacgtgcggccgatgaatgtggcacggaacgtcgcgccgggcacgacaaaagcggaagggcctcggactcgagagatggctcgccgtcggttgtcgcctctacgacggggaggataagctgcggctatagggcaactaggcacaaccaaggcgatgtgtacgtacgcggcacgcacgacgccgacccggttcatggcatggccccatcttatcgcgtacagggatcgggattccttcgataccccaacggagagggggcccgctctagagagcaggctagagagcagagaaccttactcccactctccccatatatgatggcatagtattatgaatttgatgtatcttggaatta

SEQ ID NO: 63116 - DNA, 5157 bp, Oryza sativa
agaagcagcataagggatgatcatcctgaacagttgttgtaatcatatctgataagaatatcctcacaactaggcattaccaaccttgcatcgtgccgtgaatcatataggtttctgcaaatacaccacagggtattttttttgtctctgattttttctatgttatatacaatatgttgctgggtttgccaagttctaatatgccattgcatttttctgaatttttatgatatactatagtcgtctggtttgtctttgttaaaattgtacaattttattataatgaccaaaataccgcttggatgaaaaattccaaatatcagacgaacaacttttttgcatagtttataatatgatatttaagttgagcgtatgattgaaatcatcagtgagaaaatcagggaaatttctttttcgtgcggtttgagtttcgacaaatggttttgaaatccccctgtgatcgtagcggggggtgtaagtgattaacccaacaaactcaactaattagatcaaaataaaataaagtgattttggtttatttgaagaatttatagtcactccccacctgtatgtacccttggtacggagcgttatgcagccactggtgagcacatccgccgcagcagctgcgattccctccccttcttctcccgcgctcactcttccgccttcacgccggcgaatccccccgcccctcaccgccggagccctcctctgcaaccgcaccggctccggccacgccagcccgcggggaagacgacccctacccccgccggcgatgtcccacccgctctcctcagaacctcgtaagcgccgcccctcccctccatgcgccgtgtcgtgtcaggcatccttcaacaatcaaaagcaagcaagagattagttgatatatggggcatatcatatatatggcctcaactagcaaaactttggcagttgattgctatcaggtttcggctgattttggtcacaactgatattcagttcagtcagagttgctgaaatatgtgctgtccactcttttgctgtgagatttggtaatttaacacttcttaaaatgggtttcgattgtttgattatcaaatcttttcttttggtcagatgctttggaacaaagggcagtggtagtaaccaacaagcatggggagaagctcgtgggagtgctgcatcacacgggttcaagcaagatcgtcgtattgtgtcatggttttatatctaccaaggtaacatttggaaaaatgcgtttgtaataagtttaaagtgagatgcgaacaaatgtttgtttagcagaaatgcaagcgacataaatttgtgtggagatagtttgtcttgttgcttcccaatgtaaattcacttctgttttccagaacgacagtctcattcttgacctgatggctgcattgacaaagaaagggattagtgtctttcgctttgatttcagtggaaatgggtaagtttgctccagaaaaccatgtcttcccccagcaatttcagttcttagaagaagctatagtaatactgctttaatcttagactatgggcatggttctttttcgcatgagtatgtcttagaatggggagaatagctactgtagtccctaaagtttctatgtaggatcattttagtccctaaccttttaaatagttcaaagaaatccttaaactttgtcataaggcctagaataatccttgggtccaccaaaatcgtcatatggatatgccatgtcatcattcatgcaaaatctatgataaattgtctagtttacctttatgtatatcatagaaaaataaatgtaagggtgaattagacataaccatagggaaaaaaatacttttcctttttttcacccttttgacgtatatttttgctcttacatataccatatattttttaatttttccttttgttttttattttcctatgatatatgtaaatataaattggacaaatcatatagattttgcataggagggtgacatggcatgtccatgtggcgattttgatgggaccaaggactatatcagcccatgtgacaaatttaaaggacttgtttgaacaatatgaaaaattaaggactaaaatggcccaggagcgaaactttagggaccatcttggctattctccctcttagaatgtacaactaatgatggactgagacttgatcttcttgtatctgagggaggtgcttctgtaattccgttgttctttaaaatgtaatccattatgaaatgcacttagtgaagcattatagtacacactatctgacttttacttgcataaatcttgttaattgctgtcttttattgttgcaatccgtgctgcttgacaaatatttcagagaaagtgaaggagaattcgagtatggaaactacaggaaagaggctgatgatttgcactccgttgtatcatatctttgtaaggaaaagtatgatgtaacagcaattgttggccatagtaaaggtaggtgatatatgccattttgtagatctggtctggtaattctcatttctgttgagttattccattcagttttcatcattagcaagttaaaaaagatcgtccagttctttaacaagaacttgcctattacgctcctctgtgttcgatagcaaattagtgataatgttaaaaccttgttgcagcatctgtttggagatatattgctttgatggttttgtcttggcattcatttgaacagaacatgacattcttatattatttgttctgtggaacacatggagcatatcatatccaatttgttttactcccattatgaatttatgataaattttgcatctttccactaagcaaaataccaacatgatgtccctaatccgcaataccttttctttaatggtgctcttttctttttgttgcacagaatgtatatgtcctctcttctttgttgccatatattactaagttaaatttgaatatgtatctatttttccagggggagatgtagtaactctatatgcttctatttatgatgatgtacgcttggttattaatgtatctggtagatttgacttagagaaaggcattgaagaacgtataggggaaggatcaattgatagaataaataaagaaggctaccttgatgtcaaggataaatcaggtaaggcagcatgtgcgattgtgcaaccttaatcttccaagtttcttgcagcatgtatgcctcgagctttgcatatctgtttacattttgttgtcactttcatgggcatctgtcctacctggtgcaggaaatgtacagtacagggtaactaaagagagtttgatggagcggctcaacaccgatatacgtgctgtaagcatgtccattaccaaggaatgcaggttaggaaactatcctgggccctacttgtcccttgcttttgaacttgtaaactgaaacagcaaattactgcagcattagtgtttacggtttataacatagacgtgtatactaaaaaacttagaagtcaacaatgttaccttgtgctataatataacaaagatgccatgcacatattcagataacttgccgtctttgttcaggttcttcacagttcacggttcagcagatgagactatacctgtggaagacgcctataagtttgcgaagcatataccgaatcacaagctgcaagttattgagggagcaaatcataactacaccgcgcatcgcgaagaattggctgatgctgtagtggatttcatcacatctaattaggtatagaaaacctatctgttgaattattcatcctggtctctatgggcccttcagaaattactcttttctccacagttctgcatgtctgagagactgagacaacctcattcacgagagatgacttcttgtgatggaggatccttgtgtaggttttgtgccatttctctgccttttctcctctaaacaggtataaatctttggggaatcaaataagcagaaagcaggtgtatccgtgtatattagtgtaccatttcgtaggtccatattgaattactgatatgaattgtttcttgcagatgtctgtgtacctacaggattcctgtaaatatcaaactctatagtagaaccgtataaaatttcaggtttttactttgtactaagaattctgcgtgcaaaaggtttcagagcacaactgctgctgcttcctgatttcctggtagctggagtttttatctgggccgctattgagccagtttgatgtgatcattagttgggctgcttccttatgggccaagtccttatatacacgtggatagcctaggattcgagcctatccaaacaaggcctctagccaactactagcttcaattcatctatagctaatctaatagctcattcatacaatagttacatactacactattaatatctggtcccacctgtcatatacacactacgtcttagagtccgtgctacagctcgctacaaatctgtagcccgctgctcttctctctccttatttatcttcttaaaatatgtttgcagttagcttatagcttgctattgtacctgctcttatgtggaccaaaaattggttggccgtggttttcggtgattgtaattgagttgatcaagggccttcctaactggcgcagccgcgcacgctctctctctctctcgacctctcctcagtgctaataacacttattatagttgatgatattaattagcggtaatgataactgttagtattagtatttttttaaaaaaaatacataatagaacttttaactcagatttagaaaactttcaacttggatttgaaacttttaacccagctttgaaaacattcaatccagatttaaaaactttcaactcaaatttgaaaactttcaacttagatttaaaaactatcgacttagacttgaaaactttcaagtcaagattttttaaaaaacttttaacttagatttgaaaattttcaagtgaatactttcaatttatttttttaaaaaaatcaacttacattttgaaacttccatatctagttttgaaaattttcaagtcaagatttgaaaactttcaacttggatttgaaaactttcatctaaaaattcaaaacatttaactcaaatttgaaaattttcatctcaaaattcaaaatttcaactcaaattcaaaatttcaacatgaaaggttcaacttctaaaataaaaaaaat

SEQ ID NO: 63117 - DNA, 17509 bp, Oryza sativa
  unsure (1)..(17509): unsure at all n locations
tatattcgacccagtacttcgccatgggcagcaccagtcatctttgtggagaagaaagatcatactcagagaatgtgcgtggattatcgagcgttgaataaggttactatcaagaataagtatccgttacccagaattgatgacctgtttgatcaattggaaggtgctacagttttctctaagatagacctccgttctggatatcatcaacttcgaatccgtgaggaagacataccaaagactgccttcacaactcggtatggtttgtttgaatgtaccgttatgtcatttggactcactaatgccccagcctttttcatgaatctgatgaacaaggtgtttatggaatatctggataagtttgtcgtggtgtttattgatgacattcttatttactccaagacgaaggaagaacatgaagagcatcttcgtctagctttagagaaactacgtaagcatcagctttatgccaagttcagtaaatgtgaattttggttgtccgaagtgaagtttcttggtcatgtcatctcgtctggaggagtggcagtagatccaagcaatgtggagtcagtgttaagttggaagcaacccaagacggtttcagaaattcgtagtttccttggacttgcagggtattaccgcaggtttattgagaacttttcaaagatcgccagaccaatgactcgtcttcttcagaaggaagtgaagtacaagtggacagagagttgcgaacaaagtttccaagaactgaagaaaaggctagtgactgcgcctgtgttaattttgcctgattcgagaaaaggtttccaagtgtattgtgatgcatcccgacacggtttgggttgtgtgttgatgcaagaaggaaaggtggttgcctatgcatctaggcaattacgtcctcatgagaataactacccaacgcatgacctagagttggcagctgtggtgcatgcattgaagatttggcgtcattatcttttcggtaaccgtacagagatatatacggatcataaaagtttgaagtacattttcactcaacctgatttgaacatgcgtcagcgaagatggttagagttgattaaagattatgatatggaaatccactatcacccggggaaagcaaatgttgtagccgatgcccttagtaggaaaaggtactgtaatatgtcagaaggtcgacgtttacctttgggagtatgccaagaatttgaaaagtgaacttgngatagtcagtaaagggtttgggctgctttagagctaaacctactctgcttgatcaagtgagagaagctcaagtgaatgatcctgatatccaggaaataaagaagaacatgagaagaggtaaaagccatcgttttgtagaagatgagcaaggaactgtgtggttaggagaacgaatttgtgtcccagataataaggagttgaaggatactatcatgaaagaagctcatgaaactttgtattccattcaccctggaagcactaagatgtaccaagacttaaagcaacaattctggtgggctagtatgcgacgtgagatagcagaatacatggctctatgtgatgtatgtcagcgggtcaaggcagaacatcagaagccagctggtctgttacaaccgttgaagattccagagtggaagtgggaagaaataggaatggattttataactggtctacccagaacatcggcaggacatgattctatttgggtagtggttgataggttgacaaaagtcgctcacttcataccggtcaaaacaacctatacggggaataagcttgcagagttatacatggtcagagtggtatgtttgcatggtgttcctaagaagatagtgtcagatagaggtagccagtttacttcgaagttctggcagaaattacaatcagaattgggtacccgtttgaatttcagtactgcttatcaccctcaaacagatggacagacggaaagagtaaaccaaattttagaagatatgttgagagcttgtgttctagattttggtggaagttgggataagaatttgccgtacgaggaattctcatataacaatagttatcaagctagtttgcaaatgtctccgaatgaagcattatatggtcgtaagtgccgtacgccgcttctttgggatcaaaccggtgaacgtcaagtttttgggaccgacatattgcgagaggcagaagaaaaagtaaagattatccaagaaaggttgcgtgttgctcagtcgcgtcagaagagctatgccgacaatcgtcgtagagatttagtttttgaagaaggagattatgtgtatcttcgggttacgccgttacgaggagttcatcgtttccaaaccaaagggaaattggcaccgcgttttgtaggaccttttaagatcgtgagtcgaagaggtgaagtagcttaccagttagaattgcctccgtcaatggcaggaatacatgatgtgttccacgtgtctcagttgaagaagtgtttacgtgtacctacggaggaagcagatcctgatcgtatagaacttcaggaagatgtaacttatgttgagaagccagtcagaattttggaagtaagcgagaggaataccaggaatcgcgttatacggttttgcaaggttcagtggagcaatcattcagaagaagaagccacttgggagcgagaagatgaattgaagtcagctcatcctcatctgttcgttagttcttctgaatctcgaggacgagattctgtttaaggggggtaggtttgtcacaccctaaaaatcttaaatatataaattgttgtttaattggaatttttagaaattattttaaaagcctacaagctaaaccctaattttctaggaaaattttcaatataaaaatgagctagataaaattctattaaatactatgcttgctcctctattttctagatttttctgggaattatttgagcaagggaagtatttttaataattgaaacatcaattcacaaattgtttttgtttaaaaagttcaaaaatccccctcttaggccgttgggccgatttcggcccaactctctctttcctctctctccccgcgcgcggcccatgccggcccaagccgccgccgcccgcgcccctctcctccagccgctgacatgtggggcccacatgtcagggccgtcttcaacctccggccggccgccgccgagcccgaaccctagccgccgcttcccgctccgattccgcccaaatccgagcccgattcctccgggtttttgaggggttttgttcctctcgttctcctttcttttcccccaagaatcaaagcgaatcgttgggtattttatccgaatcgaattcgttttgttttatccctaaaaaccgagtttgatttcttcccgagtcgattcctctcgtttgcggcttgatctcttcaatccgagctcatataaagcttcccctcgttgtcctcttccgtttgccccctttcccgagctctcccgtgccccctagcgccgccgcgacgtgcttcaagttcgccgccgccgccggccgtcttcggcatcgtcgcgccgccgcctccgtcgtcgtcgccgctcgccgtttccgccaagaggagcgccgtcgtgcgaggaagctcggccgcccctccgttttcgccgccgacccccggagcaccctcgtcgccgtcgacccgagccgccgcgccgcctcttctcgtcgccggccgccgtcgtgcaccgtttgccgtggtggtgagtaccaacgggttcgcctcgttgtcctctacgcgtaggtggtctccgtttccgccgccgacctccctagcgccggcgagccctccgacccgagccggccgtcgtgctgacgtcatgccgacgtcatcgccagggctgacgtcatcatctccagggctgacgtcatcctctctctctttttcctttttcccgattttctaatagatttaaacttcggaaaatcataactaaataaccgtagatccgttttaggtggttcaagtttctaaattcttctaaaatcaaggtctacatgttaaaaatatccacatgtactgtttatgcttgtttttgtgctgttttgttgattttgtttatttgctttagtttccgacgttctggaggagagcgtttccgttgaggaaggttccgaagcgtttgtggaagcccaaggcaagtcacacagatcccaaacaaccctttgagcatgttgatcccgtttaaagctattattttatttcaactatgcattgtttttgaatgtcatcgggtggtgaacctttcccagttagttaatggccgaagatgactttattttcctatgggttataatttgattagcatgaaccttatatattggattggttcagctaaatgctatatataggtttgcttagctatgcttagaaacattagctaactaaaaggggttaaatataaagtatatacataattattattgttaattagggttatattcaatggtagctcacgatggttaatcgtgtgatgttaattaattgataatttaaaacctggataaggtgggttgtgagcatatggttttgatggttgtgctcatgacaattaaggaccggttcgcgagctactgttgtgaaacatttatcgtgccaaccacaagccagcgtgggcaacgactttatcttttgtatagcgtgattcattatagtgcgccagactgagaagtggcgagaagtccatgggggtcgctggggagtccatgccttgtttataagggggtgattatgatccaggtacggtgcactgtggtgaattgtgttatgcgaggggtattgtcacgactcctttccgaggtatcgtggtggtactgaggcacatggtaacatgatgtggggttgtgtcttgtgggtacagtggtacacctctgatcagagttttaatctattcgaatagccgtacccgcggttatgggtgagttgagcaatgtttttcgtgattagtctcacactactcattagtggtaataatgtggtaattaatttaattcctggtttggaatggataattcctggtttggaggtttaatttgttcaactggggttggttgtacaaatacggttgggcctatgcaacacgggtgtgttgtatggtgtttatttaatattgattaattattcaactgttttactattctctaaaatatttattaaatgctgttttctgcaaatgaactatattatgccatcctttgttatcctgtgcacttgcatatttgctgtgtggcttgttgagtatgttatatgctcattcttgcaatattcattcatcagaagaggagtacttcagtgaaggtgatgatctggaggattaggcttgttctggttaagttgcctgtggagtggagtcgccatagctgttccgtagtttgttatagttttgttttccgctgcgtagaatgttttatttttctttgagaggaactatctacctctgtaataatttattatttgtgagtattcaatagttaattatttgtactctattatcaatattgtcattgtgtgcctcggttgattcctggacgagggtttaacacacatgtaagcgtttggaattttggatagaaattccgggcgtgacaagaagcaaaatcctctataattttggagaaatctagggaccaaaatcccctataattgtcgacagagggagtactgatggctcggatgtgcgcatatggttggatatgtgtgagacgtattttgatatgtaccaaatcaccccaaatttcaaagtatctgtggttgcgttacatatgtcaagaaatgctgctaagtggtatcactcttacaagttagtggctgacctcagttcatggggccaatttcttcatgcagttttttgacatgaaacagcaggagaggctcctactgtaatatatattaatatatatatatatatatatatatataataaaagggagaatttacaaaggttacaaataattacaaataattacaaataaaaaaataatttcttcatgcagttgcttctgaatttgaggggattgttgagcatgagaaaatggttgcattagatgctttaactcaaactagaactgtggctaagtataaacatcaatttgattcactggtttatcggattagagtatttgatccatcaggcatgatgttggtgactcgctttcttggtggtttgaaggatgagattcgttttgcagtagtggttcaacttgatacacttcagcaggcagttgctattgcacttaagcaagaaactgtgttggcagagaaggctactaaaactaagggcaagtttgttaagtatacttgtcctaaacctgattttggtgctgagacaacccctgctcgatctgacaaaggagatctttggaaatctagatagctgaaatactataggtgtgcttagggcctttgcttcaagtgtggggagaaatatagccctgaacatcgttgtaatgtgattggtcatattaaggctatgcaattgaatgaagttttggctgatgatgttcttgatgcagtggtggctgtaaagtattctgaggataaggatgatcaaagtaaaatttctcttaatactttgacaggtgcatgaattctcactaccatcagacttcgtgcttttgttcagaacaaagtctcgttgctcttggttgacttagggagtactcatagttttattgactataattttgcttagctcttgggtctaccctctacagcctatttcaccaaattctattaaggtgggtaatgggattgtttgccctgtcagtatatagtacctcacttttcctggtggattcatagacatacttccacttatgatatgagagtggttgccttgggaggttatgatgctaatcttgccatggattggctagaatagtgggttgaaatgtcttgtaattgggcccaaaagaccactaaatttcatcacaaagaagttctcatttcattacaattagtgcaagacccttctactccttccgaacctactgttgtttatatgcaaaaattgtttaaatggcacaaaggccgtgatatctgggctgctgccctattggaacaaccttccaaagtccatatccacctcctctgtcataccagttccagttcagcagttgttgactgaatttgacgatgtgtttcaggatcccaaatgcttaccccctcatcgagtatttgatcatgctatctctctcatgccagatatatctctagttaattgtcgtcccttcagatactctcccttgcagaaagatgagattgaaaaacaagtgacaaaaaatgatagatgttggtcttataacacccaatatgagtccctatgtttcccttgtgttgttggtgaaaaagatagatgacagttggcgcttttgtgttgattacagaaaactaaactccctcactatcgaaagtaaatttccatgccagttgtgggtgagctagctggcactatattattttctaaattggatttgaaggctggatatcaccaaattcgaaaggttgatgctgatgaggccaagacggctttcaaaacacatcatggccaattccaatttagagtaatgccctttggcctcactaatgtctcctctacttttcaatgtctcataaattcagtctttgcaccatttatcagaaaaatttgtgtttatctttatgtatggcattttggtttatagtcctgatttaaccagtcatttgagttagctgtagcaagtgtttatggttcttagacaacacaatttgtttgctaagagatccaagtgcccttttgcttgtcataagttggaatatcttggccatattatttctgacaaggggatgagtactgatcctgagaaaacaattgttatgcttgcttggccagttcttagctctgtgactgagttgagaggatttctaggtctgactggatattatcaaaaatttgtgaaaggatacagtgtgctggccagacctcttactcttttactgaaaaaaagggctttccaatgaaagaatgaggcagcccaacttgcttttactcaactcaaaacaaccatgagcactactcttgttctagcattgccaaattttcaatttccctttactttgggaactgatgcttgtgcttatggtttgggagctgttcttagtcaacagaaccaccctattgcttactacaacaagactataggtcctaataatcagaagctgtccatttataacaaataatctcttgccatcgtgatggctgtggataagtggaggtgttacttgcaaaggggtcccttcactattaaaactgaccataagagcttgtgtcatcttgatgatcaaatcttgggaactgagctacaacaaaaggtcatgactaaattgatgaggctccaatataccttccagtacggaagtgagtggacaatgtggttactaatgctctttctagaatctaatcccaagtgagtgccatttatgtggttcaaccccagtggattgaagagatgattaattcatatgcagtggatccacatgctcagtggctgttagctgaattggttgtgcattctcccaacagcccgggctattcattgaaggaaggactgattcgatataatgacaaaatttgggtgggctctaatgctggtctccaaaccaagcttattcaggcttttcattcatcaccaattggtgtccattccggtattgctgctacatatcaccgactcaaacgtttgcttgcctagcctgggctgaaagctcatgtggatggttatttgaaacaatgccaaatatgtcaacaagcaaaatatgaacattgtcgtgcactgtcacgcctagaaattcacgaaccagaatttctaagcttaatgtgcattaaatccctgtccaggaccagccagggtacacaaacgacaattgttgacatacagatccacgtcttacaaaaatataaaagattacaaatgcagcgaaaagataaaacgagctaaacttggaagcctgacttctgcagcgggcgactccactccacaggcaacccttgacagcagcgacaaaaccaaccctaacaagatagctccaacttggaagatctccagctctggtgtgggggaaaagagagcaagactgagtactacccactgtactaaacaagtcatactggaagagaaggtatgatgcaggataaaaccaaaggaggctaagggttcatttgcataaagcagtcatttaaaagtagtagttgaaagcagtaaaacagttgtaataattaagcaatattaaccaatcactgtccaacgctacaccacgttgcaaaggcccaaccaaccacctgaactacaccagttcattaagctacactaggggtgagactaatcacggtgaatctggttgatcgcccataaccgcgggcacggctattcgaatagttttactatggccagaggtgtacaactgtacccacaagacacgattccacacatgtcgccatgccccgaagtatcaccatgatactgcaaagggggaaatcgtgacaagaccctccgcataaccctcccctaaccatccacaccacgctaaggtttcacccccacccccagcaggcagtgggcagtcccctctgcgctgcggtgaatccggcagctggacaaccggacaccccggccgacccaactccatcacgcccaccctcgcctaggaaagggtcgagctatacttcagatcaagcagttacccactcccgcttgtggtaagcacggtaagtctcccagggtttcccatgaaccggtccttaattgccatgggtgcgaccagcaaaaccatgcacccacagcccaccattcagtgtattttaattaactgacaccattgtggtggcaccaatccaaagctatactcatagttaaagtctatgtaataatgtgatccgcattggtgtactagttgagctaagcatggctaagcatttcctaaaccaacatctagtcattttgatacccaagttatcaatgacataaggtaaacaataaatggctgagtaataggacccatcccacatgacattgtaaaagaatacaacatttaatagaaatacgggatatttgtaaattgggtacaatatgatcaattgtaatgcatgacttgccttgccctcgcattgatgataccacagcaatgtcttcgagaaaccgcggatcgacgaaacggccgaaatctacgcgacaaacaaagcacacaagcaaaacacactataagactactgaaacaaagaacaaaacaatttttaatggattctagagaattttatgaatttactgagacttgaatggacttaaacggagctcggatgaattacttatgaattttagaagataaactgtgtttttactaatagagaaaaatccttaatcaattttattgcgcaatattgccccagggctgatgtcatcaaaggagggggagcggcgccgacaggcgggccccgcatgtcagtggcatgaggcggccagtccaccgtggaccgggaccacacgagtggtccaccaccggcccacgggactgacggtccagatcggccgggaggccgatcggacggcgcgggcggtggcttggcatggctcggctcggcagaaagccggccggccggccatgaggagcggcggcggcgcaggaggcggcggcggtggccgaaggcgatggcgagctcagagagtggcggcgcatgcgggacagggggaagaagggaggagaggagctcctcaccggcaagcacggcggccggggcgaaggatgaaggtggcggcgacgaccggcgacggcgagcgatggccgagctctgggacaccctaagagagaaaagagaaaggttagagggggagtgggagtccacggcgagtgaggatgccggctgaaggcggggaaatggaggagctcaccgacgtacgtgggaaacggggctccggcggaaatttgcggcaaccgagtggcggccgaggagcaggcggcaccggcgatcgcgaaggcggcagcgacgaggctagacagcggccatagtggcggttagcggctaccgaaggtcggcggtgggcggcggagctcggaagagagatgcgacggcggtagagggcacggatggaagcggcgagggcggaaaacgagagaggggtctcgggggagcgatttataggtgtgagaggggggcggacgtggtcggttagccaccctattgcgccggcgacgtgggaaggtcgggagggagagagaggggattcaaacttgaatcccggtcggtgcgggacgcgcgcgcgtgcgaaagaggtggaggactaggcggcgacatgggcacgagcgcgggagaggcgcgggatgggcgcggaggagtggcgtgggcgaggcggcgtgggcggcagcggcggttgctgccgaggcgcgggtggcgggtggttagggacgactgacaggtgggccccacctatcggcgtccccgagaggagggaggggaaacgggccggcccggccaagaggaaggtgagcgcgggagggagattgggccgacggcccaacaaaggaaaaagggaaaataaaaagaagaaaaaggaaaagggattcctgggattaaatgttgcacttgctcatttttaactggttaaaattatttatagagctctgaaaatttcactaaaaatcatgttaatgtattggagcatggggaactcaagaaaaattccaccacgccgaattcgattattaaatgcattttttaattagggaattagctctaggttaatttaaataatttcttcgagcgatttatttaacaaatttttaaagcaagaaaaagggagaaacttcagggcgtgacatgcagctgggttattggctccattatctattccaaaagaggcatggcaagatatttctatggtttacctagatccgatgactacaatgctatattggtggtggttgatcgttttaccaaaattgccacttttatttctcttaagaattctttcaccgctcctcatgtggtacatatggttggaaaaaaaaatttcaagacaaatggcattcctcgttcaattgtgtctgacaaagatagattgttcactaatcactagcaaattttggacaaccctctttgagatttgtaacactcaacttcagaggagcacaacatatcatccacagactgatggtcggactgaagatgtgaatcaagcaaaatcctaaaaagtggaacaactagatacacttggtagagttttggtataattctaattatcacacatcattggtttgttctccttagaaagctttgtttagcaaagaatcaaattactctcaactccttgacctcactgagacaactcaccctgaagttgtggatttgcagactaaacgatagcatctgtctgaattcttacaacaacagctgactcgtgcccaacttcgtatgaaacaccaagcaaacaagggccgttctgagagggagtttgcagtgggtgatcaagtgttcctgaaactccaaccttatgctcaatcttctgtggttaatcgcccttatcccaagttggcctacaagttctttagtccctttggtatcctggaatgtattggcaatgcagcttatcggcttgatcttccgggtagtagtgctattcaccatgtgtttcatgtctctcagctgaaggggcaagttcccaacaatacacctgcctattcttcattaccttcgccggtcatcctcgacgctgttaaggcaagctattttggatcgccgtttagtaaaaaaggggaacttggctcatgtgcaagtgctgctaaaatggtcttctcttcctgttgatcatgccatttgggaagattatcatgtggtgaagaatcactttcctgatgctctagcttggggacaagttgtaactccagcgggcggcactgtcatgaccggcaatagtatggatcacaacgtagaggagttaagcaagtagcgcgtgagtttgggatttagtcctgcttgcctggaatgatttgaggcctgtgagcccagtgtgcctgtggcccattagcctatttcggaacatgttaaatattcatcaggtggctcaactgtcgcgagtctggcaaatgaaatctatcgtgcatagctaccttaagttcttcccaagtagtaggtaaaactccctcgtcagctaacccagttcaccacatgatagcaaaatctttgaactcactactggcttgtcgaactctatgttgcttaggaacaaggtgggcactaaacttttgttctactgtcatctctcaattaaggtatttctcagcatcataatatccccaaaaagagggtattttaaacttaaccttagcataaggatcatcgggcacacgattattgttaccttgttggtggtggtgatttgaagtgccacccatacctgtgcggtttgtgcgtagatgatgtcgtagccgtgcttgccttgtagcttgtgcatcaatattgccactagaatcatacaccgtgtctttaggatgaccactgtcgttgctgctgcttacttcctctttggaaggttcttgtgtctccaacacagcaacccgatcagttagcttggacatcccgcttgtccaacctctccatttggtttacgaagccgattttaaggatggcatcttggacagcctttgtaacggcctccgtcatctccttttgagcattttctacaacagtaatatggtgcctctcaacaactctcagcaatatggagctccttaccaagccattataaggttcttaccagcaaagcaaaggatacctggaagatgtaatcagcgattgcaaggatcaagaacctgtgctgtctagaagtaatatgttgagctaggaaggccaaatatatgtgagtggtacgcaatccaatgacagatagtaatgctgaataaaatcccaagtcacttgcccttagttgctagtctactcgtgtcctagacagtagtggtaacaatgatggcgcaaggaaaatgacactagtaaacagcaagaaaggactggtaggcaagcttcggcgagtctcagcaaaaacagcaaaaccgcaaggctgataagctcaacggagcgcgtcgtgagctcgatgcactagtggaaatcaacttttctttttttttattttttgatattttttattttccaggagcacaaaaataggcacaccacgaagttacagctcaatcggagttgatatgtggcctacagaattttctgaaaccactataaagaatgtacagaaacttgtgagctcgacagacaattttgcaaaccaaatttcagaattttgtattcgccaaaccctccgaaggtggggagaaacggatgtaaattttttttctcttatccgaaaagttatggttgtttgaagttagggcttccgactaggtttttcagaggggatataacctagtctgtttagcggtggtattgggatatggtggcaacggagtatgtaggatgctctggtgatgcgtggtgatctggataggtgtttatgatggcggaaacggctctcaaaggatgaaccctaacacacggatgaaaggtggcggctagggttacaaaggaaaacacacgactagactaaaacacgcattagaccagcaacaagaacttaaactaggactcaaactcaacactatggactctgaaaaggatcatgcaaaggctaaacacggtctgggttaaggtgtctaacgactacaacttttttttggcttttctgtagactctaggataactgcaaagaacaaaaactaatctagggtaaagaaactgagcgaacctgacggtgaacctagagctctgataccacttgatgtggactagggaacccgatcttccgaaagattctgataatcaacgattttggcggagtcgcgacacaaatcgatccggcttcttgaatgaacacgctcttgagccccgcaatcgcagcaccacgtctgctctagttatcacccgtgttgaaacgcggatgacctcaccgagaaggctaatccttgtttgcgaatagaagaacacaaacaagaacaaggtagaatacaaccaaaattgcagatgaatgattaagctcacaagttggggtcttacaaaccgatctagcgatgaaactgttctcgacagaataatctaagcaaaacccaaaccctatagataatggcgggtactgatatataaagtttaaggttgtgcaaccaacccttgacgcaaccctaatgggttccaacatgatacacagcctaaaggcccaaatacggcgacacaataccgggacagattctggatgtcaacttatttggttgattaccgttgactcggaaagaatttggacgtcggaccaaaaccattgaaaagattatcttcttagctttccatccatataaagaacgcccaatccgagcttgtatgtgacctatgcgcctgttttagtgcagactggtcttggactccgaattgcactcgaagttgacttggtttggacgtccaccttgatcctccataactctaggtccttctccaagtgtcttcttatcctctccattattcctaatcacaatataatcattaggtagcaatatattctcaaattcatacaaagaagaacataggaacgagctcacctctaaattcaattgtcgcgcgcgagctcttgttatcggtccttgaatgaccggtggaggattgttgtgtgtatccgatggagtgatgtccgcatcactctctccctccaacctaatctcgtcggcgacgatctcgttggtggcggtgtgttacatgtaatcaaatcgtagtaaaaaaatgtaaaatggaagaattcttctctgattttattgtgttattttttgaaacacttctccgctttatcaaaatggtgagctttacctacccctggatcctgatcttagccttaagtacttaatcctatcccagtgattgctagatcagcatacggtttcaccgcaccatcacctacttaattgagttttaattattttaaacttagaaaattaatttatctaatattgtagagcaacttctatatagaaagtttttgcacgaaatacaccaaggtaaaatctgtaccctaagtgcaatgcagtgctcttcatctccaatggtacagtatctgctgttacaaaaatactatctctgttccaaagtatctgctgttacaaaaatactatctctgtccaaaaaaaagctaacctagaaggggatgtgactctcctagtgcaatgaatctggatagccctttgtctaaattcgttgtactaggaggagtcacatgactcacatcccctcccaggttggcttttttttttttgatggagggagtaggtttgaatctatattattagtacaaatttgttgttttagcttgatagtcctaaaatgtttggatataagctaattatttttttgtttagtatcataaaactaatattctacttaaggatgttcaatttatacactatattatttttctaggtttaaatcggggttatattatttagttatcttcatgtacttttgtttgataattctcctatttatgttcatggaatgaatctgtcattcctttcttatgttcctagctagttaccaataacatatgcaagtaataaattgcatgcacttttgttgaaaaagttaattcgttcaagttgccagataacatgatctgtcaaattcttgtgcaaactttgtcgccgctcatacatcatattgttcaacatttctctttaagttgcatacaaattcagggctagagaaaccaacatgctatccaatgaagagacagtaaagctgcacaagggcttcataatttacatgttgcttctatttggtcgttctatctttattttctcaagcaaggtcgttcaataatttttatgggcatgattaattacatacatggtcaagtgatagattatttgagatttatacatgaactgaagccggttttattgtgcagtgaagcaggagaggaaacttatatatgcaaccatgtgcgaactaactatagggccgtaaatgcatatttgttgagaatacactcactggtggagagaaaccatctttggtcggtcgaccaaattccacaatagtcccggttctattaaaaaccgggactaaaaacgatttttagtcccggttaaaaaaattttgatctttagtcccggttggtaaactaaagatgatttttagtcccggttcatcccctgtcagatgtatgtcagggggtcgagaatctttagtcccggtttatactaccaaccgggactaaagattaccactttagtcccggttagagttatcaaccgggagtaaatatttctctcccacatctgatcggttaagtccagacagatatttacataagattaaaaatcccctctcttcctcttctcagatccaatcctctttctcctccccttccctctctaacttccctcctcc

SEQ ID NO: 63118 - DNA, 20196 bp, Oryza sativa
cgcgccctgcagatcggcgatggtgtgttcggcagctgcgaggcgggcggctaggtcgccgtcgcccgcggcgccccgccgcgtggcaccctcgcgtccagctccttcacccgcgcctcgagctcagcggcccgctgatccagtgcggccctctcggcgcgggcgccttccagattacggggcgcctgctcctcccgcgctgcctcgcggagggacaggctgtccgccagccgctgcgccgcggcctcggcctcctcgagagctcgctcccgctcggtaagcgcgtcctcacggaggcggagtgcggactcctcttcggcgcaggcggcttcgtgcgccgccagcgttgcctcctggatggcgacggcggcctcacggtccgccaggtccctctccctcgtgcgggcgcgctcttccagcgccttggcgcgagcctcaagggcctcttcgcgccgccgggacgccgcctcgttctccgccgcccgccgttcccgtgcagcggcggcgtcaaggactccccgggcggcgtcgagtttcttctctagctccaccgcccggctcccgtattggaggtagagatcgacccgcgcctcgttgagcacggcggtggcgatgagtgcagtctcccgctcctcctccacctccctggcgatctccgccagctccctccgacgggcctcgagctctgaggcgtgccggcggtgtgccttgcggcccgcctccaccatggcttccaccgagcgccgcccctcctcgacgcgcgcccacgccgcgtcgagctccgtccactctgcctgcaggacctccatctgggcacctagcccgtccagcaccgtggtgttcgcggcggctagggcctgcaggaggggctccgcgttcagtggggcagcggaaggcgaaggagagagccgcctcggtgcgggcgccgcgtggcacggcccgccgatcgacgtggcggactcgggggcgtcccccgaagctggcacgtcccgagcgtcgcccgaggggtcgggcccgagcggtgcgcccgcggcctcgtcgtgggtggcctcggaagtcgtcgtcgcctcgggcggagtcgggtcgggggcctggcaggccgcttggcgtgcgcgcgcctcctccgccttccggacggactcctcggcccggcggagtttggcctcctcccgagcggcttcctcagcctggcgaactcggacggcctcctgggcagcttcttcggcttcccggaggcggtctgcggcttctcgccggtcagcctcccgcctccgggcctccgcggtcgccgtctccacggcctcggactggccgaacttgggatggcggggggggggcgcgatggaatctcgctgaggcagaagaaaaaccagaggacaaaagaaacgggtgagtgaaagcttgccttgggagatgggagaataaatacggccgcagtgggcgcggggacaaacctgcgaggaggtcggctaaacgaccaccttggggggagataaggtttccccggtatggttcagtctcccccatcttgcggagccgcttcttttttcgctccccctcgggttgcgatgtcggcacggcaccctccgggcgcctgctgctggcacgcgccgccccgccccctcggggaggagatggggaaggggttccttcctgcttcctcttcccccgggtgtcggcggggcggctgctccccgggcccccgtcgcggggcccagaagcacgaccccctcccggggtagattgttcccccctgcggctcccgcccgcgccatcgtggcctcgaggagcccgctcctccgacgccccgaccgcctgcatgatggtcaggatcgtggcgcgatctggatcgctgcagagggggagaactccttgggggatgagggatgcctccacggagctgagattcagcacccgttggaccactatcttgaagtcctcaggggcccagtcccatctgaccccctggtgggtcctcatgtagtcttcggacccggtgtactcccaggcgccccgggcgcgccgctggagcggcgcaatccggcgacgaaggtagtcgccgtacaccatggcccccgtgagcccctgggatcgcagacccgccaggcggtcaagaacggcgtcgtagccgtctcccagatctaccggcgcccgccagctggagacctgcgctgggggctggctcggaagtcggaggcgcgcttcgtcggcgaggggggtgtagaaccagtcgctcttccagtcgtcccacttcttgcggaggacgcagggaatgtagcggctcagcaccggcccccgcggctggaagtagcagccaccgactaccgacggcggcgacactggctgtacggtgaagaaccaccggaacagccgaagagatgggcgcaccccgataaacatctcgcacaggtgcgcgaagatggccaacgtcattactgcgttgggggtaaggtgtgccatctggagatcataaaactccagaacatccatgaagaaagaagagaatggcgggaccagccctgccattgcgaaagggaggaagaagacggaccgccccgggtagtgtggtgccgggcgtccctcgcccagctcgaccacctcccggccggcggcagatgccggcatgaatcggcacggcagcccggcctgcctctcgctcacgatgcaggaaggcggcagcacgctaccgtcgagcggtgcggagccccgtgccatgacgccggcggaggaggagcttgagaacgagtgagtgcggcgagggtagggcacaggaaacaaggagttagggcgcaagcggcgaaggcaaggggaataatggcgagaggaaggaaacgaatctcttccttggcgcctttatacccttgccaacgctattcccggctcctcgtttcccgcgcccactatctcgccccctcgtttctcgcgcccacgcctccactaatcccactcgcccgtttgcggcgcacgaggcggatgtgcggccgtggcagtcgagatagggcatatcgtgcgtgcgttaactacgctcgccgaccgaagcgccatcatcatatctccaggcgaaatgaaccggctcttcccgattcgcgcgctactcgagaaatgtagcggtcttgaagaggccactcattattatcggtcgttttttcctagccgatgcgcacgatttgcgaccgctgggttcctgcccgcctgtagagaccggtcccacctgtcaccagacctaaggagtggcgtcacgcccgagcgcttccctcgaggggggcgatcgccctggcataacgccgggggctactgtcggtgacatgggatcgggggtatcatgactagaggcttgggcagccgcggtcacccacgtggcctgaccccctcgggggggtcgggcccgagggagacgtggccaccccctcctctgtctccccgaggggtcgggccgctcctgtttcggccccgagggctggggcgccccgaccccctgtggtattggcgccacgtgtgtgggttaggtgggcacagcggcgctcacctaaccgcatttattgcgggatggacaagcgcgccacgccgcatttaatgcagcacggcgcacgcatatccggtccgtgaccggtcgcagtgtgtgaccggtcacagaccggtcagatcgcgggttaggtggcaacaggcggcctgtcacacgcctcgccccgtcccgtcggaatgatgagagcctcttggcactcgtccctagctggagccggcgtggtaactcctggagttagcacgtcagtcccggctcgattcatgccaggcttcatcgcaaccattgcaaggaagtcactgtttgaagaagggcagatgtgcggcatgctaaactgacgtgtggtggagaagaatgaccggtctgtgactggactgacgccggtcacgtcatcggcagacaaccgtgctcccacgttgcatctgtttccggcggagtggaggtaggtatgacccatcccatcggagggtcattcagacagcagccattgcagatctccgcccattaatgaagagatgacagggtgatcccctgtgtccgacgagtgacggcgctgggcatcactcaaggacaagcggtgatttagcttccaggcggaggcgcgagtcaagatttggtcaagatagggtgggtccccacccaaaagaagagtaggtagaagtggtgcatgtggtatccccttgaaatataaaaggaggaccttgcccacaaaggaagggggacgactctgagaagagaaggaaaaaagaggggttctagagcttgaactctcttgctctccggctctctgtaactctttctcacacatatccaccagaacacaggagtagggtattacgcttctcagcggcccgaacctgtctacatcgcccgtgtctcgtgcgtttgctctctcgcgtacattccacagatcgagggtgaagaacctcactcagcgcccccggccgaaccggcaaaggggggcctgcgctgtctcccggtgaggagccccacgctccgtcaaattactactctaatacttgtacaagaacttccttctttatctagagtcctagtactagagcacttagtataaatactaaacaatgaacccgtaaagatgaaaatctatcttacttaaacaaagtaattaaataacataagaaaggaacacttatagaagttctccgaacccggagcagagtgtaccgacagctccggtactcctcccgaattcctcctaggaagctacactcgtcgaggtagaagacggatgagcgccaaacttccgggcactcctccagagcttcccctcactctctaccttattctaatgtacaaaagatacaatagagcctcttgtaattcagctcaaagttgtatgtcggaaatgatagtgaactcctccttatataggctccaaatgatggttggaggcatgggaaattaccaaaataccctgcaaccgcctttgggaaggaatccaagccatccacgtggaagcagatggcgagaagcggcaggaaaggttcggccgaacccaaaaacactcctcctggcctctccttcggctaggaggttgcttaattggcccccaacaacttgggctatgttttggcccaattctaaatggtttttattgacttattggggctccaatccgtgtaaacgcgtcctgaatgcggggaggtgcattttgtcacatgacatatgtgttttctcctcaaattacctgcatacacatatttcaccaacactagtggaaatgattagtaataaaccctaccactaagttggataccatattttatttcattatatgcaagtattgacggtcaaatattatgatttaaggaccgtcaacactcaaccagtcataccaacaggaaggtatgatgcaagggtattctcaaaggaatggctcattggatatttgcaataaaagcaggatttataaatcatttgaataagtaaaagcattattaaatcatcactgttcaacgctaaaaccacgttgcaacaggcccaaccaaaccatctgaactacaccagttctataggtcaaattgttatagtgggactaatcatggtgagctggttgaccgcccaataaccgcgggcatggctattcgaataattttaactcttatcagaggtgtacaacttaaccaacaagacacgattccacacatgttaccatgccccaaagtaccgccacgatactgcaaagagggaaatcgtgacaaaacccgtcatataactctccctaaccaaacatacccacctcaggtttcaccccctccttattccaagtcgggcaatccctcttgtgcctaggtaaatccggctacaacagagaccaatatccaggtccaaactgcaccatcgcctctacccttgccatggaatgtcagctaggttaagctatactctagatttagcctggagcccacactagcctatggtaggattcccaagaactggtccttaattgtcatgggcacgacttccaaaatcatgtatgtacccacaacccaacattaaagcatattttagtttaattaaaccataaccatggtggtacatcataatataattaaggactaaattataatgaatcccattgtgagctaatagatctaagcatgggtaagcattcctaaaccaagaatccaatcaattataacccaagttatcaacggcataagatattcaacaggctgagtacgataggcatccatcccacatgacattctaaagcaatgcaagttgatagaaagcaggagattttataaaataggcttcacatgatcaatgatgtatgtataacttgccttgctcttgagctgactgaaccatggcgaccaattcgaagtaaacgtgatcaccagaattgccgaaatctaaatgacaaacaaagcacagaagaaatacaagcaataaggctaccgaaacaacaaaagaaaccgattttatggattctatacattttaatggattcactgcaatttgaatgggttaaaacggagctcggattatttagttatgaattttacaatatgagctgcgttattactaataaccgaaaaaccttaatcaattattacatattattgcccaaagataaaatagatcaatggaaataaacctccggtaagcaagtctcacgaattaacgactcagcgagccaatccttcgtgacacgggaccatgcaaacggtcaaccaaaccggcgaacggaaccagcagcggcggtgcagggcggctagggttttgatgggctaaacaactagggtttcaacgacgacactaaaaagaattaacaccctaaacaggagattacggatagattcctcaccaaaccgagatgatctgcgaggaggagacaacaacgacggtccagcgacaacacgtggagacgacggcgaggttagatcaaaacctaagacagagacaaattagaaccggatagataatggtgatagccatgacaaagagaaggaaaatggattaccggcgacgctagggtgatgatggcgacgacgggaggtggcggcactgaccggtggtggtgggacagcggtgagcatcggcgcggcactagggctaggcggcggcagcggctagctaggactagggacaaacaaaacaaataggaaaaaaaagggggggggttgttctaacttatataggtgaggagaaaaactaaaggatgtggggcagaggggagtcgggagaggggggagaggaggaggctaactcggactagacagggagagggcggcgcgcggcagaggggagagggggaggaaaaataggaaaaggattagtaaaggaacttccccaaattggaaaagaaatacggtgccgttttaggaaaagaacggaaatagaacccgcgaacaaaaacagacacgacttgtcttgcaaaatggaaccgcggacagagaggtgagtgaattgggcacgattcgagaccaaagacgggagagaaaaaatattataacttcaaatcttatgaatttacattaacaacgttaattccgatgctctggatattcctctttaagtcatgttaatgatttcagagcaaagagaattaaaaaaaaattctccttgataattccgattattagacacattgttaatttgtattttctcctagttaaccaaaacaatttctatagacaatttattagtgaattagaaactacggaaaaggaaactcccggtgtgacatcgatgccacgtttgcagccgggcccaccaaaatgaagtccacgcgtccaactgaagcaacgtgttcttgggcgatatcgaagccgcgcgcaactaggaaaaagggtggtgggtgcgctgtgggacgaatggcttctccctcgttcccaggcgcgtgcaccgacctccgcatcccggattcgccctctcccgtgccctcgccctcgccatcaccctttttcccgcgcccccgctcgccctcctgcgcactcgctgcattctatttcccctacccgcgcccgcagtcgccctcccacgcgtgccataattttgcccccctcccgtgctcgccctcggtcacaaactcaccattgccctccctctcgcagcaaccggcttcttcgcccatcgccggggtactcgctgcggacggaggtacgtcggtgtggaaccctaaatcatttggtcgaattgattcttcaatttttgattttttttcccctctcaacgtgatgtaaaccctaggttgcgatggatccaagcatggctgctgcattcgctcattttttgcaaggtccgaacttagtggctagtttatctcaatctgccagccagccttctcctttcccctcacacccggtgatcccattccaacctccatcgttttcccccttctgtacgcagccgccgggcccgccagctccacctccatcgcccccaaacacagccaaggcaaagccttcgagctccagatctgcacgccgtcaccgtgtgactgcttccccagaagctgctgttgatcctaagaggaaaatgtactatcaacagaggaggatataaggctggtatgtttttgtttgtttttttcacttgttgacacacaacagagatattgtgattttctggtactattgtgatcctgcaggctgcagtaggacatttaggtgctaattcattctaaagaagtagatttaggaggtatgtttaggtgctgcactgccgcctcatataaaatggtggtgtcatataaatgattcttacaactatacaggtgatggtgtttaaagaaatattctaggcaacaatatctgtttacagaattactcccttcgtttcaggttataaaacgttttgactttagtcaaaagtcaaactgctttaagtttgaccaagtttgtagaaaaaaatagtaatatttttaatccaagacaaatttattatgaaaatatattcgaatattgatttgataaactaatttagtaatataaacattactatatttgtctataaacttagtcaaaattgaaacaatttgactttgaccaaagtcaaaacgtcttgtaacctgaaatgaagggagtagattttaatttataaacttcttattcctatatgttttctgggaaagatcaaaatttgggcatgtgatgttcagtatttgtccttcctgattcatacagtattatgtagaaaaagcagtttttaaaagaagtattgcaatatttatctttatttgacgcaattaggtgcttcttgattgtagagaagtcaaattatgaggtatatgcgatgtatagatgctaattcttacataaatggtgtataagtgatgaatattcttggaattgagtgaattttgtgtgtatatgtgatgtataggtgctgattcttacataaatggtgcataagtgatgattattcttggatttgagtgaattttgtgtgtataccctttgaacttggtgtgtgtaggtttcctgtgtccatggtctcaatttctcaaagagttttccttgtaaataggagctgattgaatgaaaaaaatattatttctggttggtccaagaacatgcatatcagtgaccatcttttttttttgcggggaatatcagtgaccatcttagttggtgcatgtgccagttgacaactgtttggattagggtccttctatagttttaaattattttactgttataaactcttgccatcattggttccgagaagttgttaatatgaatagaaattggcccccaaattaattggaacaactattgatattttctctgtttgtctgggtccacttgctagctgccagagagtatgacaaattatttctaagattgcttcatatgcatgcctagctggtttcatgtttcttagtgcacattttttttccctttgctcattttttctcagtgcacattttttttccctttgctcggagttacagcacgccatgatccattggaatcgccaccgaggaggacaggaaaagacagagcgccataattattgattttcatatataggtaaccaatttgaaatgaaagtattttaaactacgaatttagtgatataacatgcataatacttggcatagatattgttagtataatcagtagtaaaaaaaatatcaagtttgattttcccttaaaataaaggtactctataatttgggaagggaggagtacatcacaaacatcgactcactaaaacatataaatgtctcggataaatcctcaacggtgagtggtgcacctgaaaggatttatttcaatctatgtggcattcagagaaggcttgcagctttatgaggaacttctatagcctagctcttgtcaattcccttgactcataatccatgacaccggggatgtgagtttccataaagtacttgtcccaattgatgaactttatattacagggtatcaattctcggtctctttcagtaaccattcccataagattctgcattttcgagtcatcgaacctacaagaaagggtacaaaatgggaccagctcttgatcaaagaaatcttttcttttttatttattcttggagttacatctacattacctcgttttggatattgtgaatggccagtatacctctgccacggcaacagtaaaatcatactctctcttgagatggttgtaaatatgacggtcttcagtggtagataacccacggcgcaacatatcctgcaagcggaaataatgacccactctgtgagaaagtagccaaaaaaacattgtcgaagtgaggtttaacaagaacaaactaacctgcaaaggcattttgtagtgtttatccatggtctcgtagaagctggccattgttgctagaaaattcggttgtttcaccttgactacatctccttttgcaccgacgaatggtatctgcgagaagtatttgtacgttgtttgagacatctggccaagcttgatcgggttgctcatggaagaaccaatctgatagatgaagtctgctgttccttgaggatggtagctgataatacaaagcatcgcattgaccacaatgtctgcaggtacctgcaaggatagattactcaaaaatggtaatacattgagtccatatgtattaaattttacaattatataggtcaaatagatgatggtggtacactaaggctccattcctttccacgtttaacttttgaaatttccttgtttaccgtgagcattttttcaaattgctaaattgtactacgtattttcatcaatttatttaaaaaatcaaataaacaaatctttcaagtttgtaatagttaataaatcgtacgctaatgatatttatgtttcacgtgcggcaaaaaagtaaaaattaaacccgctttcaaacaaagcctaaatcctagtcttgctctacaccaatcgatcaattccttatgcccaatagtacaggaagatagtatcttacaatgtctatgactgttgccacatctgtaggaaaaaacttcagtgtccccttaccatagttagtgatccatgtgtcaattgctctgcaccaaatccacagggtgtatttcaaagtgagtttgctgttgattaataatgcaagtaattaattaatggtcctggacagtgatggactgacttggctccttctatccatccaggaaaaggctccttccatgtgcttgttgtggctgatggacggatgataacaattgggagccgtgagttttgttcatatgccagcatctcacccattgcttttgtgaacacataggcattcgcccatccaaacttcttagctctatttagtcatcatgcgacggttgtcttaataatgttgttcctaatgatgtatcacataaaaagtactagaagtctagcgaatagcaatgaataaaattatgtgtgaaacctttgtgcgcctatctttttcatggtgtgtcttatggtacgttctgaagcattgttgtaaactagctccttcaacttttcatccttaaatgccatctcttctgaaatatctagatctgatcgaccatcataactcctccattgttgaagcggcttctccatcatgatcccttgtttcattagattgacataagcttgtttcattagattgacataagctgaaatttagaaacaaatatgtcatttaacaagaaatcattgttattggataagtagcatagccataggtaaattttaggtttcacctgttgacacaagaagaacgagctctaggtttgtgcattttgatgcaaaatctatcatatgcttcacacccatagtgtttattgccaacgctgtatcatatctgcacttatgattagcgttaataacttgaataaatcttaaagtaaccagtaaccttgttttacctttctgcgaagtttactgtcgcagccatgtgaacaataatatttgtttctttccttatatcttcagccagtctagcgtctcctataccgaaattcttcaaggacacatctcctgctagaggaaaaaccttgtcccagaaccatgaactgaagtgcgtttgatacttctcccgcaagggttgaaatatcggaagttgcatgatctgatatgacatgtagaagagaactgaactagatcagatcttaatcaattactcaacaattcaactaactaaatttttttctgaataaaagacaatatgcatgccgtgggggagaatccatgttgagcttttacactatatggaggatggaaatttcaatttgctacattcagtccacgcttcacactagtatatgatccccaatccacatgtctttttgaacacaacactcctgccatgaatcaatatcactagcgcttggcttcgggctcgtcgccttcgctgcggtgcgacccgttgtcggcctcgtcgtcgccgaacgtgacggaggagttctcgggcatcacggcagagtactggtccgtgccagcgccgctgggcgccgcgaggtcatccgcgcagtcggcggcaacgcagccggaggaggtgttacggcaggtggagaacgaagcagctcgaaggggcattttggtcagcccgggtgcgaaattgggtggaaatggagaaaattggttcaaatggcaaaataaatgtttagtatctcttgtgcgtggcattttaacgaatccattcggcggaatgatattttggcgaaacccactcttagcagtggcataatgtccaatttctcactgccgccaccaccgagctcaacacacccgacaaccctgaatgtcctaaatcgaactttcccatcagctttggatctggatcagacagagagggaaattgtgaagaaagaaagggtgggtgagcttgccctttccctctggagctcaccactgaggaaaaaccgctggcgtggacgccattgatgagccaccggatccgccggcaaagaaatcgcggctgccgcatccaacacccagagcctccccttcgagtctgcgtcggcagcggcgtagcaaggagagcaccggcaatgagggtgctgcgaggacaccacccatccacaacatcgatccccttcgagcggagaatggcagcagcgtagggaggacacccgacggcggtcacggcactgggaggacacccagcggcggccacggccaagccaaatccaggcgccgcgcaggagagagcgagagagatgagagggacatggcggctgggagttttttccttttttttacgcgcctgggattctcgcgaaggggagagagagagaaagaaaaggaaattttgtgaaaatacccttcagtttccaggattcagggcgcagtccttttttcctctttttgtctcctatgtattgaatttcgtaggatgcgaagggcctaaacgcaatattttaaaccgagaaaagaacagagaggacgtataacaaaatatctataaaagagagggcttttctgcaaaatttgcagaggcgacgcggacgcatgtaaggccgtgaaatccatccgctctccagcgcgtgtccacgcgtcgtgaccccgtgatggccacggcagcgcaaaacgctgagggcgctgcatttcccagttggtttgaagactttagatatcgtatgggatccttagttttcatgaccccaccaacagtgccacgatgaatctcagtgcaactagcgttgctacagggcttctcttctgtgccatccaatcttttcatccaccttcgatccccttgtccacgagcatacgtttagctccaaagcctcccatctggcccccggcctgcacttctcgcaatcccctactcagcatgctggccactccatcatgtttcctccttggttggttcaaaccaatcgggaggcttgcccaaaactccaatcccgtcttggaataactctgcatgcttactccaagttttattttgctctgttttcgcttgcagatctgtttcttgatcaagtgcacaatttgttaaccagctgcgttcacgtggagcttgtagcgtcgtgcataacgtgccctggatcatgtgatggtaacatgtggcaaaaggacgtggcacgcacaagcagcggtagtgcgatcagtgcctaccgatcgatcgagattcagaaaagctaccgatccacaacatcaaaacttgcgttttatgttgttgaattgttccaatctcatgtggtttctatcattgtgcaccccatccccaattcccgatgcttgcactgggtactcagattaatggtggctggtccatgcacgagttcatattcatgcataaacagagctatgtgtgctcgagcttggtggtggtgtgatccaagaaggcggtggtggtgctgcaggaggttgtcggcttggggttggcatgacaaaccttgtgaaccaaggtggagctcaataggctcaggggttcccaggcacccggcccaatttaaattttttgtgcttaaccctcctttttgtcatatgggaacccctcataagaaaggaaaaagtccacttagacttccttaattgttcaccgaatctaattcgttacccttaactataaaatcaggtaggacgactccctgaattattgaaactagtgtaatttgactcctccagcggttttggagggtggttttgctcacgtggtgctgacgtggcgagcgggaagaagcagccgctgcaggggctggaccaccgggtgatggtggcgctggtcaagatggtcgccgccaacttgttcctacctctgggcaatgccgccgtccgcctacccgtcgtcgctcccgccgccgtccgacgtgctcgacgacgaggtccccgtgatggtgctgctcccgtggatcgtgcactggtggagaaaccatctttcgtcggtcggccgatttccacaatagtcccggatgcaataaaaaccggggctaaagatgatctttagtcccggttcaaaagggaaacgggcatatttgatctttagtcccggtttgtgttaccaaccgggactaaacatcatctttagtcccggttcgaatgctgtcaggacctgtcaggcccccccgggatctttagccccggttggtaacaccaaccgggactaaagatcttaactttagtcccggttggtattaccaaccgggactaaagatcccggtgatctttagccccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggaaatggatgtacgctgaccggcggtccaaagagtttattgacggcgtgcactattttttgagagtggccgaagctaacaggcaaaggggttttatttgttgtccatgcaataagtgtaagaatcagaaggagtattttgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgctagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcattaagaacattcttccggtgggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgaccggcagcttacaaagaagagaattcctgctaaggtgatgtggtatttccatataataccacggctaaggcgtttgttcaggaacaaggggaatgctagaatgttgcgatggcacgctgaagagcgtcaacaggacgggatgctgagacaccccgcagatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtgaaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagatatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataaagacggtagacaacaatttattccgtaaagctcatttcactgttctgcaacactcttcattggtagctccttacatcgaggagcgcttggctctagttcgcgcaaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccagaacagcgctgttcgtgtcgatgccatgggacacgatggaacaactgccacgtattacggttccatcaaggacatatgggaacttgactatggtcctctcaaggttcctctgttccggtgccaatgggttaggttgactggtggaggcgtaatgattgatgacagtgggatgacaactgttgaccttaacaaggttggatacttggacgaaccttttgtccttgccaatgatgtaacgcaagtctttttcgtgaaggacatgtctagtaaaggaaagaagggcagagggcctgatgagcctaagcgtcaagtggttctcccaggcaaaagaaaaatcgtcggagttgaggacaagactgatgaggattacgatcagttggatgggcaacccccttttacggtgacgattgaccctagcatcctcctatcaaatgaagacaccccttactcacgcagcgatcacaaggagggaacaatagtgaggagaaagtacgtgccgtaattattgtgtacacgatgtaaactattttggatgtattgattatccatataaatcaattgatgtatggcatatgttaattacgcacgattattagaggttcaacaaagtttaaatcatgtatatgctagttatatgtgatacttacaatttttaaaagttttaaatcacacaggtggcaatttcatatgtatgttaattagagtttttaacttttaatttactagcattcatatgctaattattattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggttaaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatatcattcatatatatgctaagtatatatgattattggaatttttattaat

SEQ ID NO: 63119 - DNA, 5302 bp, Oryza sativa
  unsure (1)..(5302): unsure at all n locations
ctcgttatcgaggtaactgaactcctcttgtttttatttttacatttttttttactctgatgcaatctctctcaatttttttttttttgcatttaggattgatatatttttcttgtgtagaattatgtcttggaatgttaatgatgatgagtgtttacagcttttgacaagtgatgaaaataataataaaccaactaaaagatatattatttgaagaacaagtaaatgcaataatttagttatctggatatttttttatgattgaaaatatagctcttgacttatgaatggtttgaagtaataatttaaattattaagcgtaagttattattataatctagattattagaagtaggctgaaataaacagatagttttataatagattactacaatctataaaccatattagtataatatggtaatccactttaaaggaatatttttagattattaggtggctaacagctaacaaacagctaataattcaaagaaaaaaattagctaacaacttataatccagtttatagtaatctggctcaataatctaggttataataattttaagctgaaacaaatacagtcttacttgtttatgacttttgcaattttgtggcaaaatggccttcgtcgtctccttttggtttggaataaaagtaggggctgaaaattgtgccaagtattcctttgataatgtcactatcacagctttaatttaactcaaaggttgtaaggttgttttagcgaattagccttcgacatccttgatgctaaggtcatcgactcatggttagagcttagaaccttcagcgattgaattattgcttgttactaacttattcagacaatagcgtgacacaattaaacaacaaggtaagcgattagtttatgttatggttttttaatttggttactataatttggttactataccaaacatatcagtccttcaattggttggtaggcaaaaaaaattggcataccaaattatttggcttagttgaattaggcccatatatggaaacacattttggcagtaaccaaacaagaatctagctattttttaccaaaataattggtagtaactactaattcttgccattgctaaaattttggtaaggataagattagcaaagtatcaacatgccctatgatccaagcaggaacatttagtcatctactcttgtaagaagcaaatttgattctttcacccaacctcttttttttttaactatcctggatttccgtttgttaaatcaatcagattgttttattttcatttttttttctattctgaatttgtgttgcttagctaaatgggattattgttttcttcctgatttcatttattaatgctatgctcaaactgataatccccaagataaatacttgatgtttatgataaaatttgattaaaactttatttttatattaaaagataagtattaactcaataagtgtaatggtaaggtcaaccaacgtatataatttattttgtttaaaaactaagcatgagtattatttctcggattttttttaagcaatatcgaatcttgtcttaaacattggaggaagtatattgcaaatgccagatcatatatttcaagttgtaaaatcttttggaaaaccgcctaaaaaaataaaccccatcttttcgcctacattattagattacaagctgtagcattaattagcgactgaaaaaccaataccgaaaataaactacagtaaaaaacatcaaaatcaaccgtaaaataagatttgaaatttaattgttagatgtggttgataaggtgaagagcaaacgatggagctccttgttatgattttcatgaattccttgttaccatttgacgaggtacctcaagctagcttgcctttttttcctaataagaaaatacgagtaactctagagagaaaaaaaaaggtaattctagtttattggtaaaaaaaatatagaactggtgccactgttggggaaaaaaacaacgcaaatatgccaccttttagaacaaatagaacatccgcgctctgcaaacttttgggacctcatcttttcgcatatgcttatgcttatcagccaattacttttcatttacaaatatgtcgtttcccttgctacacacacaatttttccaagaacttggtgatacactgccttttgcaactgtcaatttcaagccaaactctccaacaaaacaccagtatggcctctctaaaatagactctctaaacatccatatggccagctatccatcatttgatttagcaagtcaaagtcgttgctcgctccaacagcctctctatctaccctctattacaagtctattacaaatgagacccatttgtcaatctctactacccttcttcctcctcttccacccccattttccccacccatactactgccgacctcctccccacaccctctccgatgcaacgacggcggatggcggtgcaataagcggcggcggcggggaggcgggctgcagcgagcggaggcggcgggggcggtggactgcggcggtggcggctgcggcgagcggaggcggcgccgcgccggtgggctgctgcgagcggaggcagttggctgcggtggcgactgcggcgagcagaggcggcgggtgcagcaagcggaggcgggctacggcgagcgaaggccggcggctgcggcgaggggaggcggngactctncccttctnctnctnctnctaccactcgcctccgncaccgcgtnctctacgaatctcgcgccgacatgccgcccccgatccacctctccgcggcggccctctcgcggcgggcgaagtgccgagagctgaggcggtagtgccggatgtggccggccgggagcgaaggcggcaacgcttctgccgggggagcagcgcaagagggatggggatgaagcgggcgccggcgggatcggtgcggccggaagaggacgactgaagcgcggcgcggggatgaagccggccacatcctgcgagagcccgccgcttctcggcccagcgtcctgctgcggtggccgtctctcatcggagctctgctcgtcggtgcccgcgcgccgcaccattgaagtcaaagagagaggagagattggggtggggggagcaatgtggggcccaccactagcaactggtttggctaggcaggcaggatggccaaatttagctagctaaggagccaatttggccagctagatggcttggccagctggatagagtctgttagagtgctttttcctcctaaatttgctagaatgtcatctagccattctctcttggagatgctctaaaatagtactcaatcatggctatccttttaaaatgacaccaaagctcatgtctttttttcttctttttttttcacgtaggaggacgtggttaaggaggcaaaatacctgagagagaccaacgagaggctgacgcggcagatcgagcagctgcacgccgaccactgcgcccacgtcgaggagctcgtctacctcaagtgggtcaacgcctgcctccgctacgagctgcgcacccacgacggcgacgacggcgccggccggatttcggcgagggacctgagcaagagcatgagcttccggtccagcgagaaggccaaggagctcatgctcaagtacgggacccatggcctcgacggcttcgacccctccatcttctccccgctccacgagtccgtctacggcgacggcgacggcgacgacttcgagcagcgaagaccgaacggcgacgtcgtcgtcgacgaggcgccgcggagcccgagcacggcggtggcgatggccgccgcagctgcgggggccgagtcgccgtcgagacgtggcaacaagctcaagttcttggggaacatcaagaagctgctcccgaccagcaagaaggggcacggccgcggcgaccggaggagcagcaggaagcagtcggcggcggcggaggcggagccaccgcgggacgagcacctggagaaggcgctgcagtggctgtccagccacgacgtgctggacgacgacgactcgtacgaattcgagctcggtaccgtcgtgcgagcggacgccgctgagcagcgtcacgacggcgggctccacgcacgcccgcagcaccggcggcgccgccggcgagacggccgccgcggccgcgtcgaggctgctggaggcggagacggcgcgggcgaggagcgacgtcggcgcgtcgtcgtacgggcgggaggcgccgagccggtaccacgcgctccggccttaccaccccggcgccggcgcaggcaatgtcggcggcgacgggccccgcgcgtcgccggagaagcgggagctgaggcggcggtcggaggagctgagaagccccgcgtcgatgttcgcgggtgcaagggataatcgcatgcatcagctgcagagcaatgcttaattaaccactactactattactgaagtatttacagattaacagaaacctgctgcatatgcgagatgggatataatgcaagtttttttttctttttcccctgcttgtgtttatgcgtgtacgaactggtaattaatactggatgttagaagggtttgtgacttttgatcttggattggtgaagaaaatgatgcgttaggatttggtctacctaagtagtatttctcagcacacatccaactctaaataaatcgaccaattttcccataaattaattatttgtggacaaacgtatagtaaaatcgttagggatttaggattggagagggcaatggacaagtttggattggtaaatttggtatggatgaatgcctgaaatccaccggcccaccagaactggcccatcattaagtttccacagcctgtaatattaagtgggccggtggaaaggtaaacagaaacggtacctctccaattagtcttgatcagagacatccacgtgctagtactttagaagttttagttgctattaatccattgagcaagtaggggaaatattcctatcatctatgcttgaaataaaattttctcttaaattactcatccaatttataatccgattacaccgttgtgtttgtagttacgtccctcaagtaagcatcgactttcaatattagcatgcaagtgtgtcctgtagcaatacggtttcaatacttccaatattagagcagctaaaaccggtttcgatactgcctttttagtttaactatatttacgttgtttctataaagatgaggcatacattatatctggttttacgcctaggcgatacaattaaaattaactcaactacttatgtacgacccaaacccaacacccacctgcgtgggctaccgggtggcgaaa

SEQ ID NO: 63120 - DNA, 23492 bp, Oryza sativa
gagtcggcctggccttcgggaggaggagggaaaacgggccggcccggtaaggaagggggcgcgggaggtgatgggccgacggcccaacaagagagaaaaagaaaaagaaaaaaaaaggaattcccagggattaaatattgcactttgattattctaatgggttaaaattatttccaaggctctgaaaattccactaaaaatcctgttagcatattttgacatgtagaacccaagaaaaattccacatgcctttttcgattattaaatgcctttattatattagggtttctctcatgcctttacacttgtaatttcttaggaccatttattaatttgatttaggcttgggagaagaacttcagggtgtgacagaccaccaccgccaccgccgtcgccaactgccatcgccagccgaccaccaccgccggtcaccctccagatccggccaagaggtgcggatctgagggccgtcgccgccacgaccaccaccaggcgccgctgtcgtctcctccactcctcgtcgccagctacccctccgccagatccggccaggccaggcatgaatctggcctccactaccgccgctcccgaacatgatacttcgccgtcgtcgccaccaagcccctcgtccccacgactgccaccagccgccgccgtcgccaccttcgccagatctggccgggcccatcgctggtctggcctccaccgctgccgctccgagcatcgccccctgctgccgccgcatagtatggggagggacgaggccccaccgcccctgtccttgtggccgcccagctttgccggcgcctgctcaggcggcggcgaggcggggaaggaggcgggtgaaggaggaagacgccggcgtggtcgcctttcgagtcgcccggggaggcgacgtgagagggttttctcaagatactactgcagttgtagtttaattccccaccaaacacagggtgcagaaagcatagcaagcaggcaatgggatggtttgacttcgccgagcaaggatagctatgcacgattcatttcgggcgtgtttagtaagattcatttcgggcgtgattagtaagggaaaagaaaatttttaagcgtcacatcggatgtttgactagatgtcggaaagggttttcggacacgaataaaaaaactatttcagaactcgccgggaaaccgcgagacgaatcttttgagcctaattaagccgtcattagcacgtgtggttactgtagcacttatggctaatcacagactaattaggctcaaaagattcgtctcactattttccccataactatacaattaggttttctttttatttatatttaatactccatacatgtgtccgaagattcgatgtaatgtttttgggcccgaagtaagaaagaggtcgattaaaaacaaaaagaaaaatgaagaaatggctaccgcctaccgtagtggcaagctccgtaaaaaccacgcctccgtccgccgccaatgggtgcatcggcatatgccgcccttcatcgcctcctccctcattcttccggtgggggtgctcatcttgaggatcgagggaaggggaggagcccgcgcgtcgtccggtacgcggtaaccctacttttgtcaacgggatttctttattcgagttcagatggattagatggggattcgagtatttcggtgtgtgctaaagtacaagagagtttccggttgcaggcgggaagctccgaggctggatggatggaggaggccaccatcatggctgcggggagaaaggaacaaagacaacatggcgcaaggccaaaacggcaagaggaagttgggactggtttcaaaaggaattgaagtcaaaaaagaggaggaataagacgagtttaaatcagtgtggcaaatgctaaataaatgttttctaaatggtgggaaactgtaaattaagctttgacagcagcatgtcctgaaagtttcaaaaaaaaaaaatgtcatatgattagttatcccactatggatcgaagatgttgcttgagagtatgacaaggagaaggcccttgaagaattgagacaagattgactgtgcaacgcagcagtctgcactgcagttataacacttgctttgaaaggagatacgcagggtgcttcggatcttgttcgcaacaatggttggtggaggactggaggcacctaaatattctcagctataattattattattttactttgatcaagactaaacttccagtgctaactgttgtcagcacacctactacaaatactggcgagcctgctgagttttcttgaagcagaggagtgtaggtaattggtgcatgttgctatctagaatggtatgagattgggaaaaagtcaagaaaagcgactgcaacggaaataggaaaacagatgtaatcctcttatctccttgatacacagagacggtgcctccatttttctctttttgcacaggtacctttgtggtctgttctgtgttattcatttttcggagttcaaattgcagcgatgttttgctactgcactattaaactttttttctgacatgtcacttgtttatgtattagttgcattgtaaacagatatactggctatattttccttctgctaatgtttgttttgacttgtccatatctttcaggatcctcctttagttttctatcatcatcctctattcaaaccccagtggtatcatcaattgtattttttttatttcgtggactaagctttcttgatgtaagatttcgtcaaagtactcacctaaccaccgatgtttacattaggtacatgcaacctgccatcttcatgacttcatttctcagctgccaaagagtcgctagcatgacctttcacccatacatatgagctacttctcttgcatatttgtttctttgtgttcccttgtcgagagcttgtcaaatttctgcagatctgtttttgagcaagatttacacataggtatgtctacaagttctggacaagccatggtgagtgtttcgacgggagtgatgaactgccttcttgccaagcttgccaccctgattgatgaagagcatgttaagttcagcaacattcctaaggaggtgggcttcctcagggatgagctcaggaccatgaaagctttcctggagatacttgcagacaaagacaacctcgatccactcacaaaagagtggatgaactaagtaagagagatggcttatgagattgaggactggattgatgaggccatgcatcatctcactaaggacgacagcaattctgggttcatttcgaagatcatttttcgtctcaacaggatgagaacacaaaatcgcatggccaatcaaataaatgaggtgaaaacacgtgtggtggagatgagccatcggcacaaaaggtataagcttgatgcaagtatctctacatctgactatacagccattgatcctcgcctctgtgcgctatatgcggatgcagaggcccttgtgggtatggatggtccaagggatgagattaccaaatggtttatgggtgcagatcaacagttgatggtggtgtctgttttgggaattggtggtctaggcaagacagcacttgctaacgaagtgtacaaaaagattggagggcaatttgattgtcatgcatttatctccatctctcagaaaccagatatagtaaggatcctcagtaatatactctcacaactgggcaaggagacatttactccatcttgtgagatacatggtgttctcaataatctgcgggagaatctacaagacaaaagataccttttcttcttcttcttcttttttttttttgtttctgcaatgtaatgtctcatggatggttatatattggtcatgagtaatctacaacttatctcctcttaaaaacttaattggaacagttctgctctgtccaaaatgttcatagcaatgaactgagaatgagtctttcctttgtgctatttgctctgtttttaaggagagtgtagtccttacttactcttagtctaatttgcttattttatatgctgcatgtgaaacatttgcaggtatttgatcataattgatgatttatgggacaaatctgcatgggacatttttagatgtgccctccccaaaataatcatgctagcagagtgataacaacaacacggattgaaaaggtggctatggaatgttgcagctatcgctgtgaatttatttataagatgaaaccactgaatgaacatgattcaagaagactattttttaatagaatatttggctcggagaatgcctgtccagaacgatttaagggagtttcaactggaattttacaaagatgcggtggtctgccacttgcaattgttagtgtctctagcctgttagctaatccagcaacctctgtagatagacaatgggagtacgtaagcaattctttgagtgataagtttggaataatgcctgcattggatggaatgagaaacattttacatcttagttacaaaaaccttccttatcatctcaagacatgttttctttatcttggcatttatccagaggactacataataaggaaaagtgatgtggtcaggcaatggataactgaaggttttgttcataaagcccaggtacaagatgcagaagatgttgcaggtagctacttcaacgagctagtcaacaggagcatgattctacccacagacatagactatcagaataatgtagtatcctgtaagctacatgatatgatgcttgatcttatcttgtatgaggcagcagaagagagattttttacagtaacagataatttcagtacattgctgggcctgcacaatagtgtccatcggctctccctccaatatgacaacggaaaccatgacaccgcagcagcaactactagtctaacatatcttcggtcgcttgcaatctttggaaattctaaatacatgcacatgcatcatctttcagactttaagtttctccgagttttaattacagtgttttcagatgctgtccaccagatgagtttggacctaacaggaattcgtcagttgtttcaacttagatatgtgaagattgaagccaatattcatgtgcagatacaattgcctgctcaaattcaggagctaaaacttttggaatccattgatatagaatggggatcagtttgcattccaccagatattgttcatctgcctcacttgattcatcttgttatcccagaaggaacaggattgcctgatgggatcggaaacttgaaatctctgatcactctgcgttcttttgatctgggggagaactcgttacataatatcagaagtatcagagagctgactaatctgaaagatctcaatctctgttactctggaaaaaatgtagtatctaatatggagacatggattgatgttttgcgttcttcccttgaaaagctttccaacctcaaatatctacatttatattggcctggtacttgtgaaaatggcctatgttctttgaaccctccatcccgccatcttcagagactggagatggcgtactggtggttttccaaagttcctaagtggattggagggctccatgagcttcacgtcttgaaacttgcagtgaaggaggtgtcagatgatgatatcactcttcttgcacaactgccttccctgacaaaccttggattgcgcatgcgaggagcacctaagcagaagataattatctataagaaggcattcccagttctcagatacttcaaattctggtgtagcacaccctgcctggtctttgaggcctccgtgatgagcgaagagctgcggaattagcgctacaaaatgccattgatatgcatcctggtcgtcctagtgttaaggtcgtcagttgcccgcatacacagttccattctgacatttccgattaggaggaagtggacagggataacatatgccatctgaacaaaacctagtaaacgtcgctacttgataccatacttgtagtagtaactgtatgcagaaatttttttattaatgtgaaatacaacagaaaatcgcagagcaaacatgatcatctgctaacagcattttgagtactttgatggtaaacaaaccccactgtttggatgtgctgctaggctgctagctagctatcgaatggccttatactattgctatttagtggccctgaaatcgatgtaatcaccttctgtcttcaggcaccacacatttcactacctgttctcaggaaacacatcctccctctgtctctaaatataagtgattttagtaggatatgacacatcataatacaatgaatctggatatgcttctgaccagattcgttcgctgtactaggatatgtcacatcacactaaaatcttttataactaaaatcccttatatttagggacggagagagtatatatctgccgcatctgtagctgcagagctgttgacttgtttttgcactctgagaagatgaactatgtgatgtcatggaacttcctgaaattatcatacatcgaggattcctctgctgcaggttgctgtgagagcaactgcagcatgtccggaacttggcaagtgaaaaataaggttcgccaggcccatttgtggacaaaagtgatttcctgctaatactattccaggactatatttgctattgtttgtgtgtaccgtggtttctgttgtttatttgatcacttgagaaggctaaccctaactaatctcttcaatcctgcatacaaaattgattttttttccccttttcgcacgcaccgtacgtgttgagcagtatacccataaaaatggcacaaaacatgatgattgatgaaatcctgtatgtatgatatgatatgatatgacgaaacacgaaactgcgatcgagtgattgatattgcacgttttgcttgatcttgatcaacatggaaatggatcggtctgatgaactcacgttgtaactcctcactattgagttgaacatggacgaaattaatatggtgatggatcagcgatgggtttataacttcacctatcaaaactaaaatattgacgtccacgaatatcatgcacaaggggtatgctttcaatctgaattttatggggttaagaactgccgctgatcctcgtatcttgaatcatatattagggacacacttgcggatatcctccgtgagaatgtgtgcatgcgtctttggggttaaaagggaaaatgacaagggtatacctaagcaagaagaacctataattttgtagttgtgttccatccaatatgggaaggaaaaatgggaccgatggcaagcatgcacaaaaggaaaagcgaagttaaagggcaagctaaagatggaacgtgtggttgggacgaagcagtgggggatccagtccctcttccccctctcgccgctctcctctatttatagcttacatatgcgcgcctcacaacccgcgacgaacaccgaggagccagcaagagacaaacctgaccaaatccaccctagctacaaattttcttggccgcgcgcggcaggcagatcgagcaggcgagcgaagatgtcgtggcagacgtacgtcgacgagcacctgatgtgcgagatcgagggccaccacctcacctccgccgccatcgtcggccacgacggcaccgtctgggcacagagcgccgccttccctcaggtaacaaaaccaccaattcctcgatcgccgccggccgctgttgttcttgttcttgcgtgatcgatcaccggccaccgttgtgaattcgtctgtgcctgtgcagttcaaaccggaggagatgaccaacatcatgaaggacttcgacgagccggggttcctcgccccgaccggactgtttcttggaccaaccaagtacatggtcatccaaggtgaacctggcgctgtcattcgtggcaagaaggtacttatcgtatctgatttctaaccatgatgggtccgcagtttctcattgtctctaacctttgattgattaaatttgcagcttcttctcatatgtaagccatgggttcttgttgcaatgtttggtttggcagggatcaggaggcatcacagtgaagaagaccgggcaggcgctggtggtcggcatctacgacgagcccatgaccccggggcagtgcaacatggtggttgagaggctcggtgactacctcgtagagcagggcctgtagatcgatcgatcacatccattgtcgcgcaccgttcccaaatttcaccaacaaattaactcagccaaacgagtcacattactagatccatatgcaatttttctagccaccaccgcgcatgcatgggattaattgtggtttaatttttttttctcatcttcccctgtcaacaccacacattgcagatcacttcctgcagtgccatagtccctctcgtttcttcgtgtcgtttcggctaataattgtgtgtttttttttcttttttgccggtttggtcatttcggctgccgtttgagttgtgaatctggaacaacatatatgtgattgccattgtttcattgcaatacaaagaagacagtatatacattcatccggtctgttggaaaaaaaaacaacgaaaactatatatagttatttcttcagtttttgtttctaattgtatatgcatcactcataagtatataataactaaattaaagctagttttctttgcataaatggggcaaactaaatttgagtaagcatcagattgttttggttcttagagcatctcaagagagactaaaaaagtagcctccaaaaaccaaggattgttacaatccataaaaaaatggggcccaaaacctttaccatctttgcgccctagatgaagaggactagcggcgccctagatgagaagacaagttgatgacggcatgagcgcaatgctgtttggaggtaccaaaaataagagccaggccgacaatggcggaagaggaaaaaaatggtatatgggtggccgaaatgatatgtgattactatgaatgggggcatatcgaggtgccgaaaaagctagatcagattggcaccatttttaggattgggtaaatattgagatgatatttgggtatatctgttcgagacttttttctttttattaaattcctgaaatttacctttagggaacctgtttgggcctctcttgtagatgctccaagagcatatcaccaagagattggctaaattcccccctccccccaaaaaaaataaatctgattttaggaatcctaaatgaaatttgatatctgaaaatagctatccctcgaagagaccggctaaaattgactcccaaaaaccaagaagcggacccatgcaaaacaaccattatataaatcagtttattcctcctcccatgtgacgattgccgacaatgcaagagatgacaagacggtgagcaaagcaaacgcattgtaggctccaagcttgcataaccagacaaacaagtcaatgccttctgacctagctaggccatctcttcatatcattctcggctgataaatgaagaaagaaaaagtcagagcccagagggatcaaggaggtaggagatgtggtcgctggaggattgggacctagaggtggtcgctgttggcagcgatgcggtggaggggacatagatgccaacggtggggttgatctgatggtgacgacagtgggtggtgggttccaagtagcaacaagacggaataattccaggagtggtgttcctcggtaggtggcaaggagggcctgttcctcccggcagcggagcggaggcctgggacaagcacaatcacagcctaggcggcagtgtttatcaagagaagacaaggcggaggaggcgtggggccaagttgtcgacggcgacctgtgaggtaagtctcccgtgtgcgacgatggtgaggatgccaagaaggcttaggtggagaagtgagccgtggagccacatgtggccaaggatgaccttcccaatagcgacattggagatccggtggaggggagttggggaggctggcagtggagacgatttgcgtgggctagctagcatgaggttcgggaaggagacgtcacccaggtctgcatgagtctaatggatgtgggaaagagggtcgacgcggagggatgaggcccctggcccggtggtaggcagatggtaaagatccagatggagggtgatggatctgaccaggtcgaggtagcagtgttggttagtgacgaatcgacatgtgtggaggttgaagaggacagtgatgaagcttgcagttgcaccgattgattttctgactttctgcgggaagatgaagccaatgtcagggcacatcgagctaccggcagctaaggttgccaagaattgccggacgggaaaattttgctcctcatgtaggaacaagctgagaagaccgagagcgcaagattgggagtggaagaggagcccttgcttggcctcatatgttgagagcgaagactataggataggaactccaaaagttaaggagcagagtagagaatctctcggagcagcttttaaattaaaatcctaaaatatcagtattggaaatggaataggggtactggtgatgctcttatgcatgtctagtcattgttcaggtggtttttatattttgtttccaggacctcggtctgactagagaaaactgaaccacactctaggacagggctttttattatggttaaaccttgtggctttctcggaagcactgaaaactaggatggtcttagtaatcgagtagttaaaccatatggtttttctcgaaccacctaaaaacttgggtggtccacccagttaggtgtgacgagggagttgaacactacacgttgtgttgcaatttataaaattattatttttttactggtgatttgatctgtgaaccgttggtggttaactactaatttcaccgttttaatcactataatgacgcaagatgttgatagaggatgttaattcctttcaagtatgtttgttggggccaatacttgtagtcctctcttttcgatttgtttggacacaacagtgtgttggagggatgaacacccttcatggtccatattactatattggcccaagaacaaagccgtgtaaactggttctgggtgttttagaggatgtggaaatgagacggtgtgtgatgttgcttgtttggaggagatcaaagagagaacgatgtcatacgtgtctcacaatgtattatcactacaccagaccgggtgactggtgatgggtccaaaccatcatctcttatagttatgaccctcatcagagatgagtgatcagtgataattctatctcatctctgaaaggtgaagacccgtgagaggtggtcatcacctatgacgggccgtataaaggacccatcagaggtgagtctgaccaccctgacctagtggtattgccacccgtcaagttgattcatttgtgatgggttggttttgacacctgccacaggtcagggtaatcggaaattggtggagtcaataccgctcatcactattgtaattcactggtgaaaaaaaaatcatctgcccttcctagtgaccaactggtggcatcactcacaaaaaatcacatgaaaaattatagtggatatcaatcatcccaatcacacattcacattgcatggactcatcactcacaagtaccaggaaacacaaaaaatcacaagaatcagtggatctcaatcatcacaattactgcttgaatttcttgacaaagagatagtcacagttggaggagacgactgcagcgaggttgatagacaagctgagggaggacagcggtgacatcgtcgacgagctgctggtgacgctgattcatggttgactgcacatggttgcaggcgtgcagtcagttccgcccttacatcctccgcatatactactgtacgtaataacatgttaaaaatcaacacacatatgtgttgatttttaacatgttatggtgattcaacaacataatgggcctttttgtgtgtggggggggattctgagaagcagctggttggtagccagcttctgataatctggaaaagctgggtttcctaccttctggcgtctagttcattttttgaattctacaactacaacttatcataatctggaccaaaagcttgactatttgggggaacttctggttctggcagaagctgcagcaactagaagttccccgaacaggcccaatatgctcattcaaaagttgtgataaggatataagtgacgcatggcacaactcctctttatcacttggagcatcaagcaaattgtcctgtgacaaaggtatttcatcaattatgttataactaccggacatatttaacacatcaaaattgttcataccttgaataagtatagcacatttgtcaatacctttgttctcggtagttgtgggtgtggtatcaattaaaccttattgaaatatgcatgaagcaataggtatttctttttccttattaacttggaggttcttaagtacatgcaaaatgttagtatcgaacaagaggtacaacaaagggtcactcctccaacacattcacatcatcttagcaagtagttatatctatttgaataacaatttgttttcttagtattatcaggcaatgtatcatgtgaaaatgaaactaaactatgtcaccatattaatactaatccaattaatgtactagtcacattcctaattttctattttttcatagacgtggcactatgcaaaaatttgatcatttcttttcccaatcaatgtttccatccttgcaaattttcatcattaccaactccattataataatgaatggaagaaaggatatagctagacctcaacgcagtagatgcgcagtggtacaactctcatctaacttcttcatatcatgcccataagtggtctaacctgccatagttagtagaagacaaaagataattcaaaaatattatcccttatcagctactatattggaaataaagtcacactctctcaagcattttaccatgctcttacaagtgttcttacttacagaacaagagatgtaattggtggctaactgaggcactgtaggatgtgtagtgtgaaaattgctagaggatgtcaatcctgatcaagagtatgcttagcttgaaaggcatatataatagcaaggatgtgctaaatttaataatagagtagcaaagttgaataagtatactatatacttcacaatcactagcagagacacgtccctaaaactagtataagcaagcaagagtaatgaaaaaaggaacttaggatgctactctctcacgaagtctctcaagatgaaacaagaatggcacaaagacttccccttttttctcctttttttatcctctttttgtccctttctttcttctttttttttcttttcttctttctttctttttcttctttgtttttttgattgacacctttctttagttataatagcaaatacttcaaaacaagaaagacccaaagtggattcacaaaagaatcaaagatgatgaaaggccttaaaacaagaaagacccaaagtggattcagaaaagaatgaaagatgatgaaaggccagcaaaaaatgaattctggaacttgtaagggccaaaacaccttgcaaagcaaccttgttgcttcggctagggcaaacatttgatttcacaatctcgaatagcttacgaggaattttgatgtgatacgaaaaccatctgaaagcatacgatcataatcttttgaaaaagtactcatgggtcccaagcaaccatatgcatcaatggctaggtccgtttcatgttgatactgttaggaggaccaaatccgaccgaaacatgttgaatcatatatcttggcttatatagctcaatagttacgttatataaatggagaagacttgggagagtgttggtatttcttaacgacattactagaaatataattcccagcaatgacgcagaaatacttctggtatattatggttatggagttcatccgcaagcgcacggatataccattgtagcatttcacccgagagtattccaagggtatcatatttattttatcccgtgggaagaccatgtagagagaacttaaataataatttatatattacttgtgataatcatattctaagcaggggttaagataatccaagggtagagtgacacacaagcattaactactcattctcataatatattatctaagctaagtggaaagaaaagagaaagataatctattcctatacttctaatatacatagtatacatacattctagttaaccgatatactagctaataccctctttccgatgccctcctggtacttcgagaaaccacccctgactgccgagttccttacgacagcccgtcatgaccatataaccggggctaaatacggaggaataccctccccaaggaattaacttaggattatataccggcgtggaggaatacccgtactgagctgtcaccatcagcggcccacctctcatccgtaatatataaccccaaataatgatatcccgtaatctggacaccacgtctaaactaccagatactactctaatatcatcgtcatgacatagagtaattgcatatgcaaacattatacctgcaccaaagcatctcccagataagctagccgtatattcagtataacatgaacataatgtaaagtaggtactcatatactcgggaagtatttcaataccataaatgtatttagaagaatattctaataaaagtacacagcttataaaagagaagagaaaagctactagagccatacctgaactcttccgaaggcttccggactcctgatttctactatattcctattccaccagctagatactactaaactaaacttgagagaaatgagagagctattgcttgaggtgtgagagtgaagtgagaatgagagctccttttatagcctcccaatgacggttgtgacggttggaatggtcggtaataccctccaaccgtcattggggagccatctcagccgtccaggagaaccctggatcaaacggagctgcggaggttcggccgaaccatgggctaggctaacctggcccaatttcgacaggcagcctcctcttttgttctcatacgcagacttgtgaattttggcccaattcattgtgtcaattctgagttcttggcccattcatacataagtctgattctcgacatcgtccgattgatttatcgtctgagctgatgtcgattctcctccactttattgttattctctgcaaaaggttaatatacctaatagtagtggaatattattattttaacagatatatgcattgcaagcatcactagttctcctctattttagtaatattgatggtcgaaactgatcgataacggccgtcaacagagaggttatggtttggtcctcaattaacttcgtttatcatccatgcattccatgagcctattcttgcatcatcccttgtttaaatatatagtaaataaatcttacatagagaatatgtacctttaatttattaatgtgtaatatagccttggtcatatcatagctagtgatgtactcgtcattggtatgattgttagggtgactatttaatagctatggaaaagtctaatttgccttggggatggtaggaacgttgtaattttttttattatattgttcgaagtactagccaaatagccatgtgtttcaacagattcttgaaaatagcaaaactaagtgtttgttaaaaaaatgtattttaattggttgaaacaagacttttcatattaaaaacaaactaaatgccatgtttagaaaattaaagagctgtagtctacatagtacggactgtagactcacctgaaccctaatgtcagtgatggtattggtggtgacagattcatcacccccactacttttttgtagtatagattagatattgtactcataagtttgtaatgttaggtagtattcatgactaagtagcatattaattgtgacttctacagcatatgtttaacttacatattcaatattgtactcataagtttgtaatgttaggtagtattcatgactaagtagcatattaattgtgacttctacagcatatgtttaacttgcatattcaatatatactagaaaatcagtgtgccggctggcatgtcgacaaattgaccgcatatatggctatatattaatttgcacaaaattcgtattataagattagagattgactgcatatatggaaattttacgtggagatgagtgaagacgtgcaccaacgattaatttacacataatttgtgttataatattattaaaggttgaccgcatatatggctggttgtggtaaatctggattctttctgatttctctagaatcgtccagtgatatttcatattttgcacggcctgttaattttgcagttgtccatgggcccatttattttttttagcaaaagtcacaccaacgcaagcgcgaggcaggagctttttccagtgaaaccagttgagccacgtggcacgagcagctgcgagagtttttgcacaaatttcgatattagagattcgttgtaaaagtatcacgtagcaatgttttttaaaaaaatgtcatacatagactgcacaaaattaaactttatgttcattgcatacataaggataaaatggactttttcagtatcttttaaatataatggtcaactgacagaatgggcagaagacatcaaaattaaaaattaaagggtaatactaattttagcaaaattagcataaaaacataagggattttagcggcgtcaaaggaattttctcatgttaattacatttgttgttacatttccaaactccaatggaaatcgaaatgaccacgtcagaaagaaatacaaaaagttattagccaaaaacggcatgaagaaatgggatcaaacaaaatatggcagaacgtacaagaggtgatccagaacatgcttgcggaggtggacaaggaaagaggagaggaaaattaaaccacaatccccatgcatgcatgcacggtggctagaaaaatgcatagcatagagatctactatgtgctgtgtgtgtctctcattcgtctccgtttaatttgttgctgacgaattgaactgtggcaacgacgacgatgatggcgacggtgatctacaggccctgctctacgaggtagtcgccgagcctctcgaccaccatgttgcactgccctggggtcatcggctcgtcgtagatgccgaccaccagcgcctgcccggtcttcttcaccgtgatgcctcctgatccctgcaaatccaaccattgcaacaagaacccatggtttacatatgacaagaaattgcaaaatcaatcaaggttagagataatgagaaacagcaaaccatggttagaaatcagatacgatgcgtaccttcttgccacgaatgacagcgccaggttcaccttggatgaccatgtacttggttggtccaagaaacagtccggtcggggcgaggaaccccggctcgtcgaagtccttcatgatgttggtcatctcctccggtttgaactgcacaggcacagacgaattcacaacgatggccggtgatcgatcacgcaagaacaagaacaacagaggccggcggcgatcaaggaattggtggttttgttacctgcgggaaggcggcgctctgtgcccagacggtgccgtcgtggccgacgatggcggcggaggtgaggtggtggccctcgatctcgcacatcaggtgctcgtcgacgtacgtctgccacgacatcttcgccgccgcctcctgctgcccaacgaacgactcgtcctcctctcctgcggctgcaaagatacgggctcgatcaggtggtttctttctcctcgtcgggtgttcgtcgcggtggtgaggcgcatggtgggtggatggtttgattaaatagaggagagtggtgaggaggtggagggagtggttccccgctacttcgtcccaaccacacgttccttctttcgcttgcccttcaacttcgcctcctttgttgggctgctcgcaatagctaatggtcgtcccaattttccttctgcccctggattgttggcccagactagagatcaatagatctagtatctctgtgaatataatagtaatatttagctatgtatttggacatacttcaaagtttctatttttttagaacagaggtagtagttttttgtttcggtaaatctaattggagaggcctctccaattagtattaaccagagacacccacgtgctagtactttaggagttttggttgctattaatctattgaacaagtacggaaaatattcctatcatctatgcttcaaaaaaaaatttctcttaaattactcatccgatttagaatccgattacaccgttgtgttcgtaataattaaatctttacaacaagatctcacatgattatattttgatgaaaaatcacaaattacttttatgatatgtctaaattacttttagatttcactaagttacttcttagacatataaaagtaaattcagtaaaggctaaaagtaatttacatatattatagaagtaacttataacaaaaagaaagtaactttaattaatgttttttttcattgaacaaattatcatatatatatatatatatatatatatatatatatatatataagttacttttagatttgataaaaatacatcctatacattcataatgctctgaggtgattacttttattattattttagttaatttcataatttgtgctgattaatttaatttctagatagagtcatgttcttatctccacaacggatttacttcaaatgacatgctaaagttaccttcgttttgttctaagttacttctataatatatataaattacttataggttttattgaatttacttttatatatctaagaagtaacttagtgaaatctaaaagtaatttagacatatcataaaagtaatttgtgatttttcatcaaaatataatcatgtgagatcttgttgtaaagatttaattgttacgaacacaacggtgtaatcggatcgtagatcggatgagtagtttaagagaaaaatgtatttgaagtataagtggatgatgcctcttatagatgaagtggtagctagtttagacaaactagctaccactagctgtgtagttacgtcctttttgtttatatgctttgtaagagctctcatatcacttccacccatggttttcaatttctattcggaactgtggaaattttagtaattttgcaccccacaagcaaccaaatttctcacccaaaatttcctcttttttccaaatttagttaaaatttattcgaattcagtcaaaattgttaaattttcaagtaatttcgggaaaaaagtttcaaaattcccaaaattattggaaatttcggtgcaaccgaaatttccggtgccgaaattgaaaaccctgctttcacctcatgttcttctcttttctttcacttcctaagtgttttttttattttgatttgccaaatatggtgccatgtcattgaatagcagtcttgttcaagaccaggaatgaaatgtgaatggtactgaaagttgatagaacaatagtcactactggttttatatatagttgaggggaaaatcagaccaaatgtgcgcctttttcttgtagcatcaaaatgtatctattttattattacaatctgtgtttattcagtttttggtgcaagaatattatgaattatgtacaacaagtccatgcatgatatctctttatacaatcaatgaatacatgaatggtcactgctcggtatgcaatcctgcgtgtataaatcacaactaggtagtagtagggtagcaatgatcaaggcatcttgatatataggcgactcaatttgatcaagaggaggatgccaagagattcttgaaccactgcactgaattctttgggtatctcttccggttcttgtagtctacgtagtataatccgaatctcgaggtgtatccagcggcccactcccagttgtcaagaagagaccatgcaaaatacccgcgaacatcacaaccatcctccctgcataataaagttattagagtgtcaaccataacagggaaaattagtcctcgactcataaccgaaagttcaattgtgtcattgtttaagcaccttatggagtctgctaagtttgtaagatagtcattgtggtatttggtcctcttgtcgtccttgagggcattcttcagagagatgaaggggctgttgccatcatccattcctgaggcaaaagaagggaatctattatattacttgagtttttgttcttgcgaggaaacttcaatgaaaattttattcgaaagattatactttgttatgttaaacttgaagcaatttttatgtttgacattttttattactgtagtatttgttttaagcatacaggaacaaatcacaaataacgtaagtacacttgccattctctgttatgtagacagttggtttgttgtatctgtccttgacatagttcatcaagatcctcatgctacgaggcacgatgtacaaccatatcgagttggcctgcatggcgaatcaacagtcatatgctcagtcagttcagaaaccaagttcagttttacaaatcaaggttttcaaatcttgcagtaaattaacaacaaaagaaaaaaatattaatgtcaattttattttcacatgagaaggatgtaatgttgcagaattaattaccctatccccaattggctgtccatttctgaaggctgaaaaatgcaggcatgagaaatgaattagtcatgagctagctaatttttcaaatttaatcatccaaacttgcaaaaagaacacaatgggcgactagttttctcatagcacaagcaatctgagaagtagttagcccagttgtgtgctttgtgctttttatcatttagttctcttattattcagaaaacagtgtgaatgaaaagtggaacttacggacactgatggttgcagtatctgccaaggtgttgttcagcaatttttctattacagtagattggtcatcctttgtgtagaatgtggtatagtgattgatccccatgaagtccagtgatccgttcacaagtgcagcctctttctccgtgaacttcggtagcctgcttcccactctcgatctcatcgttgccggataatctccgaagaagaagggatccgcaaaccttccataccaaattgagcatttcatcaatggtggttctatcaaaattcagtacagggttgagtacaaaggaaaaactacagtagttacagaacagagtgcaatggttctgtccattttgtcacagtagtggtactgaatgtctcacagctgtggaatttgcaagaaaatatgaagcttgtgagttgtgaaccttaccatcctagctggaattcctgtgctctcttggcggcttcaatgtcagctgtggaatttgacattggttcgtaccatataacatcaaaagatatccccagctccccattctgacttgcctgaaaaacatgaaagctaggcctttgcatcattgtgttacctaattacgtactgaacactgaaaatgatctatggacaaatcttcatgcaggattgacttgagaaagcattgcaatatcaaagcagcacatacatatgcttacagttacagaagcctgaactatatgcagaagaattgttcacctaccttgtatttcttcctgtatatgtctgaaaccgtggcatgtgagaggatcatgttatgagcaactatgtagggctcggtgcctgaattccctttcttgcagtagaggtgcaggagcaccgagcaccggcccggtgcatgcatcccgctgtcataggcctgcaccgcgacggtgtggggctcgttgaaggtgatccagtgcttcaccctgtccccaaatgcctggaagcacgtctcagcatataccgcataatcattgctgcaacaagatcatggtacttctgttacagatcgaatagccattgtaactgcatgagaagtttgcaatgcttacatgatctgcctgtcaagccacccagtgtacttgtcctccaaagcttgtggaaggtcccagtgatagagcgttacatatggttcaattcctaggggagatgttcaacttgtcagtaaaatttaagaaaactttagattcagtagtgaattaaacctatgttttaataagtagttagctcaaacatttcaatttgtaggttttggggagtcaattttagtgtccacctttagctagtaatgcgttgattagcttgttgtagtgatcaatgcctgcctggttgacctcaccagtgccatctgaataagagtgcagatatgattattgttagtagtgcaggtctgtttatccacagataaaacatttcataatgaagaaaaacttcaaaggttatgtgtgaccattaagttaacataaagatgcaaattaatgaagagatccaagtggaaatacccatattaaccaatgaattattatattacatacttgggaaaatcctagaccatgaaattgagaatctatatgcatccatccccatgtctgccataagctgaatatcttcctgaaatattgatatgacaagcacagtaatctcaaaatttgaactcgatcaaaaaaaatagatagatatactttcactttctgtgttagagtgtagtgtccaattgtctacctcgaaacggtggtactgatccactgcaacatcagcattgctgaagtcaatgatctttcctgaaaataagtaaggcaaatatttgcttataatattgaaccatgggtgattaattttcatgatcaaaggtcaactcttaatgatttctttgttattccatatgttcgaccaagtcaatagtcaaagctatttactatatggtttcacacatgcccagaatgtacgaatcaggaacactgagattaagtgtaatgacaaagaaaaatatctaatctgtggtagcataattgcatacaggttttgaatatctgacctataaattatacaacatgagagtcgagagatgcttgttccatacgtgaagcaggcataactattgatagtaacagtagtactaagatagtagaagaaacaaggtaaggcaaggatagccagatatatatcaagaatccataggcatcttgagtcgtataccactacatatattacgtatgtttctcgaccagaattacaaacctaaaaatataattactgaatctttatcctgcttgacttggccctgaggaaactagagatgattaaatactgattacagtgattgggaaaaaagataccaaatgtatgtgcgaatttgtcccaaatggttggcccccttccgtcctccttgacagcaccttcatactgcaggaaaaatagataaatatgaaacaaatattttttttgcgtgaatatgaaacaaatattaatcatcttaatagtcaaattgaaacgtggatattactgaattcaactgttttacttatttatgatcagtactttgtgtagccaaaataagcattctagcgagcggtgccaatcgattggtgtaatagatatacacttgaa

SEQ ID NO: 63121 - DNA, 12195 bp, Oryza sativa
ggtgaccgatctatcccaatcacttgatttaagtatatattgacataaagattatataatgttaatatctacagccgattgaacatatttagttctttattatttacctataactgccgatcgatgcatatatgacatcggctcaaagataaacgatatgtcatcggcacttagccgatcggctatcgtttatggatttaaacacagtttctttgcctttacttcttgttgattgatcaaatcaactggcacgcttgtatacccgaaggcgagttttggacctgcactggagttaagcagatcttccaggcctcgtgttttccatcaacaccgaccacccatacgcccccatggcaacaacgaggacgaggacagcggcgacggcgacaacgacgaccggcggcttcgagaaatgacgtcgacgaggagagtggcgacggctttggatgcagatgacgtaaacacctgcaagcgaaaatccactcacaaaaataacgattttcgcagaccatttggtgcatgcaagtcgttccaccgcatgcgataactggatttgatcatatggaaaaatgcatttcgtagcagtgactggcagcaatatggtgttctgtagtaatgaaggcttcgttacaattggcagtttaattcattttgctcgtggtaggtcatgcaactgtggaagttgaagttgcagtcgatatacctgatcgagatgtacagcataacgaaatgcacggcgctataccatacaagtctttctgttcttcttttcttattctacaatggcgaaagatgagatgggttaattagcgaacaactccatctctttctttaagcaagttagaatggccacgttgcatctagacttagtatgagcgcagtacgaaatagcagtggggtctgagcaaactagatagaggtacagtctcccttccatctacatatgataaaaaattttagtgggatcttcgtgggggctctcatagtcttcacgccagtagtaggggctcgagaccctgccgccccaagctggatccgcccctgtatgagcgggtcttttttaattttcttctcctgcaaaggagaaagaaagatgggatgggatggctgttaattaagtcaacagatctggtcctttattaaagtaggctagaatggcacccttgcatctaattaagcaagtttgcaacaaagtaaaggtcaacgatacttaatgttattgtaaactaaaaacttagtatatgccagtaattatttgtatacagctgtgtagagctttgcaggattctaattttgtggtaactgggcaatgtagttgatctaaccgttatcattcaattgggaacatatcatatgcacatttggcttggcatgtatatgtgtgaatgacgaatttcgtgtcaactagcctgcttcacttgccatcgatctgtgggtacatctattatctttcttcccgcttgtgatgcagatcgggctggacttcatcaccacacgtctccttgccattgtgcgcctcccgctcactgtcgcgcagggtttacattaccgtcggtaaccgcgcggttactgcggttaccggtcttaccgtggggcacggtaatagaaaaaaccacggttaacctccgtaaatttaaataaatttaaaaaataatttgaatttttgataaattttgtatggtttcgtacggtttttcacagttaccgcgtggtaaccgtgcttactgccggtgcacggtaaccccggccccggcggcttcgctgtcacgtcaacgaagctaccgccgtcgtcgtctaacgcaactgttgtcaatgccacatcccatgtaccccgctctacactgccgctgcgatcaccatgtgcctcctcgttgtcgtggcctcccgctcgttgtcgccccaacgaggttgctgtcgttgtctaccgccgtcgtcgtcagggccacatcccgcgcctctccctcgactccaccaccgcgcctccgcgcgcctcttcgccaacacggccttcttcgcctccgcccctacgcggcctccaccgcctctgccccacgcggatttggccattggcatggatttggggggccaccgctgcctccgcctccgcctccatcggcgttgaggaagcccgtggcgacaacagggttgggtgtggacatgaggcggcgagctcgagcgccaccatgcccatctgccccacctcgagctcgaggatgggaatgggctcgaggagcagtgggagaagaggaagaggggagaaaggggaggaaagaaaagggttgtagagactaacatacgggtcccagtgtcatacttagagtatagagtttagcaatgagtttagcttgccaaatcaatttcatagctggctatatagatgtttggagtgtttgatttgggtagtctgttgaagatgctctaattactataagaaatgataggtacgtttcacttacgtcacaaaaactgaaatttacgtcatgacttgaaatttgtgatgttcgtatgatgaaaattcatttgtcacctattatgcgtctctaatcaagttttatgacaaaaactttttttggcattaatctagtaacgatccttctatcatcattgagtctatgacacccatttctatcattattgagcctagaaatcgtctgaactcactaaactttgatgagtagatgccacgtcagatagaaaacgtcataaaaattttagcacaccatgatatggagctgacatggcatatttttttgtcaatttattttgtcacaaaatttcttgtggcctgcgaagtcccatacaatgatcaatttatgggtcatgcccagttacaggcccgatttaggtttttaatccaatatttagcttatatgttttatactccaaggccctctttgtttaggcttagatttttttatttaggttttcaatctaatattttggcttatacttcctccgtttcatattataagactttctagcattgcccacattcatatataggttaatgaatctagacatataagtgtgcctagattcattaacatctatatcaatataggcaatgctagaaagtcttataacctaaaacggatgtagtatgttttataagccggtggctttgagccatatctccatctaacataaggaaaaaaagctacatgaagctttttttttttttgcttaataatgtaagaatggcttatatgtctttgaaaaaacaaaaaaaaaaaactagtcgtttgtttaggtggagttttgactcaaactttcttataagcctagaaagccgaaataacaatgcaattgatctagtaactgtttctcggattaattagtgattatcataatgatttattgactaacgtggcttaacgagacttcctgtttcatttgtaaatagtaatatatatctaggtgaaacagatatgtaacgaggggaggtgcctcttactgtcctacctcatcatatcataattagaaagacttagaaagtctaggtctttttactattaattgatctgttttcggtaggtagaattaacaaaagggatgagaattaactatatttcaacagccccggacctttatttaagcaggccagccagaacgaacaccgtgcatctaataaccagattacatcgagtcagtgactccagcgttgtcaatatatatggagcttttgcttcttgtgtttcttcttctggcggctatgtcagccgccgtggagagcatcacgagcacggcggtgaaaacggggtgccaggagcgctgcggcggcgtggacatcccctaccctttcggcatcgggcccggatgctcccgccacggcttcgagctctcgtgtgtcagcaacggcagcggcgccggcccgatcgcggtgctcgccggcacgtcgatccaggtgacgcgcctgtccgtcgagccggccgagtcgcaggtgatgctccccgtggggtggcagtgctacaacacctcgcagccgaccaggacataccccgactggagccgcgcgaagacggagatgaaccgcggcggagtgtaccgcatctccaacacccacaacatgctggtcgtgctcggctgcaacaccgtcggctacactgagagcttgaggagcgagggaggcgcctactccagcacatactacatcggctgcatgtcctactgcaacaactcggcgagcgcgcaggacggccagtgcgccggcgtcggctgctgccacgtcgacatcccaccggggctcaccgacagctccgtcaacttccgggtgtacgaccacaccggtatggtggactacagcccctgtgactacgccttcctcaccgaccggaccaactacagcttccggcgagccgacctcatcaagatggacaagaaccggaacgttccggtgtggcttgactgggcgatccgcgagaacggctccatgtcctgcgctgaggccaagggcaagccagggtacgcctgtgtcagcgtccacagcgagtgcgtcgactctactaatggtccgggttacaactgcaagtgtaccgcaggctacgagggaaacgcctatgctcctgatggatgtactagtaagtaacaatttccttctatcagtacatttgttacataccatttacctccctccatcccattttagatacagttatgggttttttgtgttcaaattttaaccatccgtcttattcgtcttatttaaaaaatttatgtaaaaatttaaaaaaagtcacacataaacacataaaatactattcgtgttttatcatctaataacaataaacatactaatcataaaataaatttcaaataagatggacagtcaaatgttagacatatgtcacgcccggaatttctatccaaaattccaaacgcttacatgtgtgtgaaccctcgtccaggaatcagccgaggcacacaataacaaattgataatagagtgcagttattactctaattaataagcgaataaaatgtcattacagaggtagatagttcctctcaatcaataaagatctaagcagcggaaagataagataaacggcgcagacgactccactccacaggcagcttgaccagggctacacctaatcctccacaccatcagcatcactgtagaactcttcctctgatgaatgattgcaaggtgagtatatgacatactcagcaagtcacgcagcaaatatgcaagtgcacaggatcacaaaggatggcataatagggtttcatttgtataaacagcatttaataaacatttcagaatttaataaaacagttaagtaataattaatcaatattaatccaacgctatacaacataccctgttgtataggcccaaccattctgaacaaccatacccggctatacagatctatctccaaaccaggaatataccattccaaaccaggagctaaacaaattattaccatttatagcatctattatcatgatgagaggtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacagtacccctcgcacaacacaatccaccgcagcgcaccattcctggatcataatcacccccttataaacaaggcatggactccccagcgacccccgtgggcttatctccgccacttctcagtctggtgccccgcaatgaaccatgctatacaaaaggtaaagccgttgcccacgctggcttgtggttggcacgattaatgtttcacaaccgaaactcgtgaaccggtccttaattgtcatgagcacgactctcaaaaccatgtgctcacaacccaccattatcaagttttagttggcaaataattaattaaccaatcacgattgaccatcgtgagctatcattaagccatcattaaataatagtgagtcataagttatcccaatagtgtgctattgtttctaagcatggctaagcaatcacatctaatatctagctgaaccaatatatataaagctcaactagtcaagttataataacccaaggtatcaaggaataaagtaatcaagaacaaaaggctataacaaacaataggttgattccacccaatgacattcgaaaataaatgcaatatttgaatagaaacaatagctttaaatgggatcaacatgcttaaagggttgtttgggatctgtgtgacttgccttgctggccttggaactcttcaaattcttctcctgcgaaaacggactctccgaaaacgtcggaatctaaacagaaaagagcaaaaacaccaaaacagcacataaacaagcatgaacagaacatgtggatatttttatcatgtagatctcaattttagaaaaatttagagacttgaaccaactaaatccgagctaagatgaattagttatgaatttttaaagattaaatcggattaaaacacttatatggattttaatagaattatgacgcaataatgaattatttttgaaaaggaaaaggaaattattgcgtcagcggctagggtttgcggtggaccgggcgcacggcagcggttcacgggaacgaacggccgagatcgatccatccaaaacggacggccgagatcgatcgggtctacggcggctcacggcagacggaccctgatgacgtcagcggtgacgtcaccaccggcggcggctcgggcttgcacactcgccggcgaacgacggcgcttcggcacgaacagagggcaccaggacgtagagcgcgacgcggcgaactcaccgatgaccaaaacgtcggcggaagatcaacggacggcgacggcgacgaggaagaagcgacggcggtcttcggcttgacgacgacggcggtgctccggcgatctacagcggcagcgaaggggcggacgaggacggcggtgacttggcgaccacgatggcaacctccccgagcgacgacgacgaccggaactcaaatctccttcttcttcaaaactcaaatctctgcggcgattgtcggcataattcttatgacgagactgagccactcgcaatctttcttgaatgatctttaccttttcttctgcttcccttaggatatccgtcccgaaaacttgacgttctcccgtttgatcccacaaaagcggagtgcggcacttccgaccatacagtgcttcgtaagaagccatctgaagactagcttgataactgttgttgtacgaaaattctgcataaggtagattcttatcccaacttccaccgaagtctaaagcacaagctctcaacatgtcttccaaaatctgatttaccctttcggtttgtccgtctgtctgcagatgataagcagtactaaagttcagcttagaacccatctcttcctgaagcttcttccaaaaatttgaagtaaactgactacctcgatcagacactattttcttagggacgccatgcaaacacacaatccttgccatatacaattccgccaaccgacttccagaataagttgtctttactgggatgaaatgagccactttggtaagtctgtcgactatcacccaaatagagtcatggcctgatgacgttctgggtagaccagtgatgaaatccattccgatttcctcccatttccattcaggaatcttcaaaggctgcagcaaacctacgggtttctgatgttctgccttgactcgctgacaaacatcacatactgctacgtattctgcgatttcacgcttcatacttgcccaccaaaatctttccttgagatcctggtacatcttggtactaccagggtgaatggagtataaagtatcatgagcttctttcagaattgcatcttttaaatctttgttgtcggggacgcagattctctcacccaaccatacagttccttgctcatcttccaagaaaccgatagcttttcctcttcttatattcttcttgatttcttgaatatcaggatcattaatttgggcttctctaacttgatcaattagagtgggcttcgcttctaaggctgcaacaaaacctctactgacaattcccaaatttaatctttcaaattccttgcataattccaatggtaactgtcgtccttccgtagcattgcaatagcctttcctgctaagagcatctgctacaacattagcctttcccgggtgataatgaattcccatgtcataatccttaattaattccaaccatctcctttgtctcatgttcagatccggctgagtaaagatatattttaaactcttgtgatcggtgtacacctctgtacgagtaccgaaaagataatgacgccaaatcttcaacgcatgaaccactgcagctaattcaagatcatgagtagggtagttcttctcatgcggacgtaactgatgagatgcgtaggcaaccaccttcccatcttgcatcagaacacatcctaacccaagcttagatgcatcgcaatacacttggaaacccttctttggatcaggcaaaatcaagatgggtgctgatattaagcgacttttcaactcttgaaaactctgctcacattcttctgaccacttgtactttacatctttctgaagcagtcgtgtcatgggcttagcaatcttggagaaattctctataaatctccgataataacctgtgaggcctaggaaactgcggatctctgaaactgtctttggttgtttccagttggttacggattccacattactaggatcaacggcaactcctcctgctgagatgacgtgaccaaggaacttcacttcagacaaccaaaattcacacttgctaaacttagtatacagttgatgttctcgtagcttctctagtgcaagacgaagatgttcttcatgctcttctttggttcgggagtagataagaatgtcatcaataaagaccaccacaaacttgtctaggtattccataaacaccttattcatcaagttcatgaagaaagcgggggcattggtaagtccaaaagacataacagtacattcaaacaacccatacctagtggtaaaagctgttttaggtatatcttcctctttgattctcaactggtgataccctgatcgaagatctatcttggagaaaacagtggcacttttaagctgatcaaacaaatcatcaattctgggtagcgggtacttattcttgatagtcacatcatttagtgcacgatagtccacacacatcctctggatatgatctttcttttccacaaaaataactggagctccccatggagatgaactcggtctgatgtatcctttctgaagcaaatcgtccacttgcctcttgacttctgccaactcattggctgccattctataaggtctcttatggatcggagttattcctggtaccaaatctattctgaactctatatcccttttaggcggcataccaggtaaatcgtctgggaacacatcacgatactcccggactacaggaatctcttccaaagttatttggttcagtcttgaccttaaagactcggaagacgatgcatgaacagttacaactcgaccatcattactagtgagagttacttttctgttagcacagtttatcacacctttatatctggctaaccagtccatccctaggatgacatcaaggtctttggattctaacaagataagattggccagaaatggtactccttgaatttctattctgacggaggggctacgtcgcaaagagagtacttgattacttggggtactaaccatcaaaggacgtctaagatcttctacttccatcccatgatttcccgcaaaactcatagataagaatgaatgtgtagcaccagaatcgaaaagcactgttgcaggaactgagttaacaagaaacgtacccaaaatcacatctggagcaccttgagcttctgcagcagcaacatgattgacatgggcctttgatgctggtacggtagagttgctctgggtagggacaaccttcacgcgtcggggcttcggacacttgtcagcgtaatgtcctgggtctccacagttgaaacacaccatgggcttgctgccttgctccttcttggcaggttgttgctgtgtcgaagctgcaacatggcgtggagcttgattgcggatgttgttgcccgcattgttgttgaagaactgacgttgcggacgaacaacagacgaagaacctccctgtggcatggactggggtcctaaagtaagacgcggcctttgactattcccctgttgtgccttgaattgagcaatccggcgtttcttctgctccatgcggttgtacttgtcctcttgacgaatagccttatccactaacttctggaaatcatgataatccccagtcatgagtgagtaagaaagctcatcattaagtccttccaagaacttctcctggcgctcttcatcagtgcgtacatcttccggagcataacgagccaaacgattgaactcgtgcagatactccgtaacagagcgagacctctgggtgagcgacctgaattccttcttcttgagagacaccactcccgatggtatatgcgtcttccggaaagcagcggtgaactcaagccaagtgataggttcagcagtagtcctattcaggcggaagtgatcccaccattcagaggcagggccatgcagctggtgtgatgcaaatgagaccttctcctgatcagtgcattgaagcaaatccaacttcttctctatggcatgcagccaatcaccagcttcaacaggattagtggtgctagaaaaagtaggcggcctcacacgaagaaattctgctaacttgttctggggaggtgcatggttatttccctggttctgctggttctggagttgctgcatcatcatgttcatgagctgtgcctgttgagccagaacttgggcaagtgtaggattctctccattgttgttgttattgttgttgttgttggggccattcccgttgctgtgagtgagcaccatctggcatggacaggacacaagaagagaaaccggggaaaactacttaggacagggaattaatttttcttttattgatcttaagtgagtttcattattacaaaactgaagactctcacaccactgaactcaccaactacctaacactcgaaagcaaacaaacacatgcacttacatcccaccactgatgtaaatcacatgcgagacacacacaaacaaacttaaacaaacaaactaacacaacgatctaagacaacgacttgacaaggcattttagttcttccgggcatcggagttgattgaaggctcgttcggctcgtcttcatcatcttgagtagctccccactcaatcttggaatgagtgtgcttggattcttcttcttcatcatcacttacattgacgactgggggatccgctggggctggggtaacttctttttccaccacacggacctttggcgccaattggtagcgagggacaaatagagctctcttccttgcggtaagacgaattctggccttctgcggtggtgcttctcccttcaatgcggctagttccttctccaaacgatccaccttgtcctctaacttgcaaatcttaccacgattccggtcttcacgatcttgagctgctaacacagtctccgcacgggtttcatccatagcccacagcatctcaaccaaatgccttgtggtagcatcgatctcaattccttcagtctcaaggtagctgccacggtcacttccctggggttggcgaggatggtagcgatactcagtgtcggccaactgatcactgtagcgatcgtgaagctctcctatggcgatccttgccacctcctgacatgtatggatgtagcttcttcctccagcttcgaacatcactgaggggatatcttcactattactgttcaaggtgactttgacacggcacttctcttcatgacgatcatgaggaatctgggcataaaaaggggcagtcccaaatcctttgacaaaggacatcgtacgcaactcctggacaaatccctcaactccaaacaagtactcaggcttgtagcgcggcatctaaagacaagtgaaaggagggagttaagacacttatccaattaatagcacaagtttttagattaatttgaataaagttagaaaatcaaagaaaaaggtaggtaaataaagtaaac

SEQ ID NO: 63122 - DNA, 5228 bp, Oryza sativa
ccggtttcgatactgcctttttagtttaactatatttacgttgtttctataaagatgaggcatacattatatctggttttacgcctaggcgatacaattaaaattaactcaactacttatgtacgacccaaacccaacacccacctgcgtgggctaccgggtggcgaaaaccctagccaccacttgcccaaaacacccccacccctggcctcgccgccaccagagctagccatcagcaagtcgtgtggcaactgacaagctaggaaggcggtggcgttggagcaacaccctagggcggcaatggccagtgcggcgcggtcggcgatgcgcgacaggccatgcgtggcaggaggcttgcgggaagtcgacacggtggtaggaatagtgcagcgcgggcgacggccaaccacagttggttggcgtggcacagttgatggtggcttctattttcaacaggcgacctcgacacatagggtagatagatatgggcgagagccgagcctcttcaggtcagcaatggcgacgcttgtagccgcggctttcccctcgaggtattgttgagtgatcttccctgccttacctgatggatttctttaggtgaaaactatgttgtaactacccagggagggcaatggtgtcactttcggtgctatatccttcctgaaggcgccgtttagaagattcattcccttaggcatatcgtgttcatgtttcttcaatagcgggatctagttataggcgcacgttgtgattgttttttttccctggctatagcttcctaaaaccgtagacttgtaaaatttttattgttgtatcaaatgttgtactgtcatgtgtgggttgtttaaaaaaaacgactaggtgagagaggaagtaccaaggtaaacaagagttcgtcgacccgctggcatgggcctgacaaagtaaccgacgaacgatggcaaggagcccaaattaggcctacaattcttgggccgatccataacctggacttagctttctaatttaatccagcacgacttgatcattcaccatcatcatgttaagggtcgtccattgtttgcccctgagctgagaagttcagaaatgaaaaagggaaatgtaggttggttgtgagatgatgagttcttcagacctttgttgggggtgaattcgcaggacagtagcagcactccttgctgaaaccttaggttgcagctttatcgaagcagacaactatcattctcagggcaagtgtgtgctgaattccctgacaacagcaaagatgagcaaggaccaagggcatccactgtgtgctgaataaatcatgccaaaaaccttatttataagccacagacaagtgcagccgccaagctagctcaccttcctcctcaccaccaagaacgcaagaacacagcaagagaggaggagattcaagaaccggaggaattgatgtcatcttcggctgtgattccgccgccgtcgccggagaggagggtgccgatggtggccgacaacggaggtggaggacatggggcgagatggtggcgtccgtctccatccactacttcatccgccacatgtgccgccacgccgccgcccggggctcgtcggccttctccgccgcgtcgtcggcgtcttcctctgttgcgccggtgcttcccgtcgtggtgcgtcccacgtcggcggggccgtgagggagcaggtggagaaggcgtcggcggagcacgcggcggagatggagcggctcaatctcggagctgccgctcttcacgctggtggtgctcccgaagtcgtcccgcgcccgctgccgccatcccctgcttctccgcgccgtcttcggcgaggaaggcgactgccgccgtcgaacagaggggtaaagatggaaacggtttttctgattgtattgcagcgtcaaacatttctagggtgagtttgagggatcagggatcgagaagattgaaaagatacgcaaaacgaggtgagccattagcacatgattaattgagtataaaccattttaaatttcaaaaatagattaatataattttttaaagtaactttcctatagaatttttttgccaaaaacacgtcgtttagtagtttgggaagcgcgtgcgcggactacgatgtgctctctcaccctaactcactagaacgaacactcctttagactccttttaaaatgaactgcaacgtcaaatattacacgatgaagggagtattatacaccgacgaaatgatttttgcgttcactaggcatggacggtcggctcaaagacaaacaagtttcttgagactgtgagagaccgcatgagaaaacataagacagacaagaattgaacaactgaacatgtacaaagactatatgttggtgcctacacacgattattcaactgataggatgcactagtcattaacaacaccaacacattagctactactgtactctcatcacaacaccacgtactatcaggtttacagaaccgtatgattatctgcgcaattttcgaaaccaaagatatatctcgtggtaactatacggttttcacggtaaccactggattactacaataaccgttaaaccgtggggtgacaataatcccacccaaaacagttgggagaaccctaagtcctacacgacaattgattcaaaccaaacaagtatacaacaccaacacattagctactactagtctactactgtactctcatcccagaaccatcacaaaaccacgtactaccatgtttacagaaaccatatgattatcacacgattattatacttttcgaaaccacgatatatctcacggtaaccacatagttaccgtgataaccacccaaccataagtgacgttaatcccacctaacacggttatttggggaaccctgcgtactacacgacgattgattcaaaccaaacaagtatacaaagttacaaaccccgattagcgcacgcgattttaatcacatcacaacaaaatataatccccaagtgcttaatcagctgaagagcttcttgacggcctggaacctagcggtcttgtcgccgaacttggtgccctggtagtagtccaggtagtcgccgtacctgtacggcccggggtacggcgccgccgccgtcgccggcgcgatcacggcgtcgggcccggggttgtagaacgtggcgacggacaggcggcggccctcggcgccggcggcgacgcggtgcacgacgctcttgtaggcgccgccgctgagcacctccacctggtcgccgatgttgacgaacagccggccgcgccgggtcgggccgacggggacccactcgcggccgccgcggtggaactcgagcccgccgacggcgtcgtcctggaggagcaggatgatgccgccggcgtcggtgtgggcgcggaggccccagacgaggtccgggcgcgggcacggtgggtacatggcgaacttggtgccgacgaacggcggcgcgaaggcgtccacgacgccggcggcgccggcgaggcccaggttggtgctgatgcagccggcgagcagctcggcgagggacaccgcctgcgcgatgtacgcgtccagggactccctcgccgccggcgggatgtccgggaagtcggcggcggtgttcttggggcggtgctggatgaagtaggtggcctcccagtcggcctggtcggcgaggtcgccgccgtcgacgaggacgtcgccgtcgtccttgttcaggtggaggttcttggcgaggtcggaggcgtagaatttcttctccaggtgctcgtcgtaatggcggtacacgaagctcttcacctcctccattaacgccgcctccacgccatggttttccacctgcattcgtagcgagcatttcaccgaagcagaattaattttgcgacagccaacatagaggtacacatttgtcagttttcacatttgaagaatcaaaatctgaccaacagttttttttaaaaaaaatataatctaattatttagcatcaaagttgtactactacatttataatttcaagtactttgctaacatgttacatttagacctgttcgattttgcattgctaaaaaaacagtggtgctcaaaactgttccactctcaaataatctctgaagtgttgtcacgtacccagaagaagccccagtccttacaggcctcgtggagctgggccatggtgcgctccctttcttcgtcgccgccggcgagccccttgagatcaatcactggaatctccatctctcccaaggttgggtagctacttctacttgtacgtacaactgtctagtagtactgtactagtgctgatgatgagctaacttgtatgcactaggaagatgatttgcttccgatgagcgagtggctatgtggcatgcagctgggctcctatttataggagacaatcaaccattctgccatgccggatagtatagaagatttctactaatatttttattcatcctgaaaatatagtaatcagtattaaacgagacacattcgtaatattataaatttgaatagaattttatctagatttatagaaacaaagctgaatagaagtttatccagattcgtaggattatccaattttagattactatattaatctaaaatttttttagattatccaattttactgtagtactccctcagtctggaaaaaaattaatctatgacgatgcatgtgatcccttctaatacaataattctaaataacttttatttgtctttgttgtattaggaggggtcggtcacatcccctcctagggcctgttcggctgcccgcgctgcggctgcgccggcacaaacagtgcttcacacactgtgcgcagccacagccgcagcaatttgcctgccgaacaggcccctagttgaagtatttttgagacggagattcgttgtactatggatcatatctcgtatctgggggtgtaaagttttggcgtgtcaaattgggtattatatagggcgtcgcatggggtgttcgggcactaataaaaaactaattatagaatccgtcagtaaaccacgagacgaatttattaaacctaattaatccgtcattagcaaatgtttactgtagcaccacattgtgaaatcatggaggaattagacttaaaagattcatctcgcaaattagtcgcaatctatacaatttgttctttttttagcctatatttaatacttcatgcaagtgtttaaatgttcgatgtgacagtgtaaaaacttgtgtgtggaaactaaatagggcctaagg

SEQ ID NO: 63123 - DNA, 8026 bp, Oryza sativa
  unsure (1)..(8026): unsure at all n locations
ggaaggcttgaagtcatagtagtagaaccttgagcaccaagttcccctacctggcgcgccactgtcgacgggggatacccgcagaccggatatagagggtattggggtccgttgatacgaggatatacataatatgacatcaggcagataaaagacaaggattttactggttcagaccccttgataggtaatagccctaatccagttggtatgggattatatgatggaaaccatagattacaaagggaatagcagaactcaatgatgccgacgagatcgtagtcgagttggttcgactaggtctcccgacgacttggctcctgcgcgctccgtaggctgtggtggttgtgttggcagtaagattcaatgccttaggtcctgcccagggggtcccttatataccgcgggtcagttgatctccaagtaggactcgaagacattggacccctcacgatatggctaagacccaatcttttccgagtagaactccttccatatgtagataccatccctattacgtgatagatttccttaatgtatacggaaactgtccgtatacgcgcgggtataccgtatcagtatacagtatacatccaaggatagagggtataccttatccgtaactctgacaatatgccacacttagttaaggtggtagggtaaaaggatggtattcatgtcgtactgaattttttctttagtttctaagttctaaccaacaatttttgaaaaatttattaccgaattttagcttagatgtcttttgaaaaatcagaattttggtatattgcatagaaattgtgtgagataattgcatatcaggtcgatctaaccacaacctcatggctggtctggtcgatgcttcaatgccaatctaaccgcggtttcttggccagtatgaccaatgaccatagctctaacatcagtccaactagggattgcagccgtggtatgtagccaggggcatgagctcaaatttgattatataaccgaattgaacctatgaaattcggttgatctattatgaattcaaggtaccaataggaggattccactagtggaacttttcaaagatataagcaagatagttgattgaagaagatatattggagagtttggcgtaagcatccaatacaccttgtttaataaagagttacattgccgaatcatataatagtgctttcaaagtatatgtttggatgccgctcaatctaaaattgctatggatgaagtgtttataaggcattgtgaaatttatcaattggtttgcgagataaatcatttagccggttgattctcctatgtttggtgaggtgatttatcggtcaattgttatgggacactaatagtgataaagtgaccaagaaatttttgaagattagaaagaggtttaacggatgatatgaagttatagacaaagcccataataacagaactggggtagaatcgtttcaagattaaaaattgacatgaatagatgattttaccattatggtctagatgcaaaaggcttgatgggtaatcatctagttggaaatgtctataccgaaatgtgtgaattgttcttagaagattgttgatttgttgggacgctataaagagaatgatttaattactaggcatttgaaagcacatatggccgatagaaatcatcaccctgagaccacgtgttctatgcttttcagctcacaagtttgctaaaatgacaggggtcagacatgtgttaacaacaaaatttagtactaggacaaatttatagcaagtttgggccagagttggaatagaccggagctttcccgaggaggatgagctgaccgtcatcagatcggagggtgaactgtagtctgactgtaggtggccagtcagaccgaaagccccgagtctgagtctagctaaggcaattctcgtgtttcgtagcttccgtccaaggtttctttgagtcctaattgatctcacttaatagaacgtggaaaaaaccctatggaggtaacaccaaccccttcataagggttatggccaattatattctaacaccgaccataatcccctacacaatttatcaaatcgttccttttacttttcagtaatgttttctactttaccctagtttcgtccatctttatcgatttacgtcataaattgttcgcctacgctgcgagagcccgataccctttgtaggtctgtcccgtaaaccttccgattcacccacgagacgggtgtttactaccatatctatctaaatcagcctagaggctgatttgatctctaaattaaatcggctccactggctggttttgctctttcctaaacccatcttgattgggagttttctagatcaaggtggttggtgactctgttaacaccgtaaatctttagataagtccgtgttaacccaaaaaggcaccaacactctccttcagtttggtaaaaggttgaggaggctccggaccgcagattaattgtccaatgtccatgacaaggaacaagaataatagcctcactctggtgcaagcctatgatagtgttgccctagacaaccattaagtttctttttgttaagcaccaaagcatctgtattgtggataggtagcagtgtagcacactctagcactcctatccctttttaccaagaccactgtagggaattaagcccccacagttaaatagcacccctatcctaactgtagttaccctaacaaaaaattagtagaattccacttgataaaaatatgtaggccatctaaaaactgagctagtattcttatagtcgtcctaaaaaaggcatgtattctagtggttgcagtgacctaagtagcacctaaaggtcataatttcaaatctccatatataggagcgaatttcagattaggcttgagggattaagttcataatttaaaaaggctgcatatatccgattggatgcatgtaaaggccaggtaaaaaaatacccttctcttaaaaaaaacgaaatcttatttgccatcctgagaccctctttcgatgggggccttaatcctggcccattcacatgtataagttaggagattgaattaaaatattggcccatgtaaaatcatcgggattgaattctccttaattaaatggaagagtgatatactcttcaactatatatgaaagtgaaccaaaagaaaattaaggagactgaaaacaacaatacagtgtagtgctcccatccgtcttagaaatcactacacagctagagcctagccagagcatgcagatttcactcatgcatacggcgccacgtatctgcccagacgccccatgctgaattcaccggcggcgagatggaaaacctaagcacagcagcatcagcgtgtgtgcacttacctgctcgatcgatctgcacctctatctctccatgtgctatatataatcgatcgatttgcattctgatatatatgatgcgtagacagtgatctcagtttcaactcctaattagctcctagctagctagctttatataccaaatcgaagaagaagaagataatgtccggctacgggcagcagccgacgggcgatcgtcttgagtcggcgacgttggtgcagtccatggagtcgaccaaggatacgatcgtccggcgcatcaccgagtcggcggccaccgtcgacagcgccgacgtgcaggcggccgcggccaagctgacggcggctgtggagtacaggttcgacgttgccaaagctgacgttgatcggatcatggccgggagaggtatagctgaatttactcctctatatatactccctccattctaaaatataaacatttttatatatacttccttcattctaaaatataaacatttttaagtatagtggcagattaacatttaattttgactattaatagtaataaaataaataaaaatcaattatgtaaaattgatgttactatatttattattaaacaaactattatattatgcaactttttttatttaaaacatcttatacttttatagatatagatattgttggtcgtaagtagcatatcggagaccgtgtcagactaaaaaaaatgtttatattttaggacatttaaattcttaatgcccagcagcttatagtgtgctctcggatttaaacggagttatatatatagtacgtttttaattttaatttgaatgcgactttattttgtgtgcatgcaggcaactagacaagtgatcgtggaagacgacgaacaccgctggcacacatgtccgatgcagtacaagatcgaaatttttatctgccccgatagaatttaattagcctttttctttgtttttctcttgtaactttctttaaacaagttgctggcagatcaggctttagttctgatagatagagcaacaccaacatggatcggcgctgttatgaaaaagcaataaaattaattgcatcgtggactcaatacatattaagtaggttaatttttttgcgagtactgggttacattaactaagcctatagaatatagatatacacttgctcccttcgatttcatagttctttcatgttttggatagtattgaggttaaaattttataatttaattatcaataactttaaaaatatatattaagtttatagaggcactagaacaatatatatctctactattataaaaattcaaggtgtttttgcctgaaaatttggtacgtcgtcattcgtgtttaaatcggttttaattgaatatgtttccgtatcagaattttgattttatctgtattttggtttttttccttatctgaatcggttctaattcaatatgtttccgtatcagcgattgggcccgtcccttgccgcacgccctatccgagatgcgtgcgcccttcggcgcaatgataacgtgtctgtcgcccgtaatttaaaaaagggtgaaaaaaatcagcttaaaaaggggtgaaaaaaccgtccggaaaaaaaaaagaaaaaagagcgaaaaaggtcccaaaaagaaaagtccgattcccctaacacggcgaaaaaaaagtcgttcgtaataaaaataaaaagagagaaaatccatgaaatgccatcgacatgcaccctaatcccagaaataccatcgacaaaggaaacttcccaaaaatgccattgcacaagcctctttctcccaaaaatgccatcaccgtcaactccacatcgttacaaccgttattttttttaataattatcattttgtcctcagtgcaaaatatacccagttttcactgtcaaagaaaaaattgaaatttccaaccctaaccctaccgctaccgatcccgatcccgatccagcgctctccccagcggcgtctcgacgacggcggcttggcggtggtccccggcggtggctgtggctctgcggtggtcccctgctgcggcggcgcggcaaggacgcgacgaggtggatcagcgcgacggcggtccacgggggtggcgcagcgaggaggaccacggcgacgacgtggcaggacgcggcaaggaggaccaggacggcgacggagcggcaggacatggcgaggaggtccacggcagcggcggtcctcggcggtggctgtgtgtcggcggcggtccccggtggtggctgtggctcgggcggcgatccccagctgtggctgcgcggcaagggcgcagcgagaaggaccatggcggcgacgcgacaggacgcggcgaggatgaccagggtggcggcggtccacgggggtggcgcggcaagggtgcggcgaggaggaccacggcggcgacacggcaggacgcgcgaagaagnactagggtggtgncggtncggcaanacgtgtgacgaggacacgcaacgacgcgacagacgcggtagaaggttaacgncgccgcggttgtgcaagggcacgncnagttggtccacgncggtggtggcacgcaagggcttggcaagaatgtccacggcggcgcggctgtcgcagnatgtggcgcgggggccatagacgccggcgaagagaggtcctagcaggtgttgcaactctgatgttgattttttccccgtttgtttgatttcatttggagactttgtttgatttgatttcaatgaatttaattatggaataacttgattgatagcaaaataatgatgttggtgaatttataagctaacagaaatataatttattgtgaccaaacaatgaaaaatgatgttatgtgagtaaatggttgtctaagggtaagattgtcttttcatgcaacttaacggaaagatgctaatagcagttttacggtgacggcatttttgggagaaagaggcttgtgcaatggtatttttgggaagttgcctttgtcgatggcatttcatggattttctcataaaaaagatccgatttgtacgcaacgattaaaaaagtaaaaaagaaaaaaaatcccaaaatacgtaaaataagcgaaaaaacaaaaaaggaagtccgaaaaaataaagaccgaaaaaaggccgtgaaaaaaattctagccataaagataaaaaaggcgaaaaaaaaagaaaaataataagaaaggcaaaaaaaattgccttccaaaaagaacaaaacatttccatcgtaatttttagctattataataattgaagatgattttatactcatcgtattttcgtccattgtcccttcattttaacaaaccatcctatccttattcatatatgtttttagcgttgtgacgatattcatgttttcctttttatctccacatccaatatgtttgtgcacatatgggcctaaaattgaaaaagggtccaaaatattgcccatccctattttgggttgtctcagtgaaaaatattgcccatcttctaagcatatgtgacatactatttatttcagttttgtttgtgtttatttcaataattttgcacacatgcaaatgcaaaacatacaaaattttgtatgggcagctttcacgcatgtctgtttattttgtgaaagatttatctacatatgatttttttaacatcattttttcaacatatgatttcgttcggctatttaggagtaagtgatttattattaaaaattgaagttgtttccgccgatagttttggtatgtcgtgtgtattgaagttggttttaaaattcgtttgcttttaaaaatacaagggtttcgaattggatatcatctcataattaaaaaacccatatactttttagacaaaagatatatctaacaataatactattaaaatagtctttacccgttgcaacgcacgggcttttttttccagtagatataaaagtaaaatgtatttatttatggtatatattataagaaaaaaaatatatagtcaaaaaatatattttggagactgtaccattgccgaaaacattaagaaatatgaaactggagggaggagtaattatctagtgatgttttatgagcaaggaaggaaacttttttaagtgatgcagttatcactaactcatcaaaaaaaatagacttttgcaagttctagcatgtcgggcacccagtgctctcccctcgctcctacgtattatcgtaggttgctcttaagaatggaaaaagcttgggctcatgagcttggctcatgctcacttggctcctcagttaactaggttgttctctcttttctctttttatgggcttctccagttctccttacatataaaaccaactcatcagcaaactttaaataattcttcctcctaacgtaattattcaatttatgataaatttaccattgtattcgttgtaattaaaactttataacaaaatcttacgggattatattctgacaaaaaataatagagaaaatgaaccacccttcaatcctaatctaaacattttttatcacacatgcaacatcaagttgtaattgttgaaacattacataatacctatagaaacatcccaatgacgccaggtgcaacatttatgaatgaactagtgaaacataataaaatactcattaaaacattcaaaataacatcatgtgcagcataaaaaaaaagatccattacaacaaaaaaaaattgtagtgcgcaacatacccctcaccctcc

SEQ ID NO: 63124 - DNA, 26823 bp, Oryza sativa
ttctcatcaaccgggagtaaagatcttttcccgctattttcaaattctttttaaacccggttagagttaagaaccaggactaaagattatagcactgcatattattttcgcttacatatgtgtttctaaaatagaagttaatgcattaacattatttaaagtacaaagattaatgacaattaggccgaaaaattatttgtgtctgtaataaattaagtggataaatcgtaataagcaaatatatgacttaaaattaataaaaattccaataatcatatatacttagcatatgaatgatattattaaattggtaaaaactctaattaagatatgtatgtacatactgcatgatttaaaattaataaaaattgtaattatcatatatacttagcgtaggaattatattaaatttaatgttaaaagctctaattaacatatgtaaatgccacatgcatgatttgaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgatgctagtaaattaaaagttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgactgcacataccttttcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgactggtagaaccacttgacgttaggctcgtcaggccctctgcccttctttcctttgatagacatgtccttcacgaaaaagacttgcgttacatcattggcaaggacaaaaggttcgtccgagtatccaaccttgttaaggtcaacagttgtcataccactgtcatcaatcattacgcctccaccagtcaacctaacccattggcaccggaacagaggaaccttgagaggaccatagtcaagttcccatatatcctcgatggcaccgtaatacgtggcagttgttccatcgtgtcccatggcatcgacacgaacaacgctgttttggttcgtgctcttcatgtcttgggctctcgtgtagaatgtgtacccattgatctcatatccctggaatgtcgcgattgacccagacggtcccctcgccaggaaggcaagttgttggttgatctccggcgtgcccatgagatgttgtcgtagccacgtggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctatcgtcattattactttccttccaagagttccctttccccgtagtctcccttcatggcgtgattcaggtacctcgattgggcgaaggtcttcgataaattctacgcaaaattcaatgacctcctctgttccataacccttggcgatgcttgcctctggacgagcacggttacgaacatacttttttagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgatgagacattgcaccacttcattctgaagggcttctaatctatccggatcgatgaccttctacgaaattctgttcatgaatgcacatagctttgttattgttgcccggacattgtctggaatgataccccttattacaactggtagcagttgtgtcatcaacacgtgatagtcatgagactttaggtttgtgaacttcttctccttcgtgcttattattcgcttgatattcgtggagtatccagacggtacctttatgctctccaagcattcaaacatactttccttctctgccttgctaagagtgtagctggttggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcatgtcgattgcgtggcgtacgtccaagaattcccaatatggtaactcccaaaatatagagttctttttccacatcgccgcgtgaccatcttcgctctctataggctggcttccaagcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacaatgacccatgtatacaaccttcctacagtgcttaagatacgtactttctgtttcatccatacagtgagtgcaagccttgtaccccttgttggactgtccagataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacatcgatgtcgttaccaggttgcttggggccttgaataataatcggcatcattatgtacttcctcttcatgtatagccaggggggaggttgtagatacacatcgtaatgggccaagtgctatggccgctgctcatctctccaaaaggattcatgccatccgtactcaaaccaaaccgtatgtttcgtgcgtcctttcctaattctttaaattttctgtcgatgtttcgccactgcgaaccatcggcggggtgtctcagcatcccgtcctgttgacgctcttcagcgtgccatcgcaacattctaacattccccttgttcctgaacaaacgccttagccgtggtattatagggaaataccacatcaccttagcaggaattctcttctttgttagctgcccgtcaacttctcctggatcgtctcgtctaatcttgtatcgtagtgttttgcaaacaaggcatgcttctaggttctcatactcctcaccgcgatataggatacaatcgttcggacatgcgtgaatcttatgaacttccagtcctaacgggcagactatcttcttagcctcgtacgttgtctcgggcaatttgtttctccccggaagaatgttcttgacgagtttcaataaatcgccaaatgccttgtcactaacctcattttttgccttccattgcaagaactccagagtggtatccaactttttgtgcccctgctcgcaacctgggtacaacgaagttctgtggtcctccaacatcttgtccaatttatgggcctccttttcactttcgcagtcctccctggcgtcctgcaacatttgaccaagatcatccgcaacgtcgttaccatcagcagctatttcctcctcgcccgtttgattttcttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccatttccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacatacaactaaattttggagacaaaaaaagtgtgcaaaacataggtgcaaatgtagtatgacaaaaaaaacattggaggatgaagttgcaaaccttttaggcacctccgatttgcatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagccccggttggtaataccaaccgggactaagatctttagccccggttggtaataccaaccgggactaaagttacgatctttagtcccggttggtaataccaaccattaccaaccgggactaaagatcctagaggggcctgacatgccctgacagcattcgaaccgggactaaagatgatccttagtcccggttggtgtgttaccaaccaggactaaagatcaaatatgcccgttacccttttgaaccgggactaaagatcatctttagccccggtttttattgcatccgggactattgtggaaatcggccgaccgacgaaagatggtttctccaccagtgattatatgcatatctagattgtatattctaatcgtctagtgttgatgtgtttgtacttcatatatgcatatggttctaggcgacaaagtctaactacaatggattacgcaactgcatgtaaacatatatattactaatgtcaaagagaaaatagccaaaatattcaatgattgaagtgtgactccaagagcaatgaacccgggcttgtttgatcaactatttttcacttactaattcgaggaggacgcaatcaacttatgaaagttattttaagagcttgctctcgtctaataaacgaagatagttatgttttggagcctatatataatatcggaatatgtatatatgtagtgttgcatgcgtacggtctagccgtctaggcggctaggcctacaccagtacgtacaacacggcagtcaaacaagcatattatagtcccgataataaaatactactccttccatctgatgaagatttcatttttcagttttcgaaatgaatcttcgtcttatttaaaaaatttctatgattagtactttaattgtcataaataatattttacgcgcgactaatttgtttaaaaaattcaaatatgacgaacggtcaaacgagtactactggagagatgcacatctctcccggtttgtaaccccctttatttctaggtaacgaactgtgagaaagaatctgggaataaagatcgtcatctttagtcccggttaaaatacctagtactaaagatgaatccttagtccctgttggagtcaccaaccgggagtaaaaataaaagcaccacatggagctttctctttctcttttctttttttatttttttttgcttctttcatattgatttcgcaccgaactcaacaacaaattcatccacagacaaaatcattcaacatcacagattcatttgcaacttcatagaaacatctaaaaatcatccataaatttacatcacaaaatcaaccacaaattcacaaaaacatctaaaaatcactcacaaatttacatcacagaattatctccaaaatcatcccagaatcatcacaaagtcatcgcctccggattgcccgccgcttgccacctctcctctgtgtacgccgcctgcggccgcctcccatccgcgccacctccaccgccgcgcggggccgccgcccgctcccgcgcgcaggccgccgcctccctccgccgccgctagccatggccggcacgctgccgccagccacagccatgagcgcctgccgccgctcaccccgccgggcacggccccgccgccgctggccgcctgcctgccatcgtcggccgccaaaattattatttattttcattggaccagattttgttctgttcataaaaatatttttattttgtatagattgtaaatggcttaaaaataataattataattttcactggttacctaggaaaagtatttagtacaaatataaaaaaatataataatgataataacaatataggaccaaacataatattattcggaattaaataaaactgtacttaatcataaaattatattttatttcaaattggaaaaattttatctaggatttgaatatcttggacaattataagcctttcaaaatttaaaaatcatatatacacaagggctccaaaactattttagatttttacaattatgaaattagttcaacaaattatagcacaattcttagtttactattagagtatttaggaactaaataaatcttaactataatcaataatacttatttgtttaacaaaagatgacaaatgcaatttttatttgccaatatatttttttgtgcttgtataaaaattttattacgaaatctccaagattgaataaggattttttttatgaaattgtttaaaatagtttaataaggtgccgcctacgaagatgaattttgcagccggacgatataacgcgccgcctgtaaaattgcatcttcgcaggcggatgacctagtccgcgcgggaaggccgatttcggccgtttgcaaaaatatttctagtagtataaaattgagtaagatatatatagaattcaggaaatgaattagtagccatcaagactcatactcatcaactaatggtgcacttatcatattaataaggcatggatgatattattaaactcccacttctttgttgtcgaattaagccaggaaacacattcccgtccgtacatctgcagttagaagtaaaaaattacaaaaatctggccagttatttcattttaaagtgtcaagttgatgaaattaactactcaggttttggtaattttagccagcgtatgtgttgatcttatgagcctaacgtaaaaacaaggtaattaagtaccgtataattaattaggtattaactatttgttagtgcactaattaaaatagtatgccatgcgtggctttatatgtaattatgtatacgtgagttatatttgtgattccgtaataccgtccaatggcgtaagcaatgatgaatatatgcattagataatcaagtacatacagtacaatatatgtaagatacagatggtggcaatataatatatatgcagcaatttttgttatattctactctctagaatatatccgaaatttggctggcctaccatacatgcacgcacatcactaattcattaatcttcaaaagtctccaacaaaaagaacttaaaattatcaaattaagcttgtttgtatttatattctgcgtgcaagtacggcaaggccggtgcaaggaaagcgatgtgatattgtacggtacgagtacgacatcagtgacagcataaccgagatgttatgtttctgatgaatgttcgaaagaaaataaaaatagtcaagttgcaccgatcgatttcaacaaataccaatatttttgtttgtatcagttttactcaactatcaaccgaggtttgttataatatattttggaatacatatatagcatccacatatatctatgcatacccctttaaaataccctaatagtgatgatgaaagataaatccgccactacccaccactatcgatcatatggatacttaaacatatggatacctaagtagtgtgataggtgaacttttaacccttccaaccacaaaccatcaaacaaggaaagtttattttataccactgtaaaaaatgatggcaagcctatagagttgaagctcttatccaccatttctccttagttcagtgatattaaatttcccctactttcatgtgtcaaataagaacgatatcttcgcacaatggcagggagctgaaaggctttcgttccagcttacatccgaattcatgtaaagttatctcacccttttcttctctttaaagtgctatgggtgtcttagactcgtatccctggctcacggtgtcggcgttccgtttccttttgcgccagagccatctcccagcataggcgcgcgtttgctcacagagggacgcgctcctcggtcgcttttcgctgagacacggtgcgggggcacgtgttgggcgcgcggcggccagacgtgtgtcccgtggacaccgctccatcccccatatttccccttccacccctcgacacaacgctcagttcgcccgcctctcgccgcactccctctcttcctccgccctgcggcatgctccctatcttcctccaccttgccttgtcgcatcaccggccgccgccgccgtcgtcgttcccgcaagagtaagtttttgggagacctagccgggttgggccgtgaaactatagccgctaacgtcgtgtttttcttctttctcccgcattatgttggtgattttcttgatggatgtgttctcgtgtgtgtgtgttgcagcttgttctcatggatcctaaccggtcaagtgggtacaacaatttcttgaaggatcccgatctggtgcaccccttcggtcaagcctccacccaaagcgatttttgtcatccccacgacgacttccccaacgctcatgctcagtttccccccttctctacccagccaccaccactagcaaccggcaatggtggcctgacattggcctccatatctagggtgaggcagcgtgtgcaggcaaatccagtcagccaagacgatgggaaggcgaggatgtactacactcatgatgaggacatacgcttggcaagcatatttgatcacattccaaatatttgaggcccagatctgaactaggtgcaaaaaaaaaaacttgatttggatgaagctgagcatgagcagatctttttttttgaaaggaatcagcacgagactgtgctatttcattagatataggcgtaaaaaaatacaacccctaggggcaaaaaaaagagctatacaaaattacataagcgctatgattaagttggtaagaattctccaagtcgccttgcgcctgccattatccaggttcttgcctcttcctttatttttgccataaggttgggggccgccgtttccttgtgctcgaagatcctttggttcctttctttccagatttcccaggctatgagtaggattaaggatcgcaaccatttcttgggcacttcccttttgttggctaacatttcccaccattcgtgtacgctttggcatggctcccaattgctcggatccaattgctgataagccacctagttggccgtcagtctccagatccttctggtgtatctacaggaagctaaaaggtggcatgccgtctcttcgtcatacggcatagggggcacactccgctatttggccatcctcttgtagctcgtcgatcggaagtccagactctattttgaatcacaagccacgcataaaatttgcattttgcaggggcctaagatttccaaattaggggattgaagttggtgccgactattcctagacactgagccttgtatgccgaagaggccgagtattctccatgattcgagagcttccagacaatgtgatccgactcattttggtttagcatgatgtcctggggtgcgctccatagggacacaagctggctgatcagttccactgtaaaagtagtgttcccatttagctccaggtcatcgatccaggtgtcattttcaatgccttcacgtagcgatttgcttcttttcttggaaattgcatagacgagcggcatgctgtcctttggtctttgcccgtctagccaggcggactcccaaaagcggatcgtgtttccatcccctattgttattttggtagctgcggcgaagagaagtttgtccgtttcatcacacggtgtctctagtcccacccacggcttggtggggtctttccattcatgccagagtcatctcagtcgcaaggccctcgtaaacatctccatgttcagaacccctagtcctcctagtgcggttgggaggcacgtccttttccagttcaccttgcatttccctcctgtaatgtcccccgtccctgcccagaggaattttcttctctttgcatctagaatgcccaaggcttccttagagatcttaagagtagtgagcaaatagataggttgcgcagtcagtaccgacttgactagagttgatcgccctgccggcccgatgttttttcccctccagccggtgacccggtttgctattttatcaaagatcggttggacgtccgtcttgcgcagccttccaagtagaagcggcagtcctaagtattttatggggaattgggcccgtaacgctgggacgccatcaaggatggagtctagatcaatgcttgcacatctgattgccgccacctgcgatttttgcatgtttgtgaccagtcctgtcgcatgtccaaaacgcacgagaatgtcggtgaaagcctagacatcctctctaacagggtttatgaaaaccactgcgtcatcagcgtacatggagattctgaggcgagccgctctgcctcttagcttggttatggcgtttagttccgttgctttggagaggatccattgtagggggtcaattgccaatatgaagagaagcggtgatagcgggtccccttgtctgagtcctctgccatgcgctatcttttctcctagtatcccgttgagcagtacttgtgaggtggaggtagtaagtatggccgtcacccagtctctccatttctgcgggaacccatgatgttgcatcatggctaaaaggtaatcccaacgcaccgaatcgaaggctttggtgatgtcaagcttgaagagaagctttggccgccttgttctatggcaacttcttgccaaatttctaacatagaggaagttgtcgtggatgctcctgcctttgatgaaggcgctttgattgactgtgacgagggttcacatgtgtaatcgtagtcgcaaagccaaggttttggagagggtctttgctatactgtggattaggctaatgggcctgtagtccgtcacctcatccgcgccttccttttttggaatcaggacgatgttagctgagttcagaaggttcatgtttgcacatctcagattattaagcgattcgaagaccgccataaagatctgaaacatgtgtagaaaaatttgtgtgtttgtgtggttttttatgagactgattgatatagtttgggatgcctagaaaaaaaaagttgttttgcaaactgatgatgatgagaagtagcagtacccatgtgtagaaaatgttgcttctttatgggtagtttatgggagtgtgattcatgtacatgtggttgcctacataacattgcgcaaattttgacaatttgatcctttccaaaaactaattttacaaataaaccacggccaaaacttatttcagaaaggcaaaatttgctacaggctatccaaaaaagtgtaattagctggaggacaccgtaaaaacgtgtatttgctatagggcatcgcaaaaaactggtaattggctgctggacccccgcagcattattttattatttttggaggaaaaggagagagaaacaataattaaagacaagtttacccttggctcaaatgactccaactcgggcttcacatggaagtcccctctccctctccctctcctccttcccagagaggccgggtagcagagcggcgatccacggccgcggccgcagtgccagccacgttcgccgtcaagaggggagggggaggggtttacgtgcagccacgccgacgtgcgctgccggccgctaacgctcatctgcgtgctcggctcggcgatgagtggccgggacgtcggttgtgtcggagtaggcgctcaagtgcggcggtggcggcccggtgctcgtctccctcccggcgtcgtcgttcttcgccggcaacctcgccgaggtcttccttctcacgacgctcgccgaaactcatctgcggacctggaggccggcaccggtggcttgcgcctcgccgccgagctgtcctccttcttcgcgtcatgcacgaccacacgctcatctggggcaagggcggcgaccacgccgacaacggcaagccactagccgccgccgcgcccccgccgcgccgccgctcgctggccgccggtgcctgcgctgctacacctggccgttgccccacatcaccctgcgccagccgcctcctgcatgtgagaaaggggatcgagagagaagcaagaagaaataatagagagaagagagagaaagagaatgtgaaagaaaagaataaagaaaaaggaaaaaaattcaaagggtataaccgtatttacacaactatttctctctctctctttcctccaaaaataataaaatgatgcttcgaatgtccagcagccaattaccagttttttgcgatgccctacagcaaatacacgttttgatggtgtcctctagctaattacatgttttttggatgtcctgtagcaaattttgcctttcagaaatcacccttttgttcagcgccaaatcgtatagtgctgaacttagacaccttagcgccacgtcaactggcgttgaatgccgtgccaccatggatgagaggctgagtcggcgtgccaatgtacattcagcaccgtgctatttggcgctgaggtgtctaagttcagcgccatacgatttggcactgaacaaaagggtcctttctgaaataagttttggccgcagttaatttgtaaaattagtttttagaaagggtcaaattgtcaaaatttgtgcataacattgtcttgttgatagagaagaagcacaaacctttgtgatgcatgcatatgtatctgttttgttgaagttatgatgtgtccgaagtttaattttgttgacataaatgaaaagtttttggtagctataaataattggctccttgatttgcacacttttgatgtattgaagttatgtatggagcatccaagaatatctgtgttgactgattatgggtgaaagttgcattttttttatgacaattggttccttttggtagatagcagaacatgtattcctcgaaatgttctgtgatgttattaccaatgtgtattttgcatttgttaggtatatgttgagcatttgatgatatgtaggtgagtgcctggcttgagaactctacagatctaattgagggaaatgctagaaaaggtgacacatattggaggcaagttgtagctacctataactcaaccatagaagatgacaggaaaaaggaccccaagaacctcaaagccccatcaatttgcctgagattttgaagagcccagctatgagtacccccgttgggagaatagtgtctcatgtagtggcttcggttagtgagggcacccatgaagtgtctttgttgtagatgtcctaactgtttctttttcaatttaaattccatagtagagatctgtgcatagcacaattggccagaagtgtcgtcatgcgcacgtggctacctaggtttgagctatgcatgctaaacacatagtgtctactacttctctccttaaatcaattgatagcgaggttgttagtatgaaaaaagaatacaattataaaggaaaaaatatataattatcacatcaacttagtatgaaaatcaccatcatcatatttggcattgaacccatgtcaactaattgttaaagccaatacaaataacagggaaacaaatcctctactgtagagctagccctataattttgagtaacggataaaagtgggtttcatgattaacaggcctatatgtcagtgatagaggacaatattatagaggagactcatctaaattatagttaacccgtcttacattagaagtcagattgacaggcaagtagaaaaatacagttgcttgctggagcttgagatcttcccagccggccggcaagttggtcactgtagagtagctagaggttgttcagattgatattatttcaaaccatatctttttttaaaaaaatatcaaagatatatgcatttacttttttaccaaactttcaaaaatacataagaaatcatgttaaaattttaataatattgtcaacttatatcaaaattttgacattaccaaaattgataagatttattttgattataatctgacatcctctttggtatccacagaaagtggagtatactatctagctccccgacgggaacaagtggtcatgagctaacaactaagcaaagcgacggcgaagaacaacgatgcaggcatcgccccacgtgtggttaccgacggcgatatgaccaacggaaacgccacacactcgctgcaaaacaaaacaaaaacaaaaacaaaaactctgaacaagactagctacgtgcgtacgtacacactctccaagccttgccagcctccatctcgatcgagagggatatatatatctctgatgaagaagaagaagcaagattcttgacgacttggcttgcgtggagtaacatgtagtagcagtttattcactgtttctgttcgcctcaaactgtcaagacatatgtgggtgtgtgcttgaatggtcgcttggccatgagctttcgccgtctagtttttaataattggcagatttggcttcagtgatattttgaattctgatttgtgaacagcgtgttgatattaccggccgtatgatcaaatcgacatgtgcgaattaaataaagacacatgaaacgttcagtagaagacgtgcccacgttcagtaggagattctgtttttcaaaaaagtttaatctggatggacctgtgtctgtggtggtaatgtattgagtccttcattcaactgtgcgtgtcatctgcttttccgcggaagcatatggtacaatcgaagtaacatgcatgcatcaactcattgagtcacttctccagaaaaccatctggttgcaggagagatactaagtacgttttagttctcctgtactgtaaagatagctagctagctagatatatactccctccgtccttaaaaaaaaaagacaaaccttggtttccgtgcccaacgtttaccgtccgttttatttaaaaaaattaaaaagacaagtcacgcacaatgtataatcatgttttatcatctaacaacaataaaagtacgaattattaaaaaattttatataagacggacaatcaaagttggacatggaaacccagggtttaccttttttgggatggagggagtacaattagcaggaacaaattgtcaggagatattcgttcaaaaaaaaattgtcaagagatgtgcgttacacgggcttatataagaggcgtagctagctagatggcactgtgggccatagaccacctaaaattttgatcgagattgaaattatagtatatgtgctagttaatataataaaaattatatagtggaccacccttttaatttacttattacgtatagatggatcacctttactctaaatcctagctacgccactagcttatatcagggttgtcaatttcgtttcggaccgaaatttcggaaaattttaggaattttcatacttttgtgcctaaaattatttaaaaatttaacaaaatttggttgaatttaataaactttgaccaaattaaagaaagagtccatatctattacaacttgctaattattaatttgaaattataacattaatgaaatactaaattctgaattttcatacggatacgacttcatatttctttattaatttcgaattttccactcattaaatttagaaaaactaatgaaagggtctgcgacatttaaaattgcgtatctaacacatattctagttacgatagtatatatggtctatctaatcaatggctaactctttctagttaacctaaaagctttctcgtagtgcctaattaattaatgtatgtatagaataacatgaattaattctcctgcattctaccatggacgtgaggaataatttagacaatactattatttatataaccattacttgtcaaattatataatatacagtactattcgtataacatgttagcatctatttagttgtttttcaagtatatataagactaattgtttgagtgaatagacatatcatatagatgatataacactactcccttcgtttcatatattataattaaggtgtattgagcttttctaagtggtatgagtttacagaaacatagtaatatatatctacgtacattaccaaattagtttatcgttaaatccactgttaaatatgtttttataatatatttgttttgcattgaaagtgcaactatattttctataagcttgttcaaacttaaggtttaatttaaaataaacataaaatatctcatactaaataattaagggatcggagtacaaagactaaggttgcgttctttcaggggagataggggagattgtaccttgttttccgtgcgcacgcttttcaaactactaaacggtgcgttttcgcaaaaattttctataggaaagttgctttaaaaaattatattaatccatttttgaagtttaaaatagttaatactcaattaatcatgcgctaatggctcacctcgttttgcatatcttcccaatcttctctatttccttctcctcaaacacagcctaattcctgcccaagtgatggcttacttctctatccactctctctggcgtacttttacctcgtcaaaaattctactccctcagttccattttaagtgcagttatggtttttcgtgtctaattttgattgttcgtcttatttaaatttttttaaaaaaaataaaagcataagtcactagtaaattactatttatgttttatcatcttataacaacaaaaatactaattataaaaaattttcaaataagacggacaattaaagttgagcatggaaatttatggttgcacttaagatgggacggagggagtacaaggcaatattctcacaaaacttatacatcacatcattgttcacgcctggactcaaatgctctaccgtatgagatacattaattggaggttcactccctgtcggtctcaatgccttccttttttttttccattccttcgtgaagacgcataatctccaattcttcatttcatcattctcgatcgctgtctttctcttccacaactttttctgcaaggccggaaaggagagctccatgcgtggtttgccacaaactcgttgaatataatccatgtgccatggatgcccataaccaaattaaccatactccttgtgcgacgtgttagtgcatgtcacaatcctattacccgtttggctcttcttcccaaaaagctggaatctactactaccttttgcagtttcggtcgtcagaggcctctctcttgtagactgccaaatggcctaaaattaatgacatgggtcaccctatctgtttgttgcttccaaacttcgagcgtgatacgccgctgcattattgcatcaattctgttcctctctgatctctcgatcgatctctctcccttatctgctggttgctgctggttgctgctgatgatgctggatgttaatatctttgttttgtttaattagtttaattttctgcatgctctacagtagataaaggatatccttcagaaaagtaggggacagatggtccatcagaggatatgtcgagagaacaaaaggcagcacttttgtgatatgtatgctgacaaaaagatattgtgataataggcttattagacttgtaggtacatgttgatctgtttgctcactacatgagttggaaattttcgaggatatatataacaacatatttcccaccatacactaaacaaattttgcttctgattatcttctcttacagtacggcagatatatgatggcaatagaattatcataatcgtaatagcaaaaaagaaaaaaaatagcatcaatcctgaactcttttccttttaaaaaaaatagccaagcgctcgagaaaaaaaatcgccaagctagacaagcaagctagtttgaataactagggcaacgatgaatgaaacgaaaaaacattttttttacctgttggaaacagtgacgtaaaaacatattttacttgaatactgtgaattagtgcgccatctgctcggttagtattagatattgttcatccacaaaatataattacatattcaatagataaagtgcaaatctcttccagatgaacaaaagaaatactaccttttttgaggtaaaacctcgagaaagatttacctcgagaaagaggataggaagtttctattttccaaacgaacagataaaatactcaatatttttgttaattaataaagaatacttatatattttactaattataaattaaaataaagcgcaaatgttaagtatattacttatataaaactgtacatctctactccctacggttatgaaaacatattattttggatatgtctatattttcctcaaaagttacactcacaatattatattttttatgcatggttttatagatttttagtataaattaattttcaaagtcatatatgaagaccaaagatggctcatatttttcagggttttctcgttgccagcagtaaagttatgacaaccaccacgagagacaaagtttagaaaccattatgacaataagaaatttccaagctgccaaactttaaaaacaagatttccaaagccacgtcatgaaattccagcctaggtttcaatcaccaccacaaacaacaaataacatgattgaataatattacaagcaaaacacacctcatgcatgcaccatggcttgcatttgctggctagatctataattaattaatgtcctccagaacaattaaaaaaaatctgaaatgagaagaaacaaattactccacagtagcaacgctccttgttgactaattaattaccaattaattgggtccattgcacacccaagtaattaacaaccaccaaccaacgtcattagcacacaaaccgacaattattgcagagattatcaaggagaagggatcaatgcaaggaccagccaaagcagtgaccggagcttacatagctagcttcttcccatcacgccgagatgtcgacggcaaatgatttcctaacaaatcctgatgattaaatctaatgtgatggtgatctaagccggcccagaggagccagataaagatatcatagccatggttataattaattaattaattaattaatcaactgattaggagtcgttttaattaatctaactatgaccgggtttgggccccagcttgagccgcccaagctacgagggccttgcagccatatgatcgagctactcgatcggctaatcttaatttaattaattaattagttaattaacacctcccttcctaatttacaccactaattgggtgtttaccgcgtcccacgtggctctctctcggccaggaattgggtctactatatatggagcaccatctatcgtgtgtttgaccatgcgtgaaaggttgaagccgctgctatgcgccggtagtatagattttttgctctattgatggtaacatcgttttgaagaaaagaaaatctttggaacaagcaaaagatattttttaagtacagtacaaacagcgtagatgaccatatattcactcgtcttataaatacacatatgtacattctacttccttcatctctaaatatttaacgctattgactttttaaacatgtttgactgttcaccgtataagcaattctaagacattagcgagaaagtcactgcatagttcaccgttatttattacgctacagaaatatatttttacatatgctaccaaaaaaccgtacttaaattaatgtgtatggatatattacccacatacgacctctctagttgcattagttcttttttttgggaggtcggccgtgtttgatgtgggttccaagagcgtgggtgtacaaaatttgatgataacttgaaagaggcacacaattttttagtaatgatttgtgccattttttatatatatgtttaaagcatcaatgatatggcattatgtacattaattacatagctaggtaattacgtaccttttatcgatcctaacaggaaaaagattattttttattaaaacaaaaacaagcaaacaaacttccatcaccttactgcaaagattgtctttttttttccaggccacgttgccaaagtagcaaaacaacgctttcaggccaatgtcatgtagctgcctagctaggtcgctatatatgacaaaaaaaaatcaaatcattaacttaccagttaggcctgtttgatataattatttattaatgctaaattcagatggatatattgcaataatatagaggaatatacaaactgatttcctttttcttttcttttcttttttttttaaaaaaagagcacctgctgtgagcccgtgactagattatgctttaaatagaatattgtgtgatttgtagtgatttctatctcttgaggatgtcttaaagggtgtgtttgtggctgcgtgcatctcttatataattgccaaaaaggaaatactgtctcttttgagagagatagagtgtgcgaccgcacatgtccaatatgaaattaacttggagaatttcagactagaaaaaaaatctctccttttctccccgggacaaaaattaacttccagataatcaagatatgatgtactataaatattaaagataattgcacaagtattggaaatatatatactagcacatacgtgtaaaatctaaatatctttaaaacctctaaatggagaaggcaagaaacagaaacaaccatctgttccctccactcctttccaagtctgtgcctaccacataaagaggcaacaaattaaaaggcatcaccaagaagaatatatatacatatagccctccacaataaaggagaaccccttgaactgtttggaaaaattgtgaaaaaagtaaacacacatatttagggaaaattgaagccacaagatattaacctcttgcttagattaaatcctttttgtaactgtacattttatataagcatctgctataccatgcacatgttaggtgaaatgttaattttagtatatttatatactttgtgcaaggtgacatgtacgtgcaggtgaaaacaaaattatcaacctcgaagtgaactattcattaattaataatactagcctagtggtgacaccacccattaaccaccccttttcaggtttgaccttttgatgctcgcagttagcaaaaagaggccactaatctctatcatggcatgccccgtaattaccccaaacacgcaggggcatttccgtccacgcgcctcccccacctataaatccaacgcgccacactattgcctcttctcatcaccactcgtctcctcttctcgcttcgccttctcctctccttgtccttgacctcccctgctccgccgcgccgcagagcgagcggccatgaccaaggtgcaccccaacgtcgcggtggtggcgccggcggtggtggaggaggagaagggggaggcggtgtcgctgacggtgtggcggcggtcgctgctgttcaacgggaaggggttcacggtgttcgacggcaaggggaacctcgtgttccgcgtcgagagctacgccggggggtcgccgagggaggtcgtgctcatggacgccgacggccgcgccctcctcaccatccgccgcaaggtatgtggtctctgaattcttgctctggttttttggtgcccatggccatggccatggccggccgccgcagatgctgatgttctcgtgtggtccgtcttttgcagaagctgagcttcgcggacgagtggctcatctacgacggcgacgcggcgtcgccggcggcgccggggccgaagaggttcacggcgcggcgccacgtcagcctgcgccccaccaagtccctcgcccacctgtcgccggcgcgcgcgtcgtcgtccgccgccgccggcggcggatcggcgaccgcgccgagcggcgcctgccggtacgacgtggagggctcgtacgccgcccgctgcctcgacgtgttcgcctccgccagcgccggcgagcagcggcggcgcgtggcggcggtgtgcagtaaggaggccgccgtgggcccggacgtgttccggctggtggtggagccgggcttcgagccggcgctcgccatggccgtcgtcatcctcctcgaccagatgcacgcctcgtgaaagcttcgcgcgccctccccctgccgctgcacgaatctcaaagctccctgcaccacagctgtgtgccacaaggaacaaaaatctccttgtttcttgagagctcaagacacctcctctcttttttatgcttcaagattagcaaagttatgaatcactcatgagctgagatgatcaatctgcagctatagcagaagcattttttatgtaggggtgtgacgcttttatggtttcgggttcaggatttagggttaagaatcggacgatggatgggtatccagaggtgttctataagtgccaggttttcggattttaagttagtgaaaacaaaactgtgcacttaaggttggtactttggtagggcagatgatccaagatcttgtatggagtgtatatgaacatgtaaatcccagcccctttttgtttccttcccaaaggaaatttctggtccttaatacatacctctaattaataaaactttgagtttggtttctcctactatttatctcaatattcagaatatagttaatttaattaattactttcatttgttatcctacttttttttctgtgtaatttgattgcttcagctggatcgattagcaaagttgaagaagaaattgctctagaagattgtacactgttcgatttcttttgacatgaagcaactatgaggggagaaaatagcgtaacttgtgaagtatgtttggagaagtaattcttcctccttttggggctctgtttgtgcgtagttgaatctttaagctaagattgttgggttggtgagttaggaaagtggatgacttgacttgcccaaaggaacaaaaggaacaaaagaaacgcaaccattttttcctatatacgaaaaatagagatcgaaagaatcaagctttcttttctagctgctggctggttcactgcgtctgaaagagcacagaagaagattctgttaacatgaaaaatttgttaactagacaaaaatcaagagatgttcttggctttatgtatgttctgttgatgtagcaaaaaaaatagtaacaagtggccctgtttggatggggctagcccctgtcacatcggatgttcggacactatttagaagtattaaacgtagactaatgataaaacccattccataatcctggactaattcgcaagatatatctattgagcctaattaatccatgattagcctatgtaatgctacagtaaacattatctaattatgaattaattaaacttagaaaatttgtctcgcagattagctctcatttatgtaattagttttgtaaatagtctatgtttaatactctaaattagtgtccaaacttccgatatgataggtactaaagtttagtccctggactatatttctggcatctgcacttggtgtatacggctaataggttatagctaagcgtgttttaggttttatataaggtgggatgggttaggtttatctctagttttagataggatggttctagctatttgttttgttatttaagagattataaatgatcactttttttttagaaaagggatggcgtgactcgtatgtcagcgagagcgggaaagtggttttgattggttcgccacttttttcacgtaaagctaacccaaatcttaaaaaaaataattcccttcgaaggtaatctcaacccatctatttttaagtaaacatcttataaaataggttcgcctcatccaaacacatcctatcttttttaaatcacacatgctaaaaggctaagaggtatgagttagcacaggtcgcacactaaacgctaactttagataaaagatataaaaaacatatttcgaaatgctactatatatatgtattttaggggttattaaaatgttgttgacatgttcagaacatctgcgagtagttaactagcctagcacgatcgatatctatcgagttcaagttccttgatagcgtgctatttatcgaattcaagttacttgatggacaaataggtcggcacagatgcaggttacgaaattggccgctccaccgaccgaattgaattgaattcatcgcgaaaacgacctaggataacgctagcacgctagtgctgatttttgtcccctagttctcagcagaatttcaaaccaacaaaaggtacagtagtagtacatgatcatcagcgtatcttgcgagagatttttttcttttcgttacaacaactttttttttaaatagattttcattaaccctctgtctatatccacgagggattaggccatccctaacccagaagctatcaaatagtttacatacttgtatgtcatgtataaacactatagtcctgtttagatcctattctaaaatttttcaccttgtcatatcgaacgtttgcacctacaggagaagcttgtcgaggagcacactgtggtggttgtcaagagaggcggaggcgaagacaaatcctgtgaggacgcacttggaagaggtggatcctgcgacgacgcagtgacgacaacagccagcagcgcgctgtttctggctgctacgatgacatctatctgccattgatgttgttttttttttttgcatgttctattgcctgtagatttgtatctgatgcgctctttagatgtagatctgaattgatgcatagatgtggatttaaatcaaagcatgtatgatgtgaatgtttttttttccaaaattctttttgcaggggggtcacttaggggtgctagcaagaaaaatcggttttcgcaaacgaacgtggatctacctgctaaagttgatgattttcgcatctctttgatcgcacataggacgtctggccgctcgtaaaaacgtgtttcataagcaatgtatgcatgtatatgtatgtgttctatatgccatattatgaatagttacacattagctatattaatagtttggatccaaaataaactcaagaaccggttaacaactcgttattagcagtggtggctagttacaggtttttaaaattaataatttgatttttttccccaataatagcagtaaccgattttctggagagaccagtatttcttcaaacaattttgctaaaaaatagtagtgtcatacccccccccctcgtatttcagtcacctttttcaccttgatcgattggcaattaagtctcccttatgtggagcctattgttatttgtcgttgttcttctgattgactttttttggggttgttttgcaatttttttaaggaaatcgggaagctaataaatagttttccgcatcagttctccttatatagtgactacttcaaaggataatgcacatttcacatgaaaaattttggacatttcagcgctaacatagtgtatgaattttcaaagctacttaataagacacatgttgagagatgtacctgaaaatatggcatcacagacgatatttaatctcaatcgtccaaaaacgatatttaatctatataatctaacggcctgtttagttcacaaaataaaaattttcacgctgttacatcgaatgtttagacacatgaatggagtattaaatttaggaaaaaaatcaattatactgattgcgtgtaaattacgggacgaatcatttaagcctaattgcaccatgatttgtcaatgtggtgctacagtaaacatttactaatgatgaattaattagtgttaataaaattatctcgcagtttcctgacggaatatgtaatttattttattagtagactacgtttaatactttaaatatatgtccatacactggtggagaaaccatctttggtcggtcggcccaattccacaatagtcccggttccaataaaaaccgggactaaaaagcatctttagtcccggtttaaaagcttaggggtattttttgatctttagtcccggttggtaacaccaaccgggactaaagatcatttttactcccggttgaagaggttgtcaggtcgtgtcaggccccaattatttttagtcccggttggtataaacaaccgggactaaaaatcaccccaagccgagcgcgatgtttatttcttcgcgtgtccattgtctgaccctgctcctcagtcttatccttagcttttcttcccctccactcgttctcctcctcactccttctcct

SEQ ID NO: 63125 - DNA, 706 bp, Oryza sativa
ctgagatatacataatcaatacagtgtcacaagtgctggatcaaaatgggtagattgtgcagttgcatgcgcaaaaggcatctctttttcttcacagttttagaatagaatgggagttacagctgatcctcaaatggcctttgaattgagtactcacttctcctgaagcatacatttggaatgtttggtggacatgttttccacataagaaattgacagtcttatatccattatcccagcagataaagcgcttggaccaaatgggttcaatggtttctttatgaaaaaatgttgacatataatagctcaggactactacagattggcagctcattttcatgctggatgcacaatttggaaatcttgtagttcttatataactttggttccaaagaagaattcaccagagactgtcaatgattacggacctatatctcttatgggtctgagtttaaagttcctaaccaagctaatggcagacagacttcaaggggtaattctcaagctagtaagtgaaaattaatatagttttatcaagggaaagacaatacgggattgccttgcttggtcctttgagtacatccatcactgtcaacaatcgaagagcgaaattgttcttttgaaattggactttgaaaaagcttctgatactattgaacactctgctattctttttgtcttgcaacatatggattttcctgaaaaa

SEQ ID NO: 63126 - DNA, 717 bp, Oryza sativa
  unsure (1)..(717): unsure at all n locations
gtggtgttcgtgaaccaaaagacgccatgttagacagacaggtacgcgcttctcggtctctcacttgtccaagggcgagaaccgtccagttgggtatgcgcggctttaagcgctcggggctctgtgctcctcgcgcttcggtgttgaacggtcggtgacggcaancaaattttgtccccattgaacctgtagaggttttactgtttgattgggacggttagatgggtgctcgagggtcttcgctcctgttccgcttgaattccgatggttgctgtatccatttgtgcgaatgctgatggcaacgaatttgatcatcatcgcgggggattttttctagggtttattgaagtccgtactgttcatgtagcctgcacttcatttcattatacctacaagtgatttgcttatctgcaattgtgaaattgtgaatgacagtccatccaaatagtagatcccatgagattgctttctacgatttgaatagataccacaacttccttagttctggtatggtatgaaaattttctcatttgtggtagcttaattgcctacctatggctttatatgctgaaggcaggcaatacgtattagcatatgttgatcctataataagctggccatccaaatatgcttacgctgtagtaagaatcctatatgttggtgaactaaatgcgctatagttttaaggaaaaattggttgtatatgatgggctactg

SEQ ID NO: 63127 - DNA, 2720 bp, Oryza sativa
gagggtgagggggagggttagggttagggtttcatcaattttaatctgatctgagctgtccatcaaaacgaacggctgagatcgatcgagggttagggccgcacgtgggccggcggtccactaagtgagaggaggagtatgggggtataaagtagctctgttctcttgcgggctgaagaagaaaatgggctgaaaaaggcccatagagaaaaaaggatttttgtttagatttttatttcaataaatgcagaaatgatatttgtattatcaaaattagcaattaagctatgtaaattccaagataatttcaatgagtgtaattaatatagaaaatttaataaaagttaaatccaaccataacattttatttcttacacttactttacttataaattaatttaattatatacctacctacttaaaaaatacctaaatatttcagaaaatttgtatttcaatttaatatgttttaattcaattttatctatttttttcttttcattgcaacgcaataccacttttgctataatttaaaagagtgtaattaatattgcagaaaattttatatttcattaaattacaattcatttttttcatataaatagttcaaatcaaatttcagtcaccatatcattacccggtgcaacgcacgggcattttgctagatcaaagtacattgagtataaaaatttcactggtattttattagacttgcctacataaaaataaatatttttcttcatgatacaaattttcatccatcgtcttttttagcagattagttgtctaaaccaaataacaaacaatttcttttgaacagattaattgtctaaaccaaataacactttttgtcactgtacacacttcgtaatcacccggtgcaacgcacgggcacttttgctagtaaaacaaaacataggaaatgccaataagagtaaagcggaccaattagggaaaatcttataaggtcttagaaaaaattggttcttccttttcaccaaaattggaacacccgttaccatattccattgcgtcattttttagtgcttagatgctaatacccttcaggtggcattattagtttcactacatcatgcacacaaaagacataacccactaaggtagaaatatataattggtttaaaagttatattaaacttgatattcactttgtttttttcttaaaaaaatactatgggtctaacacatcgtagggaagcagggtctagataagtattcgaattatgtcaatatgaatcagtaagagggattgttaacttcatggaacaactaaaacataattatttgcaataatagttttaaaaattttgttaaaaaagagggagcccataaacattccatttgaataaaaactacttgcttttaatttacacttacctgtttccaaaaacaaagtatacttttcttttgaatgataagtcagatcatagttaatttcttaccgaatgaatattgtatagtatgtagtataaagccaacgaatagcttagaaaaagttaccccagcaataccgattaagaaggtttttcagactagacataattttgaaatatagtatgaataatccagttgatggtatataagtctctaaagctgacaatatgatacacgcccgcacatttgcgcgggctaccttcctagtttaagaaactgttgggaacaaactcgatacaaattggtagaacacctggagaatataataaataaacaaactcgacaaagacagggttttggtgctgtcaagcagcagcattttctggtttatactcaatttaaaatagcaaatcaacatacatatcatgggagggcaatcccacacgccaagcatgccacgcaactagacgcactccggcttgaaccagcaagccacaagcaaatacagacgcaacaagataaggaaaaaaaatagaaaaaaaaagaaccaacaagaaatgttccatcagaaacaaacttcaaaaccattagttcattacaaacaatctagatcagtcatatgctgaacccagataagagataaacttgatatatccaccaatgaccaatcactgtagggactttagagttgttcttccaagtatatgaatcttgtatggatcgatcatcgatgtcggtgaccgttgtagtcaattgaatctacctgcagttggaattatagaagaaatatatcagatttgcagaaaagaagctgtgccctttcaatatgctccatatatgataagttcacaatgcactataaaaacaggttctagtttttgacctcctggtataaaagtttgaatatttggtacaaacatataatgtctgacatatgtacatgtctatataaatagaaggctactgcagaacactataccattccaacagaatagattatgtataacgacattagcacggtatcttagttagatctgatatttttgatactagataggtactagatctggtaccgtggtaccagacacaatacccataggtatcatatttggtgccaatgataccagacatgatactgcatggtactagatcctgctacctaggtaccatgctgacatcatgatgatgtcaactattccgttagaacagtatatcgttctgtagtattctgatataaatagcatgcaattaaaatatcagaagaacaaataattttgaaataaacattttcatgtttaaatatatctaaacttggtgaaaggatt

SEQ ID NO: 63128 - DNA, 7423 bp, Oryza sativa
attttttcccctccccccggcgaccgaggcgtggcattctcccaactttaggttgcaacatgattggaattaaagaactaattactggcatgattgcatagggaaattattatgggccatgtgcgacgcttggctgtaccttgcaagaaactggtaggagtatgtcccttgcatcacccaaagaacagcaggcactactcctttataaaagtaaggctaatgttgtcaccatcaggtgactattggctggtaggattggaacacttggcagcttgtctgtcactgagtcgtcacagtaatcatccagcaagcaaaagcatgcgtctcagaaaggtttttagccacaaaataatctaatctggtttgccctaatcagtgtgtttagagaaatgcaaccgtgtgttttctaccataagtattcagcgtcaattgtcaatcgatctttgaagtagcatggttgcatggatgaagtagaaagttcagccaactgccctaaaaagagcatgatccaatcacagagtgtatgtaaaaagataaactggaatgataattcccaaactgaccggatacaaaaacgttgaatttcccgagtcctacaaccaatcatatatacagttgctcactactatgctccttaatcctgaactaccgagaggatgtatgtacacgaacttgattgtctgctaaaagttgaccaatttgctgtcatagatgagcctcggtttgcagaaaaattgagtctcaaagcattgatcttgattaacaatcaccaattgtggttcttcagcgagggctcatgatgaattctcatatctgtttccattcctgagagctggccaagaaacatgcagcacaaagttggcaggatcagcaggcaacctgtcaccatcatccggggatcttgcgcagttcaaccttcaagtgattcctagattatgttcaatcttcaaccgcggtgttgaagacaaaactagggaaaactgtcgtgatgtccctgtagtataagatggacaaaaaaataacaaagtaaataacgaggaatttaatgaagtcctgactggtatttttttcaaacaatttagcagtagtttccagacgagatttctctgcgcaacagtatatatttgacagaacttaatagtccagttcataaagctctcaagctcatatttaataccttagataaggcagtgtcatgttcttcaatagattaggatgccgcaatacgaattccttccattcttgttggtttatttttccatccctatcagcatcagcatcttcaaatgtctgaaatacagaaaaattgtagcaaaacttaaatccatgcagcaaaaagggcatgttcacataggacagagccgaggaaatgattgatcaccttatcaataatggcctcgagaagttcttctgacaatttcatatcagattccgacaaaatagcgataaccatttgcataacctgcaaaacagaccatgccgtcactaccagatttgtactagaacacaaataacatacttgttgcaaattaatacagagtgccttgatgaactaacctcctcacgctcaataaacccagtttgtctcaagtcatacaacctaaatgcaactaaaacaatccaaagggaggccttattgtaaatatacctcgatacatgaatttaagaaggtagtgtctgaaagaagtgtacttacaatttatcttgtcttccaatggtgccaatggatggaagacgctaagagcatgaataaactcatcaaactctattacaccatttttcttttcatcaaataaatcaaaaacctgtatcagagagaatttctttcagtggttatacttataccctctgaaagtaacatgccatggaaataaactaacaattaaaaggagatcaatggaaaacatagtgcacaaagtggtaaatggtcaaataaaatttatagtactaaagagagcaaatgaagtaaacactcaccctatcaagaaaaagattctggccgcttggagtcttaaacaatgccagctggagctcttcctaaagaacaattcagcataggaactgttacgtatgacaaatccagcatagagagcatttcagattttatttgtctttctcaagtttttattaaaaaaaacattcactccaataaatcacgatgctcctgaaaatacaaattaaatggtttctgttgacttcgaatgtttgtattgcaaagatactacagtgttttcttaacgaaaaaacagccatgccatgccttccccttacccatcagcgttacagttgctcacatagtgtaccatgagaacgaacatgccaaccaaacaatctgagaaacaggaactattctatggtcaaattgcacatgggagccacccgacatgcaagctgtgacaaaaagtaaactagaggcaaaaaaaattctatgggttgtgaaaccaaaatacaataatgctccatgggtgacccactaatccattgcgtgcagtgcaacacctctggatcggtcgatctagtacacctagttgcaatttttttactgggtcaaattgcaacattgccttcttaaggccgactactaatcaatcgatcattcttttcgcctgacgaacccaattttcagagaccaagacaagaacagacatcgaagtgcagagcataacctctcaaaaaaaaaactattagtttattcgataatcaccgagaattcttgccacgaaagaacgtatcgaaagaaatttttgtcacatcaacctgatccaaaatgacaaattgacaggaacacaaaccttgtggatgagtccgtcgtcgatgatggagcagctgatcttcttgtagagctcgaacagcgcctccacctcgttcacggagacttgacccgatgcgatcgacaccaaacaccagatcagatcggaccacattgcgaaattggactcgagaagaagaagaaggcgatacaaacaatgggaggggggtgaggtgaaattagagattacagcatctggattcgtcggcgaggcgggcgagctggcggagggtgagggaggtgcagccgatgccgaccctgccacgctgctggtggttccatttcctggcgacggcggcgaggtaagaggaagcggcggaacggcggtggcgggaggcggcggcggacggcgggaggaggtcggcgaggcagtcggtgagcgcgaagaagacggcctcggcaatggcgacgaacggcaggaacgccgcgcacagccgctcccccaccgtcagcgagctcgccgactcctgcaaatccaaaatccaaaatccaatcaaacatagctccaagaaacggcagcgccgccggcgaccggcgacgaacaggtagctgagccaccgacccaccacgtcgtcgtcggagaagcggaagccgtagcccgactccatggatgcaagatcaatcacccgtgcgcttctctctcaccccgcctctccccatctctctatatacagaggagacaaactctttaaaagatgccgtctccgtccaaaaataagttcactattagtacctcctttcgtttatccaaaataaatttatttctttaaataattattatcatatcaaagtttataaaagtaagatgtaaatacaataaaataaataaaaataattatattaagatttaataaacgtactcttagtcttacttctatcccatcctctaacttcaaattataactttattgttttctattagcatactttttaaattgttacttctagatgataaaaaaaagtatataaaggtttctatcaaaagtaaagaaatctattttttaaatttataataatcaatactcgattagttatgttttaaatggattagtttcgtgtgccgtagaatcaaatctctaacttcatctatagattcttttattaggacgcgctaaatggaaaaaaaataaattattttgggggcggagagaatactgtgttgctgggtgcgcgttttgccggctagcgctgaaattctttggccggaggcggcgaggcgcttcgcgccgggacctaccgacgaatccatccaaaatttaggaaatggttaccggtaatgaactaatgttttatgtgatcagccgtacagctctggctccaaagtttttgcagctcggtatttttaactttagaaattataggtcaggattttaaattctagaaattatagatctagaaatacggagtatgattacatggataagtaaattattttgattatatttttaaataacacaaccactctaatttaactttgaaaagtctaaatccagcgcgagtgagttgtgatctggagttgtaccgaacacggtctaaggttatgcttggtttagattcaaaaacgattctaagttttggattaattatagcggatttacgtccccaatttcgctgttcaattttcttcttgcgatggttaacgagacaagtaaattttttttccttcttaaaatcatcttttctttaaactatttttcggaacgtaaaaagtttcgaattttaaaatcgttgcctgctgctttgcttggcaccggagtacgttattggaaagaatggttcgctttcaagtttaaagattcggttggcgtggatgaccatgaattcatgatggtctgtctcagctccgttcagtctctgtccctcaagtcctggaccgcacggagggcgaccccacgcagcgcacatcgccccatcaggttgtgcctttctacttgtcaataaatatattgtcaagtctataggagtatgttggacgttatccatccccgtcctggaaatatctcgcttaggatagtcccaacccatagtattcataagtaatgtttatagtaccatgtcaataagacattataatagaaactacactctacaacccatggtttcttaaagtgggctattaataaattgtcggctctcaaaactaacgattcggaaaccgacatgtttaactgtatcaagccctggatcagtagattgatacaggttcaacaatttagatcttcatcgcatacatttggtaaagactccaaaggagatatctttatataaaataataggacatttacaagtttgtggctaactattacagcagaggctatacgatgactcaactctgccgttttactatagaattaaaccatctaactacactagacttgaagattaggtttaaagggaactaacttatgtgattgaactcccagcttcggcaaaaactccaattaaactctgaaaaagaggggttgaagcaagggtgagtacaacgtactcagcaagctattatattaaccaataatgaatatatgaaatggtaatatctgtgtagagctaggtttacttgcagaaagctgagaataaagaggtagaaatcctgaaatgcttgatatgcaacagtatttaagaaaatcttgaattatatttctaaccaaagtaccatatgagtcccgatgctcaatccgtgagcacggctattcgaatagattcaaggatattcatattgcagtagatgtacgctttacccgcagtctacgacttgccaataatcattagcttagtcatggcctagtattaggttattaacaattgtggcacctgttccatgaactctagtccacatgcgctctgaatgtaatgttatcagcagcgagaggagttctggcgttcccggggtttttagagagaactggatgagagaccccatgtcatctcaaccaggttttcataaattcacacacacatcgcgcgataatcaagatatttacctgcgcctcggtaaatatcacatttgcccttcgcggcatatatttgcctccttcgcgaggacttatataagaaccactgtacagaggtaccacattgttaattaacataatatctaggtctgtccccattctagaagctgcgatcgtactcgttcgtttgacataagtacttggtaaacttatatcgaccgagacagtactagccacccggaaatcaaccaaatcttgcgtactgtcccaatctaagttcattatgttttatgcaatctaactaggcagggctaagcaaaagctagcatataactggtttgctatatgttcagattatgcattcaaaatcatgaatggctaatgcatagaatagagatatagaatataggataattatgctcaaggggaggaataataacttgccttgctccaacgcaaataaatccaagataggcaacctgattatacgattctcgaaataccataggttgccatccaaaagacaatagtctttactgagaaagaggaagaaccaaattcaataaaagccataaaataataagaaaacgataaacgactaagagggctagggtttaaggtataacctatctcttttatagggtatagggattatggggctagtatttgctagtggtaggttttggtagtataatagctagggtttagttatatgggagtcgactgtggagtaggacagtatctcggctaggctctatattttatgtggaggctctcgtggtttggacgataggaaatatactggatagttgatatggttaaataggcatgtggctaatatgggttaaggttggctttgatagaatagtggctaaggtttagttgtttaggccgatatcgaggtaggataaatatcggctagggttttgggtgtttgctagttgtcgctagagttggacagcatgacgactaggtttggtatcatttctagccgtgtcgatagacaacatatcggctagaagaataggaggtgggtgcaggtttagtggggcggaagtgttactccgacaaccgtgagtggcggcagagcggctaggatcacacagagctcaagagctaactgtgcggcgtgcaatggaggtcgaggggatagtgaagctccgaccgctgtacgcatcaaggcgtggggtggcaggagcagcacttcgaccttaggtttggtttttgccgggctttacaaccaacggtcgacgttgaggtccgtagaccgcgcaaacgtccccatggaaggcgtaaagttccaaccggcggctttttagtggctaacgggcattttggaaataaaagaaaatatttgaaaagcaaatataagtttaaattgtaaattcaattataagattaaatcaaatatttattcaaatggcatttgaataaattaaggaaattcaaataaaatcttaaaatagcaaatttgatatcaaaatgaagagttgaatttagatgaatttaggtccaagtttcactagaatcggatctacggtttaggagatatgtgcttctaaagaataggatttgaattaaatctagaaaatgagaaaagtcactgtgcaggggcccacctgtcagtctttctttttctttttcttctccttcttctttctcc

SEQ ID NO: 63129 - DNA, 6434 bp, Oryza sativa
ttactatagggcgaattcgagctcggtacccctccccgaaccgaagcccacaacgaagggcgtcgccgccaccaaatcgcgttcttcgtcgacggcggcgaagaggccgcttgacgacgaggacgacgatgatagcgtggacggccctagcgtcgacgtggatggatgtgggctgctgtacgctgactgtgccggcgagcaccgcacgtggtggccgtactcggcgtcgcagcccacacctccgtcgtcctatccctactgctgctcgccgtcgaggtcgctccccgccgttgatggcctcttcgccgcacctccattgccctcttgctcggggaagaagggcaaatgagtcattttttatgtcaactcacatgtttggatggcaaatgtgacgggagtgctataaatcacaagaaaattggtgtcctgtgcttctggtcgaaatagaaaatttgttgtgctattttttggtaccggattttttcctatgctatggatcgaattttctcataaggataaggattgaggcattgagcgacacgttcgtggataggaggatagcgacgccaggtcgatcggctcggcttgcggctcgatttggtacattataggtgctggttcttaaaaaaaccgatacctatagtatttgtaccggttttaactaatgaaccggcacctatacttcgtaaagatgtcggttcattatttttacatcatccggacataggaaaaggcctataggtgtcggttttaaatgaactgccacctatacggccagcacgtacgaaggttttttagtagtgggcaaaactctagatgcctctgagatgtacgtagtacactcttctatcctctatgacggagatgatattcttttcatgcacttcatcggattattacggtgcattatttgttccagtatcaaaaaatacgtttacaaaattattagaccacttattctaagttatttgtagtttacttttaaaaatatttaatttattgacataattaaatatgtagtaattagtagaataatctccttccaatatttgagcagtgtcgcttcattaaaaatcatgtgttttctctgacgaataggttctcacagtcacatcggactgccggagtaagaatgtactaggatctcaaaggtttcgtctcccgtaatactcctactactagtgcatgaaccctatcctcttatcacaattctaaatgatgagactttcttaatgattttgtgcatataacaggagtaggttgatatctgagtcaccttttgcatatcctattcgatttctacagacgcatcatatcttgcaggaatcctaattggcgcgtgcgcgccgcgctggcccacacggcccaataggcggcaagacacggttagttttttttccgaatttttccatatatatatgtaaactttcaactccgacttgaaagctttcaacttcgactgaaaactttcaattcatatttgaaaactttcaactcaaatttaaaaattttcaactcgagattcaaaaacttttaactcagattcgaaaactttcaacttgagatttgaaaactttcaactcgagatttgaaaactttcaagtacatatttgaaaatttttaagttaagatttgaaaaaaatatgaaaactttcgactcagatttaaaaacttttaactcgagatttgaaaaccttcgactccgattcgaaaactttcgactcgagattcgaaaactttcaactcgagatttgaatactttcaaatttatttgaatactttcaaatcatatttaaaaattttcaagttaagatttaaaaactttcaactcaaaacatttttttttaaaataagtgtgctaaaaattaaaaaaagtaatcaaaaaaaataaaaaaaaaccgaaaaaaatcgcaaaagaaaaataaaaaacaaatcgcgaaaaaaaaatgggatgatgggccttgggcccggagcaaccccctatatcttgtgtggttaatgaagaaagtaggagcaattctagtcttttaggtatcttccttaggagcttcaaatttttaatcatgatccatcttatacttagtccatatgcttaaggagtttctttagttttgcaccaatgcttttgtagaaagttttgcaacgcaagcaggatgacttcagtcgttgtcagaaactcagatctatcacaaatcgatgtgagtttcataaatgaatgacgcgcaagtggtgacattcatgattcattattttctttttaaaaaaaaactagtggtgacattcattaattgggattgtttatctctcttgtggagtcgtacgtattcacaaaagatctggattaagatcttattagtactactactgtgtaactgtaaactcatcagcttttccacctaccaaaaacagtagacaatgccgactgattgtttttctaaggagaaactatacaaatcctccaagaaaaagaaaatgttaaacactcactcgatccctagaatatatagagcatggattccttcatttgctttcttacctgcagtagacttatggtgttgataaaggccatctctccccggttacacaaagaacgacagtacgccagggaattttgtttaccaatccagggtgaaaattaagctatgacctctgtaggaaagatcctattcttagcgttttaggggtgacatggcacaaccccctagccaacttctaataaatgatgcaggttaattattgagttccaatgatctaggatgttggatatgtgaaggaaataaagtatacgcaaaaaagaacttttaataactgatctattcccttcgggttgataatacttgtcgttttagacaatggcacggtctaaaaaaacaactttgaccattattttttattataatatgtataaaagtgttaataaatatatgattttattaaaatactttttaagactaatctaagtcgtcatatttgaaacataaatattttaaaaataatttataattaaatattctaaattttgacctcacccttgtctaaaacgataagtattatcagttcggagggagtatgagttacaatataggggtgacccgaccatgtgcttttttttcttttttctttttttttttttgctctttttggtgagcgacaatcattgcggtcgcataagttgtggcggtgagctctcttcaatgatggaaggatgcttggaattttcttggcgttgatctctggggtgaaggccctaatatataggttatttggattcaacaacaccgatatttgtttgttgacttcatgttgaaggtatcatcttataccgatgaaaatttagcactgatattttagatcggctcagatgatatcaatggacaaactatgattacttcttgtatgcgttgttttggagtatagcctacaactctagtcttccgatcccttcattattgtaatatagcaaaatgtcacgagacagtatgatatgttcatgttgcctaagttttttgtttttttaaagaaaaactttcttttgctttttctttgtttggttgtgtgcatcctcgatgcagaggcaggatgttttcgttgaataatgaaatattccattacgtaaaaaataaaatttgatgcatgatagaaaaaaagaaatgtttgatttaaaataaagctaagaataaaacgttatttaaaacaaatcgagtattttaattccaaaatatgagagaaaatcggcgagtggcatagaagatgtcataaacagtggtaatcaacgtaaataaaacattaaaaaaatcgcttggatgtatacttctcatttgaaaatttcttttaattaacatcttgcatagtaaacacggaaaacagaacgatttattagcacgtgattaattaagtatttgctatttttaaaaaaaaatggattattttgatttttttaagcaactttcgtatagaaactttttttaaaaaaaacacaccatttagcagtttgaaaagcgtacgcgcggaaaacgagggagatgggttaggaaaaaggggttgcaaacacacccaaatttgtggtgaaaaggaacgaacagaaagggagatggggaaccgcagtcgagtagcactcgtagaaatacgggaaaaaaggtttgatggataagggcagtcccaaccctctatctaggatggtgtctatgacattaactatattgccatgtaggacttttatcttatgtggcactatattaattaagagagagagtgaagagaggaagaaactgggtctcatgcaagacacagcttcaacacgagaacttatgcactagacactatcaagttttgcattgggagataatagtgtcttgataatagatgaagaataaatatgattggtagagaagagagatgatgtactatctccgtctcaaaataagtgcagccatgagtttccgcgcccaactttgatagtccgtcttatttgaaatttttttataattagcatttctattgttataagatgataaaacatgaatagtactttactcgtgacttatgtttttaatttttttaaaaaaattttcaaataagacgaatggtcaaagttgaacgcggaaaaccatggctgcacttatttagggacggatggagtatttatgtaacattctgaaaatgtgtcattttctaatcttgcatcatgctgattcttatgttcttaataaccttctaaacctaggaaaatataattagagggacctcctaaaactaactcgcataaaacctctctggtatttaatcccttttgtgtttttcatttaaaaacatatttggtatttcttgttgaaattctattttcaaatattaaaccttctttcgactaaaactcttttattcaaatttagtttaaaaaccatttttattattatgaattatggtccaagaaatcctccaatttttgtccttgaacctagaccaaagtaattccaatctcattggaattaattgttagcccatcctttgatcttaaacccatcctttgattctcgatccaaatatccaaattcctccttttgatctagccaccaatttaatttatgtggcttgatttcctcttcggcacaagaattgtattattgcaatattgtgaataattgctcttgtgctaagaaaattccaatttatattcttcactcaacttccccttttagccacaaatatacataacaccaattttagagttcaaatcctatttattgccttcaactaattcccttctatattcccaaaaatattttgaggaatattattaatttccattcctatttgagtgcttccaaataaattccctcaaactccacctctaaatattgcactcaaataaattaggaaatctcttttgtgaattctttccaaattcaaattctttgcaaaacctagttatccaaatcaagtattcaaattaggcttctttctttttgtcatcgggccgaaactccattctttcttcctttttggcccaatcccttttcttttatcttctattttcctcctccttcttgagctgccggcccagctaagccgagccggcccaaaccagcccacaccccaaccgagccgccccctcctcctgtgcacggctcacgccggcgcaactcctcttccttcgccgctaaggaaacgaagccggccgccgtagttcgaatcttcacgccatcgtcgcccgtgcacttctcgatctcctccacaaccgcctttcaccaccgcctctctcccctataaatagccggccatccctccccttctctacatacaatcagagctccatctctctctctttctctcccatgtccggccatggccgccaccacccgatctccctcaccggagcttcgcaagccaaaccatcgcgccatcgagttcgcctcgacgaggtgattccatttttcctgtttcccccttctcccccaccccatagcaaccaccaccgccacctctctttgccgccgaagataagctcttctactcgccgttccggccatctccctcactctctccgccagccaccgcccaccccaggtgcgtcgttctcgggaacatgtgtggccgccgacgtcgccgcctttcgtccaccggagagccggcgcccactctctccctctcctgtgtagccggcaagaaaaagaagaagagaggaagaagatgacgggagaaagaagaaggagaagaaaaagaaaaagaaagactgacaggtgggcccctgcacagtgacttttctcattttctagatttaattcaaatcctattctttagaagcacatatctcctaaaccgtagatccgattctagtgaaacttggacctaaattcatctaaattcaactcttcattttgatatcaaatttgctattttaagattttatttgaatttccttaatttattcaaaagcc
